United States Patent 8,067,671 (METHODS FOR GENETIC CONTROL OF PLANT PEST INFESTATION AND COMPOSITIONS THEREOF) - sequence listing, part 46

SEQ ID NO: 103050 - DNA, 424 bp, Heterodera glycines
  misc_feature (101)..(101): n is a, c, g, or t
  misc_feature (104)..(104): n is a, c, g, or t
  misc_feature (109)..(109): n is a, c, g, or t
  Promoter: Source sequence=SeqID_36640; Location=1..424; Strand=+; Gene=SeqID_65896
tttatgttgataaaattattgttgttaattaatgtaaaccttctaagaaagtgaagagagaaattgacatttatacacacctttattccaactaaaaagtnagnaaaantcagaaaattatcagaaaaatagcgaaaacattctgttggaaattgaatcgaaattgttggacaattcgatttgttggattttggagacggcggaaatgccaaaaatagcgaaaaatgaaaaggaaaaattggagaaaacttttgagaaaattttggagaattataaaaaaatagcatcagaaactaataattctgtgcgaaaaaattgcgaattttggaaattttggcgaaaagcggcaaaaaatttcggtttattatttttatttaatttacacaaaatttaaaataaaaattaaggaaaaaatataaaaatg

SEQ ID NO: 103051 - DNA, 756 bp, Heterodera glycines
  Promoter: Source sequence=SeqID_30079; Location=1..756; Strand=+; Gene=SeqID_60521
tcactgagaaatcgattataaatatcttctaaacatctatggctttcgaatgataccatgattgtgaagtttggccaacaaagataaaagttatagctttttgaacgatgttgagacggagttggccagacggagttgacccctaccgcatccccgcgactctgacccccgcaatcccccgcccccgcgaaaagccacccccgcccacggggtccgaaccctacttttgatggtgacagtataaaacggcgcgcaaaaaaaaagtcggctccaataaatctcacgctaaaaaacccgcgtcaagtagcaacgcaaactgggcggatcccttaacaacagggctgccaagtgtcctttttttaaagatttgtccttttttggaggggccggatctttaaaatttaaaatgtcctttttttaaagattgtcctttattttaggcttccccaaactttttaaattttttgtgcttaatgatttatttcgctgatattttatttatttattttcgttttaatactattttctcttcctctctttccctctcaacttaacttttgttttttgagcattctcatccataacctgttgtcagacgcataactatttcccatttttagcttttttttacattttccaaataccccaccaaaaacgcaaaaatatttattgtgaaaattatgcaaaagaattccggcacataaagaaattcgtgttgatcggttccctgagaaattgcgttgggtctcactgatg

SEQ ID NO: 103052 - DNA, 289 bp, Heterodera glycines
  Promoter: Source sequence=SeqID_18440; Location=242..530; Strand=+; Gene=SeqID_83036
attactaattgccatcatttgtcagtgtgagtaattaacgcttacttttgtttagtcgtctcaaaatttcaaacacgtggaaaatttcgtcggctaacaaactatttgagtaagtccaattaaaataatgcatgtcaatgtttttgaattttcacttcagaatctgttcgtcataccctcaatatttgattgttcccgcttcagtgtccgacgagaaactgaagcaaatgcgacttggcagaatttattaccgttttcaatttgcaaattttttatagctaaaaaaatg

SEQ ID NO: 103053 - DNA, 398 bp, Heterodera glycines
  Promoter: Source sequence=SeqID_12518; Location=1..398; Strand=+; Gene=SeqID_76166
actcaattatcaaataaataaaaaaaactataaataataataatttaaaataaaattgaccaaaatattaattgcaagttattacttcgagcagaatattaaaattctatttttaaacaacattaattcaaaaaataagacaacaaaatttggaccaaattttttgtaaaaaaaaaaaaatgaaaatctaacttgccgacgaacgaccaatttggtcttcaagaaccaatcattaatctagcctttctcgaaatctcgcgttccattttctataccagatattcgggagtccaacgcaaaaaatattggatttctctctcccctaaaaggtgcccggtttcaagcagtctctgcgccgatacttcctcttcttttcaccggtcagcaacatcagcatg

SEQ ID NO: 103054 - DNA, 116 bp, Heterodera glycines
  Promoter: Source sequence=SeqID_10395; Location=3055..3170; Strand=-; Gene=SeqID_73590
ggtcatttcaaattaaatctcttttttatccgtttttccctatttattttatttcctaattttttcttcttttccccctttttttcatttcgtttttttagctttccgatcgaatg

SEQ ID NO: 103055 - DNA, 314 bp, Heterodera glycines
  misc_feature (98)..(98): n is a, c, g, or t
  Promoter: Source sequence=SeqID_6698; Location=1..314; Strand=+; Gene= SeqID_62526
cataagttttgccaatattcctgtccaatttctaccgtaaccccctcgtctctcgttgcagttccttgcccagcatccgtttgtgttcgcgccgttcnccgcccaattttatgtgggcgtccggcgcaatttgccctactttgactacggcgcgttcatccgcaaagtgagtaagaaatttaggaaaattttttggcccctcaaaatattatttttcccgattttttaccattttaaaattaaaatttttccgatttttccctaaccctccccccgtcccccgtttttgcagtcgttccccaactttcaaaatg

SEQ ID NO: 103056 - DNA, 206 bp, Heterodera glycines
  Promoter: Source sequence=SeqID_22656; Location=583..788; Strand=-; Gene=SeqID_45730
agtgagtggaaaatggggggaaataaatgaaaatgaaacatttttcgaaaacgggtttgtgatctggaaatttttgctcgatttggaaaagcgtagtaaaaaattaaaaaattttgttgtccaaccaaaattcttcactcaataaatagaaaattccctccccgttttgtcagaatcgtctcgcgttggatcgctgcgtgtgcatg

SEQ ID NO: 103057 - DNA, 711 bp, Heterodera glycines
  Promoter: Source sequence=SeqID_41; Location=1748..2458; Strand=-; Gene=SeqID_55510
cccccccccttttttttttttttttccctttttttttttttaaaggttttttttttccccttcccccttcccctttttttccccccccttttccccccccccccttgggtttttttttcccttttttttttcccttcctttttttccccgccccctttggaattgagtccatcagaaaaaggggaggaaaataaccgtttttattggcaaaaagaactttcaattaaaataattctggattttaaccaattctgatcgattttaattttacccattttgataacctttttcgatgttaaattttcaaattatttttattattgttattgtcaaatggaaatcaaaaaaccaaataaaaattaaattcagcaggggcccccttagaattgttggccaaatccaccaaaagttggtatcattcgaaagctcttaacaagctctatcggcttcctaaaaatcacaaagatatgccgacatgtaaaaaagttataaattaaaatatgcaaaaattctgactttttggtagtattcatgttgcaacttttttataagttgttcaatcgcttataaatgccttatcaaaagcttctaaacatgtagagctttggaatgatgccaaatttataaaatttgaccaacaaagaaaaaagttataatgttttatgcagggttcccagatctgaggatttacatattttttcaacgagtatg

SEQ ID NO: 103058 - DNA, 202 bp, Heterodera glycines
  Promoter: Source sequence=SeqID_5880; Location=4706..4907; Strand=+; Gene=SeqID_59535
tggccatcatacgttcaatgatgtgtagatcctggcaattttagcggaattaattaatcatttgtaaaattatccattgattaggaatttagatagtacagttgtttgtgattgatgagccctaattttggataatcctacccgatctaaattagacactaatttaaatcttggataaaaaaattgtcaggattgaataatg

SEQ ID NO: 103059 - DNA, 124 bp, Heterodera glycines
  Promoter: Source sequence=SeqID_4961; Location=1..124; Strand=+; Gene= SeqID_56375
cgggggatatgtgaaaaattcaacatatacgcatgccacacttgcatgtggaattcagttcactcccggacaaagccgaccgacggaaggccaaaaagtggtcactctcgggccaccgactatg

SEQ ID NO: 103060 - DNA, 55 bp, Heterodera glycines
  Promoter: Source sequence=SeqID_1473; Location=1226..1280; Strand=-; Gene=SeqID_73749
ggtaaattttgcaaaataaataatgagacactaatgatcgtttactcaaataatg

SEQ ID NO: 103061 - DNA, 525 bp, Heterodera glycines
  Promoter: Source sequence=SeqID_20037; Location=1838..2362; Strand=-; Gene=SeqID_84811
cagcgggcactttttgattcgggtttcagaaaaaaagttatgggccgtcaaacgcaagaaaaagtgagaaatcggtccccgggactcagtcgtccgcgcagaatttttctctatagttttcccgaattctcctcaaaaagttgtaagacccttccactactttcagacccgtcccattagccgttaagctcaaattagtttttgaaacgaaactccttgtcaatataacgtatatataactagcgggtgttgcatgcgagggtggcgctggggaaagcgcttcgcgcttctcgagcttcgctacctagattagctatctggttgtgaagagattttgaatttttaaagaatttcagtgatttttaggccgcttcgcggcctcgaacgggcgcttcgcgcccgttttttaaattcgttgaactcatacgggcgcttcgcgcccgttttttagcttgttaggccgcttcgcggccttggacgggcgcgtagcgcccgttatttaaattttgaggtacaaaagtgatg

SEQ ID NO: 103062 - DNA, 1003 bp, Heterodera glycines
  misc_feature (890)..(890): n is a, c, g, or t
  Promoter: Source sequence=SeqID_34635; Location=35..1037; Strand=+; Gene=SeqID_64377
taccgatgtcattgttccccctcctctccccttttgaaatccgaattattatttgggtacaaagagcacttttttactttccttttccccttctccttttgctcttttgctctgtgaggtgttttcttccctcctccctctctcctccactccttcatttattatttgattttgttcttctattttgtcatcccttgtgaacataatcatttggttttagaggatctcaaaacttttttattccaataagttattttacaataaatattttcgccgccattatcaattttaataattttgaagagggaattagcaaaattgtacattatagtgcaatcgggctcaaaaacttggttgctacccctaattcagaacatttcttaaaaaaggacagatcgcgaccctggtattaatagaaatcgaattcaacagttctttattatgtgaaccataacactaagggaccacaattattattattatctcaatccgaaataacaaacatcattcgcttcctcactttttgtcatcttctttcataatttcggttgttttgtttttgtctccataatcaactgatcacttctttttatcagtttattcttcacacaaaacaatgggagaatgtgtgtgtaagtcttcttcttctcgaaacgcatcaaaaatcaattgatttcatttccttttcgtatttttctttcgctttttcccctcccaaattttctcttaaatatattcaatcactttttgctaatttttattgactctttttgcaattacaaactcataaaaatttaaacgatcataaataaaaagttgaagggacaatttcaatgtttcataatgtttttatcctagcactattaaacaaagggctaaaacaaatcacncactttttatgggtcgtggtcattttattagatatgtatcacctataaattctatgtacttttagaaacatactaatttatttgttttttctttttatttcattaatcctatg

SEQ ID NO: 103063 - DNA, 330 bp, Heterodera glycines
  Promoter: Source sequence=SeqID_494; Location=1465..1794; Strand=+; Gene=SeqID_54338
ttcttacgagccccagagcgcaaagagtggcgcaaaatgtttttgttgggcaatgaatgatcgccgaaggcacgctgagcgaaagaaatttggaaaagttaaaaataaaagaaaatcctccccaatcattacatttttcgaagaacgacgagaaagtcggccaaaacacaaaaaacagacaaagaaggcgaggaaaaggccgagaagcaggccaaaaaacaattgggcgagcaaaaccaatacaaattgaaaggccggcagcgaaaaataattggtgaaagtgttagggtcaacggaagcccccaagcaaatgttagggttgtcaaaatg

SEQ ID NO: 103064 - DNA, 1003 bp, Heterodera glycines
  Promoter: Source sequence=SeqID_8377; Location=243..1245; Strand=+; Gene=SeqID_67850
aggaagtccgatgaggacgacgacagctgaacagagcgaagcggaaacattgccaataagcgacgatcaaacggtgccatccctaatcgaattttaccggtgaggaaaaccgaagccgtagcaatgtaaaggaaaaaaggcagagagacgccgatgttcggttggacgaggaacagaagggagcaaatgataaagatcagagcagacacttggcaaaatgagtgggaattgaggaagggcccaataatttgccaatgacaccgaaaatgtcgatgaacacgccagaatagcggtagcgtggccgtcgcgaccgttgttgctgctgcttcgactcggcggcggcggaggccaacagaacgggaccgatggaaccgccacggttccgttccaactgggcccggtcaataagaaggtggttaaatgaccgggtcaaacgaccatggttatttgacctggtcaaatgaccacgaagttggtggtaaaccgagtcaataagaaaatgaccacgaagtgccgttttgactaccaacctccgtcaaactaccatgaactatcttcttattgacccgggtcatttaactacatgcaattttggggcagattcacataaaaattttgtttttttcttctatttatgtgataatgagggatacgtggtcctattagagggataaaattaatttataattagtttattttaaagaattttaaaaaatgtttaaattggctcaaaaattaccacaattgattatcgagaaaaattattttatggatgtgtttttggttaattctttgttattttcgtaaaaattatttgtctctcgaaattttttttgtcgagttttgactacctttgtaaaaagtggttttaaaaatacttaacattaagataaattttttattttggtatcagaagaaagagcacacttcaatctataagaatcttatttttgtttatttttatctcacaattttccgtgtcaaaaggctcatggtaaatatg

SEQ ID NO: 103065 - DNA, 715 bp, Heterodera glycines
  Promoter: Source sequence=SeqID_972; Location=7720..8434; Strand=+; Gene=SeqID_65204
tcgtcagtttctctgtgaaactttttgcaattttttggtctccgacccaacggcggtcagcgatttgaccggcataaaagtgtgaattgttggaaaggattcccgacctatcgttttattcagtacttttttgatgcactcaacgacagcacccgtcactttctgcaaaacgccgtcctttccgatcaccgcacactttcggacacttttggcaccgaaatgtttgccatcgtcaaagagatcagtcaattagagtcgtcaattttaattacctttccttttttgttttagaaatttttggatttgttatgcatgcaaattgaaaatgatttgcgcctttcgtaccattcgcagcaaaatgtttctttggattcgatggaacgctcactttttgctgaaacatccgatggcaatattgggaacggtggcggcaccgccccacggcaccaccagcaggaggagggccaactttggcatgggcactcggaaagcgcaacttcgccaatggttgcaagcgtttcggcaaagctgctgcacttgccgcccttccatttgggcaacaaactgatcagtgtcaaaggtgggctcagttggccgtcctttcgctgatcgttcgatttggttttcgtcagcgttcgtccgatgccatttggagtccaccttctacaatttgtctgtgctcgctttgcacgattgcgacagttatcgccgcatg

SEQ ID NO: 103066 - DNA, 125 bp, Heterodera glycines
  Promoter: Source sequence=SeqID_17073; Location=1625..1749; Strand=+; Gene=SeqID_81501
attacctctgccttaccgggaataacccgctaccgctcattaatggattgaaaatttatgaatttaaagtgcaaaactcgaagaaacattcaaagctgatttggagagactcatgtttattgatg

SEQ ID NO: 103067 - DNA, 258 bp, Heterodera glycines
  Promoter: Source sequence=SeqID_18930; Location=1096..1353; Strand=-; Gene=SeqID_83653
atcatttttttcataaaaatagggggaaaaaatcatttatctgtttcaaattttctattccattcagcacgcagtccaaatagatgagatttaggggaagataaaaaaacaggcattttagtacgagtaaggcctatatacgaattttagggtgactcaaatatatctggggtggtttgtgccctgagggtttaaaaaatgccgaaatttcgctaaaataaaatttaaaaaaatgtaaattttatttctttaagaatg

SEQ ID NO: 103068 - DNA, 119 bp, Heterodera glycines
  Promoter: Source sequence=SeqID_8985; Location=1332..1450; Strand=-; Gene=SeqID_69916
ttataaatttggaaaaagccaactgacttttcttttccttggggggggggagcgaggagttgttggatcacgagggatctgatagtttaaaaaaacagatttgagtaggtaaaccaatg

SEQ ID NO: 103069 - DNA, 875 bp, Heterodera glycines
  Promoter: Source sequence=SeqID_27250; Location=739..1613; Strand=-; Gene=SeqID_57935
gttaatgctctatttcaaaagttataagaaaaacaaaatttaaagcctcataacttttctctggtacaccaaatcgcttagcatttgcttagaaaaagcttctcattatcaagagctttcgaaagataccaagattatccaatttggttggcaaaaaccttcaaaaataattcccaaatatcgtgattttttattattttggacaaaaataaatgaaaatattcatgttgcacatcggactcgaaccaccaccctttgtccctttactatcttacaaaaaccactgagccacacatgcaaatcttttctggtacagcagctcatttcccggacgctgtgtaaagaatctattaaaaaacataatgctatgcattttctaaatttagaaacagctcatttgtttcgtctgtcaattttttctgtatcacaattaggaactgttgatcgctaggatttcaatacttttacattttgcgacaaccagaaatcgcccaaaaactggttttaactcgaaaataaacaaaatagaaatcccccattcttcatgattgctcagtggaggttcgagtccgctccacgacattaatgtattttttttgtccaaatcaaaaattaaaaaatgaaaattatttttgaaggtttttgccaaccaaattgcatactggattttagaaagatcacgatgaggaaacctttttccaagcaatggttttttgcacagtgtgtgtccagcaataaaaatggaaaaaaacccctaatagaaaaattctcaaaaattcatccctaaaaaaactaaaagtgatggacgactaaattggaatagagttttcctggccttaccaaaataatttaattttacagcattcgaatcaatg

SEQ ID NO: 103070 - DNA, 85 bp, Heterodera glycines
  Promoter: Source sequence=SeqID_31663; Location=1..85; Strand=+; Gene= SeqID_61980
ttttccatgtttcagttggctttgcagcgacgtttggatggacattctcccatcttttgaccatgcccaactcggactcaaaatg

SEQ ID NO: 103071 - DNA, 1003 bp, Heterodera glycines
  Promoter: Source sequence=SeqID_17399; Location=1988..2990; Strand=-; Gene=SeqID_81878
acgactttaaatttgtttttgtggttttttaattgtttttaagagtaagtattttaaagtccttaattttttggatttcaactcgaaaaacccatttcttaaagtcttaccaataaattaaatgaatttgaaaagataattaatagtcaataaattttctaatttaaataaattttcaattattaaaattatgattcttttatgaaattcatggcacaattaattaattttattaacaagggaacattccgagctgtcagtcggaaaatgcatataaatgatataccattggatagaggagggtcgacttctatatcggttttttaatttttcgtttgaaattaaaaaattattttctgatgaaattaaatttattttaatacaaatatatttaataaaattattaattaattattaattaattttgtaaattttttagtgatgcgtttttttgtcttcgtgtctgtcgcgcctaattaccctaattaccctccccccccggcgattgttttgtgaccgacaaataattgtaaaaattttatgatttatataaatttaaattttttaggctttaggctctaaaaagaaaaacctagaaaataggccctaataactcgaaaagtaccttaacaaccaccaaaaaacaacaacaacttgtttttcgtgtatttcagaccatagggagctcagcaaataaaaattgaagccctagtgatgaagtgtgaaaacatccaatgggacgtaattacgaaatggcatttgaaattatgatgaaattcatggcttttaattattttaatattatttattaatattttattattaagaaaatctattgatgatcagtttcacttattgatcgcctttttggcaatgcttctccacattcattaaaatgaaataaaaaattattttccgaagaaattagcttaattttaatacaaatatatatattaaaaatattaaaaacttattaattatttattatatttttttagtgatg

SEQ ID NO: 103072 - DNA, 136 bp, Heterodera glycines
  Promoter: Source sequence=SeqID_1021; Location=1..136; Strand=+; Gene= SeqID_66272
ttcccttttttattttcaaatgaatataattttatttttaaatttgctttctcattgaattgccattttgtgcagtgtttcgcccccggcggcggcgctttgtgcccaaatgttttggttggttggcattcaaatg

SEQ ID NO: 103073 - DNA, 481 bp, Heterodera glycines
  Promoter: Source sequence=SeqID_6306; Location=4004..4484; Strand=+; Gene=SeqID_61088
tgcttgtacctcttctaacagtggttgtacctagagcccggaaatttcaaatttgcggatcctgttgcaggattggaattcaaaattttttgcaggaccggatccggccggattaatcctgcaaatcctgcaatcctgcaaatcctgcatttaaaatttgccggatcctgcgcaggattgcggatttttggaaattttgaaaaaatttcaattaaatttaaaaaatttccaaaacgataaataagtgttccgatatatttttagacaaaaactggtgaaaattaatatgaaaaattgacatcaggaatagaatgaacaagcgcgtcctcatacctaatccatatgtatattataaaaacaaagtttctgtatatttggcattgtgtcttagaaattttttttaaaatcaataaaatcccgcataatcctgcacaaaaattcaaatttgcggatcctgttgcaggattggaattcaaaaatg

SEQ ID NO: 103074 - DNA, 54 bp, Heterodera glycines
  Promoter: Source sequence=SeqID_6348; Location=1704..1757; Strand=-; Gene=SeqID_61229
aaaaaatttgtaaactttttaaactcaaaaaggcgataataaaaaacaaaaatg

SEQ ID NO: 103075 - DNA, 204 bp, Heterodera glycines
  Promoter: Source sequence=SeqID_19188; Location=1572..1775; Strand=-; Gene=SeqID_83936
tttacaaaaattgctaaagatttttaaattttttttctttccttttgtcttataaaaacctcaaaaattgatattctaaacatttttttaccctaactttctttaaccataacaatttattttaagtttgcaactaatatagaaacacttagaggcttggggctgtcgaataaatcaaatttattcgttaaatcctaaaaaatg

SEQ ID NO: 103076 - DNA, 775 bp, Heterodera glycines
  misc_feature (46)..(46): n is a, c, g, or t
  misc_feature (95)..(95): n is a, c, g, or t
  misc_feature (142)..(142): n is a, c, g, or t
  misc_feature (218)..(218): n is a, c, g, or t
  misc_feature (224)..(224): n is a, c, g, or t
  Promoter: Source sequence=SeqID_43477; Location=870..1644; Strand=-; Gene=SeqID_71127
gaaaggagcaaaaatttttaaatagccaaaattttgttcggagatnaagtttaggagtgcttttttctttttgaatttttgttaagcaatttttngaaaatcctgaaaaatatgtacttttaaataatatgtagaagacaanttaataagaaattggattataaagttagtctagaagcctcaaatcatgtggaaaatgtgtattttcttgcttattntcattncgcataaaataactatttacctaaaaatccttcactgcccttgtagttttgttttatttgccaaaatcttttttcagtaatttttggtactgaattggtccagtccctgtgggtttcttttgttggcggcgaatgcattgagttgagaaggagcaattcatacccggagggcgaatttccaacaagtaattaaataaaaaacatttttaatatgattttgaatacttttttcagatgatcaccatttagaaaatgctttgaataatttgcgaaaacggcgaaggcacagtcatttaaagtaataaatagagaccgactaaaaaggaaccaaaaatcgtgaaaaaggcactataataggcaccaaaatattgcaaaaaaagattaaatatttttaaattttattttcgaataaggaaaatttttaaacctaaaatttttaccaagaaaaaaaaaattaaattttgacgatccttttttgagaaaatttttcattcttaggtgcatctttaatagaattttctggaaaaaacgccaaaaaaggcaccaaaatg

SEQ ID NO: 103077 - DNA, 1003 bp, Heterodera glycines
  Promoter: Source sequence=SeqID_12580; Location=3200..4202; Strand=-; Gene=SeqID_76244
ctttcgtccggcctcggtgctccacagaaactggggaaaattcaatcaaagattttttatgagttgcgtttgcaaaatttgcaagaaatgtgagaatggtgaccgaagattacggtattatggtaccccaaaagcatcgtactcatgagattatcgttggtttagtggcaacaatagacacggacggtattagggtaccccaaaagcaccgtatcacctttggcatttaaaagcaatcggatttattcctaatttcaagtaattggtactattaggcgcattcggtaattttcagtttttctcatatgcccgaaaatttaaaaaaatcaacaaagggcgcgcaaaaatcagttcagtacgtgccatgatttggagaatgccacaattcgaaccaaactttttatgatagagaatgggaaaaaatcgtgttttttttgcgcgcttttgttaactttttttttgttgtaattttaaggcgtaagagtaatataagtattggcacccgacttgataaccttttttttattgaaacagaactttgttttgaatgtttttaatgggaaaaaaaaatttattaaaaaattattatgagtaacgaagaacatttattgagatgagaaaaaaatgcaaaaaaaaaatgaattttttgtgtattacataaaaggaaaaaagcataatagtggaacttgaagagatgtcaaacaaaatgcttttatgtcagtcgcttgcccaacaaatgaaaaaatattatgtccaattattagggcttcgactaacacgacaaaacatggaattcgttcgaattttgcagttttaacatgaaatggagagagtaattaaatgtggggggaggggaggggacggggaggaaatattagggctgtgcgaagctttccaaaaaaaaataatggcaatttgaaatgggatcaaaggatggaccagaggacaatgaccatgtcgagaaacaaaacaatgaggatcaatcggtcgtgccaaaaaaatg

SEQ ID NO: 103078 - DNA, 1003 bp, Heterodera glycines
  Promoter: Source sequence=SeqID_5368; Location=246..1248; Strand=+; Gene=SeqID_57799
ggcaaatgatggagaactgatgggacttcaattttccaagtaaaagttcaacttttaagtttttgatgggctcatttatcgagatcacataatttttcattcattttataatagcattctttgatattcattttgataaaaaaaaaattgggtttttgttttgcatttaaaaatatataacattcaaaattaattacgaatgaaaatttaatgtttaattgatttaaatttgcaaaagaagtaataaataattgatattaatttgtatgggtcttagttaataatctttccttaattattttcttgaaaagcgtgctatcagaatattaatattaaaaatttggttctgttcggttttatgcgtcccatgaatgactatcttctgtttcttaggacataacttttttcttacttggtcaatgcctatattcttggtatcaaacaatagtttaagtctacagcagcttttgattataagctttcataaacatacattaaaaatataaatttagtaaatcccattaaattttaaataaaacccgcatcattgattttctttgccagctaattaaatcactcacattaaattggaaattattattccaaagcaaaagattagcaaatctgcgtgttcaatttccaattattaaaaaatgattttgtccaattttgacattaatatgaaaatgaatcattaaaattggcattttagccaaaaattattagtttattaataatcacattttacaaaaggtcttttttgtccaaatgacaacacaatttcattaataaaatgaaccttttttgtctgtgtgggcggcttccacaaaaatttgtgtgacttttgaacttcaatgaatgaattctttataaattgtaagtgaagcatggaccgtatgacacttatattctaagaattttttttatttaataaaaaaaaaatttaactgacttttttgcatcaaaaatcatatttatattagatttaaattttgtcaacatg

SEQ ID NO: 103079 - DNA, 136 bp, Heterodera glycines
  Promoter: Source sequence=SeqID_23047; Location=1151..1286; Strand=+; Gene=SeqID_53752
atagcttatgacattttgaattatgggcaaaaagttaatttaaaaacttttaataaaaaatgaaaaataaaatttaggaaaaaatatttttgacgaaaatattggccattttaatgcgcaagtgatttgtataatg

SEQ ID NO: 103080 - DNA, 543 bp, Heterodera glycines
  Promoter: Source sequence=SeqID_16757; Location=585..1127; Strand=-; Gene=SeqID_81166
aggttacctatcatttcgtcactgatcattttgtcacttagaaataatttttaaaaaatgttggcaaaatgtcacatatattttaaaatttcaattattttgccccaaatggtatgaacatgctcttagataacgaatggggtcttgtgctgctcgctgctcaaattcagcaacaatctaacgcaaattgttgtcctgatcaacatagagggatttcgcctaatacctttccctctaatgcatttcattttttaaaaattattcctcagtgacgaaatgatcggccaccaacaagaatgccattggacaatattttgtcgaaaaaatagctaaaatggccgattttacgaaatggcctagcaccatttttacccgtgcaaatttgtaagggttagaagaaactgttttatttttaaaagtaatcatgtgttaaatgtttacacttttgatcagttcgttcatttcttttcgtttttcgctttctctgcttatctgtttaaacttattattttttatcttttttgtaaagctgtgctgaaaatg

SEQ ID NO: 103081 - DNA, 323 bp, Heterodera glycines
  Promoter: Source sequence=SeqID_5122; Location=1537..1859; Strand=+; Gene=SeqID_56989
cctaaaaattcgaaaattataaaaaaaaaattagattatttatgctttttttgaaaaatagaatttttaattcaaaattttcttaaaatgacacctttcaaaataattaaaaaaatataatataatttcatttaatcaaaatgagtataatttataaaaaataaaacattaataagtagaatttcgaaaaaatgtaaacattattttaaaaaataagtagatttgctgagtaaagctatgcaataaatcagcataaatatgggaataaaaatgaattcgtaaaagtatttctaatcattttaatgggtttattaagaaatatg

SEQ ID NO: 103082 - DNA, 758 bp, Heterodera glycines
  Promoter: Source sequence=SeqID_20890; Location=1..758; Strand=+; Gene=SeqID_51474
aacaacggtggaaaaccagaaattaaactgaacaatttctggttaggctcattatttttctaaccagaacaacggtggaaaaccagaaattaaactgaacagtttctggtttggctcttttcttttgtctaatcagaacaactgtggaaaaccagaaattaaactgaacagtttctggtttggctcatttcttttgtctaatcagaacaactgtggaaacccagaaattaaactgaacatggtttcgtctcatttgttttgtattggtaactttatggttgtttttctggtcatgtttctggttttgtcttttcttttgtctaatcataacaacggtggaaaaccagaaattaaactgaacagtttctggttcggctcatttctttgttaaccagaacaacggtggaaaaccagaaattaaattgaacagtttctggtttggctcatttcttttgtctaatcagaacaactgtggaaaaccagaaattaaactgaacatggtttcgtctcatttgtttagtattggtaactttatggttgtttttctggtcatgtttctggttttgtcttttcttttgtctaatcataacaactgtggaaaaccagaaattaaactgaacagtttctggttaggctcattctttgtctaaccagaacaacggtggaaaccagaaattaaactgaacagtttctggtttggctcatttcttttgtctaatcagaacaactgtggaaacccagaaattaaactgaacatg

SEQ ID NO: 103083 - DNA, 374 bp, Heterodera glycines
  Promoter: Source sequence=SeqID_11493; Location=422..795; Strand=-; Gene=SeqID_74908
agccgcggccgatattatcgcgatgggaaaatggggcgtaaaaaaatttattacaacccgcataaagcattccgtctctccagccacaaatcattttcatttccaagctctttctaatcgcaaaacaatttcccagctactacttctactgcacacagccaaaaaactttcatacataagtatccgcgcagcctaaattgcacgcttcctttcccgtattactcaccactgcgcaaatctatctcattcccactgattagtcgtaagactataagaaaagtttttggttttttttttttttttgagtgctcatttaactcattcatctaattaatctaagccaaatagtagaagtctaatacactgaaattatg

SEQ ID NO: 103084 - DNA, 817 bp, Heterodera glycines
  Promoter: Source sequence=SeqID_9202; Location=2654..3470; Strand=-; Gene=SeqID_70579
ttttttgttgagcatcggcaaaatcatttttccataattcgctaaacaaatcgtttccattttcttttgtgcagaaaattaaattgaaattcagacaaagtaaattagataatattataatataaaacatgcggacaaattgatccaatgatgtgagggcttaaggcaaaattaaattaattaaaaaaaattacataaatatttagccaaaaaataaaaagaatttctgtcataaatttataaaaaatgttgtttaaaattaatatataattatagaaaggatttctttatatattgataaaaaactggtgttaacattaatatataattatttttaggaatgatatttatagttgctaaaaacggccaaaataattaatttttaggttctaaaaaacccaaaatagttgctaaaaatgggaaaatagttattaaaaactttcaaatttaggggtgtaaaatgttaaaatttattcaaaaaattgatcaaccaaaatagttgaaattaaatttgaaaaaataggtaaaaaactaaaaatatcatccctaattattatacatattttatgtacattttgtaaattataaacttttaaagacccgttttccaatttttaggcaatgttttgagggtttttttttgtcacttaaaacatttatttccttaatagatattataatttattagaaatattcttattgctttgcctttaagccaatcaatagcattatggagggtttaagtgagattccatgacaatttgatggtggattgaaataaataatattgtaaatttgaattattctttacagtatg

SEQ ID NO: 103085 - DNA, 314 bp, Heterodera glycines
  Promoter: Source sequence=SeqID_6776; Location=1115..1428; Strand=+; Gene=SeqID_62861
aagtcaattaaatcagcaacacgttttaaattaaattaattattataaataatatttggacattcgcataatgttgaaaaatgaaaaacaaatgccaattggttttatatttaaggagaaatagccgcgtctattataaataaacgcatttttgatgttttgttttcacttttgctctgagttttcttatgattcgtaacgtatcgctcttcttctgaagcggtacgtttttctttttttttttaatttaataacaattaaataatgaatgttctcatttatccattttcaaattaagactcattgtgagaatg

SEQ ID NO: 103086 - DNA, 150 bp, Heterodera glycines
  misc_feature (29)..(29): n is a, c, g, or t
  Promoter: Source sequence=SeqID_40031; Location=497..646; Strand=-; Gene=SeqID_68472
gaacacttgggttcccgtcccgcgcccgngtttatttaccactgacaaatgaatataattaaattttgaggcttattacttggtcacaaagtatcaattaattaatttcaatttaggaaatttgactgggaaattttcagcaaaacaatg

SEQ ID NO: 103087 - DNA, 61 bp, Heterodera glycines
  Promoter: Source sequence=SeqID_28734; Location=1514..1574; Strand=-; Gene=SeqID_59311
ttttgccatttattaattggcccttccgttgcctcaggcgctcggtgccttcgccaaaatg

SEQ ID NO: 103088 - DNA, 580 bp, Heterodera glycines
  Promoter: Source sequence=SeqID_16054; Location=1101..1680; Strand=-; Gene=SeqID_47336
agaagcggagggaagagagaggaagagagagaagggaagagaagagagagaaagagagagagaagggaagagagagaaagagagagagagggaggaagagagatagagagagagaggaagatagagagagaaagagagatagagagaagagagagaggaagagagagggggagagagaaagagagagggggagagagaaagagagagggggagagaggagagcgtcgactgatcggacgtagagcataagaagcatttgccgccaaccttagcagatcaccactccatctccccctcctctactctgtttgctgctgatcgtccgcttttcctctccttcagctaaaaccactcaacccccccccccctcctctctcctctgtcccataaatctctgccgtcttcttcgtctcatcgttctgccccccccccgcctccattctccgctgactgatctgtccgcccccgcacttcttttgcccgtttcttccgccgttacacactcatctcacatagtcccacaaaacatttcaccaacaaaagcagcagaagaattaccaaacggaagagcagagaaatg

SEQ ID NO: 103089 - DNA, 159 bp, Heterodera glycines
  Promoter: Source sequence=SeqID_21778; Location=844..1002; Strand=-; Gene=SeqID_52385
aaaaacaaattggaaatttaattcccgcccaaaccgtgacgcgcgaaaaatttaagccggggggacagagttatgattgtcgtccattcaacgaaagcacaagcctcacaccgaaaattagcttggaaccattttgggccttaccaaatcattgaaatg

SEQ ID NO: 103090 - DNA, 286 bp, Heterodera glycines
  Promoter: Source sequence=SeqID_2562; Location=3070..3355; Strand=-; Gene=SeqID_47337
atggagggggcggaggttaagcgatgccattgtaaactatactccaattaaagtgcattccaatgcgtatttcctacagattctcgtttttgttcactcacgaaaagaaactgcaaagactgcgaaggcattgcgcgacgtttgtttggaacgcgacacaattagcaaatttttgcgagagggaagcgcgtcgacagaagttttgcgcaccgaggcggaacaagcgaagaaccttgacctgaaggacttgctgccctatggatttgccatccatcacgcggggatg

SEQ ID NO: 103091 - DNA, 1003 bp, Heterodera glycines
  Promoter: Source sequence=SeqID_2802; Location=2389..3391; Strand=+; Gene=SeqID_81682
atttgaaaatgtcatatgctgccgataaaaaattatatttaatgaaattaattaatttttcaaattgagttgaaaagcatttgaacagagtgagtttttgaaccattcatccatcgctaaagtacaagaacaattattattatttctggggcaattaaattaaacattttcggatatttttcaataaactgagtaatatgtaattttcgcgatcggcaaaacacgcgaagccaaaattagcataaccccgtgccgaggcgttgcttaattccgcctccaaaaatgtttttgaattattaaaacaaaaatattattattttattttacttattaattattaattttttataaaatttttaactcctgcacaaaattattccaaatgtattctttttgctgaaaaaggtttttacaatttgattgaacggttgggcgagtgaaaatgaaaaacatatgggcgttcaaattagccaattagatcgctttacaatttcgtttaaaaatacaaaataaaatttccaatgccgctggcgattaacaataaattttaaaaaatatgggagttaataaccaatttgggtcgctttacaatttttgtttaaaaataaaaatgatttttagtaaaactagtcgcaaattactaaatgattgtggttgaatgaactgtataaattgcatataaaaagaggcaattgggtcattaaaaacatcaacaattaaatttttattaaataattaataagcatttcgaattttatcaaattaaaattttaccacccctaattttctctattagcataaaaatttcctttaaaatttttgggtaagacataaaaagtcgcttttccgtcacttatagagataaatttttgaagacaaaacaatattttgctatttttgggctaaaataaaaaataatttttttaaatttaattcaaaatagcgatcagttgtcgtttttttccatttaacttgggcatttttatagataaattagaaaatg

SEQ ID NO: 103092 - DNA, 78 bp, Heterodera glycines
  Promoter: Source sequence=SeqID_32802; Location=1316..1393; Strand=-; Gene=SeqID_63043
atgtatgttttttttggataaaatgaagctattcaaacaaattaggtgacagttgcgaccacattacatgacaaaatg

SEQ ID NO: 103093 - DNA, 426 bp, Heterodera glycines
  Promoter: Source sequence=SeqID_28389; Location=174..599; Strand=+; Gene=SeqID_59015
ggtttgtgacttggcttcatccattcattcaacattgcttttttggggaaaaaaaacaaatttttgaaaattgaggggttgaaaaaaatgcaaaaatttagtgtattttttctgataaaccagtgaccagaaaagttcagaaggcagcttattcatatcatatggtttagccatattttatcaagatcttttttcaattttgcatgctagtaaaaaaaagaaatggccaaaaaatgttttaaagttttttttgcaactttacgaagttttttttttgaaaatttcagtcaaataaaagcaaacttttaaggctatcaaatgatatccccacctaaaactgaatttgtcccttcgtttctaaaaaaattcccttaatacggtttttttctcactaattttcccattttttcgtccattttcagaatg

SEQ ID NO: 103094 - DNA, 169 bp, Heterodera glycines
  misc_feature (9)..(9): n is a, c, g, or t
  Promoter: Source sequence=SeqID_31981; Location=842..1010; Strand=-; Gene=SeqID_62294
gttggtacncaagtttgcggtaaaaaaatgagaaaaaagagatagccattttttggtcaagaattttttttgtttgcgtttcaaatatcgtaagattgtttgatagggccagacaaaagaaggcaactgttggtaccaagtttgcggtaaaaaaatgagaaaaaagatg

SEQ ID NO: 103095 - DNA, 257 bp, Heterodera glycines
  Promoter: Source sequence=SeqID_5880; Location=6609..6865; Strand=-; Gene=SeqID_59536
ttttttaaatataacctcgattccccttcattaaaagctttttcttcaaatttctcttcaccttcaatttatccaattttcaaaaaaaaaattatcattttaaaattaaatgattgtttttatatattaaatatttgaaactatattttatccaaatcaaataaatttaatttactggtcactgtttcattaattaatatgctaatataatttaatattttagaatataattttgttaaaatattataccaaaaatg

SEQ ID NO: 103096 - DNA, 716 bp, Heterodera glycines
  Promoter: Source sequence=SeqID_5444; Location=5902..6617; Strand=-; Gene=SeqID_58067
ttatgtctccaagtaaaactaagttatgtgaatttacgctcgtttttgttttttttaaagccatgtaaccaaaacaagaaagtaccaatattttactgttataccaattttaattcgctcacactatacaaaattattctgaaaattttttataccggcgaacttcattgtagtccattgtgcccatagaataaagtttaattgccaactataaggaattaaattagatttgcaatttacaaaaaagcaaccacttttttgattaattttcagttcggccaaaggactgcctcagccattcgtcttgccctggccaaaatcaattcgcgctttcttactacgcgtcaatggcccacttccaaccaacttaaaaagcaacattatatgaagatttgatttcacagtttcaacaagaccatatgcgaaaaggtcgctgattaactgtaattatctcaaaaaatatttttgccctttattgctttaataccttaatttgtgcataaggtattactcatcagcatatgatttaactctaattatctaaaaaatgttttaccttttactattttaaaacctctctaagcatatggttaatataaatatccatttattgcttaaatgccttatttatgcttacagtattaatcattagcttatgacttttaactctaattatctcaaatgctttatcccttttattgcttcaaggcaatatg

SEQ ID NO: 103097 - DNA, 1003 bp, Heterodera glycines
  Promoter: Source sequence=SeqID_7064; Location=4349..5351; Strand=-; Gene=SeqID_63719
agatgatacatagagagagagagaggagagagagtgggggagagagagagagagagagggggggacgggaaaaaacagagggcggtagaagggggatgagagaaaccagcagcaagcgaggagaagcaaagtggccaattaatcattcgtcatgctttggtgcggtgacacgaaaaccgctgaaattgccacaaagaaattctaaaaataaaatgtgatccataaacagcagaaaaaaatattgaaaatgaaaagatgatcaaaaatttgacccgttaatttataaattcggttgccatggaaaaatgttaagaagggcaaagagagacgaaaacaaaacagacgaactgccaaaacgaccccaattatttttatttgtaaaagtcgtgaaaacatgcttccagggcttttcgggttcgctgatcattagggctcgaagttgtatgcactaaaaaatgccaaatatgcgcataaaatatgcactaaaaatcccccaaatatgccctaaaaaccggaaaaatgcccaaatatgcactaaccttaggggtatatttttcgcttttttaatatgcttttatatgcactaaaaaaccttcaccaaaccaaaaaattttaacgtagaaattctattttgagcccctttcttcatagcatatgcgcagaaaaaatatgcaaaatcatacaatacgaaccctactgatcatgaatctggcatccatttcttaaattccgaaccccggatccgatttcgaacaaatggtcgaaaatgaacgaattttgaatttgcgatcggaatggaccagtagctccattattaccaaatgcagtgcttgcgtatggtgttagtttgtaaaattgtatttttatgcttatcgcatgaaacaaacgaattctggtaaattctaagaaaattaatcggttttattaaagttatgtgaaaacaataacttttacaagaataaatgaatgaatttataatttcaaaaataatggcacaaaaatg

SEQ ID NO: 103098 - DNA, 203 bp, Heterodera glycines
  Promoter: Source sequence=SeqID_4357; Location=1251..1453; Strand=+; Gene=SeqID_45787
ggtagtttttttttttggatggaacggcattcgaaaatatcaaccttcagattgacttggacactattgacattagcaatttgaatcgtcagtttctgtttcggaagaagcatgtcggaaaatccaaggcggaagttgctagtgaagcagtcaaacagatagcccctgacgtcgatataacgtttttccatgactcaattatg

SEQ ID NO: 103099 - DNA, 136 bp, Heterodera glycines
  Promoter: Source sequence=SeqID_21075; Location=1..136; Strand=+; Gene=SeqID_51663
ataatcatcttctacggaaaatttttcccaaccccctagaatttttttttcgaatttactcagattttcgtattttttcacccgcaaaaaatttgtgtttaatgaattttttcttacataaagtgaatagaaaatg

SEQ ID NO: 103100 - DNA, 1003 bp, Heterodera glycines
  Promoter: Source sequence=SeqID_25385; Location=358..1360; Strand=-; Gene=SeqID_56124
tcatattcaaaatttatttatttatttacttgactacatttttgatttttaaaatatttatctcatttccatttttagcacctattttgggggtttataatagggttgctccccgaccccgagccccctacatccgactttttatcccccgaccccacgacactaactcggggaattgaggactcttgaaaatttttaaatttgttaaaaattcctaaaatccgaaaaactttcggcggcgcctatcggaaccgccggcctcccaaaactccaaaattttttttaccaataattggcttgaaaatcacaaaatttgacaatttttggacaaattctcttaacaaattatactcattttcaaaaaatttcccggcggcgcctatcggcagcgccggacacccccctcccccacctcagaggtgatctttcgctttttctattgataaaaatggtttattgttttttttgggaaaagatttaaaaaattcaaaaaaaccgaaacggtataccgaaaatttttcttcggtttttttgggtttcggtttttttcgggttttataccgaaaccgaccgaccgaccctcttgtccggtctctagtaaaaaccagagctgccaactgagaattttcaaaatcagcataggccgaacaaaaaaacatcttttgggatcaaaaaccagctttttggaaaatttcgcttcaaaaaaaatgatatgtaattcaaaaattattcaatttttgcatttttattttcaaatccaagaataagcacaaaacaaggaggtcgtaccaaaataaggaaaatcttagaaataaggacatttttaatttctaagatctggcatctccaaataaggacaaatcttagaaataaggacacttgggaactctggataaaattaatcatttcgctaattcaaatttacattgaaacgcagtgttattctacctaaccgttttatttaacagccccactcatttttgaccaccgccccactgagatg

SEQ ID NO: 103101 - DNA, 585 bp, Heterodera glycines
  Promoter: Source sequence=SeqID_663; Location=3611..4195; Strand=-; Gene=SeqID_58495
taatttacttaaatatctgtaaatcagaaaaagataatagagcaaaaacacagaacttaaataatactaaatttaccatctttagacaatttaataaaattatatataacttagaattcactcttctttaatttacctcataatcactaatgtctggcaaaattcgatttggtaatgtgcaacaagacgcaaatgcggacttttttatttggaatcataataatcagggcggtcaaaaatatgcaaatgcatatttttttaaattaatttgccttgttttttgtgcatatttgtataatatttatacgcatatttttatcattttcgtattacctaaatgccgaaaaatcaaggtacgattaactacaacaaaatactacattaaaaataagcatgtaataaatgattcaatgaatgttaataatattaataaaaattaatgcattcaaaaaatagaacataataaatttaaaaataaaaataaatcgaaaaattaaatctagttatatttctattatttttaatttgttaaaaaaatttaaaataaaaatgtcaaaaattttaaggatactgtaaaaaccaatg

SEQ ID NO: 103102 - DNA, 662 bp, Heterodera glycines
  Promoter: Source sequence=SeqID_28074; Location=577..1238; Strand=-; Gene=SeqID_58732
aaatactcaacaaagtttactcaaaattttaggggctttctttaactacggacaactatgaacatgcccaaaaaacaggttgttgcctgcccagttgggcatcgcccaattgtttccgtcgagggaccctttctcccccgagtatgatccccccccccccccttcaactatgttttatatgtgtgtgcaaaaatttcatctaaattattccatcataaagacacaccaaaatctttgttttcttatttctgaaatgagccagacccttggcttcgggggggggggggctgaattcaaaaatcgatttttggggtgtattttttgttttttttaatctcgaattaggatgggtgtgttttactggcttttatagtagtttttcgccaaaaatgagtatttttgccattttggactatgtttcaaaaatatggcaaaatatgatgtggtccggcagtgctaacaatgagacaccgccgggtttgttaagagttgcttaaaatattcaaaaagttacccaatttctcccatcggcggattgtttccaacgaaattttttttttaattccatatatttttcggacatggttgaaaactaatgatatttagagggtttaattaaaaactgattcatttcaaattgtccattgtttagttgggacatg

SEQ ID NO: 103103 - DNA, 315 bp, Heterodera glycines
  Promoter: Source sequence=SeqID_38603; Location=299..613; Strand=-; Gene=SeqID_46571
ttaaaatactttttgtctaaagttcatgaaagagatgtgtatggagcagcgaaagagtaaaaatacaacaataattatttgttcactatggaaaacagagacaggtcgggacgggatctggcgcgggatttcagtctcaagttctcaactccttttttagaagttacaagggtagacagttcgccaaaaaagaaaaatttaaaaattgaaaaattaaaaaaataaatgtgatgatttttaattgaatttttacggagcttaaattttaaatgcctaaccgctttttgtaagcttgattttagcaaataaactatg

SEQ ID NO: 103104 - DNA, 854 bp, Heterodera glycines
  Promoter: Source sequence=SeqID_4924; Location=1..854; Strand=+; Gene= SeqID_56213
aattcccccccccgaaatgaaaatttttaaaaattttccagcaaataatggaaaattttttcgaattcccccccccccaaacgaaaatttaaaaattttatagacaatttttgtaacaaatagcactcaaattttccgtaaaacggccaaaattgggtccttttttagtgacaaagtggagtttttacccagcagtgggaaaaagttttttaagcagccgccgccgacgaccattttttccaagtgtttttttttagtttttttaaaaaactcatgattaagtgatcgtaagtggagagatcgcagcttaaatagacataaatggaaaggggagaagtgtgggatcgatcgctattggctaacagaaaataaataaatgaaaagagattaaaaatgagtgtgaaattgtgcataatgcttcgtcaatttatgttaattagaatatgtcttacacctcatacccccttttagaccgtcccaggtctcagatttgaaaccagttaaaacaaaaaatgaattatgaacttttcgcctatctccattaagaaatcaatttggttgctttcggcattcgaagtaaacaaaaaaaaaaattgttgaaaatattttagaaaaatggcagatatttggtttttgggggtgtattttcaattcttatatttttcttacatatttttttcaaaaatgccaaaataagtaccaaaccctcgaaatatgtgctatgtttttttgtgccaaaaggccaaaatatgtgtttttatgtttttataagtcgctctaaattgaaaattgattcaacatatactccaaaaaccaaataaaatttaacaaatttctaaagttcaaaaaaaatg

SEQ ID NO: 103105 - DNA, 239 bp, Heterodera glycines
  Promoter: Source sequence=SeqID_1412; Location=737..975; Strand=-; Gene=SeqID_73380
acatcattacaaaatcaaaaaacaacgtgggaagagagaagccaaggctgaagaaaccaaagactcaaaaattgatgtcgcaaagagggtccgcagaacgcgccgggagagatgtagaaagacaactcaatcatatcaacaatgtatcgagttccatccaaaccaaactaagcacactaagagaagtaaatcctcaaattttagaagagcctgatataaaagtgtggtttgacaaaatg

SEQ ID NO: 103106 - DNA, 118 bp, Heterodera glycines
  Promoter: Source sequence=SeqID_40902; Location=669..786; Strand=-; Gene=SeqID_69135
cacccccccccccccccccgcggcggactttggcggattcatttcgctgtccatcgccaaattagtagtcactcggaagaaccaaaattttaactgaattcgccaaaattaacggatg

SEQ ID NO: 103107 - DNA, 497 bp, Heterodera glycines
  Promoter: Source sequence=SeqID_3787; Location=255..751; Strand=-; Gene=SeqID_51872
tctctttcgaatctttttcaccccccccgtcccattcatcccccctcccatttcccaaatgttgggtgttttgatttctctcagtgatgagaaagtggttgggcttgtgattgtccaacccctaggtctatctctccatctgtcggaccaaaaatgatgcacaatgaccttaatcatcgggaaactgtaactacagtattacattaaataatgaacattgataatttattaaacgactaaaatgtgttcacttttgagaaacttctctgcacacaatgatcagtcactttctgacaattgtccgatgggatttcggccggagaacaaattaatcaaaaggctaataggaaaaaaatcacatttaaccgagactggctcggtgcaaactcaaaagccaaacgtgggcagaagaaccgtaatcaaatttttgagtttgaccccgaattcccttctttcgcattacagattcaaatttactaattttgccttttcagatg

SEQ ID NO: 103108 - DNA, 588 bp, Heterodera glycines
  Promoter: Source sequence=SeqID_5981; Location=2347..2934; Strand=+; Gene=SeqID_59904
tgtgggacctattttgaaagaaatctattgtatattgaaaattttatatgaaaggaaaattgattgatttaagaaaggagtttccattttcacttgtccttattcggagggaccggaccttaaagttcaaaaatatcattttttgatgaaaaaaggcattttgaatgtttgaagcatatttcatattttaaacccaaaattttattcttgcaatttttctataggaactttgattttatcccattcaaaaactcattatattaaagtaaaatgaagcaataaaactatgtctcattttttcaaaaaatacatcatattaagaattattatattgtagaaatccgaaagatttgtctttatccaagagcaattaattcctttgtgtgtttttttgaaattttcttgcctatgtatttcccattaattggggtgtccctaaaaattaaaaatgagctgaaaagaagagaatcgtgtacgatgctaaaatgtccgaaaataacttaacagaaaattatatcaaaatggcaacttttcatgttaaaatttggataggcttaaaatgtacgcccatagtcgagagatcctatg

SEQ ID NO: 103109 - DNA, 441 bp, Heterodera glycines
  Promoter: Source sequence=SeqID_9350; Location=228..668; Strand=+; Gene=SeqID_71093
tcattctaaaaaattatttgcataaagccaaatacatttcttaagcaattcttaaaatgtatgtagcatagaacctattcaaaatcaagctaataacttagaaattttttaagaggtgcagctaaaagtttcaaatgtaatcaggagaagtctttaaaggttttaaatttttttgcagataattttcaagcaaaaacaatttttttgatgtttttgaagatttttagcgcatatttttagggttttggctatattttgtgtaaaatttttttctttttttgtttagtgcttaatttagaatttttgatatagataattaagtgcttaattcacctttttggtgcttaaaaatcctgtcccaacatatgtagattattaataaaagaatttagaaaaaaacgcaagcaaaatatcattttttaattagaatttagaaaaatg

SEQ ID NO: 103110 - DNA, 611 bp, Heterodera glycines
  Promoter: Source sequence=SeqID_12361; Location=1..611; Strand=+; Gene=SeqID_75964
gggttcccagatctgaggctttagcctcattttgtggtttttggacaggtcaatgaaggctaaattttcaaaaatgaggctttttgtggttttttgagaaaattttgaggctttttgtggttaaacatgtgagcagctcgtttacacccacccgattttttttctgggttaatggcaactcgtacaaaaggcaactcgtacacaataaactcgtacactgttagtacaaaggcaacccgtacaaaaatgagctcaaattttacaaaataaagccaaggctttagcctaaacctaagcccgagcaagcctaagcctaatcctaaggcctagttgccttttgtacaagttggcatgaaattttcaaaacttagagatttttcaaaaaaaattttaaaaagaggggaataataggaagggcggaatatagtgtacctaaaaaagtacaccttagatggttcaaacaaaatttgtctttttagttctgagctgattaaaaatgcatagttttttaattgccaatttaaataaattggtgaaaaattaaattaaacaaaaaaatttttggtcaaataattccatattaatccatccgtcccgcgaaaaaaaaaatg

SEQ ID NO: 103111 - DNA, 297 bp, Heterodera glycines
  Promoter: Source sequence=SeqID_11505; Location=4853..5149; Strand=-; Gene=SeqID_74932
tctaattatagcccagtctctattaatcccgcagtctccaattatcccccagtctacgaggtgttttgaaaaataatccctctatcataatcccccagtctctaattatcccccttttctgaggaagttgaaaaataatcccccatgggctataattagagcatatacggtaaggttattttatggcacagatgcagaactttttttttttgaaatcatccgaatttatatgaacccagaatttgtacaaaaattttggccttcaattttaaggcctatcgcttcgttttggcaatg

SEQ ID NO: 103112 - DNA, 77 bp, Heterodera glycines
  Promoter: Source sequence=SeqID_14815; Location=1342..1418; Strand=+; Gene=SeqID_78966
ttggccattgctttgtcggttcagtgccctcccttctcgaccggctgctccccccacatgatcaggtcccgccgatg

SEQ ID NO: 103113 - DNA, 362 bp, Heterodera glycines
  Promoter: Source sequence=SeqID_14607; Location=1..362; Strand=+; Gene=SeqID_78687
tttagcaagaggacgggcacgccccgcctgagcttatcttctttttctttcgcgacgattccctccctttcactgcctaccgtagggattatctgatgtgcgtggaccaatgcgcggtaaaaggcgcttcgccggacgcgccgccgacactgagtgcgacgcgggagggcaacatgaactgtgcctttagactgaagtacggtgttcataattgaaaactgtgcctttagacttcactgctatatgattttatatgtacaataatatttaatttaacaaccagcctaaactaaatggttttttctcaaaaaaatatttaaattattctaaaatttttttttttgcttacatgtgcgctaatg

SEQ ID NO: 103114 - DNA, 1003 bp, Heterodera glycines
  Promoter: Source sequence=SeqID_7432; Location=735..1737; Strand=+; Gene=SeqID_64800
tgtaaatgatagacaagccaaaattggaaataaaattaaaatccaaaactttttatttttcgaaaaaaaattcatcgtttttaggctaaagaattttgttccaagcatccagcaatttcttaaatttaaatcaattctaagtaaaaattttaaattttgtccccatatatttttcgtgaatttccccgatgagctttttcagaatttttggcacgcaaaattttgaggtttttaaaaataaacttttatgctaaaacatatgacccacctaaaaattggtgtgaatttttcgtaaattccggcattaatcaccttattatctaaattctctgaattttttccaccataaataggctaatttcagacaaatgaatacaattcgtaaaatttttgttaattcattttagatccctaatgttctctattagccctcaaaatttcaaaaatttcgcttgactttcaaaaagttatggccagaggaggtttttcaaattttatttagggttcctccccgaccccgagctccccggtccccgaccccgatccctgacatttttgggcctattccccgtcccgacccccgacatgtcgctccccgaggtccccggcccccgactttttgccccccgactccccgacactaattcagggaatcggggaccccgagcattgttaaaatttaaaaagttaattcaacaacgaagaggggaaaggttgaaaatttatgaaattttgaacaattttcttaataaaattagttaaaaattccaaaaaactttttggcggcgcctatcagcgacgccgcccccccccccccaaaactccaattttttttttgcaaaaaattgtcccaaaattgctaaaataggtatttttaggaaaaatctgttaataaattaaaaattttcaaaaaaattttcctcgcggctcccaacagcatcgcccccatcccccttctgctgtagcccatagtttttttgaaaaagagcgccgcaaaaaaatg

SEQ ID NO: 103115 - DNA, 868 bp, Heterodera glycines
  Promoter: Source sequence=SeqID_23311; Location=2034..2901; Strand=-; Gene=SeqID_54016
aatgaatgaaataaaacatgatggataagtgatgttgattttctttgaaatccatttggatcaatattattagctttattttaaacattttttaaaatcaatattcagcgaaattattattttattactactttttattatcaaaaattttttttatattgcagcataaaaccaaatgtttttaaaaacatatcttaaaaatgaacaattttccataagcgagaaatttagttgttttaatgcaataataaaaggggataaaaatataaaatatttttttgttttcaacattttatttgaaatttttcaacgtgaaaaacacattctctaatgatgggctcaaaaactatttattgaatatacattttaattagttaaagaatttgtccaaaaatgtcaacagttttgtgcttttgagataactttcgtgtaaaacaagctggttgtcggggaaatgcactgcttttcttcgttgtacaaatatttcaatgacggcgaagggtttggaaaatgttagtggaataaagcttaaaaaataaagaaagatcgggagaattttatgtgttttatttggtttttctagcgtaaagatgaaaaaaaaatttacaggaaattctgaaaatttccgattctttagaaaaaatacagaactccattctgaaagggagttttcatatattaaaatattagaaaaatcattcaattttttgaattataagaggtattttattttatatttttatctcttttttgaagaaagttttaaaaataaaactcaaaaatcaccaaatacaaatatatgatgttacactgaaaaaggaatgcattgaacgaacgacgggggaacattttctgctgggaaggaatg

SEQ ID NO: 103116 - DNA, 131 bp, Heterodera glycines
  Promoter: Source sequence=SeqID_5788; Location=690..820; Strand=-; Gene=SeqID_59228
aataaaaagaataattcctaataaaataatatatgtgattcaatattacggaagtaagtaattcatttttattaattaacgtgtattagtattgtttaatagaatcattaaatgctgctgctgctgatatg

SEQ ID NO: 103117 - DNA, 57 bp, Heterodera glycines
  Promoter: Source sequence=SeqID_10767; Location=1747..1803; Strand=+; Gene=SeqID_74019
tgtgagaacaatttaaaaaaaaattctgaaatttttcagagcttttttggaaaaatg

SEQ ID NO: 103118 - DNA, 87 bp, Heterodera glycines
  Promoter: Source sequence=SeqID_41787; Location=1..87; Strand=+; Gene= SeqID_69835
tgcgcttcaactgtcaaatggaattgctgtttcaaaaattgcttctgctggtcataattccagccaaaatatcacagacggacaatg

SEQ ID NO: 103119 - DNA, 131 bp, Heterodera glycines
  Promoter: Source sequence=SeqID_340; Location=2161..2291; Strand=+; Gene=SeqID_83235
tggtcagctgtttaccattccacctgctgatgcaagcactgacctccagcgaatttcgactgaacactccctcgatgtgaacaaaacttcttaaatcctatcatcatgaaaatatttagaataagctgatg

SEQ ID NO: 103120 - DNA, 861 bp, Heterodera glycines
  Promoter: Source sequence=SeqID_459; Location=1945..2805; Strand=-; Gene=SeqID_53206
tctgcaaactgaaaaacggtggtggcagtagcatttatggcactaaaagtgccaaaaaagttcaatgattatttaagcgtacgatggattagaacgaataaatgcacaaattttaaaattgggaaaaaagacacattttattatcgctttattaacgacaccgacaaaaatatttgaattgaaaatagaaaaacagaaggattgccccgtgtagccttcaaaggactgattggatgcgcggaatgataaaaggggagcaaatgcaatcccaacaatcagaatgggaagggatcttccgtccacagcagttaagcggcttggcgcggcatgggccaggaaatttatttttgtggttgatttgattggatgagttagagagagcgggagtgacagagggagcgagagaggatagatgaaggggaaagaaataaggggagacgaagggagggagaaagagagagcagagagagaaagagagagaagggggaaagagtggggaaagagaattggaaagataaagggaaagggagagaggggagagagataaggggagactggggagagagaaagagagagaggaggacgagaattaagaaaatttgagaggaatggtcaagaagaatgagggatggtaaatggccatttcgatgttaaatttcaaaaatttaatgccatctttgggatcaaccttcgagattaaagcagatgcatttttggtcaacttaaaaatcatttattgtctcttaatactagtaataatataaggggagaaagaaacgcaaatgcgaatgaaccgcccaattgggcgccggaggggcggagagaaaagaaacgaccgaacgttcccccgggggaaaaatg

SEQ ID NO: 103121 - DNA, 91 bp, Heterodera glycines
  Promoter: Source sequence=SeqID_9666; Location=1666..1756; Strand=-; Gene=SeqID_72264
caattgtacgcttggtgtagcatgattgagcagtggccttggtatatttaatatatccagattaatcccccaatgtcttttcaggcgcatg

SEQ ID NO: 103122 - DNA, 701 bp, Heterodera glycines
  Promoter: Source sequence=SeqID_16695; Location=1448..2148; Strand=+; Gene=SeqID_81092
ataaatgtaaaccctcgacatttgaggcccaattttgagaaaagtctacggatttaaaccgtatactgtagccaacattagggtatggtcgacaaaagccatgagttacggtacaagtataatctcactaaaataatacaaatgttaattttaaaacaaaaacgatttgatttcatgagttgtttcaccgctaggactcaaaaaattctcacaaaggggctatactgtgataaattatttcaaaaattccgtaagattttgtccaaaatcttaatttttaagggccaaaatgtattctgcgacttgggcgcccagcgttgtccaagtggcagcagttgcgtttcggcactgaacgccttcggcatgatgatctgttgtcgcaatgcgcggcaatctttgccagtaaaaataaataaattcaaaagggtggttttgtaattggattccatgacaatactcttgataaacactcattgattcttcaaaaaaagtcttgacatcaaaaattaaaatggaaataaacaggcaatttcttaattttattttgaaaaatataaaaattaagacattctttttcttccaccaaaattcatgtccttgaaaacaatgatttccacatgtccttgaaagtcccaaattaacaataatccctttagcaattagaacaaattaattttttcttttttttccaaaaaataatg

SEQ ID NO: 103123 - DNA, 84 bp, Heterodera glycines
  Promoter: Source sequence=SeqID_5249; Location=657..740; Strand=+; Gene=SeqID_57452
aaatgttgttgcttttgctctgattatgaaaggcgtttccccttcgaagttgttgacctttccgtgcccggccaatacaaaatg

SEQ ID NO: 103124 - DNA, 72 bp, Heterodera glycines
  Promoter: Source sequence=SeqID_18811; Location=1..72; Strand=+; Gene= SeqID_83492
tgcaccgcaaacattttcaatttgaaaggcacatttataatttcaatcaaattatttaaattcaaaaaaatg

SEQ ID NO: 103125 - DNA, 193 bp, Heterodera glycines
  Promoter: Source sequence=SeqID_1905; Location=1590..1782; Strand=+; Gene=SeqID_47090
atttgttcgcatatttttattgacttgcatataatttgttcgcatatttttattgacctgcgtaaaagcgtaaatttttttccccttaatctgtttcttataaaaattcaattgtttcaaatcttaaatattttattaattgctcaattctcactaatggcacccgaaaaatttccagccataatcaacaatg

SEQ ID NO: 103126 - DNA, 1003 bp, Heterodera glycines
  misc_feature (614)..(614): n is a, c, g, or t
  Promoter: Source sequence=SeqID_44039; Location=351..1353; Strand=+; Gene=SeqID_71591
gagaattaggaaaaacgaaaggtggcgagcgaaaataaaaaaaagggaaacaaaaataaataaataaaaataaaaatttaaacggagtatgagtgaattaaaaaatttgtaatcaaaataaaaataccctattgaaaaaatcacttggttacaaaatttatatggcaaagattcggtaactcgagcaaaattctacggtattttacatataaatcctgccaaataccattcaccctagggcttggatttttaggtgcgaaaaaccccaatttagaggcctaaatagaggcgaaaaaaccacctaatagtggcgaaaatggtaaaatattggcgaaaattttaaaaaaatttgtgctttttttcaatgaaaataaattaagaccagtgtaaataacttattcaacaattttaattacaaaaaattaaatttcatttttttgaataaaaagcaaaaaaaaatttgcttaatgaaagttcgatttttcagcttatttttcatttgaagtctatattcaaagaggaaaaagtttttcaatttttttttgtccaaaatctttaaaaaattatttctattttttgcaatttttgaaaaattttcaagaagtcggtccttnatggtgcattttttaattgcatttttggtaagaaattttttaaaaatgccgaaatagtggtaaaaataagggcgatatgccaaaaatgccaaaataggtaccccctattttaggggcgacaattcaaaaatagggattcctagggacgtatagaggagccttaaaacgaagaattttcgcgctaaaaaggttttttttcgtgcttttctcattgaatttaagccgcagaaaaaataaatactaaaaaactaagaatccgggcactaattttaagtaaatattcctggctttattctagtttacgcgtccaatatcaatgagcatcctcagtttctttggccctaacttttttttccctgggtcagtgccaacattcatggcatcaaatg

SEQ ID NO: 103127 - DNA, 1003 bp, Heterodera glycines
  Promoter: Source sequence=SeqID_357; Location=1788..2790; Strand=-; Gene=SeqID_84141
caacaaaaaggtgtgaccatctaaactgcctattaccgaaaatctttgtggattttaaggctgatagagtttatgtagagttttataatgatgccaatattctaggattttgttgacaatgaaaaaatgtctcattccaaaaaactcgagctggcgcctaactccgaactgaaaagacccattccctgaatacttaaccgaatataaattgtaaaggaaatgaaatgaaagaaatcggatttgtataggcaaaaagtggatggttgtaaaccgcgagacgaaaaaaggtttaattgaacaccacacgactgagactgacaaaagcaaaaataggtttgccaagtcctatccgtgcaatagtcaaagcagttaaaaatgaatatacctaaaataatgagtagtatgaaattagtatgcactaaaaatgccaaatatgcactcaaaatacctcagatatgcctaaaaacccgaaaaatgcccaaatatggacgaaaatatgcttcaaaaactaccaaaaatggctttgaaccctcaaaaaatacagaaaattatgtaaaattcttaattgactttcaaaacataaaaacaatggctaaagagagttttttagagaattacaaaaattttgggttttttgtgaagcgcttttcttgtaaaaattacaaaaaatgcccgaaatacatatctctaaaaaagcaaaaatggtaaatatgcatttattctcgaaaatccctacaatatgcgtttataagcataaaaaacctccaccaaatcaaaaaaatttaacgtagaaattcccttttttattgcataaatagtaaatgtgtgatgatcaaataaccggaaaagtgcttcttttatataatggaggatagagaagaagaaaatcatactcctttttttgctaaattttttgtttcttttttggtcgtcatcattataaaaggaatgcattttctcagtttcgaccattccattcctcattcaacaacaacagataatg

SEQ ID NO: 103128 - DNA, 505 bp, Heterodera glycines
  Promoter: Source sequence=SeqID_4357; Location=598..1102; Strand=-; Gene=SeqID_54163
taaagcttaaaaactagattaggtacatacatattttttgaattataagaaattaggtaggtaattcgatcgatagccggtggaaaataaataaatagcctttaacttttaaattttcgtaaatagaaatgtaaaaaaatatataattttaatttatttcttcaaccatttacatatatatttaacttttaagccagattcaatttgtgaatttgatgtattctactgtaattgaccctttttcaaagtctgaccccgaaattgggatcagaaatcaatttaaactttacaaaaacaaaagctacgattggcgatccaatgttattgaccctcacaacaacagtcgtttttgttttctgcagccattgactacgtacacaccttggatattcgagaccactgatcaaaattttcattaccaacggagcaaaatttatgagcaacgagaaaaattggatgggctaagttatgcaagacaattgattcggtttagtgctatggcatg

SEQ ID NO: 103129 - DNA, 808 bp, Heterodera glycines
  misc_feature (623)..(623): n is a, c, g, or t
  Promoter: Source sequence=SeqID_15410; Location=1..808; Strand=+; Gene=SeqID_79675
tcaatcaaattctttggggcgagaaaattttccttaaaggcggagatgcaaaaagaaaagcgtcacacaaaccgtagattttatacacgggaactgacatcagagaaatgaagggaaggccgaagcgacttcatttgaattccatttcgcttaaggcggggggggtcggggccattcttgcccctcggggcgcttgcccccaaatattcaaatttttcaatcgatcatctggatctgtcaccgcggcacgccagcacggcatggcagtgggaggagtcagcagcggcaccatccccaagttctcttctcatcatttgccactttcgcccactttttcaatttgtcagcagcggagacgcatcccaaattcgcttttcactagttgccattttcatccactttcatcatgccctttattgcccccggcactttcgcttttctttcaaaagagtatggggaattttcgactgggcattttgacccaaacagagcatacgacccaaattcacttgcagaactttcgtaatacatttattttgcttccattatctttgatttttttctttgtagtcaatggagaaaagagtttctggacggccgataccgatccaaaacaaccaacnccctccttcccccctgcgtgccccatcgcccagctttccaatcccggtcatcgttggtaatttaaatttcagttttttttggattttgcaaatattccgtttacaggaaatcgtccacaggatgaaaattgtttggttttccacaaatatcttgtctgattttttccattttagggcggcagatg

SEQ ID NO: 103130 - DNA, 58 bp, Heterodera glycines
  Promoter: Source sequence=SeqID_3373; Location=6865..6922; Strand=-; Gene=SeqID_47601
tccaaagttatgcttacctgaattttttagatttttaatgctgatgaaaaaaaatatg

SEQ ID NO: 103131 - DNA, 102 bp, Heterodera glycines
  Promoter: Source sequence=SeqID_29671; Location=1112..1213; Strand=-; Gene=SeqID_60138
ttgaaacactttccccattttacatttacatacagtaataataataattaaaaagaaattaaaaattagtgttcatttcatcaatctttcaattaaaaaatg

SEQ ID NO: 103132 - DNA, 72 bp, Heterodera glycines
  Promoter: Source sequence=SeqID_24798; Location=1253..1324; Strand=-; Gene=SeqID_55545
ggtacataaataggctcttgtgcagtttaggcccatatactaaaaattttttacatttcagaataaaatatg

SEQ ID NO: 103133 - DNA, 345 bp, Heterodera glycines
  Promoter: Source sequence=SeqID_41067; Location=1..345; Strand=+; Gene=SeqID_69273
cttaaatttattaatcaaacaaaaataaattcacacaaaccttaaatgtaattcatgtttttttcatatgtttacatatgtaaatgtaattttataattatcggaaataacaatcaatccatttaattcaaataaatgacttaaaaattgctgctttcttagaatataaatctgaattaaatcgtcaatttattatttattttgacaaaataattgtaattattaattatataaaaagtttaatgcatcgcaattttgtgtttcttttgctgtcattttgcgtaaaaacagccaaatttgactcaataaaaggcgcaaattgtgataaccaacaacaacagaatg

SEQ ID NO: 103134 - DNA, 86 bp, Heterodera glycines
  Promoter: Source sequence=SeqID_8004; Location=2296..2381; Strand=-; Gene=SeqID_66661
aaggcaattccaattctaatccattttcctttctttcatttaggtccgtgtgagttccggttgtgccgatttgccctgtcaaaatg

SEQ ID NO: 103135 - DNA, 265 bp, Heterodera glycines
  Promoter: Source sequence=SeqID_22548; Location=1..265; Strand=+; Gene=SeqID_53216
taaggaaacggttggtaaggaaacggttggtaaggaaacggtggtaaggaaacaacaccaacccatcattcgtttcatttatttgttttcgtctctctctttttcgaccttttctccctgacaatacctttccttctcattttttctctgtgacattttacaattccaaatcaaaattctttcaatgcttttttaaatttgtataattttctttttcagttcgcctatttttttttgttgtttgattaccaatctcaaaaaaatg

SEQ ID NO: 103136 - DNA, 324 bp, Heterodera glycines
  Promoter: Source sequence=SeqID_29356; Location=168..491; Strand=-; Gene=SeqID_59864
atgtcgtcatgtttgtgattgtgttggtagaactactctcgatattcgcgtgttttatagtcttcgacacatccaaaagtgaacaaaatccgataattttaaacaagttttaatggagaaaatccaattttgaaaatcccggttggcgctcagttggcaaagctgggggatttttggcatgttttgttgcccgtaaattgtaaggccaggagcggaaattttttgagatgttttttttagatttttcattgtgagctttttgaattactagtagtttgaaaatcccgactccatatcgaaactctgatccttatttctaaaatg

SEQ ID NO: 103137 - DNA, 578 bp, Heterodera glycines
  misc_feature (51)..(52): n is a, c, g, or t
  misc_feature (100)..(100): n is a, c, g, or t
  misc_feature (105)..(105): n is a, c, g, or t
  misc_feature (114)..(114): n is a, c, g, or t
  misc_feature (130)..(130): n is a, c, g, or t
  misc_feature (167)..(167): n is a, c, g, or t
  Promoter: Source sequence=SeqID_32397; Location=1..578; Strand=+; Gene=SeqID_62708
tttatatgatattaatataattatatctaaatgtgttatgggattatgcgnntaataatgattttttaaataaaaggattaaataaataattatacagtntaatntaacatatnttataaaaatgtattntaaccatttatttttttatttattggtttgctatatntcataaaaatttggcccaaagaggaaaaattgtcagtataatattatttgttgtttttataaatccatattcattaattattttgttagtagtttttttttcctattttttaacatgcaaaaataattataaaggtatttttccgaaattgtttattttcttctttgtcttttaattgctccattcaaattttttattaaaattactaatgattattatgttgctttagtttatgctaattaaaaataaaatcggtttattaaaaattaaaaattaaattttttaaagtttggtttttttttgtttatgaattctttggcattcgttatttttcatcttttaaatctcatgattccgagcctcatgaagatttacaaaataattaattttttgaatttttatggcataatg

SEQ ID NO: 103138 - DNA, 230 bp, Heterodera glycines
  Promoter: Source sequence=SeqID_35054; Location=62..291; Strand=+; Gene=SeqID_64706
tgtaatattcttaatttgaaatttccatggctaatcattttgcttttccgttttcagcttcatttctgccgattgttggttgggagtgttcgatttgcttccgctttctcagcttggactgggaattgcattgatcagtcaccgatttgactatttcgttgacgaacatttcaaaactcgcaaatggaaattgagaccaattgtaattcgacacaaaattggagaaaatg

SEQ ID NO: 103139 - DNA, 148 bp, Heterodera glycines
  Promoter: Source sequence=SeqID_30638; Location=1244..1391; Strand=-; Gene=SeqID_61046
gaattggacaaaattcccggccttttaatgttaattcccgtttaataaactgcttgatttgctcccaggtttcccaagcaaattttgactacgaatctgcgtcagggaatgcattttgcgatgttttccaactgtcagaccaaaaatg

SEQ ID NO: 103140 - DNA, 464 bp, Heterodera glycines
  Promoter: Source sequence=SeqID_15208; Location=2433..2896; Strand=+; Gene=SeqID_47278
aaaatggggacaaattgagatatcgactctctctaaataaaatgtgtactgaccttgattcagaagcattgtggccttttatttttagtgttaaggtattattgataagcccaatgccacccgattgtgagccattcattgctgctgtttttgaaaccaaatatgcttatcttaataaccctgtgatataatatgattggaaacaacttaagcacagaaccaaatttttaattctgcatccaatgcatttcaatttgtaagactactttcaaagcatcctaaaccctccctagatcgattctgtcattaattagtcaattttttatattacattacaaatttgtattgaatgaattcgatgaggatcacaagcctttaaaaacattcttgtctttttgtttcacctttaaattgaaattgcctttattatacagcaattcgagtgctacaaatagttcgaaatg

SEQ ID NO: 103141 - DNA, 624 bp, Heterodera glycines
  Promoter: Source sequence=SeqID_3524; Location=520..1143; Strand=-; Gene=SeqID_85029
acaattttaacggtgggcggcgacatatgaatttaaataaaaataaattgataatctgaaattagtacaaataaacaataataaaggaataaaaagagaataagcggagaaataaagaaactctgcatacaaataattagacacaaatttaaaagcaaaactgccgaattaaaattaaacaaatttcaaaattcctccaacaaacacacccgattatttacagaaaagatttaaagaaaaaggtgaaagcgatagagagagagaaaagagaaaccaagaaagagagagaaaaaggaaaggagaacaaatacaaaaagaaaacaggaaaatggatttggagacaaaatttgaaacaatacaaaaaagagttaaagaacttgaagataaattattgtttaataaagccattgctttgccttctggcataaagatgccaaagtttgacggtaacagcgattttttaaattcttgaaagaatttaatttattggcaacagcatcaaactggcatggccctgactgtgtcagattgttgcctttgtttctagaaggagaagcgaaagaagtgtaccaaaatattcccgctgataaaaagaaaaattggcgggatctgacagaaagaatg

SEQ ID NO: 103142 - DNA, 692 bp, Heterodera glycines
  Promoter: Source sequence=SeqID_42034; Location=1..692; Strand=+; Gene=SeqID_70040
tcagttactgtttactcagacttctcggtaaaagcgacttttattttacaaaacttttcaaaagaacaaaaattatgaattcaaagcattatttttattttaattttatcatagacgatttctattatctgaaaaatattcttttagatactgcattacagattgggattttatttggggtatgtcaaattgcccatttgattcaattatgcttattctttgtcacattctaaaaaaggtttaatatccttttttattcgctgttttaaatcaattctatttgagcccaccatgagaataagaatgaatcagttactgtttactcagagttctcggtaaaagcgacttttattttaataaaactttttcaaaagaacaaaaattatgaattcaaagcattatttttattttattttatcatagacgatttctattatctgaaaaatattcttttagatactgcattacagattgggattttatttggggtatgtcaaattgcccatttgattcaattatgcttattctttgtcacattctaaaaaaggtttaatatcattttttattcgctgttttagagtatatataatttgttgctatatcctggtcttttaatatttttgctgaactagcgaaccagcctacacaaaaagacgtctttgtcgcaatcaattctatttgagcccaccatg

SEQ ID NO: 103143 - DNA, 600 bp, Heterodera glycines
  Promoter: Source sequence=SeqID_7028; Location=1201..1800; Strand=-; Gene=SeqID_63613
cgttggagaaagaaggaatatattgtggtgagggaattggaaatcagagttggggattggatttgaggggataattccaattcagcaccactttagttttagtcaaatattagctgctcgtttttgtaacggcagctttaaagtcaagggtaatcaaagttggggaatttatcaggaaattaaaggagaatttcataaaacataaataacgaattcaatatttcaatataaaatgaaaacataaaaacattgatatataattcgaatacaattttcgaatgagaagacaaatatgaaaaagataaaaggacaacaaataaaatatttaaatgcaaatataacgcgaaaacaatcgctatgaaaataataaataaataaataaataaaggataaatcattatttatcctacgtaagattgcgataaattttaggtgcggggaaccggccttttaggtaaaaaccaaaacctttaaaaataattttcaaaaattgtcatttttcatttttggacaaaacaaataaaacacaaaatcacttaatgcggcaggaaattttaggaattttatttgttccataaacaacgcccgccagcgtccatg

SEQ ID NO: 103144 - DNA, 153 bp, Heterodera glycines
  Promoter: Source sequence=SeqID_9859; Location=4298..4450; Strand=-; Gene=SeqID_72887
ggtaaaataataaaaaaaatatttaaattaaaaatattatttttcccgggcattattaacgacaagatctgcggatcctgaaatcccgccagttaaaaaacaaaataaaaattgctaaatttttaaaaatttctatttttggcacgacaaatg

SEQ ID NO: 103145 - DNA, 1003 bp, Heterodera glycines
  Promoter: Source sequence=SeqID_589; Location=1818..2820; Strand=+; Gene=SeqID_56957
tttagtttttttaatttttaaatcaattatagtgaatttttattaaatgccccaaaaatcaaaaatttcgcatttttttcttacattttaaattttttacatatttgagaatttatcaaaatttctcgtgaaaaaataaattttttttgaaaagtatccctaaaaatacgtttttttcaaaaaagagataccaaaaattattttaaaatactaaaatgtgattatagcctatttggtatttttatgattttgcaccctttatgaagaatttttttccaaaaaataactatattaaaacatgaaaatccttttaaatgcatattaaaagagatgaaatgataaaaatttatttaaaataatattttttgataatttaaatttccacgcctttttaatttttttttaaagccaattattactaatattcctttttagaagggtaatgaagcacgcaatttgttgcctcagctgtacagtcgaattgctgagttggaacgggaaaacaatttgttgaaggatttgttgtggagagaacgcaaccccaacagtttcgcggtggcacaacagcagaaaatggtggaaaagaaattacgaaaatgaaaatgaaataatcgaattctcaaaatgcaattgtaatttttaacaattttttttactcattttttatttaattattcgtattttctcgattatttgaattcttccaaaaataggaatggaatcgtgcaaatggacaaacaatggacatggaaaatgcattcccacaacgcgcgatgagcgaagcttcggtcaattaatgctaattgataaaataattaattggcaaaaaaaacatttacacataataaaaccggaaattcttttctatttttagattccttcaatgtttaattgccaaacagttcggtcaaataatttaattttcaatggatggcctttactgaatcggaataaaaaatcaaacagaaaactgaactgaatttaaaaacgattaaaggcaatg

SEQ ID NO: 103146 - DNA, 194 bp, Heterodera glycines
  Promoter: Source sequence=SeqID_4151; Location=481..674; Strand=+; Gene=SeqID_53379
tcccattgaagaccgtctcctccgatggggtactcactatatttgcattgtttctctccccccatttccatcaatagaaggatcaaattgtcgcagtaaattccttggccgctcatttggattcgctttcgttggggttaaaacaaagtaaaaatgaaacggataaaaagggagaagagagccgaaagaaaatg

SEQ ID NO: 103147 - DNA, 134 bp, Heterodera glycines
  Promoter: Source sequence=SeqID_5201; Location=2195..2328; Strand=-; Gene=SeqID_57257
ctcaatctgtccgctgctggatggttcggtgcccttttctgatagtcctcaactgataaattaaggcgtaccaacagtgtgccgctgcctcgtgggcatttcatgcacaacagcagtattcttcggcaattatg

SEQ ID NO: 103148 - DNA, 1003 bp, Heterodera glycines
  misc_feature (333)..(333): n is a, c, g, or t
  Promoter: Source sequence=SeqID_17173; Location=2033..3035; Strand=+; Gene=SeqID_81614
agtgtcctttggcgagtggaaattgcgaatttgaactgcacgcagcggtcgctttgacttgcgtgttcccaaatccgtctttcctttaatgggtgttcacagaagcctacttatcagcttgtgaagccaataaagtcttttccttactgttgacgaaagcggtctacttatcgacttatcggtcagtaagaatgtgttacgggcaaaggtggacacaaatgaattgaataaaattgaatttggaattaaactgccaagtgaattgtattttaaaaataaaagcctatgctgactgcgccaatttgttgtgtcgtttatcaacaacaacaaatnataatcaataacaaataataagtcagaggagaagagagagataaatatgtgtggggtgaaagaaaatgagaaatgagaatgaatgaagtccgaagcgaggaaggagagaagacatcagtatttatgggcgatgatggtggtgacgtgccaataaacataatgccaagaaaatatgaaatggcaataatacaataaaaccttcactaaaacaaaaaaatttcaaataacaatgctatatttttgagcccctttcttcaatatgcgcagaaaaatgtgcaaaactctttcctctgcggagtaatatttcattaatttaccaaagataaagttttttgtaattccataaaattatttttcaacgttttactaaacagaaacggaaatttaaaaaatctaatttttttaaatccattatttcatttttctcgatgaaataattttttataattttataatatatgaatttataaaaattattttacaaaaatgtaaatgaaatatttgttaatcaattgcataacaattaaaaacaacgataaattgcaattaatttgataatttatactttatgaaaaatatttttccaaaattctataatattaatataatatatatttaatattataagctgaaaattcaaatttattattttgttattactaaaaaaatg

SEQ ID NO: 103149 - DNA, 225 bp, Heterodera glycines
  Promoter: Source sequence=SeqID_7848; Location=1899..2123; Strand=-; Gene=SeqID_66155
ataaaagtaaataaattattattttaatttaaaacatttttcacaaaaaataatttaatttaaattaaaaaatttattttttattaaaaaaacaaacactcttttaaatgaattaaaacattaaaaataacccatttcgaattcgggtttcgggttgagaaaaacttcgggtttcgggtctcggggtccggttggcatcactgcttcacacgttcgcgtccaatg

SEQ ID NO: 103150 - DNA, 449 bp, Heterodera glycines
  Promoter: Source sequence=SeqID_15467; Location=2379..2827; Strand=-; Gene=SeqID_79740
tcaaaaatatgtacaaaaagtggccaaaatatgtacataaatatgtaaaaaaaatcccgaaatatgtgtaggcataaaattgcataaaaatgacctaagtaggcctagaatcaaattttttaatattttaaaaattaatttttgatatctcttttttaccgtttttaggggtacaattaaaaaaatgaaaatttgccgaaattttgaattacttttgaggatttccaaaaatttatataaaaatcttcaaaatatccaatatgtaccaaatatgtataaaatcacgaaatatgtaaattatgtataaaaactccgaatatgtaaataaaagtcccgattcttgttcacaaaacacaaaaaaaagaagaaattgattttcctactatttagagcatagagaatccaggaaaaaaatatgtattttcataaaattagagaattcggtcatg

SEQ ID NO: 103151 - DNA, 661 bp, Heterodera glycines
  Promoter: Source sequence=SeqID_42206; Location=1..661; Strand=+; Gene=SeqID_70155
tgctttcaaattaaatctgatcagatctgaatgaattccttttttgaatttattttttcaaaattaaatctgatcagatccttttgaattgctaatttcaatttattttttcaaaattaaatctgatcagatatgaattaattgctactttctatttatgctttcacaattaaatctggatctgatctgtatatgttttgataattaattaaagctaatcttaattaattgctaatttaaatttatgccaaattaaatctgatctgaattaattgctcatttcaattatgctttcaaaattaaatctgatcagatctgaatgaaatgctaatttcaatttattttttcaaaattaaatctgatcagatatgaattaattgctaatttcaatttatgctttcacaattaaatctggatctgatctgtatatgttttgataattaattaaagctaatcttaattaattgctaatctcaatttatgctaaataaatctgatctgaatgaattgctaatttaaatttatgccaaattaaatcttatctgaattaattgcttatttaaatattcaaatctgatctgatctgaatttgctaatttcaaattttttcgtaataaatttcaattttgctttcaaaaaataaaattttactgcccaaatg

SEQ ID NO: 103152 - DNA, 749 bp, Heterodera glycines
  Promoter: Source sequence=SeqID_4658; Location=2183..2931; Strand=-; Gene=SeqID_55258
tttttagacttttttgttggaattcgagcgtgaagttaacgcaaagcacaaattacgaaaaaatttttatacgcaaatgtcccgttttttcttgcgatgtgagatcggaggtcagaggtggcaaattccttttgttgaaggcgaaaaccgatcatttcggaagactgaaaagataaagaaattattgagtggaaacttttggcaaagaaggcgtggtaagacgcgcagtagagaccggaagtttaaaactaccgagcccgggcaacacttacaattgaccgggccgcccgttcaaaaaacccgttttgccggtcggcccggcctcgtgggtttgtccaaaaaagggaaccgggcgggctggcaaaagcccgccaggccccgggcccgtcctgtccctattaagtagtacacatgaggagtcaatggcaaggcaattaaactttaaaaatggagtgtctcattgtatcgcttgactgacatttgcacctaatcggtccgaaaagggcaagagtcttagagttttttaggtattcaatttatcagtgaattggcggttaaaacgcgtaaactcttgagggcgttggggcagggacccaaagaaaaaccttaacagagtgaaattttcttgaatttgaacgatagacacaaatgtgaatagaaattgcacttaatgactgatcttcaatttccgtgcaccgactacgcaaccccttgaaaacaataaacctgcaattgcaggcactaaaatg

SEQ ID NO: 103153 - DNA, 94 bp, Heterodera glycines
  Promoter: Source sequence=SeqID_2859; Location=2270..2363; Strand=+; Gene=SeqID_81991
aaacggtgtcaaacctatctactgcaaggcaagaccagtgccacacggggctttggacgacgtaaatgccgaaattgaccgtcttttgaaaatg

SEQ ID NO: 103154 - DNA, 1003 bp, Heterodera glycines
  Promoter: Source sequence=SeqID_13347; Location=692..1694; Strand=-; Gene=SeqID_77214
ctgtttattcattttatatccaattttattataattatttatttgtttagtcaattttaaaatttattaactatttaaacactattattgcatattcaatcatttattttttattcatttgttcaaatagaaatttttacataactattctatttgaaaatttcatataatttttgctttaatgaataataaatttttataacttatagatagattatttgatgctgtctatttaatgttttatgttgaaaaaagccaaaaatgaaaacaaaaaaaaaggaaaaaaaattttttaattgaccgctgatcggtcgcaattgacagtttggatcatttattatttcaactaaaaattcatttttgatcaaaaaaaaattcacaggtttctcttagttcagccagaaaattgttttgtatgccatcaatattataattgaagaaagtgctcgattaattctcagcaaaagcaaaagtaattaattgtgccgtttttgccacaaaattaatttgaattttagcgcttttcctaattacgctgcaaagtccatctaattttctatgaacaaattgaatcgaaattgatcaaaattattcaaaaaaatttttactaatttactaaaaacaaaaattcctattttgacaaaagatttatattttaaaattttttttattaaaattttattcatatatactttaataattataaaatattttttttatcggtataattttctaatagcaaacaaaaattgtaaaacattttgcctttcttccaccttcttaacaaaatcaattataataatttgtaaaattaatccagaaatttaaataaccaaaattttaataaaatttcataaaatattactccaaatatttttaagagaatggaattttatgttataatttttatattattattcataaataattcaattgaaaagaatgggaaactttgaccaacttttgaagaattatttggcaaagaatgggaaaatgaaaaatg

SEQ ID NO: 103155 - DNA, 294 bp, Heterodera glycines
  misc_feature (4)..(4): n is a, c, g, or t
  Promoter: Source sequence=SeqID_31608; Location=1377..1670; Strand=-; Gene=SeqID_61929
tttntgcggtgcaagaaatcggaaatttttcaaaaaatatctcctataataaaaaaatttctaaatattttaataggctaacttttttaattcttaaccaagtaaaaggtatttcacaaatgtttttagtatattctcttgaaaaaattattcaattattttatcaaaatctttttttgtcatttttcattattttagaacatttttgggaaaaggagtgactatttacacgttttttacagcgcgcttttttcaaaactttttgtgaacttggaggagggtaccgggaaaatg

SEQ ID NO: 103156 - DNA, 117 bp, Heterodera glycines
  Promoter: Source sequence=SeqID_5603; Location=2758..2874; Strand=-; Gene=SeqID_58611
agccacaagacggtggcggcgccgctcaacaaagcccaagacgacgagtgacaaagattggaatttttctggatggaaacggtactcatttttttttgttttgtttgttggcaaatg

SEQ ID NO: 103157 - DNA, 943 bp, Heterodera glycines
  Promoter: Source sequence=SeqID_43173; Location=514..1456; Strand=-; Gene=SeqID_70908
attttctgtggggggttgggctaattcgttgtgtttggctctgattggctgctgcttttccagaggcaaagctccgccccttgccaatgttagccgaacaaccgcagaattcattcattcattcaatcatttgttttcaaatgaaataaattttctaaataaatattcttaataaataaaataaattaggataagaattaagttagttctctgatagagccaagttcctaaggacactaaatgggattagtcggtcattagagggaagttacaatctaattagcacgactccgggtcggtcaagtccgctaattgagctccattagtactggcctgaacacaaagacattaattaggaagaataaaattgtcagcttaaggcaattagccctgtggcttaatgatccttaattggggaacaagtacaattagcttaacacctgtgggtaataaaaacgattagttgaatagcgtgtgaaaattagtgtgttgtacgtacgatctcaatgtcaaacctcgagccaattagcttacactgatggcaatgactaattaaaacattacattagccctgtggcttaatgactcttacactggggaaccgatctcaatgccaaacctcgggccaattagcttacactgatggcaatgactaattaagacattacattagccccgtggcttaatgactcttacactggggaaccgatctcaataccaaacctcgggccaattagcttacactgatggcaatgactaattaagacattacttagccccgtggcttaatgactcttacactggggaacgagtggaattagcttaacacccatgggtaattaaaaacgattagcttaattaattagtgtgtgctttggacgatatcattgccaagctttttacacttatggctaattaagagattttgttgcctttcagaatg

SEQ ID NO: 103158 - DNA, 127 bp, Heterodera glycines
  Promoter: Source sequence=SeqID_12170; Location=716..842; Strand=-; Gene=SeqID_75745
ttttttagccaaattttgttgtggtgaaaaaactttttttttttttaaagagttacccccccccccattatctaacacatatttgagagactgtctctatatacaaaaaacaaaccgttcagaaatg

SEQ ID NO: 103159 - DNA, 439 bp, Heterodera glycines
  Promoter: Source sequence=SeqID_21590; Location=2605..3043; Strand=-; Gene=SeqID_52191
gagcaatacagtttttaaagcatcgccttgttgctaatgtttggttattgggagaactgagaaaaaatttttgaattatatttttgtttatttttaattgtagaacaaatcttaagttcatcataaaaaattttttatacactctaattgtgcttgcgaataaacaactacgaattgtacagattcctttcatttattactttttttaaaattatttttatgtaatgcaaagccatttttacattgccaaaatgccatggaattgattttcgggctaatagatgccaaattttattaagacagtgaatattgtcttcgtgaaatgttatacctattcacattgaagcgctttttacacgttttggacaatgtgcatcaatcaatacccatcagatcccctaagaaagaattattctattttttttaatttctaaaaatg

SEQ ID NO: 103160 - DNA, 581 bp, Heterodera glycines
  Promoter: Source sequence=SeqID_7188; Location=751..1331; Strand=+; Gene=SeqID_64086
agtgggaagagttcaacgatgaaaacttgaaaatttaagagattttcgagattttttgtatccctccccccggcacagatgtttcttccgcctttatgcggtcggcagcgaataatgttctgttttttgtggtgagaaataaatttaaaaaatacaaattaattttaaatcaataatttcactgattaatttaatctgttttttaaatttttattctattttgcctagtaattttaaaattttgtaaatgagatttttttataacacattggacgaaaccgtaattttttcatgtccagaggggttagcgatgtaaaggggtaggtagatacataaattcagtaaaaccaaaaagaggccgctcaaaatttttttcttaatgtggcaccatccacatatctaagtcaaaatccataagaacgccccaattgttggcttttttggtcattttcaagtcacacgtttttgatcacttggactctgtccaggactcaattggccggcccctccaatggcacttgaccaatcatgatgatcagtattattaattataaatcatttttcagttggactggcgcatg

SEQ ID NO: 103161 - DNA, 384 bp, Heterodera glycines
  Promoter: Source sequence=SeqID_15690; Location=2356..2739; Strand=-; Gene=SeqID_80001
ttttattttttttgtcacctttttttgaagaagcaaaaatacatcaccacaaagatatcttatataaactagagctcagactggacctgggtccaggcctggatttttcctggatccaggtccaggcccaggccatttttagacaacctggatttttctttgcaggattttcctgggtttgtgtccaggaaatcagttccagataaaatgtgaaaaaaatctaggtccaggtctttattgaaagcaatgaatttttgctataattttctcatatttaaatatttcaaatttttggaaataaaaaacttctccatatttataaataagaaagagtaaccagcaaaatttgaaaattttaagcacaaaagcgccgttggaataatg

SEQ ID NO: 103162 - DNA, 771 bp, Heterodera glycines
  Promoter: Source sequence=SeqID_4502; Location=1..771; Strand=+; Gene= SeqID_54682
tgctgatttggaaaaggagtacaattcagtgagttcaattaataaattaattattaattaatgccttaaaaataacatttattaatatattattattttttactttgatgtactaaaggggaatcaaattaaggaatcaattaatcacagttaattaattaactaattaattagttcatttactcagttgtcagttgcttcgttaataattatactctttttctagtgaattataaattaatgtcccaaaattagcattattaatatattttgttttttttaattttgatattctaaataggcatcaattaaagaatcaattaatcgcagttcattaattaactaattaattagttcatttactcatgtgccagttgcttcgtcataattaattatgctctttttcgtgtgaaatataaattaaatgctccaaatagtatttttgaatatattatttttttatttctaaataggaatcaattagggaatcaattaatcgcagttcattaattaatgaattaattagttcatttattaattggtcagttgctgtgttaaatcagctcttttcctattggctaattttattcgtaatattaaaaattaaatccacttttatttatagttaaaacaaaaaatattaatatttattaaatattattaactgattttcttaaattttttataaaaatattatatttaaaataaagttccataattaaaaacattaatattcgcaatgttgtcaatatttagctcaatgaaaccatg

SEQ ID NO: 103163 - DNA, 67 bp, Heterodera glycines
  Promoter: Source sequence=SeqID_12792; Location=1588..1654; Strand=-; Gene=SeqID_47083
tttcatatttgtccataatttaaatgctttgagtcttaagactttacacataaagaaccgattaatg

SEQ ID NO: 103164 - DNA, 79 bp, Heterodera glycines
  Promoter: Source sequence=SeqID_20512; Location=181..259; Strand=+; Gene=SeqID_51050
aatattatcctaaaaatgtggtaatagaacctttttacctaatttatctcatcttaccttctcaattaatctttagatg

SEQ ID NO: 103165 - DNA, 1003 bp, Heterodera glycines
  Promoter: Source sequence=SeqID_4976; Location=2376..3378; Strand=-; Gene=SeqID_56426
taacgtaaataaaaattggaataagtaaaaaatgaatgattaataattttatacaagcattttttcaattattattaattagtttgcatcttttttgcttttgtttttcaaaatgttcttcaattttattctttacttttatacttgattatgaattttgcatttatagtgttatggaaataaatttgcagctatacatttacaattttaaatattcttactatattaaaatttatattttttcattaaatatttgatcctaataataattttcgtataaatatgaatatattaatagtattattttgttattttgaattatgtttaaattttcatcttttagtaaaaattaaaaaaataataataattttatatcttgcaatttattgctgtaattatgtttaatttacataatataagttatttttgttaatataaagctttgtcaatttaacttgatttttagatatttatcaaaagtttcaatcccatttaaaaaatgaatccatattatagcaaaaataagaatattaatttaagcaataagtgtattgtattaatacactgtaaaaatgaaatgctttctttctatttttcataaataaataatattattgttctaaagattatatataatttaataattattgtttaacaaataatattatatctttttctttaaaattcttaacatttttctattattttgctcttttttaattgttgcatttcgaaatgttactttgtatattcgtttttctttaattagggattgtcttagccataaattgcgtttatttttataatttttaaaattctttttcgaattgaaggctgtacaatttttttttattaaaaactttatatttaatcatttttttataatttttattaaacaaatttttaattataaataatttattttccttgcgaattataagaggtatcttttcaattgtccaataaatatgttttttcacattgcctctatgtcttccaaatg

SEQ ID NO: 103166 - DNA, 89 bp, Heterodera glycines
  Promoter: Source sequence=SeqID_33679; Location=1..89; Strand=+; Gene= SeqID_63671
tacaggaccagaaactcaaaatttctgggctctaaaaagaaacacatattgataaacagtaaaaaatttttttctaaattttagacatg

SEQ ID NO: 103167 - DNA, 355 bp, Heterodera glycines
  Promoter: Source sequence=SeqID_1486; Location=6482..6836; Strand=-; Gene=SeqID_73858
tatacattgtacatattgagctggattattcttacctatcattctctatcaaatttgaaaatacgccaaagagggtgtctttttgatttaatgttaattttcttgactttttggtaatagtcaagaattaattattgctcagatttaaattttaaccaatataatttaattagtccactggtgctcttcatactgtgtctattcaattacttataatatgaactgacaatgagcttgatacagtcaagttgagactagaaataattaggctgtttataattttaaacgctccgcagaactgaaaggcgcaccgacgcattgggagggagcggacgaaaatcgggaggaaaaaatg

SEQ ID NO: 103168 - DNA, 447 bp, Heterodera glycines
  Promoter: Source sequence=SeqID_13653; Location=405..851; Strand=-; Gene=SeqID_77553
aacattgggactcaacccaccaactttcaatgacattccaatcataactcaacccaccagcattccaatactgggactcaattctccggcattctaatctctgggactaaaatctccggcattccaaacactgggactcaacccaccaactttcaatgacattccaatcactgaaaatcagcccaccagcattccaatactgggactcaattctccggcattccaatctctgggactaaaatctccggcattccaaacactgggactcaacccaccaactttcaatgacattccaatctctgggactcaacccaccagcatttcaatctctgggactcaattctcaggctttccaatcgctgggactcaacccaccggcatttcaatctctgggactcaaatctccggcattccaaacactgggactcaacccaccaactttcaatg

SEQ ID NO: 103169 - DNA, 168 bp, Heterodera glycines
  Promoter: Source sequence=SeqID_1579; Location=1..168; Strand=+; Gene= SeqID_74607
gaattaaaatcattacttggggcactcacctattttcggcgttttattaaaaatttcgcgcacattgctcgtccgcttcaaacattaactcaggataaatttgagggtaaaattgaagaaaattggggaaaagaacagaacgaagcgttggaaaagctaaaacaaatg

SEQ ID NO: 103170 - DNA, 139 bp, Heterodera glycines
  Promoter: Source sequence=SeqID_6048; Location=1..139; Strand=+; Gene= SeqID_60139
aaaagaggcagaacgtgtgattatgcattgtgaatggaaagggtacagcgctcgctccaatagttggattcccgcaaattcaattagcgagaaaaatatataaaaagcattatttaataaaatttataaaaaaaaaatg

SEQ ID NO: 103171 - DNA, 99 bp, Heterodera glycines
  Promoter: Source sequence=SeqID_29772; Location=1..99; Strand=+; Gene= SeqID_60237
cctaatttttgttagcctcctttttactgttaggttatccccgtggaagagacgtgccatgctaatttggacgaaattaagacattgttgtcagaaatg

SEQ ID NO: 103172 - DNA, 502 bp, Heterodera glycines
  Promoter: Source sequence=SeqID_22667; Location=1342..1843; Strand=-; Gene=SeqID_53352
ttttctcgttagagatgctttctttgtttattcttacatttatttgcttgcttttttgtggtgcaatttcttggtatcatttgaaaagcttaaagttctattgaattttttaaactaaaggtctaaaaatgtagccagacgaagaattattattactaaaatagtcaaaaaggttgaatttagcgttctcactgtaagtagcgactttttcgccggtgcaaaaacccggccagtgttctccgacccggtttccttgcagtttttttttcatgttttcggttttttctaccccaatttttcagtacagtttcggtgactataaaaattaaacaaatgattattgtattttaagcagtaacaacaaaattttttttttaattttaaagaaaaaataaatcaattaaaaatctttttctgcttactttttggaatataaaaaagtttttacttcgttaacaagcacaacttacgacaaaagtgtgcaaattgttcagcaaaaatg

SEQ ID NO: 103173 - DNA, 89 bp, Heterodera glycines
  Promoter: Source sequence=SeqID_20051; Location=1418..1506; Strand=-; Gene=SeqID_84828
atcgccacgccatcaaacgaaaaagtgaaaaactgccgacagcaaaattttgttttgtttttgctaaacctgagccaggtgcaaaaatg

SEQ ID NO: 103174 - DNA, 566 bp, Heterodera glycines
  Promoter: Source sequence=SeqID_2190; Location=5786..6351; Strand=-; Gene=SeqID_78386
tccccccagtttgtccccccccttcctcgacaaactttttggtgccacgacccgggaacacaaacccttcacccttcaattcactttcgaccatccatcactcttctctctgccgccagccgaccctttaggctcccggcaactcaacccttcgctgtacgccgaccatcttaggcctccggcactcatcactcaactcaagtcgccagccgccccctcttaggctcccgacaaaccctcaccgagttgtcagccgcccatttcaggctttcgaccattcatcactcttctctcagccgccagccgccctttcaggctcccggctttcatcactcaactctttgtcgccagcccccctttaggcttccgacaagccctcaattgagtcgtcagccgtccttttaaggctcccggctttcaccactcaactcttatcgtcagccgtccctctcgggctctcggctaatctccactcaacccaccaaccgacagccgccttctctaggctctcgaccaaccaagcccgactcttgcgtccagccgccaatcctagactttcggaaatg

SEQ ID NO: 103175 - DNA, 165 bp, Heterodera glycines
  Promoter: Source sequence=SeqID_8398; Location=714..878; Strand=+; Gene=SeqID_67927
cattggtgctttcagaatcaagagtcaattctaataattttttaaaggtgtttaaggagctagacattaacgttttatcaagggcattccaggccttgactgatctgttaacaaaagatttggaagattttttagattgtaatttaacatttaaccggaaaaatg

SEQ ID NO: 103176 - DNA, 208 bp, Heterodera glycines
  Promoter: Source sequence=SeqID_44312; Location=864..1071; Strand=-; Gene=SeqID_71810
taaagcgcacttttctaaccgtctactcgctcgttttccctaatcgtttggccagtctctcgcccacacgtctctccgttcgccgcccttttttggctctttcggtgccccctcgtggtcacccccccctcccggtcgttgtccatcccctttgtgcgacaagtggtgccgttagcgattcgtaatgtcttctgcacgatgccggatg

SEQ ID NO: 103177 - DNA, 310 bp, Heterodera glycines
  misc_feature (17)..(17): n is a, c, g, or t
  Promoter: Source sequence=SeqID_18944; Location=3143..3452; Strand=-; Gene=SeqID_83668
tgaacaaatggaaaatnagggaaaaatgccgataaacttgggggcgtataaattggattggagtttgcttttacaatctgttttcagttcgtcaggaagaccgcaccaccacacaaatcagcagcctcagagttcgtcgagtgtgcaacaggacgccaggtttttttacgcctattatactatttaaacaaaatccttttcatttatgggaacgtttcactttttgcgctgaatggacttacaaaacgctttcctttggtttagggctcagcgtgccaacgcctttctgtccacaattgtgccgcggatg

SEQ ID NO: 103178 - DNA, 1003 bp, Heterodera glycines
  Promoter: Source sequence=SeqID_22856; Location=162..1164; Strand=-; Gene=SeqID_53563
ggcttggtaaatattacatttaccttttcgtgaggtgacattatatgcaattgttcttcctgttatataaatttgttaaccatttgttttatgtttgatttaaagttaatgacataaattttcaaaaacgaaaacattgattgcattggggggggggaagtcaatggtaatgatggcaaaagtgcagttttgtggttttgcgaaaaatataaacatttaaaaaccaaattttctatgagaaaagatgtacttcactaccctgagctcattgtcggatgaccattttttgatgttgcaatgatttttgactaatagctaaggtgcagaattgtggtctcaatgggaaaaaattgtaaaattttaaaaagcctttccgggttaaaaaatgcgctgctgaataaattttcgaagaatccaattttttgtcttatttctgatcaagtatcataaaaattaaattgaagccaagcgggctcgaaccccacatccccgtttcatatgacccctacggacagtaattaaattacaataaaatggtaaaataaaaattagacatctctagacattcaatagctcattccaatgctttttttaatctctacaacatctgtgtatgagttgcttacgactatctttttccaaaaactttttaaatcgaggtcggtttcttgtaccttaacaaggaaaaatccctcttttttaaattttgcaaaattttggcgttttgattactaaataaaaaataaatttgtttccgtccgaatttggataattttccagtttagggcccgatgcttcgagttgggggccccccaaaaaactcaaaatgtactgccgcgatttgtactattcaaaaaacttatacctaagtcattaatttgattttgaataaaaccagtaaaaagcattttataaaatttgatgatatgcttatgacgatatatttaggtatttattctcgagtataacttggattttacaatacctaattgactccaaaatg

SEQ ID NO: 103179 - DNA, 1003 bp, Heterodera glycines
  Promoter: Source sequence=SeqID_1066; Location=3589..4591; Strand=-; Gene=SeqID_67105
cgttttcttttgattttatttttatttttttcaaattaatacaggtttttctatatgttcttatttgtaagaaatgttctgatttgggggtagtgccttattttcatctaaaagagggaaatttctgaaaaattgctaatttctaacaaaattcatataaagtcttaaaaattttccccttgcggcgccaatcggcacagccagcccccaaaaaatcctattttttcttaaaaattagccaaagatcttaaacgtttgtcctttttggacaaaatttgttaacaaattgcattcaaattttcaaaaattttttccggcgggacctctcccctcgcacattcaccatgttttttggaaatgtgccgcaaaaaatgttaaaaatctgatttagtgatcccgaatgctctgaaatttatgatatataataatagaatacatttttggttgaataaaatgtaaaaatatttgaagcaattttgcaaaatgttctatttttaactatagtcttattttttggcctttgttattttgaaaattttgagatagaaaccctggattaatagacaaaaacacccataaaaattgactattctggcataatttataatccctaaatttggtcatttttagacaatatctgtgcaattataccaaaaagaattaaatcgaggcgatacaacgaataaaggaatgtggaaccaaacacatcattcaaaaaattaatttttttgtgagattttggagctaattaaaagcaaacccccgcccccgccccgcgactctgacccccgcaatcccccgcccccgcgaaaagccacccccgcccacggggtccgaacactacaaaaaagtattgaaacttttttgtaatttttattattcacgagcagtgaacacttataacaatcacaaagctcttcacttcttcccccttcagaaatgagccgggcctgcttctacctggacaaagcgctcagtgttccaccgccgtttccccgcaatg

SEQ ID NO: 103180 - DNA, 377 bp, Heterodera glycines
  Promoter: Source sequence=SeqID_32959; Location=1..377; Strand=+; Gene=SeqID_63171
ttccatatcgaaaatgattcatttccactttttccctttatttccctttcaattcgatggaatgtttcggtccgctggtgaaaagtccatttcattcattcattcgttacgttgtccattcattctcatattaatatttccgcttaatctgaactcgtttagctttgctttgctttgctttgcttccaaatgccattctctctgaaggctttgttcaaattcgccattttacaaaagaatttcatttaaacgactgacaaaactaacgactcacttttggaacattttaaaacaaattgatatttatttaacaataatatttataattggcaataaataatttttaatttttgcataatttctattcagtttaaatg

SEQ ID NO: 103181 - DNA, 771 bp, Heterodera glycines
  Promoter: Source sequence=SeqID_7315; Location=2535..3305; Strand=+; Gene=SeqID_64435
tttatttaggccaacagtatttagcttgaattcagtaaattgttccgagacaggctttaggttaaattggagagatggagttttgatttcacagatttaattttatgaattatttttttgctctaattcaaataaaaaacaaacggaaattaatttgactgtccctctcccgctgattaaaagccgtcgcttttccgttgtatctgctactgttgattgttgatgaaggcttttcacatatcttcgttttcaccgacacacagaatttatcggttgcgtatcagcggaattggcgccggagttatgccattgaaacagtttttgcttggcattttgatgggctttttgttttttgttgtccaccggcacttttgctcgtcattttatgctgccaaattcgcgggccctcgtcatgacacattcggacaatctttggctgatgatggcaaaagtccgacgatgaatagcgattttatttttgtaagcatagcatttgttggcatttttaattgtttgtttttttaggttggtgtgttaagtgcgcaggtaaattgatttaaaaaaacaattcctgttgagttaatccatcgattataccctttttttacgtttttttgataaagcatttgcttctccccttccccacagcgttttctcgacacgcgtgcatttcaaatttggcgcagttgggcgcgccgtgtgcctggccgcgtgctgttctttgtcgccgacggcactgtgctcagtgcgcgagtgcgtgcggcgcgcatg

SEQ ID NO: 103182 - DNA, 1003 bp, Heterodera glycines
  Promoter: Source sequence=SeqID_4040; Location=1065..2067; Strand=-; Gene=SeqID_52927
acaaaaattatataatatcagtcattggctgatgagtacaatcagcagaatcatgcttggatctgtgtggtggaaataaaattattacatattattaccatgaaaacggatttcgggaagagtttggccccaaaaaatttagcctcacaatcagaaaaaaaaaatttaaatttagcctcagaaacacttaaattgttagaaactctgatttttggggggaggggggattttggcatttaatttaagtgggccaaaatgtttgaatccgaaaaatgagtggactttttgatattgtgcgatgaaatttaagagaccaaaatatggaggctgctgacttatggcaattctcgaaatataaaagaaaatttccgatttttataggaatttttacgaaaaaactgatttttttcattagaatatttactaattctaccgtatgacaacaaataccataccttggtctcgtaaaacaaaactatgcgcaaaaatatatggtaaaaaaaaagagaagaaagcgctacgaatggacagtttttattatgcttggcgagtgtccttttgtgtagttaaacaaataaaagtggtcaattagcaaatggaaattagcaacaaaatttgaaaatattaaattgcgattaataggaggaacaataaaattagcatagaatcaatgtttgaatgaataaaataaaataaaaatgaaatttaacaaataaaatataaatttaatgagtttgactataatgcaattaattaatgaatttttcactctttggatggactttttgtttgctttgatcagcagcaaatgttttgtgtggttttggggtgatgaataaatgaaaatgaatttattatgctttatgttttacgttgggagtgttcccacagatttcgccgttaggactcaaaaacccatcaaaagaggcgccgcctaattaagccgtggaaacggcaaatttgattgattgcttattatcaaatcccggcgtttcagtccatg

SEQ ID NO: 103183 - DNA, 336 bp, Heterodera glycines
  Promoter: Source sequence=SeqID_3292; Location=1..336; Strand=+; Gene= SeqID_47579
gtggggctgcgccgcgtggaagggtagacagtaaacagccgtgtgctcgctgtgcagcagcattgtgtgtgggaaaagggaagaggtgagaaaaataaagaaggaaatagtgcactgtctgactgtctggttacgcttttgaaaaatttgacccaaaaccgggacccaaactgaatgaggtaccctaaattttcccaaacatgtaaaatgtgttgagtgttcatccaaatttttcaaccaaaattccccatttctcgcttctttacaattagatttgggtaaattgcttatttctataccattattcgacttcaaacagagtttattaacgacatg

SEQ ID NO: 103184 - DNA, 106 bp, Heterodera glycines
  Promoter: Source sequence=SeqID_8438; Location=1088..1193; Strand=-; Gene=SeqID_68065
tgcgtgtgctgcctgggtatcggccacaggccggcggagtgttggattttggaagcttggggttcttaatttttttttgtaatatatattttttctctttgcaatg

SEQ ID NO: 103185 - DNA, 280 bp, Heterodera glycines
  Promoter: Source sequence=SeqID_14536; Location=1..280; Strand=+; Gene=SeqID_78589
ccaaactttgctctttttaacaccatatcaccttttaacgattgatatatttttgaaaatccgaaaaataaaaagcaaattaatttttaatttgcattttaatttcaaaatttttgattcagtagacatttttgtcgtatttgtattattaatgtacaattagcaaaacatttacgccaacaatataaaattcatggtttttaattaaaaaaattaattaattaattataattttgctaattaattgccccccccccccaatttccttcagacacttatg

SEQ ID NO: 103186 - DNA, 170 bp, Heterodera glycines
  Promoter: Source sequence=SeqID_34818; Location=1..170; Strand=+; Gene=SeqID_64505
tgctgcgttaccgagtacaccataatgtactgtttgcatatggtaacaaagcaaatattaaatacgcactcaagtacccttttaaagggccaggacattgttatgtcgagtgcaaacaagagtccggcaataaaatcggaattgatgagccggctcaatatgccaagatg

SEQ ID NO: 103187 - DNA, 349 bp, Heterodera glycines
  Promoter: Source sequence=SeqID_6861; Location=820..1168; Strand=+; Gene=SeqID_63135
tttccatgttgccatatttacactatatttttatcacctgtgaatttttaacatttgattgaattatttttattcatttttattacggtattcattttgtatttttattttgatcaaatttatttgttgttttctttttggcaccataaagagcactcatgtgcctttggtttgctcgataaattaaataaattaaattaaattaaattaaattaaattaaaatgttcataagacaaggaaccaattctggatgaaattacagtatttaaaagggaaacattcgatggggtgaaccgtctcatatatataattttttgtttttgttttgtttgtggaatattcaaaatg

SEQ ID NO: 103188 - DNA, 382 bp, Heterodera glycines
  Promoter: Source sequence=SeqID_7956; Location=1..382; Strand=+; Gene= SeqID_66482
ataatatgtatatgattccgtaatttgatccatatttcgtgattttatgttttcgagccttagtgaatgtaatggatagggcccggattcttatgtttttgcttatttttcagtggctttgtttcggtgagatttgaattttcgcccctatcggcattgttgaaaataaataaggatggatctcttgaaaattttttatgattgtggacaaaaaagaaaaaaaattatctttatattgaaccaaaatgaaaaataagacgaattttctgtaaaactttttttttgttgttttgttttttttatttaaaaaaggattctgaacaacaatgacggcgaaaatgcaacaaattctgatcattgtgagcaaacgacaacaacaatg

SEQ ID NO: 103189 - DNA, 533 bp, Heterodera glycines
  Promoter: Source sequence=SeqID_16776; Location=1..533; Strand=+; Gene=SeqID_81192
gtgactcattaaatggatcggaattaaaaactgaatatcggtatctcatctcaagggatacatttttagcacaaaaaatcgcgaaataggacctaaaaaggaagaaaaaaacaaatatattttcggatcaattttcggtaaaatttttcaattagcgtgttttttctgtaaattttcgggtaatttcttaagggtgtatttttcgtttttttttttttgcatttttgttaaggatttttccgaaaaccctgaaaataggcgccaaaaattgcgaaataagcacaaataggcgcctaatctctgatttagaggcaatgctttgcgttttaatgaagaaattttgatcatggagttgagcattgaaacttttcatgatcgactgtacaagcgcattgattcctataagaatgaccaagaaatgcagaatataatccggcaattaacacaaccaatcatggaattgcatcaaggcacatattatgctaattaaacatttaattaatcatgtaaaattttaagtggcaattcatatg

SEQ ID NO: 103190 - DNA, 167 bp, Heterodera glycines
  Promoter: Source sequence=SeqID_20222; Location=1..167; Strand=+; Gene=SeqID_85021
gggaatgtggcctatgattaacaaatgatatagggcaaaaatgagtgaataaaatttattattaacagtaaatactctctgaaagcgtaaaatcatgaaaaaatttataataattctgtaagctttatgattatttttttaaaaattattattttagaaattaaatg

SEQ ID NO: 103191 - DNA, 424 bp, Heterodera glycines
  Promoter: Source sequence=SeqID_12981; Location=1532..1955; Strand=-; Gene=SeqID_76743
agtgacctttgagcgcggaaaaaccaattatgggaccgattgcctatggttgaacggcatgtttaagcgccgcaaaaaataataaaaaataaatttccaaactattcaggatttcgttttacacaccactcaggaaatcgctggagatgcacaaatcgcagttgctcagcatatataaacatcacaaacaacggcgaaaccggagctagtggaaccttgagtcaaaaagaacacaaccacctcccagcacctcagaaacaacaagtttgtataaatttaaaaccaaataattaatgctttgttaaaggcagagtcaaggcgacagaaaatcaaagaaagtgtcctggccgagccgtgtctgaagcccacacgacttttggctaaagtgaggcgatcagcaacggatgaagcctttgttgccatg

SEQ ID NO: 103192 - DNA, 193 bp, Heterodera glycines
  Promoter: Source sequence=SeqID_18764; Location=1927..2119; Strand=+; Gene=SeqID_83443
atttatttgaatattttaggatcgaaagtaaacaaatgctgcggtgccctttgtgtttgaccgacccaaaattaattattgtaataagaaatttaattgccatgccattaatgcttctcgtgtctgttccctacaaaaggtggccgattttgcgccaattttcttcgactcgtcccaaatttatcacaaaatg

SEQ ID NO: 103193 - DNA, 56 bp, Heterodera glycines
  Promoter: Source sequence=SeqID_38757; Location=420..475; Strand=-; Gene=SeqID_67478
ttgtctcctatgttgacgatcttttcgccgaatttccggccgatgacaatgccatg

SEQ ID NO: 103194 - DNA, 115 bp, Heterodera glycines
  Promoter: Source sequence=SeqID_25220; Location=605..719; Strand=-; Gene=SeqID_55963
tatcaagtatgcatttattggagaagctaacggcccgtagaatagagtaaacaatttcttattctaaataacttaatatcgaatttaacgatttttaaaaaatttagcaaaaatg

SEQ ID NO: 103195 - DNA, 59 bp, Heterodera glycines
  Promoter: Source sequence=SeqID_807; Location=289..347; Strand=+; Gene=SeqID_61771
agtgagtgtttttttttttgaaccaaaccaataaaaatttcaaacaattttaaggaatg

SEQ ID NO: 103196 - DNA, 1003 bp, Heterodera glycines
  misc_feature (532)..(532): n is a, c, g, or t
  Promoter: Source sequence=SeqID_11411; Location=1711..2713; Strand=-; Gene=SeqID_74804
tctatgtttaatttcgtgccccctaatttaaatcttttaatgcatttttaaaaataaaagaaaaatttattgaaacgggaattagattaaaaaaagtttttcgtttttattacatataatagacaaagaaaaaatagtttccataaataaaaagagaaataaaacatatgaaaacactttcatacacaaaaaagaaattaaaaaccgtgcaagtgggaagcattgcgagattattttgtaaaaaaatatttaagcaagaatatttttaaggacaacaaaaaatcctttttaaaaaataattaaaacgcatcaaataaaaaaatattaaaaattaatttgggtctcacataaaatattgtagaaggaaattatgtttcataattaaataagttatgattacacttttaatacaatgtttgatttgttaattacaatggattaaaatagaaaaaaattaaaattgtaatcgtaatcacaattcaatgtgttacaaaatcaattatattaattcagaaagccatcttttaggaanataattaactataaaaaaatgacaatgaaacaaatctttgtatttttattgaaagaattagagaatgtttatgatgaaaatgtaaaaatatttgttcgaagaacgaacttcttagtaactttgctaaaaaaattggtaaaaaatgaaaacaaaatgtgtttaactttaaaattggacaaagaataaaaaaaaggattttctgtgaactaagaaaaaaataaaattcaaaaaaaatattacaaatgaataatttatttatttataattcttacattataatatataaacgaaaacaatatttaaatactaaaataaaaatgtctaaaacattataaatttttatcaatcaaaaaataaaaataaaagccttttacataaaccctcaattctcaaagtcgattattaaaagccgaaataatattgttttatagaaccaattataaagatttaatttttacaggaaaataaatg

SEQ ID NO: 103197 - DNA, 133 bp, Heterodera glycines
  Promoter: Source sequence=SeqID_28400; Location=791..923; Strand=-; Gene=SeqID_59024
cccccccccccccccccctttccccttttttgcccaaatgtttgcctttgtgggcatttgtcgcgtcccattttcccattcaatgctcactatccatgccaaacctttgctaaaaccgcacgccttcagaatg

SEQ ID NO: 103198 - DNA, 537 bp, Heterodera glycines
  Promoter: Source sequence=SeqID_34098; Location=1..537; Strand=+; Gene=SeqID_63974
atcattaggatatgattgtaatgatcggaaattgacaaaaaaaattttagaaaatttcggttttacggtctctaatcaatatatcctatagctgagcgggaccgggactggtactgaaaaaaacctacaaatgaatgcctagccccggatttgaccgggaccgagactagtcccggtgtttcccagccaaaaagtcacgggttttaacccgaaaaattccctgtaccaattttttttttacaattaccgattaccgctctactctaatataacgaacaaataattttcagattttcattggttacaccggaaaaaaacgtgggcaaaatctgccgaaacagaaatgtgttgccataaaattgtatggcaataataaaagacatttttataatggcacaaatgttttgagaaaattaaaaccatttgattcaaaaaatgagcacattgtcaacatgatggactagtaaaattcaaaatttaattagcattaaaaaataatacctaattaaatttgcaatttttagtggccaaattatg

SEQ ID NO: 103199 - DNA, 308 bp, Heterodera glycines
  Promoter: Source sequence=SeqID_14238; Location=763..1070; Strand=-; Gene=SeqID_78255
ttagaaagagcgcaacaacaacacaacagcaacaacaacaaataacaacggcggcagaacacaaaacaggcacggagaaaagcaaagcaaatacagcgtaacaaaaagaaagggtccccctctccacttgccaaccagggataaattactcttggcatcgtatagttttgtgccgatttgtgtggggctgaggctaaaacatgcaaattcaaatctctttctgagcaaccttttatttaaagacacattttcaaaagcgttttcttatgtttaattaaaatggaaacttgtttagtcagagcaaaatg

SEQ ID NO: 103200 - DNA, 252 bp, Heterodera glycines
  Promoter: Source sequence=SeqID_19296; Location=680..931; Strand=-; Gene=SeqID_84038
tttcgctaaaaacattatgccattatattattttttaaaaaatttaattctaaaaatcaaaatttataaattttttcttccaaaagttttaattaggcttcaactccaagatttaaattcaacaagttttttttcaaattcctttgaaatccgtagaaagctatttataacaacaaaaaaaaacaggctgcttttttccatccacttttatttttctagaaaaccttacaaatatacgtttttaatattatg

SEQ ID NO: 103201 - DNA, 1003 bp, Heterodera glycines
  Promoter: Source sequence=SeqID_710; Location=2961..3963; Strand=-; Gene=SeqID_59490
ccataccgtttgctagagggatggccaccatccccataccgtttgctaggaaaatggacaacatccccacaaaactgaagcgtgctcaaaaagtacacttcagtaccaggcgaataacacgccagtgatggtacccatccctatgccaacggctatagtgatggtacccatccctatgctaacggctatagggatggtacccatccgtatgccaacggctatagggatggtacccatccgtatgccaacggctatagggatggtacccatccgtatgccaacggctatagggatggtacccatccgtatgccaacggctatagggatggtacccatccctataccaacggctatagggatggtacccatccctttcacgggccaaggacctgccccagcgggggatcatgtgtccattcaacaaaagtgttatgcacactaatcaccattgtacctcttctaatcactgttgtacctcttttaatcactgttgtacctcttctaatgactgttgtacctcttctaatgactgttgtacctcttctaatcacttttgtacctcttctaacaattttgtacctcttctaatcactgttgtacctcttctaatcactgttgtacctcttttaatcactattgcacctcttctaatcacagttgtatctcttctaactattatggggatagtcccatccccttaaacatttaaaaaaaaagtttcagaatgccaatttattttttatgcaaacaataagattatgtaatataaatctcagatattttttgtgtcaaattgggatatgcttttttctgttacttttagttagttaatcaatagcgttgacaaactacttcgaatattatttaattaatcaaacaaatctttagattttcatgacacctatttttgataaaattattaaaaattttgataagacatgtaagcttattcatttttgtagtttatacatttttacttacagacaaaattcctaaaaaaatg

SEQ ID NO: 103202 - DNA, 215 bp, Heterodera glycines
  Promoter: Source sequence=SeqID_9539; Location=2221..2435; Strand=+; Gene=SeqID_71799
aaaaattcaaaaagacaattaattaaacaattaaattgacggaaagaaactacttttctgaaagatttgttgtagtgccttagatttggctttgctgttgaccgaccttaaagctcaattaattaagagtcattttctaaatttatttttttcaattagcactgtaaaatttaaacattcttctcaaatcctaatttgtttctccagttgccatg

SEQ ID NO: 103203 - DNA, 697 bp, Heterodera glycines
  misc_feature (75)..(75): n is a, c, g, or t
  misc_feature (79)..(79): n is a, c, g, or t
  Promoter: Source sequence=SeqID_38037; Location=1..697; Strand=+; Gene=SeqID_66980
cggggacctctagagtctcaacagaagttttccaaaaaaaattgtcagctatctttttaaattttatgaggaaanaaanatacggggccacttctttccattaattattcgtatcctgagaaaaattccgaacttttttttttggaaaataatctctgcccaattgtggtcttaatctgggcctaattgtcatgaagatatctttaaaaaaaatttaaaaagcttatgtgaactgattatgatatgattgggatgtccaattgtccatttctaggaatgccgtgccgattgcaacccaaacatttggttcggcaacttgttgctctttcttccaattgtcgctgttcgtgcgcaaattttaaaacataatttatgaaataataaaatatgcttctggcttggtcccgccgtaaattttctgatcaaaatgcctaagagatgatgattcgggagttcaaaaaacttgtttttgttttatgtttcagacctcccagtccaagttaaaaaaagacgcatgtgcgttaattaactgccctaatgagatgatctggtctgatcacaaggattgatcggcttgattttgcaagacccgaactgatcacttttttcttgcttggggactcttgtcaagatttctatgatttaatcatttaatcattttttgccacacaaatttcagtcgttggccaatgcgatg

SEQ ID NO: 103204 - DNA, 751 bp, Heterodera glycines
  Promoter: Source sequence=SeqID_29367; Location=1..751; Strand=+; Gene=SeqID_59872
tgaaaatgtggagtgtggtgtttttttttaaattccgtttggatgagaattcccaacctctctctgcttcaccagcagcaccatgttccggccattggcttgtcgtccgtctctcattcgagttgcatacatacaatttgggcaaaaggccataaataataggacagaagcgaaagagcaaacattggcgggggaggggggggggcaggggacgggggaggaattgtctgatgggcaaaatggaataaattgcacttcgaccgcaccgccgatgtgaggggactgggcaggaggggaggcgaagatgacaaatttattgttttgttcgacggtttgatggtgcaaaagtgccaaaattgggagggactgctcccccctccctcccccgaagggcaaatgccctcggggaatattgcctaagtgcaaaatgaaaaaaaaattaattctttttttttgccattggtgctgctaccgaccgattggaatgtatgctaaaaagttcgaatgccaatgttttttaaaaaagaaattattagtgtcgacatccggctcaaatatattgggttgggaaatgtcttaaaaatggtgcaagattttcaaggactaggttagagcatcactcctaaatgaaataatatgtatcacaacacacgctaaatatccttggttggcatcacaaaatgcaaacaaagttagaagcgagcacttttagccattctaactttttgccatgtttggaatgtcaaaaatg

SEQ ID NO: 103205 - DNA, 449 bp, Heterodera glycines
  misc_feature (48)..(48): n is a, c, g, or t
  Promoter: Source sequence=SeqID_35065; Location=1..449; Strand=+; Gene=SeqID_64716
aaaaaattttcaataaaaaggctatttagataaatggtaatgatgttntaattgaaatgttaatgcccaaaaataagacaaataattttcctgtgcttgattattggcgctcatttgctgtgcttggaaaacagctggatcacgcgtcaattatttgatgaacttatgcatattttgtgccaggtaacaaaatggggagagagataagccaaggaaatgtcccaatatttcttttttcgcttgcttctctttcattctctcatttttgttgttgtaaatttaaaatttaaccaaattgttcatttttaagttcattttttcctaacaaataagaactcatttttaaacagattattatttgggctttattttaatttaaaatattaaaaaattacgcttttagaaaatcttcaaaaataattaagtagacaaatttatcgtgtcagatg

SEQ ID NO: 103206 - DNA, 119 bp, Heterodera glycines
  misc_feature (46)..(46): n is a, c, g, or t
  Promoter: Source sequence=SeqID_41626; Location=1..119; Strand=+; Gene=SeqID_69712
aaattttaggcattttcgatctgaattggattggcacggtgcacancggcattccgcttgaccagctgacatttcgacttaatcccggcacatccgagtgcccctatttggcatggatg

SEQ ID NO: 103207 - DNA, 586 bp, Heterodera glycines
  Promoter: Source sequence=SeqID_6009; Location=1955..2540; Strand=-; Gene=SeqID_60005
ttgttgtatttttgtggtgactttcacagcttacaattttcgtgtcttttcattctttttcaccacttcgttatgattttatcaatattttaaataattaccacattatttgttaaatgttaaaagtaaaaagagccagagaaagtaaagtataatgatattttattatatttaagattccaattacataagctgattccaaaattgattcgcgaatttttctaatacttctctttatctaatctccctctttctaatttttctctaatctctctcactctctctctctttttcccacccccccccctccctctcatacatctctcctttttctttctctttttctctctgtctctctctcttttctttttttttctccctccccctcatttatcactcctttccggtctacctcagttcggccccagcacgtttcggccacaaataaaacaattaatttttcaaataaaatttcacgcaaaaattagcaagcaaaatgacttttttaaattaatagtgttattcttatttttatatttttaattttaattcgaacataaatttaaactttttaagatttattatg

SEQ ID NO: 103208 - DNA, 1003 bp, Heterodera glycines
  Promoter: Source sequence=SeqID_22211; Location=622..1624; Strand=+; Gene=SeqID_52883
tgcgactaaaattttctgaaattttaaaggcaaataaaggacacttagggctatcaaatgatatcaagaatgtttaatttggatgcttctataaagagttatggtgcattaaatttatcaagatattacgtggtcgtgtttttttcgtggttgtgtaaactgaagtagagccagatatatttagtatgattagcttattattaatttttaatatagtttttagtgtattttttaagtttgtttaagcaaataatctttgagagcttaaagcatatttcggccttttatagtccatattttatggccatatttggtgttttttagtcaatataatttaaatattttaaccctaataattaatacttaaaatgcacatattttttcctggtttctccatgctctaaatagtaggaaaaacactttcttttttgtgtttgcgaacaaaaaccgggacttttatttacatatttttacatatttcggggtttttatacatatttacatattttggatttttttcatatatattttcatttttttacatattttgaaaatttataaagaaaaaataagtttgaaaatgttgcctaaaaataccaaaaaaagtaatttttatgtcattttgtggctatttcatactttacggggaatttctttcccaaaaaataccattaaaaaccattttatttgcatatttggggttttttgtacatattttgggatttttcttacatatttatgtacatatttggaccactttttgtacatatttttggcagccctattcattaaccattctcgcaataactttctgtttatatattttatttaaattacttaaactaaaaatcaatacattaaatttttgtcataaaataaagtaaaagaaatttatgtataaatttattttaatgttcgaaaccaaatttattatttgaaaccaatttaaaagttcaagacgaaaaacgcacaaaatttatgaaaaagtgaacaaattaaaatg

SEQ ID NO: 103209 - DNA, 138 bp, Heterodera glycines
  Promoter: Source sequence=SeqID_19541; Location=941..1078; Strand=-; Gene=SeqID_84272
aagaagcagcagccattgcgtcaattagtcgtaaagaataaaaaaaactatttaagttattaaattcgttgtgttgtgttaaaattcaatatgattggtaatcaattttattccaataaagaaattaaattaaaaatg

SEQ ID NO: 103210 - DNA, 89 bp, Heterodera glycines
  Promoter: Source sequence=SeqID_12601; Location=2610..2698; Strand=-; Gene=SeqID_76265
ggccgatcattcgcctccattagacgtcgagtggcctcactccgctgatggaagcatgttccgtcgggaatgccgagattggcaaaatg

SEQ ID NO: 103211 - DNA, 175 bp, Heterodera glycines
  Promoter: Source sequence=SeqID_12379; Location=1030..1204; Strand=-; Gene=SeqID_75986
atattcagtagtggaattagaagcacttgccatttgcgcttcattaaagaatttccgcccatatttggagggagctggaaggtcaacggtggttacagacaattcagcattaacatcactattccgaagaaaggacttagaaggacgattaagcagatatcagctggcaattatg

SEQ ID NO: 103212 - DNA, 168 bp, Heterodera glycines
  Promoter: Source sequence=SeqID_1706; Location=1927..2094; Strand=+; Gene=SeqID_75421
ggttttaagggaaaatgaaaatttcaaaatgaaaaaataaatttaaaaaaaaaagttgatattcattgaaagaagccaatcgcaccaccaaaatgggaaggggtccgatcggcggtcgaccaaccgcccgcctgtgtgccacacgcaaggccaacggaggaaggcatg

SEQ ID NO: 103213 - DNA, 474 bp, Heterodera glycines
  Promoter: Source sequence=SeqID_16441; Location=494..967; Strand=+; Gene=SeqID_80846
tctgaaaaattggattttgtcctgaaatcgtttgcgagaagctattttttgacactgttggttataagcattaaattgtgaaaatgtaaacgtggtaatataaatgtatttcatacagacaaattggtaaatcgcggtttatttttatataatttattaaaaaaacggtaaatgatatttatgaatgagtaaaggttaaaaacggtaaatgatttatatgaagtgaataaaggatcacccccgcttatcgaccatattgcaattatgtccagccattgattgcgcccctgccttatgcatgtggcctctcctcacgcggcggtttgccctggaagctggtcggcttgtatcgcggctcggggaatgcattcaaccgatgactttcatggcagcagttccaacaccgcaatttgcggacaatttcgggaaaaaattttaaaaaataataaaaaaaatttctgaaaatatggaatg

SEQ ID NO: 103214 - DNA, 790 bp, Heterodera glycines
  Promoter: Source sequence=SeqID_30334; Location=1197..1986; Strand=-; Gene=SeqID_60755
tttttgactatatatttttctcctttgaattgttcacctatggcattgtgttggccattgcttttttgaatttggtggtgatttgtcccgccaaaattttacatgtcaacctgaaaagcattctgatcacccaaagtattgctttaatgctttggggtttagtacgatcaatagatattactcaaaaattcatatccaacaactcattcacgccgccaaatctgattttgacggtatattctaaacttttctgtatttttgtttaaaatcaatgtataaaaacgtaaattatagtgtattaattatattttagacaaccggaaaaagttcggccattttttaagctcgatttatactataaaataatcaatatttctttgattcctaatcaaacctgaataaattcaagttttgtatccctatttcactgttgttttcttaaaaaaggcgaagctattttttaatagcatttgaaacacaaaaattctcatgaaatttgtgtcttgaaattatgtttaattgcaataaaagaaatttattttttgcgaaacttttttctttaaggaaaatcatagcggtggccccaactcctttccataaatcgaaaattctttgaaaggaatgacattctaagttattttgcgttagttcattttaaaaattacgtaataattaaaaataaacgatcttttttcgaaataaaccgaaataaattgattaaaaattagaaataattttttttcatcaaattacatggtgatattaattcgttctattgtagaacattatg

SEQ ID NO: 103215 - DNA, 259 bp, Heterodera glycines
  Promoter: Source sequence=SeqID_16836; Location=2424..2682; Strand=+; Gene=SeqID_81256
tctttcttcatttaactcttctggtgcattttttacaaaataatacaataattattattttatgaattcataaatttgacttttgtgattattagcccctaaaaggaacctcgggaatccaatatgtctttttcaccaaattcaacaattgccgaatttacttctgatcagggtaattaagcaataaaattcgagtaattattatagtaaaattgttgactaaggatttcaaatttaattttagcaccgtaccaaaatg

SEQ ID NO: 103216 - DNA, 150 bp, Heterodera glycines
  Promoter: Source sequence=SeqID_2338; Location=1558..1707; Strand=-; Gene=SeqID_79204
aattttgaaaacaaagaagattcaatcaaggtttgataatccaaaattcgtttatatattgcatgttttggcctcttcttgtgttttcatgttttaataattaggcctttgaggctttttgaaattttttgagttttataaacaaaaatg

SEQ ID NO: 103217 - DNA, 338 bp, Heterodera glycines
  Promoter: Source sequence=SeqID_9690; Location=123..460; Strand=+; Gene=SeqID_72364
tgtttgcgacgtttgccagagagaattagttagtggttataatattgagtttagtagtttattttttattttttttttctttcagaatattctattctttttttttatattttttttttgtcttttttttagtttttttttaattccattttttttattgattatttttattcgtagtttttttccacggttacgtttagattttttaatgatatttttttgattttttcaatcaagcacccaaaaagctggtggcatacgtcagctccgaaatcaactacgatcttttcggactgccttggattgaggctttggacgtcatcccacatgaaatcatg

SEQ ID NO: 103218 - DNA, 116 bp, Heterodera glycines
  Promoter: Source sequence=SeqID_26536; Location=1747..1862; Strand=-; Gene=SeqID_57275
tcagacatgccctgaaataaagagacgaaacagaaaagtgcccaagtggattcacattgtcattgtttcgtgtcgggcggatgataagttgttatggccaagtccatgcctcaatg

SEQ ID NO: 103219 - DNA, 744 bp, Heterodera glycines
  Promoter: Source sequence=SeqID_1860; Location=1..744; Strand=+; Gene= SeqID_76420
tattttgtaatcattaagcacataattaccgaaagcacctcttgttcggattttgccgtcctccttttttcagcccacttgataagtctggccaatgattttccctcatatcccccaaccaatgagtgttttctgttccatcatcttttggctaattctgcccatggacggcacccgatcaaatgggcggcaattgggccaactttcccaattattttggggtgccaaagtcggcaaacactgactgttttctgcgcatccccggaggggcaaaaatgctactcctttcccgggtcaagtgccatttggcagggcttggggggtttggccacttctcgagtctcgacaaaaataaataaacaataaacaacccacaaccaattaacagtgatcaacaagcggcgcaatgcttgtaccttgtacacaatcagcagaagaagcatcaatgaaaatgaaaaaaaactggatgcgcttggctgccgatttttgagcacccccccccccccggtgggggggggggaaacatgtcgagagtgagttgagtctcgacgccgctgcactttttggtccatccggcgatatataaacagcgcaaaaccaagcggaataaacacactgttcagcagcaacaattaaactgacatttcggagtcacttaattatttcaataattttttatatataatttattattaattaattaattattaaattatttttgcaagcaaaagtcaagtgaaaatg

SEQ ID NO: 103220 - DNA, 890 bp, Heterodera glycines
  Promoter: Source sequence=SeqID_30506; Location=693..1582; Strand=+; Gene=SeqID_60908
tgccaataatgacgacacttctctgtctttccaattcctccgctgaataacaagcaatataatttattttaataaaaattatttgtttttatgtttactgtcgaaaagtccactattttttgtgtttctgtcgaaaagtcctttactgtcgaaatgtcctttgctgtcgaaaagtccttctgtcgaaaagtcctctgtcgaaaagtccactgtcgaaaagtccggggagccgccaaaattagcgaaaaaatttttttagtggcaaagatccaaaatagtgatgaatagtggcgttaaaacgaagaatttccgagctaaaaatgttttttgtgcatttcagtcgaaacaaagccgcagaaaaaataattaaaaaactaaaaatccgttccctactaatcacactgtaaggccgcgaatggaaagactgattcttgagaccgttttgttttcatgactttcgaacaaaacttttctcccaaaaaagtggggagcataggcagtatttttcgacttcagggtttgaaattggtgcaaatgaatgtcaattcgtgatcagcagctatcctgaaaacccttgagggtaatactatcgatggtgccccccccatttttggaagaattttttttttctgaaatgtcgtggaaacatatttacggggggttttcagggtcgatcgatgatcgcgaatctgacatccattttgccctatttcaaagaaaattcaaaattttgaaaattcacttttagttcaccccctaaatccgctccctagttcactaagttattgctcacgaactgtacataaatgttgaagaattttttaagtcattgaattcacagcctttcttccatctctcttttattatttcgcgaatttttgtgtgaaatg

SEQ ID NO: 103221 - DNA, 675 bp, Heterodera glycines
  misc_feature (36)..(36): n is a, c, g, or t
  misc_feature (42)..(43): n is a, c, g, or t
  misc_feature (69)..(69): n is a, c, g, or t
  misc_feature (108)..(108): n is a, c, g, or t
  misc_feature (114)..(114): n is a, c, g, or t
  Promoter: Source sequence=SeqID_42765; Location=1..675; Strand=+; Gene=SeqID_70582
agtttttctttttctcattttttatacttggaaatngggttnntagtgcgaaattaaaagagcgatttntcgtaataaatttatattttgaccgcttttaaaattttntcgttnttgtcgatattctataagttattttttataaattcgcaacttaccaacataatatagatagaaatctattaattaataaggggttttattttctataattaaatttacatattcattcaacaactgtttggcatataccccacccccgcatatgccaaacagttgtttgtcatacgtcaaagcccccatttatgaataaaattatagaaaagatattatgtggtgccaacaaaatgtatggcatttgacacatatcattttcccctttttctctgccataatcttcatttaacatactgtctattctacattgtcttcgtatcttttccgctatcctttatacaaatactattttcatacctaccccatattctcatatgactttccatattagaacagattgtgaatatgaaaaaattattattatttattgttaggggaatagtgactgagaacccattactaatgaaattttcatttttccattatttatcaaaaagtagcctcgggttcccagtcaatttttttgtataaagattaaaaaattttttatagaaaatg

SEQ ID NO: 103222 - DNA, 589 bp, Heterodera glycines
  Promoter: Source sequence=SeqID_41902; Location=952..1540; Strand=-; Gene=SeqID_69938
ctgcaaacaattgaagcaaaaaaatcggcattttgcgaaggcgcctttctattcgattttaatgagatacaaacatcggaactgagcagctttgaaatcaaaaagacaaaattgcatgggctgaggacgaaaagcgaacgcaaaacgggcacaatttatttggtggtggaagcgacagaaagcgtaaatggacaatttaaaaaatgaaattgatgccaattcaattattaattaattaggaataatatccatttttaggctatttccacattttaagggatttaagctagttggttttgtatgcattaaattgtttttaagatttgatcaccaagtagttagcgttcagctggctagtaggaaaggcggatttttaaaaatttattcgtttgaaaatttttaaagttttgcaggcttcggtagtccttagtccttcggacaaaactctaaactgagttagaaaaattcgactggcgatttgtgtaagattttagtgcatacaactaataggcctattaacacaagcaattaatattcaattaattaaccaatacattaatttctttcaaaatagcctatttacaaaatg

SEQ ID NO: 103223 - DNA, 138 bp, Heterodera glycines
  Promoter: Source sequence=SeqID_23483; Location=1..138; Strand=+; Gene=SeqID_54180
ttctctttacaaaccattatttttatttttaaaatgattatgtttaggatttttagttttaattttaactaaatctagagtttttacataaacgttattaaaattaaatataaattagcctgcctgttaatcaaaatg

SEQ ID NO: 103224 - DNA, 684 bp, Heterodera glycines
  Promoter: Source sequence=SeqID_15425; Location=1887..2570; Strand=-; Gene=SeqID_79693
actgaaaatattagaatcggtgtcaaacagacagtgattgggttaatttttttaatcacatggaatgaccagaacaaaacttttattttatatccgataggtgaataatgtcatgattatgaaatgttgagaaaaaaaaattggttttataggcacggattttaaggcgtttaattgctgaataagtgctggctaaaaatgtatatattagagtaaataaatcaaaaattaattattttttgtcaatagttttttaaataattcaaattatttttttgtaaacaagaaaaaataattgcaaaatgatttcgtgagactttgtatatcactaataaaaatggggtctataatttcaaatttaagttttgatccattttggataaattacgctcaacaatcagttacggcttcgttataattgtcttgtcaaatgttcaataaaaacttaaattacaaaaacctcttaggttttaaggcattcattttaaaaggaacttgcatgactgatggaccaaagtcctttctgctatgagtttgcctttttctcaatgcttcaccgctcttttcacattggaattctaacaacacatttcaaaacactgagtttataattttctaattctaagtccgtttgcttccgtcaaagtttaactcattaaaaaaaattatttattctaaacaatg

SEQ ID NO: 103225 - DNA, 372 bp, Heterodera glycines
  Promoter: Source sequence=SeqID_6177; Location=1..372; Strand=+; Gene= SeqID_60605
aagaaaaatcaattaataaaattaatttttttttttatttattcggataactcaactttaattctttgaagccttccaaaaatattaattaaatttaaaattccgcattaattacttaaatttccaatttttgtaggtcggctcttgtcgacagtgacgaattcccattcgcattgaaatatttacatttatgttaaaaataaaataaaaatacccattttgatataaaaatgcatttctggcaatctttcagatttaaatcatattttggataattttgtgaatagtctatgccagggtttttgcgaatcgaaacataaaatacgaaaaagacgaaacaaaaataaatacccaaagctgaaatgcgaaatg

SEQ ID NO: 103226 - DNA, 474 bp, Heterodera glycines
  Promoter: Source sequence=SeqID_3766; Location=1..474; Strand=+; Gene= SeqID_45628
gataaagaatctatttcttattcttttagagttcgagtccgttgtgcaacatgaatatttttatttatttttgtccaaaatattaaaaattgctatttttggaaattgtttttggaggtttttcccaacaaaattggacaaacttggtatcattcgaaagctcttgatgaggagaagctttttctaagcaaatgttaagtaatttgatgagttcgaaaaaagatatgaacgttcgaaaatttaaattaaagtttgaataattgtggtttttttattgctttttgcccatcacactgtcctattgccaatttttttgcctcacttttttgttgttttattacttatttcaactaccttttttgttacaagtaataaattttaagataaacgttaacaattggtattaatagttgcaattttgtcgttttttggtagagttgttttttgtcgttttttaggttagttggtattatg

SEQ ID NO: 103227 - DNA, 961 bp, Heterodera glycines
  misc_feature (8)..(8): n is a, c, g, or t
  Promoter: Source sequence=SeqID_10069; Location=1..961; Strand=+; Gene=SeqID_73135
tgaaatanccttttacttgggttaagaattaaaaaatttagcctattaaaatatttagaaatttttttattatattgtatattttttgaaaattttccgatttccgacgtttttggggtcggaaatccgatttccgacacttccgaaaattttttgggcctcggaatgccatccctgataaagaccgccggaccccctgttcctagttttttgaaaaattgcaccgcaaaaaagtggttttgaaaagaaaaaaatagtcaaatttatgaaccgttaataatttgatttccgatcaactttttaccgtcggatccaatcggaaaattttagtgacacatcagcaccttttaatgcatcccgccagcccctaaaaatttatttttcagcattttttgatttttggaaattttttgaatttaattgaatttttcgaattttccaaaatcccgcaatcccgcacgggatcccgcaaattttaaatgcgggatttgcgggatttgcgggattaatcccgcgggatcccgtcccgcaaaaaaatttgagttccagtcccgcagcgggatccgcaaatttgaaatttccggtctctatacataacatatgtatgtctcaaaaaagaagagattctttacttggcatggacggtaaaaaagaaaaaaaagcggcaataaatcttttttatggataattatgggaaaaaattggcgttctgtcacatttactttttatctttatttctctcacttttacgtactatctcttcattcttaataatgtaaagaacaacatttacttcgctctatagaacttttttttcgccttacagaatttcttcatattttgcatatcgatagagaaaaaaattctgaatcgattaataaggaaatttaatgcaaaaataaggccaactttagagttattttaaccgaaataataaaattatttttttcaggaattaatg

SEQ ID NO: 103228 - DNA, 75 bp, Heterodera glycines
  Promoter: Source sequence=SeqID_12814; Location=272..346; Strand=+; Gene=SeqID_76539
tttttcgagaagggtttctataaaataacaattgttgatgttttggacagtttggcatgaatttgcaacaaaatg

SEQ ID NO: 103229 - DNA, 184 bp, Heterodera glycines
  Promoter: Source sequence=SeqID_180; Location=1752..1935; Strand=-; Gene=SeqID_76516
cccccccccccccccctatacatggatggggcaaggccgtcttcatatgcattcaattcacttccattttaccccaatcaaaatagttatttcaaaaatgttgtttcattattttttccactttttaacgaaaaagtttaagaaaatcccaatctaagttttttttctgttcatccacgaaatg

SEQ ID NO: 103230 - DNA, 685 bp, Heterodera glycines
  Promoter: Source sequence=SeqID_5450; Location=1654..2338; Strand=+; Gene=SeqID_58094
aactaatagtgttttaatggaatttaggagccccaaacttttcttggtttcaaaaaatggatgaaaattattatttttccaaaattcattattctttttgatttttttattagagtgtcgggtttttttagggtctcgccgggacaaaatctcgccgcaaaaatttaaaaaaaattcaaaaattgaattttttcaaggaaaaaatcttagaaaaatttattataagaaaatataagaaagaaaattattgttaagtttttcttgaaaattgcgcggccaaatttggaagttccatggcataaaaaagcaattttttctaaattttgaaagtttttacttttaatagaaaacttttggttttgtgtagcagtctctaagagattttggtcaaaaacgttttgtcaaaaacttattgtaaagatttctcattcgttttttggtgcaaaagttccctttttagggtttttgcttttttgttgaaatttattagaattttcacaacagcttagcaaaggaatagtttttttaaatattgtgtgcccaaaaaacgcgctccagttttaaataggctatgaaaataaaaaaaaactttctgaattcggcgtttttttaagggccagaggctttttgctgcaaattttttaagatttataattttcatgactttttcagcacgtgcgcaatg

SEQ ID NO: 103231 - DNA, 471 bp, Heterodera glycines
  Promoter: Source sequence=SeqID_8505; Location=678..1148; Strand=-; Gene=SeqID_68324
actataattatgtcaaattaagtgatcattcaattgccaattcactataattatgtcaaattaaagtgatcattcaattgccaattcactataattatgtcaaattaaagtgatcattcaattgccaattcactataattatgtcaaattaaagtgatcattcaattgccaattcactataattttgccaaattaaagtgatcactagagatgggaatttaagtcaactgactttttttttgctgatcttaaatggcctaaaaatgactttaaaatgttccacactttgtttgaagcttctaacatgcattttttgtgactttttggcgattttttatggcttttttagtccactttttggagatttttcgtgacttaaattcccagccctacacctatcacgaagcaacagatcccacattcattcactcattaattaacattcttattgtcaccaaatttgcccaaatg

SEQ ID NO: 103232 - DNA, 85 bp, Heterodera glycines
  Promoter: Source sequence=SeqID_5815; Location=1451..1535; Strand=-; Gene=SeqID_46128
agttcgtaatttagcttatcaatttggcaaaatccattattttatgcccgattttggtcaattcgttcccttttctcaaagaatg

SEQ ID NO: 103233 - DNA, 988 bp, Heterodera glycines
  Promoter: Source sequence=SeqID_3361; Location=2470..3457; Strand=+; Gene=SeqID_84374
atcgctgataaataaaatttttcgttgagttggaacaatggggaagaggaggggagggttggaataagttggtaaatgttttttcacagaattttgggaacacattaaaatataataaatgctcacgaataatattggtccgcatagtgcatcgactaacattatgccagcgtcaatccccctcccgtgccggcaacataagccacacaaaatagccaccaatccatccccatcccctgccggatgttggcaactaaaaccatacatctggcctatccatctgtgggtgggaggcaacttaagcctcccaatccctcctcaacccctgccgaatgttggcaactaaagccacacacccggcctatccatccgcgggtgggaagcaaagtaagcttcccaatccctcctcatccactggcaggtgttggcaactaaagccacacacccggcctatccatccgcgggtgggaagcaaagtaagcttcccaatccctcctcatccactggcaggtgttggcaactcagaccatacacacggcctaccctttcgagggtgggaagcaacgtaagcttcccaatccctcctcatccccctccggatgtaggcaacttaagcctcacatccgaccttttggggcatttgaatccaacctcttattctcaatccttcactggttgacatcatagccatataaacccatttgattttttgattttaaaaacattaatacaaaatacgtggaaaattaatgataaacaaagaaatgccaatggtcggcgggaaggttaaaaaacttctatgtaattatgggtgtgtgtgtacaaacgtccttgagtgtttcggaaaaaacgagtgacagagagcaaaaattattgcttacgtatgcaaaaaacagccaatcggacaaaaaactcttgtgaatagctcctatttaagtagctagctgctcgctgctgctattcaaaaatggagcacccctttgaaatg

SEQ ID NO: 103234 - DNA, 725 bp, Heterodera glycines
  Promoter: Source sequence=SeqID_4189; Location=762..1486; Strand=-; Gene=SeqID_53524
aactaattggttgaggataaaatcatttaaacatcacgggattacgagctacttaaaattttaggctttaaacattgacatagaagcggaaacttttcaaaaatctttaataatagaaaagtactaatgtgaccattaataaaaaagttccattcatcagggtcatgcatatttaatgctcaattacgttcatttcctgtttgaacagctttaaccgaacgaatgcaacaaaattgaaaagtgattaggacgtcataaagaaacacatgagtaaatgaacattagttaattattttgaattgcactaatcaaacaaagaattctgaacttagtgataattatttcaactaaaagaattggctatttaagccgaaataaaattaataatcatcaattcattaaatcgtttaacaaaagaagagcctttgaagaatatgcagccccaaactcttctctctattttagtcattcttctgcaaatattcgaagttaactcattgccggtaaatttttaatattttaattaaaattaatttaaaaacatttttgttaagctcttctcatcattttccccatctgcgaatgaaagcgaagagatttctgtcaaaaacaatgaccaaatatttggacaagaagagcacaggcaaaagaaaagggaggccataaatgagcttgtcttcaatgatggacaatcaaaaacaataaaaataataagcaaaaatatg

SEQ ID NO: 103235 - DNA, 937 bp, Heterodera glycines
  Promoter: Source sequence=SeqID_5233; Location=1..937; Strand=+; Gene= SeqID_57381
atcacgaatccggcatccatttcgacatatatcgagccccgacgcgaattcgaacaaaaagtcgaaaattcaaaaaatttcaaaattcactttgatgttcgaatctatgtagaatgattattttcacgtgttcgcaatggtttctagttaacttgcttgttttaatctatttagaaacaaaaattgaattttgaaatttttttattttcgactttctgttcgaattcgagcctggggttcgaaataggtcaaaatggatgccggattcgtgatcaacgactctcgaaagccctggaagcatgttttcatgacttttgaaaacaaaaaaaattgcatcaaaaaaaggggggcaaccatcggcagtattacccaaattaaaaaaaatttcgttttattaatttttgtctaccttctgacaaaagcactatttcctctgtgtctcctactttgttggttcccatgggcagagagtaccaacaaataaattaaatatatttcgccaccagcagtgctaatttgcacaccccgaaaaaagcactggacaatttcgcgtaaaattgccaatttttgatacaaaaatctcaagattggcataaaaggatacaactctatcttcagatccttgacattttaattctcgtttatttatccaagctgtttgaaaaattgtgaccgattttttaatgatttaaggaaaaatctgtaatttttcaaaacgctcagtttcattgaaattgcgtttgcccatcgttgcctaaattcatttgaatttgtaacttttgtacaaattttttctttactttacattttgttcgtttcctctcttatctttcttccatttgctatttttgagctacccatttccttttttgctctgtcatcattttttcgtacaaattttgttttttttggccaaaaaatcatttttcaggaaatg

SEQ ID NO: 103236 - DNA, 110 bp, Heterodera glycines; identical to SEQ ID NO: 98226
  Promoter: Source sequence=SeqID_32520; Location=686..795; Strand=+; Gene=SeqID_62825

SEQ ID NO: 103237 - DNA, 113 bp, Heterodera glycines
  Promoter: Source sequence=SeqID_36519; Location=1..113; Strand=+; Gene=SeqID_65806
aataaaatgtatttatttgtttagattttgtttattttccatttatttttattttattatcaccaattttaaatattaaaataattttatagcctattttcaaaaaagttatg

SEQ ID NO: 103238 - DNA, 251 bp, Heterodera glycines
  Promoter: Source sequence=SeqID_3378; Location=2185..2435; Strand=-; Gene=SeqID_84452
ggtcaattcggcacccccttttttgcttaatttgcatttccattctttcgcattggttttgtcggcttttcctttaggatcctcaacaaatccctcaaatgcttttgcacatgcagcagctcctcgccggtcttccccccaatttcgtctcggcctcgggcggtgcgtccgccggcacttcgccccctctgtcgaactgcgtcgtgtcgtgcctcggctcgtcctcgggtccctctcccgtcgaacttatg

SEQ ID NO: 103239 - DNA, 123 bp, Heterodera glycines
  Promoter: Source sequence=SeqID_6264; Location=4785..4907; Strand=+; Gene=SeqID_60940
attgaaaattggccattttttactcaaaaactggtctttgttacaataggttataagccgcggaacacccaattgttggccatctttctgcggatgtttgtgaagatattttgtccggaaatg

SEQ ID NO: 103240 - DNA, 116 bp, Heterodera glycines
  Promoter: Source sequence=SeqID_1882; Location=2401..2516; Strand=-; Gene=SeqID_76555
tttagttcctttttacaataattattgaatgaataaaacatatttacaaaacaacaaaataatgaattgttgagttagtaatcgacccgattcagaatgaattggccataagtatg

SEQ ID NO: 103241 - DNA, 102 bp, Heterodera glycines
  Promoter: Source sequence=SeqID_16144; Location=1..102; Strand=+; Gene=SeqID_80506
gatggcatcgtcgacgatggccaaatgttgaaaaatgatcacctgaaagtgtttcctccgctcagttttcctatcggtacccaaatcactttgctgtcgatg

SEQ ID NO: 103242 - DNA, 1003 bp, Heterodera glycines
  Promoter: Source sequence=SeqID_13710; Location=1448..2450; Strand=-; Gene=SeqID_77632
gtgcaacaaataagctcagattaattttcaaaattttcaataaaagccaatttttgcagaaattggttaaaaactcttacagaaattctattctaaaaattagggtaggacgggaccgtgaccaaaacacggacaactgagtaccaaggtcccggttttcaccagttttgaccgggaccgcgaaattcccgggttttttcccggttttccaagtctaaaattcccgggtttcaacccaaaaagtcccggtcccggttgtgcccaaaattccggtcccgacctaccctactaaaaatgttcttaattactatttttattaaaaatttttacatactctaaaaacaaaaattggtacgaaggcataaggcttaaatgttgaaacaacaacttacggtcaacaaatattttttcaatttttttttcacgcatttcaaaattattgaaaatttgcgccagcacgagtgaccacggggccgggcgccgcgcttagtgcgtgcgtcgacttggcagcgccgggccgcccgtcggactgtccgtcgagagcgaatctgtgcaacgatgcgatatacagagatctgatgacacaacaggcacgagagcattaaatggcattttgccggaagaattaaaaaaactataaggccggggaggttatttcctaaaaggtaaaataaaaattgacgaaaattttgcaattttccttattgttttcccccttcaaaatctctcacacaaatgtctcaaaaaaatttcgctattttttccaaaaacccacaaaaattggctcaaaatcgcaaaatgatggtcatttttagatgaaaatcttaaaaatttatcccggcggcgcctacagcaccgaagtttttgaattcatggcaaaatcccgactcataacgtaattccgagatttcggattcgaagattaagtgcaaagaaatgtattcaattgtttaacaaattcaaaaattgcttcttttttttttgttcagtgcccacaaacatg

SEQ ID NO: 103243 - DNA, 54 bp, Heterodera glycines
  Promoter: Source sequence=SeqID_3993; Location=424..477; Strand=+; Gene=SeqID_52726
ggtaaacagaagcaattgagtaattaatgatcatcagcaaaaccaaacaggatg

SEQ ID NO: 103244 - DNA, 336 bp, Heterodera glycines
  Promoter: Source sequence=SeqID_11005; Location=1..336; Strand=+; Gene=SeqID_74324
gatgtcatttggcgccacccccggaccctccaaaaatgtttgtcctcttctcacagtcagccaaaaaaatcacccagtccgcctcctgacccttcaatgtaaaattagtttcatttgcctcattttacttaggtttctatttccattaatttcaatgaaagtggtggcggtcattgcgcatcggtcatcaaaaggccgattggccgtcaaaaagtgcttttggttgaacagcagcagcaaagccaaggtgcagcgcacggttttgagaagacattgccaaattgcaactcaaaaattggacgcacaactcgggaaacgacccattcgaattcaatg

SEQ ID NO: 103245 - DNA, 275 bp, Heterodera glycines
  Promoter: Source sequence=SeqID_29929; Location=388..662; Strand=+; Gene=SeqID_60402
tttgaaactaattaatgggaacgcatttttggatttattctgtttcccattaactttgaattactctctaaataacctaaatgttgttttgagttattttcgaattttagatcctaaaaatcccgtccctaatcatcataagtcctttgaatctttgttccgtgtggggcataatttaaaaaatattttttaaatttaatttttaatatttattttttgttttgattttagtcccgtgaaatttttgttttttatgggaaatatttgtcaaaatg

SEQ ID NO: 103246 - DNA, 417 bp, Heterodera glycines
  misc_feature (62)..(62): n is a, c, g, or t
  misc_feature (69)..(69): n is a, c, g, or t
  misc_feature (106)..(106): n is a, c, g, or t
  misc_feature (111)..(111): n is a, c, g, or t
  misc_feature (119)..(119): n is a, c, g, or t
  misc_feature (146)..(146): n is a, c, g, or t
  misc_feature (156)..(156): n is a, c, g, or t
  misc_feature (173)..(174): n is a, c, g, or t
  misc_feature (184)..(184): n is a, c, g, or t
  misc_feature (192)..(192): n is a, c, g, or t
  misc_feature (195)..(195): n is a, c, g, or t
  misc_feature (199)..(199): n is a, c, g, or t
  misc_feature (243)..(244): n is a, c, g, or t
  misc_feature (257)..(257): n is a, c, g, or t
  Promoter: Source sequence=SeqID_13367; Location=1..417; Strand=+; Gene=SeqID_77241
gcaggtctcgtacaacgcacgttgagatatcactctgaacagtctgaatctaccatgggagngaaaggngggcattggtcttttactggaactttaaattaatggnaattngttggagnaattataagggaattctgggaattggnaattagaaanttaattgttggtgttannaggtaattanatgatatnggncatnttaaagaaatttaggaaagaatgaaatttagaggaattttgtgnnggtggaaagtcangggacgattggtagggatgggtagtagatagaaagaatgaatggtagaaaatgatcttcctttgccctaaaggtacgtcagccaaacttgcccggacagtcagctgatcacacactcccctccgctggtgtacgacctttacagggacccattcgaaatg

SEQ ID NO: 103247 - DNA, 227 bp, Heterodera glycines
  Promoter: Source sequence=SeqID_2491; Location=3936..4162; Strand=-; Gene=SeqID_80033
aattcgtgccaccgacaaatgtgattccttcaccatttcacacatttcactccgccggacggaaatgcattgacttttttgaaaaaaatgggtcacccgtagaaaaacgtcaattagaagaaattatggcaaaatcgggagcaattcggcatgccaagacgcaagagtatactggtcctgacattcacctctttccttttttcaaattaattttaggtgatcacatg

SEQ ID NO: 103248 - DNA, 116 bp, Heterodera glycines
  Promoter: Source sequence=SeqID_5634; Location=1..116; Strand=+; Gene= SeqID_58717
tttattatttataattttttaaaatgtttattttgtttgttttatttttaataaatttttcttcgagttataatagccctattctttaccctgaacgatccagggacaccgaaatg

SEQ ID NO: 103249 - DNA, 1003 bp, Heterodera glycines
  Promoter: Source sequence=SeqID_19407; Location=76..1078; Strand=+; Gene=SeqID_84133
atgaatctgaaggaatttttcgggggtcatcatttcctgatgagttacatacacgggactcaagtgtccaaatccagcggtactaaactatatctatccgtggctaaaacaaaatacctaattcattagttaaccgttgattttgtttttaggcgaagcctaagctttaaagtagggtagcacgagaccgagaccggtaccgataccgatccggtaattaccggttttttcaggtaccggtaccggtctcggtcccggtttttgaaaaaagtcaagtctcggtcccggtttttgagtatcggcggtaccggtactaaccggtactaaatatgcactggtaagaatggagttctgagagcaaaagaaagagagaaggttgggaaatgggaaaatatttgtattttgaataacatttcgccaaattttacagtcagtgggttgtgtgtcaagcaattgtccacctcatttatttctttcattttttgatttccatctactttttttcatttagaattaattgattaaaatgtctgatatttggaaacattacaacaaaaatttgactggtgcaatttgcaaaatctgcgcaaaaaaagtcacccgaagtgacggctctactacaggaatgtggaaacatttggaagcaaagcatcaaaaggaattttctgtgttaaaaaacacagaaaatttagggcaaatgggggaggataaggtttattgtgatttttattgtaatagagactaatttttagaaacaaaagcaaatacaatcttttttggtgacaaaaaagaatgagacggaaattgctgaagaacgcatcgtgcgaataatggtccggcaaaacaattcattctattttttcgatgacccagacttaaaggatttgtttcaaaaagcacatccgaacattgtacatcataatatatcttatacattgtgaatttatttttgaaggatcttggtgcacgagaacattttcgccgaaaagtgattcccaggatg

SEQ ID NO: 103250 - DNA, 69 bp, Heterodera glycines
  Promoter: Source sequence=SeqID_2195; Location=6055..6123; Strand=-; Gene=SeqID_78423
tgctgattacacgaaacggtccaacagcactaccaacaactaaacttttttgtttaaacccatgttatg

SEQ ID NO: 103251 - DNA, 57 bp, Heterodera glycines
  Promoter: Source sequence=SeqID_14010; Location=678..734; Strand=+; Gene=SeqID_77981
accagctcccagcgccggacacgctacggtacccagcggcgctagttgtgaacaatg

SEQ ID NO: 103252 - DNA, 404 bp, Heterodera glycines
  Promoter: Source sequence=SeqID_8761; Location=1017..1420; Strand=+; Gene=SeqID_69139
ttcaaattaattattcaattgttgtggccactttcagtcccctcctccacattcattttccgcatacgcgcaattgtcaaaccgaatagaaatgttgtttcgttacaaaggcgtacacatcagcaaatgtgagagctttttcaacaatttgcatttcgaatgaacaaaatgtgtgtcccccgccttcgctaattgcctttggttccgtttaatcctttacaaaagcaccaatttgcataatttcacccatttggacgttaaaggactaacgcatccaaccaaataaaaataattgctcacagcttggttaatttcttgtctgaaagagtttcattttgcagtcgaaaacttttagcgccctctcaaatccattccgactttttttcctgcgcaataagcaaatg

SEQ ID NO: 103253 - DNA, 538 bp, Heterodera glycines
  Promoter: Source sequence=SeqID_2314; Location=1..538; Strand=+; Gene= SeqID_79074
ataaaaaagttatagccaaaaacctaaacttttttgaatctttgtacacagataatacataagtaccaaatctggaatttagtcagtttttttattcttattctttttgttagattgacgtcccaaatgagcgaaagttggagcgcgcgcgacgctttgcggatgacgaacaacgaacacaacgaagtcgaccaatgccgtccagcagacgacaaccgttcagcaagtggacataaatagaacacaataaaatatatttttttttaaatctcataattttccgcaaatcttggtcattcctttaaaatagggttgtgtagctagtgttcatcttttaaccgaacagaaaacttgttttttggtgccaaaaaacaatgtgtaccagcagcctctatcaataactgaccgtgcacaaagccttcttaaaattttaaaccaatgagtggcatttgattcattaaatttagaaaaaaaactattttaatttaaaaatccttcgttaaataatttatttaaaagattttccgctgatgctatg

SEQ ID NO: 103254 - DNA, 583 bp, Heterodera glycines
  Promoter: Source sequence=SeqID_17897; Location=918..1500; Strand=+; Gene=SeqID_82449
acttgaagaattgaagaaaatgcgaaaagaaactttttttttttactatttattgttaattatataattaaaaaatgttatagaaattaataaaattttaaaatgtatcagggaagaatcttttaaaattttttaaaaatttaaacaaataataatttaaaaaaatttttttgctatcgaaattacagtaactattaccaacaaaataatgaacaattaattaatttccaataaaaaattatttaataaataaaataattcgtgattattacaaaagataataattaccaataaaataattagtaataataactaagaaaataaattgtaattaattacaaataaaaaaaatagtgattaattagcaataaaataattaggtatatcaatagaataattagcaattaataatcaattaaataattaaaatgtttatttgcctaccgatgcccattccacacgttttcgcatttgccatgccccgtgcacgctgcacgcgcacccagtcgtgaacacgtgtctgccaactgctcgcacaacgcgccctcgaactcacgcgtgcagtcgcaggtgaacaataatg

SEQ ID NO: 103255 - DNA, 1003 bp, Heterodera glycines
  Promoter: Source sequence=SeqID_7220; Location=997..1999; Strand=+; Gene=SeqID_64179
cgtattttctcaaaataccgatctctaattaatacattttttaaacaaaattatcaataaataaaaatagaccattcttggcataattgttaacagattaaacccaaattttcaaaaaatttttactttcgttgaaatttaaaattcaattttcatgactaaataaatcatgaaaacaatatatttcaaaatattgacaaaatatcgaaacaattaaatttcaaaattcgcttggccgagtccaaaaattcgtaaatcttattaaaaaaattggctcaaaatcgaaaatattcagcactttttgggcaaaatctgttaacagacccatgtaaattttcaaaaattttcccggcggcgcctatcggcaccgccggacccctttctcctgaaaagcctttagaaaaagcgcgccgagaaaaaaagatggtttgaaaacgaaaaaagtaatcagaaatttttgatcattttttgaataagattcacttttttcaaattgccggatccgaaaccggtttccggattgggaaaaatttaaattttcacatgttaatatttgtaaaaaccggcaaaatttcatttattaatatagaaattcgatgcaccagaaatgtcgccgccaaaaagacataatgttgccgacaaaataaaaaattttaaaattttcaagatattaaagcatacaaaaatatttatgataaaaaataaataaataaatataaacaaataaaactttattatggaaattataaaaaattttgactatatggcataaggtaaaaatttaaaaaccccgaaccccgaccccgacccgaacaatttggtcgaccccgaccccgaacgattttgttaaccccgaccccgaccccgaacttgctgaccccgacaaccccgaaccccgacttttctaaccccgacgttcgggggtgcaaccctagttttttaaatggggattttgaaaattaccgtgaatataaaagtcaatgagtataatttttagaaaatg

SEQ ID NO: 103256 - DNA, 208 bp, Heterodera glycines
  Promoter: Source sequence=SeqID_4531; Location=1..208; Strand=+; Gene= SeqID_54791
gcccagattatagaagatgtttatgattagcaaaaaaaaaatgacaaaagaacaccaaattaatctccgaaaaacattttgccaaaaaattatttcataaattaaccctcccccccccccaaaaaaaaatttaatgcagtggaagcaatttttaatacaatttgagacgaaattaaaaaaaaaaaaaattttttttccatttaagatg

SEQ ID NO: 103257 - DNA, 534 bp, Heterodera glycines
  Promoter: Source sequence=SeqID_31831; Location=596..1129; Strand=-; Gene=SeqID_62140
agttcgatttggtgatgcctcccgtgctggccaaagtgtgcaccaaaggacccgtggaattgcaccaattgttgccctattaagcaattacgaaaatcactaatcttttcactttgcattatttgtgcttacccgcaaaaatgaacctattttattgagtgagtattaacgacaaaattttattagcagttagagtaaatttcaaattgccttttctaaagtccataattcatattgaaataaccgaattcaaatgtaaaacatggattttgagtgcttcggctttttgttcgaattcaagtcaactcaactgttcagaattgattagatcgcctttcccgcattggagtccgattagggactgtgccatgatgcaggtcgagccgatcgaagacggcatctggtgagataaacggaaacacccattcttcgacaatttcacaaatctcgagtcaaattcagattcaggacaccgctgaccgagtaagagaattggaaagttcgataaaggaactcgagaactttacagaaatg

SEQ ID NO: 103258 - DNA, 804 bp, Heterodera glycines
  Promoter: Source sequence=SeqID_19860; Location=220..1023; Strand=-; Gene=SeqID_84618
tttcaccacaatatttatacctaatattctaattttataaaaattaatttaaaaaataaccatgctgcaatagtagcctatcctaacaaggtgtcgttttcattttccaccgcttatggttatatatttaaggctaaaaaactaaaactaattgctaaaattataatttattgtcagattttttaaatatttttttaaaaaaaattgaaaaaagcgtacacctagctaaaaacttttttgagagtaatatttagacgtaacaattatactgttgatttacctaattatgctgaattgttaaacatttatgatcaaaagtcgcttgaaagtcgtaggttaaaaatagacttaaaactttttcatgaaataattttaggtaaaataaatttacaaaataacgaatccttttctttttccaaaaaccctgtaaaaaacgaattcactataagaatagcttattgctcaaccaatgttagatacaactcgttctttattcgaacctctcgtctctatagacttttacctaaagagacgagattactaaatcctaatgagtttgccaaacttcttgaaagatctgatcttaatttgttgatttctttgccaccccaactccaaaagtgaccaattgattgttttgatattattatttctttatttttcggcgtcacgcttttgcgtataaatgattgattgattgattaaaaaaattcaaaaattcgagccataagaacaggcccgtaaatatttaaacgagtcacgatttgcaaagtcctctataagatttctcaaattgttgcaatg

SEQ ID NO: 103259 - DNA, 76 bp, Heterodera glycines
  Promoter: Source sequence=SeqID_23034; Location=766..841; Strand=-; Gene=SeqID_53735
agtgagaagagaagagaaaaaatgtgaggagaggcgggcagcgcggcgtttccattcgatcagtcaccacagaatg

SEQ ID NO: 103260 - DNA, 315 bp, Heterodera glycines
  Promoter: Source sequence=SeqID_38603; Location=301..615; Strand=+; Gene=SeqID_67372
tagtttatttgctaaaatcaagcttacaaaaagcggttaggcatttaaaatttaagctccgtaaaaattcaattaaaaatcatcacatttatttttttaatttttcaatttttaaatttttcttttttggcgaactgtctacccttgtaacttctaaaaaaggagttgagaacttgagactgaaatcccgcgccagatcccgtcccgacctgtctctgttttccatagtgaacaaataattattgttgtatttttactctttcgctgctccatacacatctctttcatgaactttagacaaaaagtattttaatg

SEQ ID NO: 103261 - DNA, 1003 bp, Heterodera glycines
  Promoter: Source sequence=SeqID_1514; Location=3789..4791; Strand=+; Gene=SeqID_74124
aatgcagtggcaagtcaaaatctcaggaacaatcgagcggtcattaactcattctcgatagttcaaaaattgcctgcccctgtcccactctgcctccactaaatcacccacctccctgtcccactctgtatccattaattaattatctcaattaatatttaatagccccccgcccttcccccagtggaaagccaagattcaattcgtgacgacggtcccgaggggttaactactaatttttattctattttaactgaataactaaaattgtatttatttattttttgttaaatttttaatatttctctcattttttctatcatttatcattcaatgaactttttttcatctcaaaatttaaatttaaaaacgaatcattttatatactatccattgtttcaatttagataccattaatcaattttaatgggattttatggaactgtaactgcaaaaaggtggaatttatactgttttttttaagttttaggtagattcagtattttcggtttttattacattattctaaggaatttcctgcaaaaataaaaaaattcgctttaatttagtttattttttgttgaaatattttttaattttaatgtatttattttttaatttaattttttggtttctttatttttgataggccatattttttaaaagaattcgattttgaatgaagaaaacataattatttcggttttaaaatgttttcattttataatttggaatttcgctacttttattatataattaaattcttggttagtctcctacacaaatccgcaataagagatttttaaaaaatatggctaattttgaaaattttttcaaataaatgatttgttaaatattgctattttttcttgttcatatattttgcaatgaaaaaaaaattaaattattgttaattaatagagaccggacttttaggcacgaaaacttctcaaataggcacctaaaataggcacgaaaaatgtgaaaaaaggcataaaaaatg

SEQ ID NO: 103262 - DNA, 68 bp, Heterodera glycines
  Promoter: Source sequence=SeqID_27677; Location=580..647; Strand=-; Gene=SeqID_58348
ttgcggagaaggcaaagcaagcgtaccaagaagcgttcgaactcgccaagaacaaactccggccaatg

SEQ ID NO: 103263 - DNA, 426 bp, Heterodera glycines
  Promoter: Source sequence=SeqID_3259; Location=2463..2888; Strand=-; Gene=SeqID_83948
gaatccgttgccaccgccaaatttaatgttttaaacagaaacactccatccctctctgcacggaattgtcctttttatgtgccttataagcatagtggtgtactattaatacccgtctccctaattttaattgctttcgatggagaggcggcgaagtggaaaaggtaattaattaattaggtacttatttgattaattaattgcctaattaattgatcggttactcgctaatcgatttctctcctttccctttccgttttgcgccgttccctcaaactgtgccgtgcccatttgctcctctcgcttacaatctcttccgttttagtcgacattaatcttggatttgtggcgtacgaaccatataagtaccaaaaattttgtggtatgttttgaagccttcggtttgctcattttacagatttaatg

SEQ ID NO: 103264 - DNA, 1003 bp, Heterodera glycines
  Promoter: Source sequence=SeqID_17195; Location=1325..2327; Strand=-; Gene=SeqID_81657
ccattatttggagcaaaaatggttctcaaatttcttgtttaaagctgaatggcagatataggtgagagagacagcagaactccttcgcgaagaagcacacagtgatttcccaacgtcaagcaaaaacatcatcagggaagtgcgtgccgatttgccaattgaagttagcgcagcttctgctccttcaccatcaaatatgcgttggaattactaataagcagaattaggaacggtaattaatttaaataaaactaaattaaccaaaactgatcagatttgtagacatatttgattagtgaaagaatataaaattatattttttttaataaattcaatttttaaaacaaattaattaaaacatctctttaatataagaataataataaaaaacattttgatgctttcttggacaagaaaattcaaataaaagcgtgaaaccgggcataaaataccacaaaaagaccaaattatgtttaaatgtgggtttaaacctaaaaaaatataactaaaaataaacttacagtgaggcaaactagtagaaaaatatgtaaatatctattttaaacaatgtagaaaagccccatattatttctaaatgtatgcaaataaaaatcccaaaatgttcacattttatttgatttaaaaattcaaaacaatattatttcctgtgtttttaaaaatttggaccaaatctttggaattcaacaattttctttaattgtttattgttttttaaattttaaatttttctgagggcggccggcggtgccaatagacgccgccagggaaaattcaaaaaatgtatgcattttattaacagattttgtacaaaaaatgacaaaaattgccaattttttgatcaaattttagatttttttgtggagatttcaacattttttaaaaaatatttatcaaaaatttacaaaattcttgggaaattgagaaaggctttggagagggtttcaagaaaagccataagccatttcaaaaagatagaaaaatg

SEQ ID NO: 103265 - DNA, 1003 bp, Heterodera glycines
  Promoter: Source sequence=SeqID_9483; Location=1107..2109; Strand=-; Gene=SeqID_71584
cctgatttttagacttagctcgttaagagctttcgaatgataccaaatttgttcaaaattttttatttaaatggatttttggatgatttctgaggcaaattttcgtgatttaaaccgattcaaaaacctgttcaaacgctttgccgcgcagtttttttgatggtttaggctttttcagcacctaagaaaacctataaaagtggttttgggtgtttttgagttgggagctatgataaacattttcccaatatgtatttttgtgattccgtataaaaaaattttaaataaaaattttctatgtcctgctattagttggaattgcaatttttcttttaatttgataaattaagttaaaatgaatttgcagactcaaaacaatattttatgatttcttaaatcgtcggcattaaaattttaatttataaaaatataaattttccaccatttaagcatataagaaaaaaaaagataaaattgtaattttattatgtaagcataactaattaattattacaaatttaaaatttttgcgtaatacattgaaagtcggccaaagattatgcaaatagataaaaatattagatttttattgtttttgctaaatttacccgctccattcatcagttgtgaattgaagccattatcattcttctaattttcattcgattttctcagttcttatactaataaggaagaattaataataaataaaaattttattaaaagattaatcttgaatttgatatgatgatatatttaaatttataattaattaacattatctaataattaggtatttaaaagagccctaaatatataattgctaagttttgaaattattatttacattaatgttttaccgatatcgttttattaaataaagaatgttatcatttataaaaaatgctatttaattatattttaaaaattattgatttattattttgcatttatatttattattaatttttactattgaagtttttaggtttttatcatcatg

SEQ ID NO: 103266 - DNA, 454 bp, Heterodera glycines
  misc_feature (162)..(162): n is a, c, g, or t
  Promoter: Source sequence=SeqID_24220; Location=1102..1555; Strand=-; Gene=SeqID_45847
tcatcttggtcaaaatttcgaaacatataatattttcaaaatcaggataaaaatcaatgattttttacaaatctgatatcatattcgtgatcagaagctccggaaacccccgggttgaacttttcacagcattaaaataatttttttgggtggagcgcagantggccagtattaccccggtttacgggattcccccggctgcgacccggatttagaggcaggcatcaatttagaagcacaagtttagcattttgcagaaaaatcggtacacccttttccaagtacatatattttaaatttgaccacaatttgtgtttgtctgaattagtaatgctttttcccaaatgaggctaaactcacaaatatcgaagccatccttcagaataaacaaatggtagtgatcgattttaattcataaattcagcttaaattatatttgctacttacaaaaatg

SEQ ID NO: 103267 - DNA, 87 bp, Heterodera glycines
  Promoter: Source sequence=SeqID_19608; Location=881..967; Strand=-; Gene=SeqID_84349
aaacaaataaaaatatccttttaggcaaaatattgactaccctcccgccctttgaggattatttccccgatgaattaagtgaagatg

SEQ ID NO: 103268 - DNA, 111 bp, Heterodera glycines
  misc_feature (58)..(58): n is a, c, g, or t
  Promoter: Source sequence=SeqID_43327; Location=1..111; Strand=+; Gene=SeqID_71031
ggggtcaaattttaactttttttttttttttactttagactattcaaaaaagaaagtntaggcaattaaattttttcgatgctatgacattgggcaaaaactatcaaaatg

SEQ ID NO: 103269 - DNA, 79 bp, Heterodera glycines
  Promoter: Source sequence=SeqID_30821; Location=1437..1515; Strand=-; Gene=SeqID_61199
tttttcctccttcgttcgctgccaaagatgcgcaacaattggtcgaggatggcaaaattgggcaaatgccaccgaaatg

SEQ ID NO: 103270 - DNA, 144 bp, Heterodera glycines
  Promoter: Source sequence=SeqID_8424; Location=847..990; Strand=-; Gene=SeqID_68013
aattgtaattgataggaaagaccaaatttatagtttaagatccatttacatttatgcctttttggttttgaccttataatctatgtttttgataatttggatcccattttgacataggaattatcatcaattcgtccaaaaatg

SEQ ID NO: 103271 - DNA, 457 bp, Heterodera glycines
  Promoter: Source sequence=SeqID_11202; Location=337..793; Strand=+; Gene=SeqID_74554
ggtagtgtagacttaacttacattatgcgaaaagtttgcaattaacacatttgagtcaattcgaatgcgaaaaatagttcaaaaattaatttttcatatatggggccaaatggtttttttggatttcgattgtttttcgggtccagtgcatttacagtgtgacacaaaaataatacgtttaccaacaaatttgggcacattgaaggttccactgtaagaattttgtgaaactgtgcaagaccaaaaaagttatgacgagattgatagtattgcctaaaaaatattatataaaacaatttcataaaaaagaataatatgtttgtaataaaatttcaaaaatgcaataaattcatttgttttattcaattttattatattaacaaaagagacttgaatatacatattaagccctgttcctaaattaaatatttttaaaaaatataggaaacatcgtatg

SEQ ID NO: 103272 - DNA, 587 bp, Heterodera glycines
  Promoter: Source sequence=SeqID_9865; Location=1647..2233; Strand=-; Gene=SeqID_72894
atttgatatttaattttaatttaatatttaatcaatttaaatattttaaatttataaatcattgtttcaattttaatgcaatttgaatttttaaatttattgctatttattcatgtcaagtaaaatttttaaagaaatcttaataaattttactaaaaaaaaaatttaaatttgttttttttattatgcaaacaaaaagcgaatgaatttttttcaaggatcatgtgtcatccttccaaacaaaaattttaacaaaaaaatttttggcttttattagcaattagcattttcaaacggcaccacagtaaatgattttttaaatttttatttctgaaattatttgctgaatttaattttaaaattttaaaatttttatttttttaaatttctctttatttacgtttttttacaaaaaattgaatttatataatttttagaaccaatttaaaaaattttaaactaattttagaaattttccaggtgaatttggacagccaaacacgcctttccacccaagcggcattgtcggttgtgccgttgcgtgccgacatgttcatgttggcacacaaaaaaattgccaactgatg

SEQ ID NO: 103273 - DNA, 617 bp, Heterodera glycines
  Promoter: Source sequence=SeqID_4069; Location=1..617; Strand=+; Gene= SeqID_53053
aaagaaaactcaaaacagagttttttaaaagaaaactaagaaaaatatttctcaataaaatttaagcgattttttggaaaaattatttgaaaaatatcggtaattcaccataaacattttcgaaaatttttttcttagttttttttcttgaaaagtctaggttagtaaaatttcggcgctttttggcatgacaacgttttgtcctgctccatatataaatatcattttcaattattcattttaactaatttttgttaagagcctcaattctgcccaaagagcgtttgctttggaagcaaaatataccgagggtaagtttcaacgagggaatatggttgcttaacagaatttttttaaatacgttttggtcaaaatctttcagcggcattggataaaagcggagcagggcggttctcccccggcatttctggcccaaaccggcgtctccccctaaaaattaaaaaaaaattcaaacaaattttcaagaaaaatcgcagtaaaaattttataattttttcgaaaaatttctgttataattttatatttttcgcaaggagggtggggggacgacgcgtgggggacacagcggggaaagatgaagtgcactcgtatacatg

SEQ ID NO: 103274 - DNA, 332 bp, Heterodera glycines
  Promoter: Source sequence=SeqID_25644; Location=1086..1417; Strand=-; Gene=SeqID_56397
ggttatttttttagtcatcaaaatttttagcgcttgttgaaatgtggggacttcttggttgtaaatttttttaggtcgtgtaaactgcaatagtgctaaaaatcgtaaaacttttcccgaggttttcagagtcatttccgaatccctgttcagaaatataaaaatgtttttacgctaggcatcatattaaaataaattgctgtccaattgggtccccacttggcttttaaaaattttcaaaaagtgctacttttcaactaacgctcacattttaaatggaattccacgtcctcattcataatttcgtttaggactttgttcgcatcaatatg

SEQ ID NO: 103275 - DNA, 80 bp, Heterodera glycines
  Promoter: Source sequence=SeqID_24244; Location=396..475; Strand=-; Gene=SeqID_54959
ggtaattcataaagctaaaattgtataaatattatatattaaaaatatatttaaatgcaggcggaattaattcggcaatg

SEQ ID NO: 103276 - DNA, 53 bp, Heterodera glycines
  Promoter: Source sequence=SeqID_16795; Location=268..320; Strand=+; Gene=SeqID_81213
ggtgggcatcaactgctgacaatcgagaggattagcgaatttaatagcaaatg

SEQ ID NO: 103277 - DNA, 95 bp, Heterodera glycines
  Promoter: Source sequence=SeqID_1747; Location=875..969; Strand=-; Gene=SeqID_75675
ttttaaattatttttatttaaatcaatatttttaatatctgtcaccaatttcttaatgattgtttttcgtctatcaaaacattaagcggaaaatg

SEQ ID NO: 103278 - DNA, 175 bp, Heterodera glycines
  Promoter: Source sequence=SeqID_20236; Location=542..716; Strand=-; Gene=SeqID_85038
gctgagagagagagagagggaaaggaagatagtggcagagaaaaagaggacaaacgaaagtgaaggtgaacagagagagcaccaaaaacacattgtaagggccgtatccctcgtggtttgtccatgtgccaagaagttcggaaggacacccgtggggggccaaaacggagtgatg

SEQ ID NO: 103279 - DNA, 546 bp, Heterodera glycines
  Promoter: Source sequence=SeqID_21872; Location=1..546; Strand=+; Gene=SeqID_52512
aaatctgatttttttgagcccggtgttcttttgaataatttttgatggccgtcatagccttaatttcaaaatggacgtattcacatgccatgtgaatgtagattagcaaaaagacattcgtcttgatatgtgaaattaattcagccaaagctcctaattagaatatgaaaatggtgatgaatttattaagcctttttacattaaatattttgccaaattgtttaataattgctcattttgattttgctcactatcacagaagtgccttactgaattaatttcgtattttatgatttcattttctttagcttcacttttctcctctatgtatgaagagattgcgatcatatttatagtcaaaaatttaatcaatttattttgtattaaattcggttaaaattacacaaatcttttatttttcttatttcttttaaaaaagactccatccaaacaatcttaaacatttttcgtaagccgaatcaaatttaagaaactcatgtaaacttttcactcatattaattctcttattaatcttgcaaaaaatg

SEQ ID NO: 103280 - DNA, 1003 bp, Heterodera glycines
  Promoter: Source sequence=SeqID_19109; Location=1029..2031; Strand=+; Gene=SeqID_83848
atatttttttaaagcaaatattcacctggtttttgtcacacacacgggaattcatgtttacttgagatgcaaatgcacgccaaaaaggaaatcgtttagacacacaaaatgaattgtaatttcacgtttacaaaggaaatcgttttagacacacaaaaagaattgcaatttcacgtttacaaaggaaatcgttttagacacacaaaaagaattgcaatttcacgtttacgtggagtgcaaatgcatgcaaaagggaaatcgcttagacaaacaaaaagaattgtactttcacgtttacttggtaaagaaaaaaaatttaaaatgaattttcaaataatttttcgtaatcaccaaattgaaataatgactgaaggtgataatttaatagtgcttcttgctctaacaaataagctatgtcaatttcgacatacttttttttctttaatcggaaaatttacccacaactaaacgaatttattacatatagtttattaggcaaattgattaaaaaaatgctttatacaaaaatcatatcacaaatatatagcacgcaaaatttttggtgtttcacccactagccttcttagtctaaagagcttagattttgatcaggtatacctaacaattaatatcaagaacaaataaaagatataaaaatatattttatatctttaaaaagcaaaattaaaatgaattgctcacattatcaatgacaacataattcttgtaaatcaggaatttataagctaatgcattgcacaagttgatcagatcactacttaaggatgatatgaagtgatcaaaatttttagcaccaagaggaattgaaaaaagaactttttggaaaaactttataaatttttgatgttttcattcgcattaactttcttaactccgaaaaatcacatataaaattcaatattgagatgatcatccaatttaagaatttttttttgaaaattaaatccagaaaatatgacccgcaaaagacggtccgcaaatg

SEQ ID NO: 103281 - DNA, 392 bp, Heterodera glycines
  Promoter: Source sequence=SeqID_28239; Location=1055..1446; Strand=-; Gene=SeqID_58879
tttaaagcacacttccattttctcacaccttaatcaccctatattttaagtatgtggaccaaccatgagaagccacaccaacttgaaaaatgccaacagaaattgatcagttccggaattaatgataaattgttaaaaaacaataagtcccgcgggactatttgtcgctttatctctcttttatcagttctgaggaactttaacacatcttaattttatttaaatataaaagctaagtctttgcaatttttggaacagactctcatattactcacacacttctgtctaagccctgcggagctaattaatgaattaaaaaaagaagtgagaattgataactcaaagctaaaatgctcaaaaaaaaatataacttttttttaattaaagaaatg

SEQ ID NO: 103282 - DNA, 200 bp, Heterodera glycines
  misc_feature (66)..(66): n is a, c, g, or t
  Promoter: Source sequence=SeqID_15511; Location=1591..1790; Strand=-; Gene=SeqID_79787
tgcttttcttttcgaaaattagcgatttcttccccttccaggggacacagccccccccccccacanccacccgaccttttaagcagcaccaagaaacaaacgggaagggggaggggccaaggccaaggcacaaagaaagcccaaaagctttccaggaaaagcagaaagaggaagcacaacgcggcgcagcgcttctgatg

SEQ ID NO: 103283 - DNA, 527 bp, Heterodera glycines
  Promoter: Source sequence=SeqID_266; Location=4342..4868; Strand=-; Gene=SeqID_80658
tttttactggaattttaacattctttgttgttttttaaaacaataaattctttttaatttatttaaatgttcactttatttactatgaacgcggagattttcagataataataaatgaattctttaaataatcaatgttaataaataataataaaaaatttcaatgtttccaatttatttagtttttcttttgtacggtggcgggttaacggctgggcgaaattaaattattttaaattttctctgcttctttataaattgctattaaaaagaacttaattttataaacctttataatttggtttgtttttttgcagtggtgtgtttatggtaaggaccaaaacaaacatttgaaattattaaaaatcattttatcacaagaatcgtactgataaggcccgctctcttttgttaaaattgcacttttcgcgaaacgccatttttgctattttcgcgcaatgacctagcaccatttaaaccggtcggcttcgcctttttcaatcattcctccgtatgtatcagggatg

SEQ ID NO: 103284 - DNA, 81 bp, Heterodera glycines
  Promoter: Source sequence=SeqID_37905; Location=1123..1203; Strand=-; Gene=SeqID_66878
cgtccaggctcagtgatcatcagcgatgaatggccggcgtacctgaaactggctctgcacttgccacagtacgaacacatg

SEQ ID NO: 103285 - DNA, 58 bp, Heterodera glycines
  Promoter: Source sequence=SeqID_16085; Location=1..58; Strand=+; Gene= SeqID_80439
tttattcgcctcggggggggggggaggaaattagccccttgaagttggacgaaaaatg

SEQ ID NO: 103286 - DNA, 524 bp, Heterodera glycines
  Promoter: Source sequence=SeqID_6707; Location=1..524; Strand=+; Gene= SeqID_62571
aaaactcaaactaaactattaccgagaattggggaattaacgaaaatttgaaagaattttgattatatcgcctaacagccagcgcacactcgactacgatggcaattacatatgtggtgcaacaagactccggaagaaagccgcgcatgtccgcatgcggttgactgattggcggggacctgattgattcgttggcgctagtttaaaagttcgatttgtttagaatttgcttggaaaaaattctcattttcaaaatctttttttaaatatcaaatttgttcaatttaattggaaatgaaacgagttaaggctgatcaaaaaaaaggcaattatcagtgtaatttttgaattaacgcaaaaaattcaacatgccaatgtaaaattcaaatttccttccgatctgccttgccgaaaattaggttgccccacaaaactcggattctaaaatccaattggagtttggtcagtccaacattttttgcttatgttttggtagcttcactcaattacaggtcaattaaatg

SEQ ID NO: 103287 - DNA, 433 bp, Heterodera glycines
  Promoter: Source sequence=SeqID_17992; Location=728..1160; Strand=-; Gene=SeqID_82555
agtgagtattcaaagcaaaaatacgaagttcaccttagccttgtgtattttatgagaaaaaattggcactgtgacaaaattgcgcaggaatttgaaaaatatgaacggacagaatgccaaaaatatcgaaagtattttgacgtacgaatatttgcatagagaatacgccggaatcccaacagggaagccaaaattcgtatttaaaaatattttgttgatgaaatattttcgggctttgtcaatggactagcagcgacaaatatatttcgcaattatggggatttttaaggaaatttttttattaaatgtgcttctttcttttttcattttcagtttggtttatttttatttatattctgtccgttcatattcattcaatttttttttatcaattttgttacattgccaattctttctcataaaatacaaaatg

SEQ ID NO: 103288 - DNA, 1003 bp, Heterodera glycines
  Promoter: Source sequence=SeqID_2880; Location=2597..3599; Strand=+; Gene=SeqID_82144
gaaagttatgtctatttttttaaacatttttggttagaactttgtaaaaactcaatgaaattttctgaaattttgcaagccaagagctacagtatgattcttattctttatgttataattaagaaaagttataagtgatttttctcgaaaaatcggtaaaattggcaatttttacgaaacgacctagcaccgaaattccatcctttgataaatatattttttagctttgtgaattaataatattattatttttttctagtttttaattcaaaaaaaaatacattttaaaggaaaatgtatttttatttaattaaacaaatgagaaaatcgaaatttttttcttgaagaaagaaaattgttaaaaattttttgttttaaatgaacgagacaaaagatgctgatgatgatgaagaaccacagcacagaagaagcaaaactaagagctttaattaggccgacaaaaaagaagaattgattttccataccctcaaaaagtatgtaattgagggatttaaaaattttatacccgttattatcaaaatcgaatgtgaatgcaaataattttcaaaccccgcgagggcaatttattcaccccccttttgtgttgctgctgccgccactgctgtcaaacttcctgtcaacatcggcagcagttgaggatggcattaaaattggcggcacaaattgtgttatttcttgttgccctcctatgacaaaattttcagtttttttttaaatgtccaaacggcattaggtttaagtttgtcttaatggaaaaaaaattgttggacatttatttaagtaagccataaattttcaaatttcgcatttaaaatgtgtgtttttaaaatttcagcagattttctgataattagaggtgtctattgtattatattttgacatgacataaaaatgtaaaatcaatgcctagcgaaaaaaaatttatagcgatttttaaaatttttcaaaaaaaattgcttttctttatttcccattaaaaatg

SEQ ID NO: 103289 - DNA, 183 bp, Heterodera glycines
  Promoter: Source sequence=SeqID_7853; Location=828..1010; Strand=-; Gene=SeqID_66162
aaccttctttttaaacgaccatttgctatgaaaatcacggaaaaagcattaatttaaataaaattttttttttcatgttttggtaaaaccattaaaaatgtttgaaggtccaaggtttttcataaaaaggacggataatttccgatgatccaacaataagcggacggggaataatgccaaatg

SEQ ID NO: 103290 - DNA, 62 bp, Heterodera glycines
  Promoter: Source sequence=SeqID_2312; Location=835..896; Strand=+; Gene=SeqID_79036
aacgatttgaatttttcaaatttcaacgagccattttaaacgctttgctttgtctcagaatg

SEQ ID NO: 103291 - DNA, 645 bp, Heterodera glycines
  Promoter: Source sequence=SeqID_2863; Location=1903..2547; Strand=-; Gene=SeqID_82030
acaaataggacagaccgacccctggcataaaagttgatctagcgtgaattttttcaattttttttcaagtgcataaaacttacatttcttcaaagtttattgtatgtataaattttcttccagcaaatttgagccaattttagagggcgtgtaaatttacaaaaaaattcatctacacttcccaattttgttttcttcttatatttgtgtgttaggtctatttggcaaaaatttctaagaagatgtgaacaaaaaaattaattaaaccaagttagacagtgcattcattcctcatagtgatctcaaatccaagaatgatggcttgaaggaaatttttagaaaaaaatttaataggctagtaaaaaatttttcaaaatcaggacgggaaaaaaacgctcggggaatggtttttgtttgtccttctaacccttgattcgcgtcttgtttttttgagtaaattttttaaaaaataaaattttgattgtcaaaaacaaaaccaaaatttattttaaatttattcaaaaaatttttggcataatgttttttgtcaatacaaaaatcaaattcgtggatcctgctgcggctgcgggattggaagttccaatttagaaaaatcttcaaatcctttcattccctcgcaaaatg

SEQ ID NO: 103292 - DNA, 77 bp, Heterodera glycines
  Promoter: Source sequence=SeqID_13293; Location=1..77; Strand=+; Gene= SeqID_77134
tgttaattgagtgtaaaaatgatcttcgtatttagccgagtaagaaatttgcggataaggaagtggtgaaagagatg

SEQ ID NO: 103293 - DNA, 839 bp, Heterodera glycines
  Promoter: Source sequence=SeqID_856; Location=1..839; Strand=+; Gene =SeqID_62828
cccacaaaagccacaaacagtgccattatggtaaagagtcttcttgggcattccttcaccccacgggactttgtccaatttcttggcccttcgtcaactctgttcgatttgccccaatcagacaacgcaacggaatttgtttgacgcatggcagtcggtcagttcaaaatgaaaaacaaccaaaaggttttcttcccgtttgacttcgttttctcttgtccagttgatgtgcagcgcccttttgtccctgctgaaaaccgccgaaggtcggctgaatatttacaatgtttttcattgaattttcttaatacaaagtgtccctatttcactaattaatcatttctaatgtcattcattttctatagttttcctctcccccccccccctctaaatatttaatttatctctcctctcattgttatttttgccacattttctcagagtgccgtccttccgactccgaagtgtcctccgtttcattgctttccgccgtcgttttgctgctttccgcactttccgcgcatccctccacttcgttcgattcgctccctccatcgcccgtttcctcgtcgtcatcctcggcgtgtcctccgacccgtctgtgcattggccgtgaacttttccaacaattctgtgccgttctccgccaatctttgcaccattcatcgtgccaatccgtccaactgaaggctcttcaagcagttcgcctcctcttcgaatgctcgtcgttgtccgcactttttgtgcgcgagttgggcaacgattgttttgccaacattcgtccatttgtggacgaagcgtcggaacgcagtgagcaaaataaacggcgtcggaaaatg

SEQ ID NO: 103294 - DNA, 582 bp, Heterodera glycines
  Promoter: Source sequence=SeqID_5588; Location=1287..1868; Strand=+; Gene=SeqID_58567
atttatttttgtataaactcaattattgttttttttgttacaaaattgttgctaaaagcattcaataaatacatagctttgctaataggatgtgtttatactcaaaggtttcttcgcccagttttttgtttttggcgttttgctaaaattcttaaacataaagaaagaaaaaggcaaaagcataaaatgaaacggaatgcgcagataaactcccaaactattaaggaaaaagggagcgaaggacgaattgcgcagtcgtcgactttctcctcttcatcattgagctttcatcgatttccttcgtccaacgacaatttcaattgcaagtgaatgagcccattcccttctcttcgctcgatagagggcgaaattaaatgaacaattatttatatggtttctttgtggtaattgggcatttgtattccgtttttgccatttctccttacgactctgacgctctttgtttacgccaaaatataatttctttgataaaatcgaaaatttacaaacacgcttttgcttttgaaaaaggatttcaaatgtttggttgagatttaaaaaacctaaaagagaaaggaaatg

SEQ ID NO: 103295 - DNA, 165 bp, Heterodera glycines
  Promoter: Source sequence=SeqID_38872; Location=1..165; Strand=+; Gene=SeqID_67577
ttaattttgggaaaactttcccccactgatttcatccggtatgagcagcaagttttgcctaaaaaggcagcggagcttggttttcaggaaaccatttcaaatttgaagtccctattttcagacacgaagtcaattttcatccgcaggttcgagtgttttcaaatg

SEQ ID NO: 103296 - DNA, 103 bp, Heterodera glycines
  misc_feature (34)..(34): n is a, c, g, or t
  Promoter: Source sequence=SeqID_8998; Location=931..1033; Strand=-; Gene=SeqID_69954
ttagcgatttttttatttatctagctttttcttnttgtgacattaaaaaattaaaaattaaattattatattttttaaattttttgatcatttttccaagatg

SEQ ID NO: 103297 - DNA, 159 bp, Heterodera glycines
  Promoter: Source sequence=SeqID_754; Location=1970..2128; Strand=-; Gene=SeqID_60474
tttggaaatatttctaaaattcatatgtccattagttctgtaataaaattatttattattttcaatgtttctaattttcgttcatttttgtaaacctttggacctttttgtccatcaaaaaataacaaaaatttcatatcgaaccgaaacaccaaaatg

SEQ ID NO: 103298 - DNA, 1003 bp, Heterodera glycines
  Promoter: Source sequence=SeqID_36763; Location=326..1328; Strand=-; Gene=SeqID_66006
gtcctatcaaatatggctttccaaaatgcgctaaatatcaaatcttcctcattgaccaccttatatccaaaaaaagttaatgaattttaatgatgagaaatattaggctaaaaaaaatagtacttcggttagaaaagcttggcgagcagtaaatgtcgctaaccaaaatcttaggcaaaacaatgaattctatgattaggcatcggatttattttgactcctattttttttaaacactttgacctaaacacaaaataatattttgagctttattcatgaatttttttttcctttccatgttttagatttttgtcactatttccatattgtatattcattttaaggcattttcacaaaatctcaaaaagacaccgctcaagaatttttgttgtttgtttttgtaaaatacgaccttaattgaaaattttggaaaaccatattaaatgtaaaaaatgttttctctttcacttcaaaattcctttaaaaaatgaatttttaacaaaagttttaaatttatgtaaatatatttttttttcttttcatctttaaacacaataattatagattaaaattatgtcattctataattcatgtattaaataagcatcttcattgaaaatttttttttttggtctttgaattttttttttccttccgaaaattaaaaaaaaaaaatttttttttttttacatattttcttttttttttgtgaatttcaactattttgtccatatttcggccttattttgcattttttttctcatttcttccatgttatctatattttgttttgttttttcttctctgcttatatatgtaaattagtaaaaatttataagtttgtaagggatagagttctcagaatatcattctcagaaataaaagggaatagggtcctagtgaaaattataaataatactttatcattttaattattaatatttaattaaaataaatgcacataaaaatcatcattaataacacaaaatcaatttcaggaatg

SEQ ID NO: 103299 - DNA, 448 bp, Heterodera glycines
  Promoter: Source sequence=SeqID_15292; Location=1297..1744; Strand=-; Gene=SeqID_79515
tcattaatatacattttaaatggtcaaggagtttaattaatgattcattaacaatattaaacagagaaaaattttactttttcaattagcttgcttattattaaattaatataaagaagtcttctgtatacgcccgaatatgaacgtttccttgtcactcaacggactcgggggtactttaaaataagatatttattaaatttagcgaaattaccgtcagatttaagttaattttttttttttttttgaaattgaataatgcaaaagggtggtacgagcataaaataaggttgtggtgcggaacggtatatttttttatcaaaaatactcatatttttttggcaattaaaaaaactgatttttagttagtagttttcttttagtaaagtaccatgccagcagataaaaaaaaaagtttaattccatgagaaatttcacaacagaaatg

SEQ ID NO: 103300 - DNA, 983 bp, Heterodera glycines
  Promoter: Source sequence=SeqID_17801; Location=806..1788; Strand=+; Gene=SeqID_82334
tttctccactttttgctccgcattcagcaaagtattcttattttaccagcagacggcaatgtgaatgaggtcaatgaagattaaatttaatggtactcaaaaattaacttagaaaaaagtacccgtaagaaaatgggtgaaatatgcataaaatgctataaaaataagatcacctttatagattttgaaattaatttttggtattttttggtttaaaaaaataaaatttttcacaagaatttctattatttttcaaaaaatacatatttacacaaaatttacatttcttattcattactgttcattcgtctcttattataaaaaaattattttaaaagctctctaaaactaatttttggtaagagtaccaatgatagcccccctttctcgtaaatttttgaaatttaaaaataaaaatatgggtttcgaggtcgttgatcatgaaattaacttggccaaaatgaaatgaaactgctgctcgctgctcatattcagcaaaatttgacgcgaattgttgaattagtcaaagtgtatggtctcgggtcggggggctcggggtcggagagcaaccctagtttatttaataaatagagccaaaatttgcactttttcacgcggcgacgcctaaaacgatcaaatttttctcaaaaattcgtttcataattctaatttccccgttggagcggacaaaaacaaaaccattaatttttcctaaaaaaaaattcgatctaaatcacaaaattcttgtgaaaaattttattttttttaaaccaaaaaataccaaaaattaatttcaaaatctataaaggtgatcttatttttatagcattttatgcatatttcacccattttcttacgggtacttttttctaagttaatttttgagtaccattaaatttaatcttcattgacctcattcacattgccgtctgctggtaaaataagaatactttgctgaatgcggagcaaaaagtggagaaatg

SEQ ID NO: 103301 - DNA, 98 bp, Heterodera glycines
  Promoter: Source sequence=SeqID_10726; Location=1673..1770; Strand=+; Gene=SeqID_73973
aataattaattatctaattagaattaatttacccttttaaaagattggtcgagctggaggaggtcgaacttggagtggaggcgtgcgacccgtccatg

SEQ ID NO: 103302 - DNA, 659 bp, Heterodera glycines
  Promoter: Source sequence=SeqID_503; Location=3884..4542; Strand=-; Gene=SeqID_54652
attaagaaaattcccgaattttaattaaagagtgcattttgctttatagattccctcccatcaatccgcttcattttttgagtcaaaattttgctggacacatttcatttttggtgatcccacaaattctttatggccactcatttttcaaatctatccaatttctttttttgcttattttatttgtaaaattatttttaggtataatttataaaatttaaatttagtttaaaacaaaaaaaactgatcactgatttgtgtgtcctgccaaaaattgtgacgcaaaagacccaattccgatcagcagcaggggcatttttcccatctttttgaaagttttaaaaaaatatttttaattaagggagtttaaaaagaaaactataaaccttttttgtcatttttaatgataaaaggataatatcatatgtaaaataatttcaattttctcattatgtacctctttaaatgagttcacaaatatttaattgagcataatatttattttgtttatttagcgcccttttagaaattttatatatttttttgttttttaaataaaaacaaatcgacaaaacaaaataaacttattttatttgtgtatcgagaaaaaaacattattattattattctttaaggtacttttttttggaaataaaatg

SEQ ID NO: 103303 - DNA, 466 bp, Heterodera glycines
  Promoter: Source sequence=SeqID_5382; Location=463..928; Strand=-; Gene=SeqID_57836
tggcttttgcggttgggaaaactcagatttcatcggagatttagaatatgtaattatatcataaaatataacaaaatgattatactgtctatttgagaccggattggcacggtgaccaggcgggcttttaccgggcggcccggtcccgtcccatttttctaaattcaaataaaagattaaaatttttattttattgaaataatcaaaattccaaaaattttaaaaagccctgtcccgtcgggtgcccgttcaaattttggaccgggccctgggcgcccgtaaaacgggcttttttgaacgagctccccggtccctttcaaatgtctaagcccggtcccggtactttaaaattccggtctctactgtccatataaaaataaagaatgatatttattcctttaaaattaattatgaagattttaaagagttaaaatactatgagaaaaattgcctaatgttgcagatg

SEQ ID NO: 103304 - DNA, 74 bp, Heterodera glycines
  Promoter: Source sequence=SeqID_13061; Location=3404..3477; Strand=-; Gene=SeqID_76847
acttaatttaaatttaattattcaaataaaaataaaaatatttatacgttaggtcagttaatatttggcaaatg

SEQ ID NO: 103305 - DNA, 922 bp, Heterodera glycines
  Promoter: Source sequence=SeqID_9398; Location=1..922; Strand=+; Gene= SeqID_71270
aaaaaaattgggcacggcccgaattaaatgaagaaattttcggatgcggaagactttttaagcagcgccaaaagcattgattggaaaactgatagtgcggagagcagaaaaatctgcggagattgaaaaaatttggcacgaatgggtggacaaaaaggcattggaaaagaaggagacagatgatattttaaaattgctgatgcaatatgaaagtatttttgcgattagtgatgaagaattgacacaaaccaatctgatcaaacaccaaatcgacacaggcgaggcagaaccaattcgctgtaagatgcgttttgtgccatatgcctacagggagaaagtcgcggcaatgttacaagactatttgcaacgagatgtgatccgtccctcccattcgccgtggtcaagcccaatcgttctcgtgccaaaacgcgacggaacgttgcgattttgtgtcgacttcagagcagtaaattcggtcaccaggaaagacagttttcctttgccgaacatcgacaatacgctactaatgctgggagggcgtaaatttttcacgacccttgactttatgaccgggtattggcaaattcgtatggacgaaaattccatcgaaaaaacagcattttctaccgaatttggcctacatgagtttacggtaatgccattcggtttgtgcaacgtcgtagcaactttccaaagatttatgacgcacctttttgacggatacataaacaactttgtttttgtatatatcgacgacgtccttatcgcttccgactcatacgagcatcatttaaaacatttggtgcttgtttttgaacgaattcaggaggcgggactcaaactgaagctgtccaaaagccatttttgtgctaaagaattgccatttctcgggcatattctaactcgcgaaggaataaaaatg

SEQ ID NO: 103306 - DNA, 311 bp, Heterodera glycines
  Promoter: Source sequence=SeqID_20927; Location=397..707; Strand=-; Gene=SeqID_51511
tttttaaatggggtggaatttttaaatgggtggtgacacctggtactttcccaccaatgcctgtgagcaagattcaccgagctgactccatctgccaattcctcattcagagaacttacaaattactcgtttattgttatttaattgctatctctctttggcaacccatttaccccgatcaaatgctcgagagcaggcgccgcgtagtctgtcgctactgacatataatttttcaaagaatttcctaagttctcgggtatgccagaaaactggctatctcttttttggaacaactttctagcgaacaaatg

SEQ ID NO: 103307 - DNA, 217 bp, Heterodera glycines
  Promoter: Source sequence=SeqID_44781; Location=1..217; Strand=+; Gene=SeqID_72205
cccaaattttaggcccccagccacagccccttgcttccccaccttgtaagtcttggatttgtcaaataaattcaagacttcaaattaataatcaaaaattctcttaaaatttttttgaacccaattcaaaaaaggaaaaaaatttgcagtcaaaaaattattcgaatttctccaattttgtttccataatttccgaaagttattcggtatcataatg

SEQ ID NO: 103308 - DNA, 207 bp, Heterodera glycines
  Promoter: Source sequence=SeqID_14454; Location=1475..1681; Strand=+; Gene=SeqID_78498
agaagaaagcggaggaaaaagggggaaaagcaccactcgagaattgtttttttcaaatttcattgttcccaaatgcctaaaatacataacaaattttatgtgttggttgaccatgaatatttttgtaattatggatgaagagcaattaaatgccttaataatttttttcgcaaatgactttaataatatattttcgttttccgaatg

SEQ ID NO: 103309 - DNA, 276 bp, Heterodera glycines
  Promoter: Source sequence=SeqID_7481; Location=764..1039; Strand=-; Gene=SeqID_64958
taaatacaaatagaattaataatttctttatttatggaaaacaatttattttgttgaaaattaggcattttcccaaattttgactattttcttaacaaattttaacaaaatttcacttattttctcagagcctaccgatttaaattttcataagattccaaaaaatttcaacaatacctttatatactcaatgttgcctagcagtaaaacggctgaaatcatgccataaattttttgttgcgaattttccgaaaatccaacagcgcccatcgcatg

SEQ ID NO: 103310 - DNA, 278 bp, Heterodera glycines
  Promoter: Source sequence=SeqID_14229; Location=2770..3047; Strand=-; Gene=SeqID_78246
ttttttgacccttaacgaaacttttcgaaattttggaggctaatagaggacacctaggactatcgaatgaaccaagattgttggatttggttggcaaaggaaaaagttctagccaaaaacttgcgtctcatacgaaaacgatctcgaccctattaaaaaatacacaaagtatttaaaatatgtggacaaaaatggcaaatttacataatgctgatgggccaatttctaagagaaaattaaaaaatattaggccaattaaaaagttataattggtgatg

SEQ ID NO: 103311 - DNA, 939 bp, Heterodera glycines
  misc_feature (21)..(21): n is a, c, g, or t
  Promoter: Source sequence=SeqID_4832; Location=1..939; Strand=+; Gene= SeqID_55881
aaacatatatgaaaaattaanaattcaaaaagccttattatataaatgtttgcttttgtcttgatttgttaaaattacatattttgtttgaaatctgtgcctgaataaaaatcattttaattaaaatttgagacagaaaaatggtcttatcttgcagctgagcttgtttcttccatggtccattcccgcactcgtttaaaaatcatttatgcactcaaatccttggctaatgactgtctgcccctatccgtaccgttagcattctcaatttttggcacttcttttggccttttttgagttttgagcacatattttgtggggttttttggcacatattacctatatatttatttggcatttttagcacatataaaatagaacccttttagtagtgatcaaatatttttcaaaacaaaatcaattgctttcaaaaatgcgaaaaattcaatttcattatcgttcttttgcttattaaacctaattaaattaattacactacaattcagaaaaataataattatatttgtgaaagaaaaagattgatattaatggcttgaaacattacataaattattatttattattaattattgatgtgcttccgcctatctcgaaataaacaaaaacgttgcataaataatatgtctattataatattattttatattttttacaaatatttgtgcgaagaaatagaatcattttaattgattatacacttccgctaacaaacgtcaaattattaaatttatagaaaatgaataaatagtctatatattattttattgattatctatttccgcctatctaaaatataaatacacaaaataacagctatgttaaatatatttccaattacctatatgtctaaaaacagtatttaatatttgttgttttccctgaaaatttcagttttttcttcacttgtttatttcaatg

SEQ ID NO: 103312 - DNA, 124 bp, Heterodera glycines
  Promoter: Source sequence=SeqID_1293; Location=1458..1581; Strand=-; Gene=SeqID_71820
ttagtggtcaattacctgaagagctccggaaatgtttatcgatgcgtcctagaaccgttttgatctatattttcattatttttttagctcataaattgtcttgcagaagtatttaattaaaatg

SEQ ID NO: 103313 - DNA, 203 bp, Heterodera glycines
  Promoter: Source sequence=SeqID_41809; Location=680..882; Strand=-; Gene=SeqID_69849
tctgtgtaacaaatcacataaaaaggatgaaaaaattgagccaggtaaaaagttaagttaaaaatttctaataaatgcaaaaagatcattccgaaatgtcttaaaaaaggaatttacaactccaacctgctcaagcagtacagtcggctgccgcgcaccgccaaaatgtacagcggaatatccatggtgcggatgatgccatg

SEQ ID NO: 103314 - DNA, 54 bp, Heterodera glycines
  Promoter: Source sequence=SeqID_982; Location=1911..1964; Strand=-; Gene=SeqID_65462
ttggcacaatgtccaaaccgagtagccaaagtccggcaaaatcggccaaaaatg

SEQ ID NO: 103315 - DNA, 456 bp, Heterodera glycines
  Promoter: Source sequence=SeqID_11869; Location=2116..2571; Strand=-; Gene=SeqID_75367
tttatttgttccctttgctcccaatcgatatttgaccccgttcgccctgtcccttctttttaaataaatatttattttattcctcttcggactttggggcgtaacaattggcgacgcccgtgcagacttttgactgtgggcttattgatctgattgtggaggaagaggtttgacagcaaccgagttttgctgtgtcatcgctgaagactgcctgcatttgctattatctaggcgataataacaactttttgttgaacctgctaacagtttgacactgttagtggtgagaaattttgcgccgctgattttgtgtcttggcgacacatttcagttcatccacgcgcacccactctgtttagtagcttggcgctgctaacaattgagtggtgaacgacacgtcatttaaaacgagtactctcgagctgaggggaaagtccacgagctgtggttaagatg

SEQ ID NO: 103316 - DNA, 372 bp, Heterodera glycines
  misc_feature (116)..(116): n is a, c, g, or t
  Promoter: Source sequence=SeqID_39187; Location=854..1225; Strand=-; Gene=SeqID_67818
agtataaaattttttaaattattttttttaaaattatatttttatgtatatgcacatatgaattaattttaaatattattttcatatacataaaaaatttataagaaatttaattnaaataaataaataaataatattaaacaactaaaattgtatggttattttttgtaaaaatataaaatattcttatcgcgttaattttttctgcgcaaacatctcctgctgctgtgctgttctcgacaaacaatttcctagataagattttcgagtaaagttataatatgaatgacctgtggtcattcttcgtccatattatcattctcctcaatccatagttccatttttactaaattttttcttagtcaaataatg

SEQ ID NO: 103317 - DNA, 986 bp, Heterodera glycines
  Promoter: Source sequence=SeqID_7352; Location=1459..2444; Strand=-; Gene=SeqID_64564
cagagaatttttaaatatatctaatatccaagaaattgactatctcttatttggagaaattttattcgttacaaatgctctcgagcttgataggaagggcggtgcgcaatcgccatttaatttctcagagaatttttaaatttatcttatatacaagaaaaatgactatctcttattttgagaaattttatacgttgcaaaagcgctcgagcgtgagagggagggcggtgcgcaatcgccatttaatttctcagagaatttttaaatttatctatccaagaaaaatgactatctcttattttcgaccccgacccctaaaaagctcaaaaaaggccaacatatgtgccaaaaattgaaaaaaaaactgtcaaaaaataagtgaatttatcaaaaaaatcacattttttatccatttcgctagtacaattctaatcaaaaacatttcaattctttgtgacgtaaatacttttctctccaagatttacttatttttctgtttttcatcgataaaattcaaattttgccttaaaaatgaaaaaagccattaaaaaatatcaaaaagtgcaaaaagaaaaaaaagaaaatttttgatcatttttggatatcttgccaagaatttgagtgcaaaaaagctaatttcgtaaaaaataaaaataaaatttccaaaaaatccccaaaatatgtgctaaaaaaattagtcaattaatgacatcagatgagaatgaaaatgtgatatttgtgatagttaccttaaaaaccttcataattatagttatctcatattaattactacccaattcgctgataaaaggaaaatttaataattgaattattataaaaatgttgtcaaattaatgaaataatgattaaatgtggttaatattgattgaagaaaaattaagccatgctataaaattaataattacaaaattcattgcgaaaaatatttttataaaaataattcattatatttttacaaaaaaatg

SEQ ID NO: 103318 - DNA, 275 bp, Heterodera glycines
  Promoter: Source sequence=SeqID_22065; Location=61..335; Strand=+; Gene=SeqID_52708
ttttttttaaacagcgtaggaacaaaatgaaaaaacaccacaaattaggtaggtgcaataacgtaggattatgcgcagtgaagaaatacctacatatgtagtttgagatttctctcacaaattcacgccattttatactcaaaatttttccactgaaaaaagttcgttacagaagtgtataaaagggcacgattttgcttggactgatcattcatattattaattcaacacatcttcaattgcctacctacctaaatcatattttgctgataatg

SEQ ID NO: 103319 - DNA, 364 bp, Heterodera glycines
  Promoter: Source sequence=SeqID_34109; Location=233..596; Strand=-; Gene=SeqID_63987
ttgtgccgcattttatgtccgagaatttccttcctttttcagaagctaccatggactatgggacattgcggaattttgatactcaattttttggaggagcagccccgctcaaaattgagcgcggcactggcaagaaaggcgagaggcgaaattgaaattttggatataagtcaatatctaatttttgtttgtttgtcaggtccggcaccgtccgtcgctgtgaagccgccgtcaaagtcaaagccctcggagaaagggaaaaaagtgccatgtcagtgttgattttcttttgagatttacataatgtatactgattttttcctcccatttagccagccatcctgactatggaacacttcaaatg

SEQ ID NO: 103320 - DNA, 146 bp, Heterodera glycines
  Promoter: Source sequence=SeqID_2252; Location=1811..1956; Strand=-; Gene=SeqID_78731
gcgcgctctgcggtcgcttccgcacatatgcctggtcgccctttgaattctggcacacggacgtggaatgccgcaaggtcgtcgaagacccgctgcccgctttcaccaaatggcttctgaacttcgaaacggaagttctcggcatg

SEQ ID NO: 103321 - DNA, 94 bp, Heterodera glycines
  Promoter: Source sequence=SeqID_23494; Location=1484..1577; Strand=-; Gene=SeqID_54190
caaaatgttttcatgggtgaaccatttttcgaaaatgtttttaatttattataaaaaaaacaaatttttaaattttcagacaaattcgatcatg

SEQ ID NO: 103322 - DNA, 159 bp, Heterodera glycines
  Promoter: Source sequence=SeqID_754; Location=1972..2130; Strand=+; Gene=SeqID_60475
ttttggtgtttcggttcgatatgaaatttttgttattttttgatggacaaaaaggtccaaaggtttacaaaaatgaacgaaaattagaaacattgaaaataataaataattttattacagaactaatggacatatgaattttagaaatatttccaaatg

SEQ ID NO: 103323 - DNA, 238 bp, Heterodera glycines
  Promoter: Source sequence=SeqID_1401; Location=3971..4208; Strand=+; Gene=SeqID_73292
aaattttattaaatttttacgtcgtctgcttttttgaattcaatcgccctctcccaagcatttgtttatcctgctttgctaataaacctgttcccccaagtggaatatctttgaatcttcactttcaagaggaaatcagttaaaccgacgaacattcgctgacccttctcaattatttatttccatttttatatttcgtttttatcgcttaatttaagtcatttttgtgtccaaaatg

SEQ ID NO: 103324 - DNA, 140 bp, Heterodera glycines
  Promoter: Source sequence=SeqID_6204; Location=3017..3156; Strand=-; Gene=SeqID_60700
aaataatttataggccttaaaattaattttctctgaaatttcggacaattccctgaatttcccaagtcgctaaatttttccatcaaaattaccaatctttgtttaaaatatgttaaaaattcagggaattctaaaaaatg

SEQ ID NO: 103325 - DNA, 730 bp, Heterodera glycines
  Promoter: Source sequence=SeqID_3030; Location=3923..4652; Strand=-; Gene=SeqID_82853
acgctttcattgcggcgattacaccgacttgacgcattgcgccaactccaaaaacagtgcaaattgtccgacaaattgatacattccgttgaacaaatagcgcgagctggtgactgtttttccaatcatataataaaaatggaaaaataaataaacaaaaattattttacttacgaatcccaacgccaaaaacaaaaattgaaagaaacatttgggtttttgagcgtcatccgactaaaaaaaacatatttcgtggcttccaattttcacagcccaacactaaaaaatttgagttttttaaattgcattccttggaaaattggccttttaattgccttttttaattcaggcggtgtcggcggatgccattgatgaaaaagtgcgcggggacaaaacaccgaactgccgtgtcaaactgtgtcgattctgccaaatgtcaaaactataaattattttcggaaaaaacaaataatttaattgaattttcctattaaaattgtctccaaaggatgattggtgtgataaactgaataaaaagacctccacaaacatgatttgcttaacactttttgttattttcattttattttctatcgaaaaaatgctttctttcgacttccatgttttgcgccattaaaacatttttagacaatttgtcattgtgcaaaaaaaggataatcacagaaagcaacacccaacggaaacaacaacaaattaattgtccacaatg

SEQ ID NO: 103326 - DNA, 473 bp, Heterodera glycines
  misc_feature (99)..(99): n is a, c, g, or t
  Promoter: Source sequence=SeqID_35391; Location=706..1178; Strand=-; Gene=SeqID_64951
aaaagttttggagcaattactacaaaacattaaacagttgttgctctatctgcagaataatttttaaatggctgaaaaaatatgtataatatgaaaatntaataaaaataaataaaaggattttaaattcatttccaatttattcattcacaataaataaaataaaaaagttattatttatccataaaaatcataaaatagtttatttttaagttttttttaaattatatttttttgccttataaattaatggaaagaaatattttttgaatttaaataaaatttcctttttttccgttttaatttaatgctttaagtcacttgttcaaaaaatgcccaagttatttttactaattatatttataaatgcactgatttttggcaaagcgtcacaaaattgtgcttggcaggtccataaaattaaaaaataatttttaaaaaattaaaaattttttttagaattgtaacaaatg

SEQ ID NO: 103327 - DNA, 52 bp, Heterodera glycines
  Promoter: Source sequence=SeqID_3804; Location=1..52; Strand=+; Gene =SeqID_51943
agaaaaaaagttaggaatatttttttaaattaaaatttcttttaaaataatg

SEQ ID NO: 103328 - DNA, 1003 bp, Heterodera glycines
  Promoter: Source sequence=SeqID_11609; Location=3952..4954; Strand=-; Gene=SeqID_75059
cacggcactctaaaatttgctggggttggaaatgccgggcatttggggaagcaagaaaaatggccaaaactaattagcctatttttaaacgtatcttattcgaaaattattttgtaagaaaagcaggaaaaaaagaagaattatgattttgaaaaagcatagacctgtattttttggaaaaattgctagaaaattcatgtccaggaaaaacctatacccggacccaggctaataaattttaattttttgaagtttttcgtgcctaacttggacctgtctctttgtgtttctttctctctctctctcttttttctcttttctctctctctatgcatatatgtctcaaatgcggttggccacttcacaaaaagtgcaaatttgggcacttcacaaaaaaggcaaaaataaaaaataaaaacttggccttaaaaaaagcttttttatatttatgtgttttttttgttgcctaaggcactttgttgttgctcatcatttggggttatcaatcgcgaaatcttaacaaagggatttgctttaattaataaattaaatataattaaataaaaatctgttaaccaatttcgctatgttttaaaattatttttacttttatcgcttcaaagagtgccctaagcataagcttaatgcaaatttttaaattcctattatgcaaactttagataattttttggataaatatatattatattattattataaattgtaaaagtgtcagtaataaaaatttaacttacaatgcttttgcttattttaaatttaaaaaaaaaataaaataatttctcaaataaaatcgatggaaataaaaaaagaaagaatcacattcttattcacatagtcgtcataaaatattcatagacctaaccattcacattattatacatttcatttttagaataagaatttctttttaattttattatcaaagatttatatctttactttataaaaatataatttaatttaaaaaatttagataagaatg

SEQ ID NO: 103329 - DNA, 172 bp, Heterodera glycines
  Promoter: Source sequence=SeqID_3006; Location=4079..4250; Strand=-; Gene=SeqID_82728
acacaaagtcaattaaataaggaaaataaaacaaattatcggcaaaaaaaattcatttatataaaacaaaaaaatgaatgacaaacaattccaaaatttcccccctaaatttccgttccaacaacaattcgcttcatacacatctgaactgctcgtgcaaccgttcgccatg

SEQ ID NO: 103330 - DNA, 1003 bp, Heterodera glycines
  Promoter: Source sequence=SeqID_7761; Location=161..1163; Strand=+; Gene=SeqID_65857
ccagtttttttggcttgaacttttgaaaaaattaataaaattttttgaaatttaccaagctaataacgcaaattaagggctatcgtatgattaaggtataagcagatgaacggcagcaaaagatcattgtgcattatgatcactttatgctttgtaaggacgggctatttaaatgccaattatttttttgcggtttcaatgaggccaaaaaagtaaattgacttacctaattaaagaataaataaaaccaactaattatatctttgtgtgttaggctggtcatgtgctgttttgacgacattgtgcagccggagattagtgcgtttatttaccgagaagggctgacaatttttgttgccgaatttgcgtgttatgcactgatttggctggtgattttatgccgaaaatcgcacggaaatttttttataaaattatttttaaacaccaaatcaaatgtttatttaggtaggaggacaacaaaaaaattggtgaagccgttgacatcgataatgtgcatcacctttttctgctacattcaggcaaaatataaaaaataacacagaaacaattgaatatttgttgaaaattaagtttttttttaaatttgttttggtgcttctagggacgtatttccatatgcgtatttgcatatttgtgcatacttcgcatagtgcatattttgtgcacatattttgcgatttattatatgtatatttttggtacacaccaattccttttaacgaaaataaattaattgtttttgtgtaaaaaaccactagaatttcaaatggctattaattaggtacggtactttttttaagaaaaatctttgacttttgaaaaatttgggcatttcagcatgaaaagacaagcattattttaataaaactttaaattttctaaattatattggtgaactttgaatttaaaataatttttcgccaaattaaaactattttaaaatgggccatttataattcaacacattttctttttcaaaatg

SEQ ID NO: 103331 - DNA, 654 bp, Heterodera glycines
  Promoter: Source sequence=SeqID_26721; Location=1..654; Strand=+; Gene=SeqID_57481
aaaacttcccctctctgcgtgccattccccttcccacctgttaattaaattttgtagccaaccaaaattcaaattttggttctctccgtgccagttcccttctcgttgtcattcaaattggttctttcgctagtcttctcccttctttcaccacataccgcactgaaaatcgatcacgcttcgctaatggttccgccccttcacattttgccggaattggcgtcctttcattcgctcttcttctctcaataatcagcttttcaacaaaccgtctcctattacttcaatttattccctttttattgcttcaatttcttcctttttcaatttttcttatctctatccttttttcgtcgtgactttttctcctattgaatttatttcattttttctgctcaactttcttctcgaaaaatgtctcgcttttgccctctcgttgaaaccaaagaattgggacgtctttccgttatgaagggaaaattttgtgagtttgagatctctttaacttcagcacaagatttacaaatcttttacttgaattttaggcttttttatgccctcgaattatctcgtaattaccaactgatcgataatggaatctctaggaaggctttccgttattttatggaaacagagaaaaaacaacgtgaaatg

SEQ ID NO: 103332 - DNA, 141 bp, Heterodera glycines
  Promoter: Source sequence=SeqID_39330; Location=740..880; Strand=-; Gene=SeqID_67917
tcacttatcaacgcgcatgcactagcaacgaagtcctttgcgcgaagcgctcatgtaatgcatattcttttcatctctcacaagtatactgtctacaccgatggcccataactttttttctaaaactctgatcaaaaaatg

SEQ ID NO: 103333 - DNA, 74 bp, Heterodera glycines
  Promoter: Source sequence=SeqID_10887; Location=3030..3103; Strand=-; Gene=SeqID_74167
aggcgacttcggcaattcctgaaaataaaatcgaaaagtgtgtttagtcagtggaatgggaagcagctgaaatg

SEQ ID NO: 103334 - DNA, 1003 bp, Heterodera glycines
  Promoter: Source sequence=SeqID_4786; Location=966..1968; Strand=-; Gene=SeqID_55715
tttgactacaacttctttgaaacacaatgaaattttttgaaattttacagaaaaatagaggaaacttagggctatcaaaagataccaatattgtttaatttggatgcttctacaaaaagttatgggcattggtcaaaaattgatcatttttatggtgatcagttattcaaccaagtattactttctatgtacaaatcgcagacccaccattccaaaagcaattcggtagcaaattttgtgctctttccagagggcttgcccattttctctagaaaaaatttcccaactccctatggatttcgaaaatttccccgattttcagtgtcttttaagtgtccgggtcactaggaaggagtgatctaatcaagttggtgtaagagactatatttctctcataaaaatgtaatttgtttgggaaatattaaataataaatcgacattataataatggtctgcaaatctaattaataaattaaaataattatatattaattaattaaaatcatttattccgtactgaaatgacccgccccttccgatcacccatcactaatacttttttagcttcgccacactcatacttttttagcttcgccacactcatacttttttagcttcggctcaccacgggtggtcaccagcacggagccccgacttttgcggcccccgacatttgcgcctgcctatgtccaaaatcggactcaaagttgaattttttcaagccctgatagtctaaccgcattaaaattaagatatacggtcttctagtttattaggagcattaattctgttgtttcaaaattttcacgcgatcagagattgaaaaaacttaattttcaacccgattttggacaaaggcgtaaatgttgggcgtaaatgtcagagccgcaaaaacttctaacgaaaatggatattaaaataaagaaaatattatttaggaaaaagctaaaatataattatattgtttactaatattattcctcgccaataataacgctaaatg

SEQ ID NO: 103335 - DNA, 240 bp, Heterodera glycines
  Promoter: Source sequence=SeqID_26399; Location=28..267; Strand=+; Gene=SeqID_57131
tttagccatacatgcaattaattcatttttgtacaggagctcattttcgggatagtgtgttaaaattcaaatttatttttaaaatatttttttattatttttttggctttcagtttttttcataattttttaaaagtgcctgtcctgcccccaattcccccccccccccccgggtcgattctcaagagttcaaaatttcgggttctacaaatttttacagaaaaaacggtagtagaaatg

SEQ ID NO: 103336 - DNA, 196 bp, Heterodera glycines
  Promoter: Source sequence=SeqID_24496; Location=1..196; Strand=+; Gene=SeqID_55227
taatattcggcgaaacaatgcgcaattccttcgggattgcatatggtaacagatgtttgtaatcaatcgataattttcgacgccttttcaaaatttccttaatagggtatatcattcctttctccgtctataagcaatccctaaaagcattcattcgttcacattcatttcctacacactaaaaattcccaaaatg

SEQ ID NO: 103337 - DNA, 254 bp, Heterodera glycines
  Promoter: Source sequence=SeqID_36358; Location=199..452; Strand=+; Gene=SeqID_65693
tccctttctagctcttccgggcccttcccttcccttcccttcccttcccttcccttcccttcccatcgcttttctcttggacctcttccggctcacaaatgctttctctgctcggattgaccgcctgtgaattgtaacaaatcattgccatagacaaaggcaacaaaaggagaagcgaaaggatgcgggacattgacagaaactgacggaaaaggcaaaaaaaaattgggggggggggagaagcgaaggcaatg

SEQ ID NO: 103338 - DNA, 53 bp, Heterodera glycines
  Promoter: Source sequence=SeqID_11992; Location=2114..2166; Strand=-; Gene=SeqID_47004
gatttttaaaaccgacatttgcggatgatgattaaaaacgtcgtccgcaaatg

SEQ ID NO: 103339 - DNA, 240 bp, Heterodera glycines
  misc_feature (75)..(75): n is a, c, g, or t
  misc_feature (107)..(107): n is a, c, g, or t
  misc_feature (118)..(118): n is a, c, g, or t
  Promoter: Source sequence=SeqID_21237; Location=1560..1799; Strand=-; Gene=SeqID_51830
gatttcaatgtgtccgtgctccatgacttcggtctcttctgggtctgctcgaaaatatggtgcatatttttatcnttgattaattacttaattatgtacattatatntatttaaattnttatgccctcattaaaatacatttatatttccatttcgtaaattggcttctccgataaagaaattgaaaaatttatggatttttttgcaatttaaattttcaaataaaaactaaatttaatg

SEQ ID NO: 103340 - DNA, 81 bp, Heterodera glycines
  Promoter: Source sequence=SeqID_22690; Location=1..81; Strand=+; Gene= SeqID_53375
gcttccggcaatgtggaggagttcaaatttccgaccgaaaatgttgaacaaatttttgacggacttttcgcattggaaatg

SEQ ID NO: 103341 - DNA, 54 bp, Heterodera glycines
  Promoter: Source sequence=SeqID_982; Location=1913..1966; Strand=+; Gene=SeqID_65463
tttttggccgattttgccggactttggctactcggtttggacattgtgccaatg

SEQ ID NO: 103342 - DNA, 135 bp, Heterodera glycines
  Promoter: Source sequence=SeqID_45200; Location=1..135; Strand=+; Gene=SeqID_72541
tttttaaacaggtcaaaaagtttaggcttatattttaccccaacaggtcgaacctagcgcactaacatcgatataatctctctaaattttgcaggccttctccattgtaaaggactaacttaacctgaaaaaatg

SEQ ID NO: 103343 - DNA, 95 bp, Heterodera glycines
  Promoter: Source sequence=SeqID_332; Location=9629..9723; Strand=+; Gene=SeqID_82789
ttttttatttattataaattcgttggcattttttatatatatatatatatatataaatacaattagatttcttttacagattctttaaaaaaatg

SEQ ID NO: 103344 - DNA, 223 bp, Heterodera glycines
  Promoter: Source sequence=SeqID_12713; Location=1714..1936; Strand=-; Gene=SeqID_76405
ttcttttgtgaacatgtctgtccaatcgaagctagtggtcattaattatcccttgggaattctttttgtgcatttctgaccgagtcaaaaccaatggaatggtcattaataaccccttggacgcattttgactgtataatgcccacggaagtgtcggtaatataccactggaaatagaggtcaagctgtgagtcaatgattaattgtgacagttgtgcctatg

SEQ ID NO: 103345 - DNA, 432 bp, Heterodera glycines
  Promoter: Source sequence=SeqID_25984; Location=1..432; Strand=+; Gene=SeqID_56735
aattacataatgatcagaagaaatttttgggaaaacccagtgaaatggaagaagtcctgaaacagaagagaaaggtggattaagggaaatggggaaataatgaagatttattttataaaaaaacaataataaataattttctaaaaatttagaattttttgtagcttaaaatcaatttttattttaaggtgcttttaaatttcgaagaaaattgttgggacactaacgcttgtagcgacgacctcgaaatcattggcaacgatagtttaactgtccattataaaggaattttttctggtaattcacctaaagtatttataaaaataacttttcttcaaaggttgtgggcattccgtcttcgcaaaacttccgattttgcagaatgattcttcgtccgacatttgttactatgaaatttcaattaaaaatatg

SEQ ID NO: 103346 - DNA, 757 bp, Heterodera glycines
  Promoter: Source sequence=SeqID_4719; Location=501..1257; Strand=-; Gene=SeqID_55495
tagtcttttgaaaggaacgcgaaagtgccgggggcaataaaagacatgttggcaatggaaagtggtcgaaactgacaaacaatgagaattgaattggggatggttctgctgctgacaaaattgaaagcggacgaaagtggcaaatgaagtaaacttgcggatggtgcggctgctgactccacccactggcatgccgtgctgcagtgccgcggtggcagataaagatgattgatggaaaaatttgaatatttgtgggcaagcgccccgagaggcaaagaatggccccgaccccccgcctcaaccgaaatggaattgaaatgaagtcgcttcggcgttcccttctttatatgattgacagttcccgtgtataaaaactgcggtaaagtggccgcaaatatttttgcatctccgcagcgctttaaattttctcgcccaagaactttgattgacagattgtgaacataaaaactattttgaccttggagcgcggatggcaccatttttggtgcgccccgcacaaaaatttcgcaacaaacgaaaattaaaaaaacgcaattgaataatcttatctgatcaaaatatgcggggagcgaatcgcggtaggggggtcagatgaaagggagggtggggggatcttgggaccaaatttgggccggaatttttcaggggggtggtgggttttggtaagggaaggggggggggaggggattttggtaagggaaggggggggggggttttggaacgggaaggggcgatg

SEQ ID NO: 103347 - DNA, 133 bp, Heterodera glycines
  Promoter: Source sequence=SeqID_40469; Location=1..133; Strand=+; Gene=SeqID_68793
tgttttccggacgttatcgagaagtcgccgatcaacttttttctttgcctcatctacctgtttggagctgctggcactgcgactgcgggattttacctgtttttgagggagaaacggattcgtcgcaggaatg

SEQ ID NO: 103348 - DNA, 118 bp, Heterodera glycines
  Promoter: Source sequence=SeqID_12265; Location=825..942; Strand=-; Gene=SeqID_75851
taagataaataaacaaaatgccaaatgtgccctttttagtgtgccccacccgtactcagttggcccctctcagccgtccaccgcccccgccggcgtccgtctgcggccccaagcgatg

SEQ ID NO: 103349 - DNA, 189 bp, Heterodera glycines
  Promoter: Source sequence=SeqID_10528; Location=508..696; Strand=+; Gene=SeqID_73756
tctgaaataattttgttaattagaaaattatttttaaaaatttttaaatgaaaatattttatttctgaaaaatcaaatggacctgaacataatgggctatcaatttcctcaatttgctcatcggaatcttaatcaaaatcctcaaagttttcgccatcaatttcatcaaaatttgcgcaatcgtcaatg

SEQ ID NO: 103350 - DNA, 397 bp, Heterodera glycines
  Promoter: Source sequence=SeqID_18567; Location=1..397; Strand=+; Gene=SeqID_83198
tttatcaaagtataaaatattatttaattaataattaccaatttgtagtattttccctttaaaaatgggaaatgccacaatatcttttcattattctccagcctacgaaaaataaattgccgtttctatgacaggtgaacacgacgaggaccgatttggcacagcaagtcatttgcccaattgcttgtgttgagtaaaaaatgcagctgtcatttgctcacagaccattcattcatttgttttcgaaaagctctatttacaaataaaattaaaaaaatagaaaaataaaatatattttggtgtattattaaattaaatttaactatcgtctccttctaattatttttaaaaatgttttaagccattttccattcgcaatattttccttttccaaatg

SEQ ID NO: 103351 - DNA, 136 bp, Heterodera glycines
  Promoter: Source sequence=SeqID_26968; Location=1181..1316; Strand=-; Gene=SeqID_57702
caaaaaaaaaattgggtttaacgaaaaccaatgttcacggaggaccaaattaagtgaattttgtatggtacaagagaatgatggtcttggccggatcactgatctcatttcttgatgatgatgctgtgatgtcatg

SEQ ID NO: 103352 - DNA, 485 bp, Heterodera glycines
  misc_feature (31)..(31): n is a, c, g, or t
  Promoter: Source sequence=SeqID_43195; Location=477..961; Strand=-; Gene=SeqID_70926
gtcaattaagtgattatgcgtgacaggggangggaatgtcagtgctacgctcagacataattgtttatttttttttaatcttcattagatttggattatgggataataaaaatgttttattttgcgttatttgttaaacaatatttttatgtcatttttcactattagctaacaatcatatggcgctgatcaaattaacctaacaaatgagcgcatttcattcatatttattattatttttttacgaaaatggtgaatagtgccaataaaatgttggcttttttttgttaaatctgctgattatctatccagtatcttgtttaatcacgtaacgccaaaaaaagagtgcataactgatctgcatttgaacatttttttaacttgtttctgttccattgtgtgctgtgcgtgtcattttatttatgttataataaataataattaaaataaatataataaaataatttaaaatatatctaaaaatg

SEQ ID NO: 103353 - DNA, 196 bp, Heterodera glycines
  Promoter: Source sequence=SeqID_12216; Location=1..196; Strand=+; Gene=SeqID_75792
aaattaccatgataaaagcaacccatccactcgatggcaagaggacgaagaggcgggtggcggtgccaaagcccatcaacgcggtatcccgtgtcttcaatgtgcgcctccccgacggaccagctcgcgcattgcacttgcgccccggggtgttccagctcgaagaagcggatgtaccgctgagactcagccgatg

SEQ ID NO: 103354 - DNA, 681 bp, Heterodera glycines
  Promoter: Source sequence=SeqID_1711; Location=979..1659; Strand=-; Gene=SeqID_75443
tttctttagtccgttcgttcaccaattcaaatggctcaaattccattaaatcaaaaagttcaagttgaattttgtagcaggcagaagtggtggcacggagaaatggctaaacaattgggaatcgaaatcaaatgacaattaatccaaatattttaatttaaatcataaaaatgattagtcccgttgaccgctttgaaattgtcgatccattcgtagatgttttctgatccgtaatttctatatatcaatcgcttgggttggccatcttttgtcggagtgtgcaaccatttggacagcgcttggccagcagttggaattgcatttggatcatcattcccatcggggtcaccagattgtattgaagtcaactggttgagatcagtgagaattgtcggcgaagtgtggcgacgcaaattgtccaaatgttccccgtcgggaaagtccaattggcggacgtttgtcacgaaaatgggccaaatttcacggacaaaaacatcccaaatcggctgggcaacaatgtcaggtgaaagagaaaccaacaaatacaattcggtgccaattttgtcaaaaatttgctaattggcacggagaaaagcgagcacaaaatagtcaatgtacctgaaagtgacaaataaattgttgttttttttgtacatagaatatttgaatttacaaaatatg

SEQ ID NO: 103355 - DNA, 526 bp, Heterodera glycines
  Promoter: Source sequence=SeqID_7563; Location=2828..3353; Strand=+; Gene=SeqID_65235
acattgtcaaaatatccaaataattacaaaaaaaataaataaaattaaattgaaaaaaacaattaaaaatggattaaattaaattaacttttgttttcatatttagaactgcttctgatttaaataaaacatgtaattaattactggtagaaattcaaattcttttcttttcctctgctgccttagattttgcgaaattaaaattaattaattaaattaattaaataatatttttacttttaattcgacagaaattatttttgtattcccaaaagattctctttccctttggctgctgccgctgtgttattttccgctttttgtttaccatttcgcgacgtaaacaccacactccccagtgaatatttttattatttgttatttttgcttttgcttttgcccctttttcccccggcttaaaattcgttcgtttcgctttaattttttgattttgatttttcaatttttcgtcataattcggcaatttgtcacttttggttagcttttaatattcaattttccgatg

SEQ ID NO: 103356 - DNA, 1003 bp, Heterodera glycines
  Promoter: Source sequence=SeqID_15726; Location=1209..2211; Strand=-; Gene=SeqID_80051
ttaaaattctcaaaaattttcccggcggctcctatcggcaccgccggacgcccattttaccatatttttgaaaaatggagaccaaaatggcaaaaaatgttaattttttggtgaaaaacggcaaaaaaatttgtcaaatacaccccatattcggggtttcaaaaaacgaaaaatacaccaattattttttatttaattcttatttttttaacaaaacatttgtctaatcttccgtgtgccggattcatgatcagcgacctcgaaacccccatgaacttaatattttttatcacttagcattttctaatgacttattttccactgactcattttccgggcgccaatcttcatgatgccaaatttttcattgtccattttcggtgccctcaacaaaaaaatgttaccaactgatttgagtccaatttgcataatttcctttttttcttctttgatttatgtaattcgtaaaaagcttttttcttatttttctaaattgtacaaaatgaatttccaatatttttgtcatgcacataaaatcaatcccttcaatgttaatgatgcttttccaattcgcgtggctttggctgtccacccaccaaatccctccccaattcatttgacttttctaattaaatatttctattttcagtcattttcacattttgctttttaatattttcctttctttttttttgctatgctttataatttgctgcgcctttttctgcctttttttgtcgtttttctgtcgtttttgcctcctctaatattggggtaaactccgactcagaaaggccttcctggtaagtgcagtgcactaatcaaataatcacaaatgatcatttgccatctgccaatggcactgattaacataaaatttgtttatttaactgcttcttgtgctctcattaatgcacctataccaaagcattttcccgagagcacagattagaatttgaaggttgacggcttttggggaagggataggctggaacaatgaatg

SEQ ID NO: 103357 - DNA, 116 bp, Heterodera glycines
  Promoter: Source sequence=SeqID_2035; Location=8005..8120; Strand=+; Gene=SeqID_77434
ttttcccttcttcggttttttgcgtccctctgtatttgcacacacacacatatatatataaatatgtagataaaaaatttcttcctccattctactaaacccccacccccaaaatg

SEQ ID NO: 103358 - DNA, 635 bp, Heterodera glycines
  Promoter: Source sequence=SeqID_12576; Location=1143..1777; Strand=-; Gene=SeqID_76237
ttctcgtgaataagtctcctaatcagaccttgttcaaaaaaggggcggaaaaaagtcttgactcaaacttgaaaaactatttaatagtttacccaaaaatctgaaaaaatcctatttatataacttttgatattgatcaaaaaagtctcttatgccaacttgatcagatcactcctttatggtgatcgagacaccaaaaaatacattgaaaatcgggaaaattttcgaaaaaattcctagggagttagtaaaatttcccgggaatttttgaataggttcattggaaagagcacaaaattatctgccgaattaaatatacataaacaagaaataatcagctaaatttccagtcgaaatttaaaattctacaaattttatcatcttgagtcaagacttttttccgccactgtatgcttcttaaatccactctatgagaaaattaaaaagatcaatattcccattccaacacttatttcatcatcatatttcccttttctctattttcatttttctttttgtgaattttttattgaaattagacataaatgaatttattttgacaaaaattctccaaatggtaaaatggccaaactaataatgtaaaagcagtaatttccattgtacttttagcgatg

SEQ ID NO: 103359 - DNA, 264 bp, Heterodera glycines
  misc_feature (15)..(15): n is a, c, g, or t
  misc_feature (43)..(43): n is a, c, g, or t
  Promoter: Source sequence=SeqID_33701; Location=693..956; Strand=-; Gene=SeqID_63677
aaaaaagcgtttccngcagctccgagtgttcgaatgcacgacnccaatggttccaccgcaaattaggcccgtccattcaaagttctgagcggaaaaaaaagtaaggacggattacaatcacaaaaatttgattggttatttaattttagaaattacgaaggcaaacaaaggaggaaaagtaagataaaatgaataaattgcataatttaacattttaattcaaaaacaggttataatgaagagaagaaaaggttagctaaaatg

SEQ ID NO: 103360 - DNA, 61 bp, Heterodera glycines
  Promoter: Source sequence=SeqID_15946; Location=1988..2048; Strand=-; Gene=SeqID_80298
ttttattttatttttagattttcatatgttttttggcgttcgttacatcattttgctgatg

SEQ ID NO: 103361 - DNA, 254 bp, Heterodera glycines
  Promoter: Source sequence=SeqID_36358; Location=197..450; Strand=-; Gene=SeqID_65694
ttgccttcgcttctcccccccccccaatttttttttgccttttccgtcagtttctgtcaatgtcccgcatcctttcgcttctccttttgttgcctttgtctatggcaatgatttgttacaattcacaggcggtcaatccgagcagagaaagcatttgtgagccggaagaggtccaagagaaaagcgatgggaagggaagggaagggaagggaagggaagggaagggaagggcccggaagagctagaaagggatg

SEQ ID NO: 103362 - DNA, 346 bp, Heterodera glycines
  Promoter: Source sequence=SeqID_7981; Location=2178..2523; Strand=+; Gene=SeqID_66581
ttgttcaacctttgaaatttgttaaatcttttataatataattattatttttatattatacaaaataaaaaaagtaataaataatggaaaagcaaattcaggcaaaaattaagcaacattttcaattcttcataataattacacgaatctgaatcgatttccacaatcaatataacaattttttaatttaattattttcgttttaatttatgaaatatacaattaactcttttctttattatcaatttttgggattcacaaatttaaaagttggtaacaaaattaaaatattaaataaatagaataaaagataaaatatcttttttaaattttattatccaaaatg

SEQ ID NO: 103363 - DNA, 626 bp, Heterodera glycines
  Promoter: Source sequence=SeqID_8050; Location=1..626; Strand=+; Gene= SeqID_66827
gcaatttcgagcatatttcatttttttacatatttagagatttgagaaatttatagaaattttttatgaaaaataaaaatttttatgaaatgtatccctaaaaatatgaaaaaaattaagcttaaaatactacaaggtgattctaagcctacttaggtcattttatggcatttttgcctatttcaccgtttgcaagaattttttttccaaaaaatgatcaattttaattacatattttcgtaggatttttgtatatatttatatattccggggttttttcttatccatattttgtaaattttattacataacattcccatccctattaataatagataacgccgcgtcgttcatttttaaaattaaactatttcttcatattttagaccaaattttaacttcttttttttggaaattttttaaagccgtcatcataagaaacacaggctaaacccaattttataaggctaaaatcaattttacatattatttaaaaaaagaataagagtagtccctgtttaattgtatttgttgtataaatatgttttttaatttttcgattcctttttttcattaaaaatatttttcctaccaatataaataaattatttgaatttaagaaaatg

SEQ ID NO: 103364 - DNA, 109 bp, Heterodera glycines
  Promoter: Source sequence=SeqID_15609; Location=1..109; Strand=+; Gene=SeqID_79900
ttttcatttcctgtttattaaataaaaattcaaatttgaatttttagaaaaatataaaacttgccttaatttttttttccaatgtatttattttaatttcctcaaaatg

SEQ ID NO: 103365 - DNA, 1003 bp, Heterodera glycines
  Promoter: Source sequence=SeqID_168; Location=798..1800; Strand=-; Gene=SeqID_75823
caaaaaacagtgaaaaagaaaaattatttaattttaaatacatttagatattatacaaatttaaaaatatttggaatttttagctccaagactccggttagcacaacattgactacaaagtacaactcatacatctgcgtggacagccgtgccaaaaaacaaacgacaatccccggcggacaacggtgagatagaaaaaataaggagaattttaacaatttttttggcgtacataaaatcgctgagtctaaaatgttttttaaatttttattttattttttcaaatgttttctttttaacattttgctttttttacttttaaatttgtccttttacaccccaaaaggctgaaattatgccaatattcgtcagcatttcgtactttttttcattatttgttcttttacacacctaaaggctgaaattatgccaatattcgtcagcatttcgttcttttttttcattatttgtacttttacatcccctaaaggctgaattatgccaatcttcgccaccatttcgacttttttttttcgcaatttcattttacaccccctaaaggctgaaattatgccgatattcgtcaccattggttgaaattatgccaatattcacagcattttctactttttttttcactatttgtccttttacaaacccctaaaggttcaaattatgccaaaattcgtcaccatttcgaactttttttttcaatatttttattgccacccctcttaaaggctaaaattttgccaatgtttgccgttttttttattttacacgcccaaaaggttgaaattatgccaatatttgatactattggtggtttgatcctaaacctattgcaagggtgcaggccatctgagcgccccctaaaggctgaaattatgccaatattcgtcaccatttcgaacaatttgttattttaaaccttctaaagctgattgtcttttttctaatccaaattttagacgtttatttttgcacaaaatctaaaagaatg

SEQ ID NO: 103366 - DNA, 136 bp, Heterodera glycines
  Promoter: Source sequence=SeqID_19625; Location=1360..1495; Strand=-; Gene=SeqID_84371
tcctccaaatgttcgacctgtaccgtcttctgttcccccccacgacccgaggctctgctccttcttggactcgttctaaatccagcccgaacagttcaaccgggactggttctgctcattgctgagcaaagacatg

SEQ ID NO: 103367 - DNA, 60 bp, Heterodera glycines
  Promoter: Source sequence=SeqID_14273; Location=1323..1382; Strand=-; Gene=SeqID_78290
tgtcataaatcaaaaacggatgaagaaaaatttgaaattgtacaaaaatttaatgaaatg

SEQ ID NO: 103368 - DNA, 348 bp, Heterodera glycines
  Promoter: Source sequence=SeqID_1837; Location=3334..3681; Strand=-; Gene=SeqID_76279
attaaattaatccctttaaactaattgtttttcatatttgtcagagagtcggcgtcgtttgcgcgaatgcattcgtttggacgccgtcggctgttgccttcgtgcgttacgttcgttgctctctggacccaacaatgaaatgaatcgaattgccgaagacaccttggcacacacaaattttgtgcttctccgcaaaaggtgactccgtttacagtggccgaaggcggtgttgcgacaatgaaaagcctcgactgtttttttccacttcagatcgaaagttcctcctaaaggtccgtctgagtggggtcgtaccaatgttcgtctctcgtcttccgccgtctgaaaatg

SEQ ID NO: 103369 - DNA, 1003 bp, Heterodera glycines
  Promoter: Source sequence=SeqID_8449; Location=1749..2751; Strand=+; Gene=SeqID_68105
tttaggctaaaaaatctcgaaaatagctaaatagggttgaaaaatcacttttgaagaagaaaaaaataccaaataaagctaaaatgttattaatattgtcgagaaaatacccaaaaaaaggtcattaaaaaaatttcggttcatagagatcaaacgggccgctgtaatagaggggccgctttaatagaggatttttttgaaaatgcccaattatgcaaaatatgcatatggtatcatcgtagaagcttcaaaccaagctaataacattttttgtacgtttaaggccttttatataatccataaaaaaaagcatatgcatataatacccaaccctatttatcactgagtttacactatgcaatcatttttaaaaagcggaagactttctgtcaggggccgttctgttaaagggttttaaaaactcctgaaatttattttatcatttaaaatgggtttgcatattccatataatttagttacatttgcaatgacgtttggttcgatgtgtttgagttccttagccgtgccgaactcggtaatttaatggcacagatcagcgaacggttcgatgcattggtggacaatcactattcgacgattaaatggtcggaacaattattattattttggaatttttcaacttttacatacctattctcaatttttgaggattttttaatgaatttttgaaaatgtacattaaaatcgttttttccaaaaaatgacttagaaaccaatttttttaaatagatataatcttattctaagcctaattaggtcatttttatgacagtgcttatccgtgcttttctaaaaattttcgtcaaaaaaataatatacaaaaaaacagaacccccggggctcgaactcagtaggtacggtgtttggggatttttgtacatattttttattcgagattttcttattttgagattttttagatatattttacatccctaagaataataattattaaaaacaattcatttaatgcttaaggatg

SEQ ID NO: 103370 - DNA, 306 bp, Heterodera glycines
  Promoter: Source sequence=SeqID_5968; Location=761..1066; Strand=-; Gene=SeqID_59858
ataaagattagtaaagaatatccgatttcgatcagaaaaatttccaatgagaacaaattacctaataaagataaaaaaatatttcgaaattaatgaatggaataggaaaattattatttatttatctaatttgtaagtgaaaaattaaattcactgcttagaataacgtggcaattttattattgacaaagatttgttaaaaaagagaatataaataccaagtgaaataataatattaaaaagctgaataaaaaattaaataaattcatttaatgcaataaattcgatttctcaaaagaaaagatg

SEQ ID NO: 103371 - DNA, 367 bp, Heterodera glycines
  Promoter: Source sequence=SeqID_39921; Location=1..367; Strand=+; Gene=SeqID_68373
cccccccccccaacttagcttcacccaaaatttccaaaaaaattttcactaaaatttcgaaaaaatacacaatttgttgatgaaaatctgctaaagatggctgaaaatcgcaaaatttgtcattttttggacaaaattcgttaacaaatcggattataaattgcaaaaaggggaggtaccccttattatggggttttcgggctcgctgatcacacgaatatgacatccatttcgaccgatttcggacccgaactcgaacaaaaagtcgagaattcaaatttttcaaaattctcattgaccttaaattgattaaaacagggtaaatttagaacgaatgattgtgtatatattagtcgggtgaactatg

SEQ ID NO: 103372 - DNA, 71 bp, Heterodera glycines
  Promoter: Source sequence=SeqID_13734; Location=906..976; Strand=-; Gene=SeqID_47153
ataaagggatcggaattcaattaggaaatgttgaatttaaacggcggataattacaaattaatgcaaaatg

SEQ ID NO: 103373 - DNA, 52 bp, Heterodera glycines
  Promoter: Source sequence=SeqID_11224; Location=668..719; Strand=-; Gene=SeqID_74582
ttctgtttaaaatgttttgataagcctaaaaaagcacttaaaggtacaaatg

SEQ ID NO: 103374 - DNA, 127 bp, Heterodera glycines
  Promoter: Source sequence=SeqID_20712; Location=2191..2317; Strand=-; Gene=SeqID_51271
gtaaaggtccttaaaaagtgctaagaaactattcctagaaataaatgggataattgaaagccaaaatttgttcaaaaattttttttttaaatttattaatttattttttgacattgttaaaagaatg

SEQ ID NO: 103375 - DNA, 1003 bp, Heterodera glycines
  Promoter: Source sequence=SeqID_8881; Location=3132..4134; Strand=+; Gene=SeqID_69513
attggtcaatttttctttatttttaagatttttacttaattaatcattttttcatttttcttcgattatgattttaaaaaaataacaaaattatcaatttttagcctaaaatttccggtgcaccccaaaacgtcgtcggccgaaacgtcgtcggaagactttttgaaccataactttgttcactgtcaatcaaattaagaattgttggtgttgttcgatagctctatgtgtttattattaatttgcaaaatctcaaaaagtttggttaaggttcaaaaaagttatggccagaaggaactcaaaaacccagtaattcgaacttttttttgctctgatttttttgtgcataaataaaaatttttgaaaatttgcaggctaatagcatttttcgaatgctttcgaataataccaagaatgtttaatttggttgagaaagaaaaaagttatggtcgaaaaattcgttcgacgacgtttctgctgacgacgttttgtcctactccggccgcgtcgcgcgtttcggggccattctttttttgtttaattaagacaatttgagtgattttcaatacaattttttaaatgcatttggtgcttggttggcgctggaaaagcgttaccgaattttttttttcctaaaattgaattcgttaaatttaagctatataaatcgacgattgggatttttataatttcgcgaaatttcggtgccaaaagtgccaccgatgagaattttgcatttatgaaatttgttgagaattatctaattttttaagatttaaatttccctgctaactacgactccctccccttttcaaaaaaaaaaataattgaaaatttaacaaaattgtctattctagtagtgccactgccgaaaaatgccagcataaacccttttttccgatttcggctccccattttccatccgtctatttatatatatataatttttttatttccgttacaacaggtgttcggcggagcgtcgccctcctccgtgtcgatg

SEQ ID NO: 103376 - DNA, 298 bp, Heterodera glycines
  Promoter: Source sequence=SeqID_3925; Location=1996..2293; Strand=+; Gene=SeqID_52470
attaggaaaaattgtataaaatgaaaatttacttcgtaattttactatgattttgaaacctaagaaaaattatattttacatttttgacgaaactttccgaactctgtctattgtgaaaatattaggctaaactatgaatggttcgtgctacgttattttaatagttcaattcatagggctgccaattttatttaaataaattttttcctggattcattatggtacaaatagaagaaaaacaatcgttgcgccaggaatctatttaaaaagtgacttttttgtgtttgacaaaaaatg

SEQ ID NO: 103377 - DNA, 1003 bp, Heterodera glycines
  Promoter: Source sequence=SeqID_5222; Location=1683..2685; Strand=+; Gene=SeqID_57315
acagcaatatgtttcggattacaatgaagagattatccgcaaagtttgtattaagcgagccattcattttttaacgattaaaatagaaagtaaatgtttacctgtttttttctcaaaataagcaacagaaaaatgttaattctaagtagtgatgttcgagagtctcgactcgagaaaagtctcggttttttttggtctcgagtctcgggttttcagtctcggtctttgagactttcgagaccgagacttttttacacccctaatgatcggctttttgtttagaaataaatatacttttggtatatttttgcttcgttaccttaatagtgtgcgtggctcagtgggttgtgttcttggtcatgtcttcattttagcgttggatcagtacccctccaagtatttaatttttcttctaatttttcaaaattattccttttaaagtgaatctaatcaaattaaaatcataaaatattgtcatttttagtactaaatttgttcacaaattgcactcaaattttaataccctttatttttttaaattgacacaaaaactgcgaaaaaatcaaactaattttttgttttgtgcttttttgaaatgataaatattgtaccaaattgaatcaaaataaaaaaaaaccaaaaattagttaagaatagagtcaaaaaaaatttttaaacgatttttaagcgaataggaaaattttttgaaaaaagtctcgggtctcggggttttcagtctcggtctcggggtcgggtctcggggtcaagtctcggtctcgagtctcgggaaattttcggtctcgaacatcactaattctaagaaatgaacccaaactaaagggcattgtagccatttgaattgatgaacgaacgactaatgagaagctgacactgattaaggatgaatatggagacgggctgttgaagcgatgcccaattagtgaaaaggcggcgacggatcaatgggaaaatgaaaaaaattgggacgacaatttgaacaatg

SEQ ID NO: 103378 - DNA, 561 bp, Heterodera glycines
  Promoter: Source sequence=SeqID_1782; Location=1781..2341; Strand=+; Gene=SeqID_75929
tgccgaccgcatgggctggttgcacaggtgccaatgtgatgttggcaaatcgggcctgtgaaatgtgcaatttttagtaaaattcaatttctttggcaaattttccatttttaccagggtttggcgttaaaatttaatttcacacttaaattgataaatttgaagcccaaaaattggtgtaaaagcccgaccgaaacatggaaaaagaagctaaaaatcttttaaaaatcaaataaaaaacggcaattttccaagttttcatcatttttagggggtctattgaacagtcttccaaataaaaattttagacaaaaattccaatttaatgaatttatttttgtgcaccagatccaatttctgggcgatattttactccgatttaattccaatttaagacgaactttttttttgcaccggggaatttcggattttatgaaaaaacttagtcataggccttccggactctctttttttttacactcgaaagctgattgcatctccagaaattgacaaatgtccccaacccgaatatgccgcaaaaaatgttaccaatgaaaaatg

SEQ ID NO: 103379 - DNA, 107 bp, Heterodera glycines
  Promoter: Source sequence=SeqID_13019; Location=1..107; Strand=+; Gene=SeqID_76795
ttttttttgactagtctctgaatggggttatcccagttttagtatcctttttgaaaaacaacaattttaataactgatacggtagcccaacatccattgccccaatg

SEQ ID NO: 103380 - DNA, 286 bp, Heterodera glycines
  Promoter: Source sequence=SeqID_21884; Location=939..1224; Strand=-; Gene=SeqID_52525
acggtgctgagtcgttatataaaaaccatcaaatggaaattttcaacaaaaagctgcccataacttttgtcatagtcaaccaaattaaacattcttagtatcattcgatagccctaactttctctattagttcaactaaattccaaaaaatttggtcaaggttgagcaaagttatggcctaaagtacccaaggaaccgggttttcgaacatttttgggcataactttttttttcgagttaaaattcctttaaaatgaatttcgaatttttcacttcgcttaaaatg

SEQ ID NO: 103381 - DNA, 211 bp, Heterodera glycines
  Promoter: Source sequence=SeqID_19125; Location=1..211; Strand=+; Gene=SeqID_83868
atttccttcttatatacgcgttgagaggaatttctttattttttgttagggtgttttttggtcaaaaatgggtatataaaagccaattttttgcctcctctcaacataatttgaactttcatccaaaaataatgcctttcttctccgcttccttcgccgtcctttttcccatccaacccatccaaattatttgtgttgcatttgccgtatg

SEQ ID NO: 103382 - DNA, 658 bp, Heterodera glycines
  Promoter: Source sequence=SeqID_28250; Location=1..658; Strand=+; Gene=SeqID_58889
cccggatttttatgtttttacatattttttttgcggcttagttatggcgagagaagcccaaaaatagcattatctccgaacaatttttgatttagagcgacttataaaaacataaaaacacatattttggcgttttgtcacataaaatatgttagcacatattttggggtttggcacatattttgcacatattttggcatttttgagaaaaattgcaataaaaatacaagaaaattgaaaaatacaccccctaaaaatcgacttttttcctaattattaacataattttcaaattaaaaaattttttcttcgattgtagaaactaatgaaatctcgaattcattaattcgtcattggatttcgaagttctctgctggaactttcaatttatagaaatgatttatcaaaaaaagacaattttaccccaaacacttcgaaatgtatttgatttgcgttgtatgggctaaaaatgataaagaatgagatttttgggaatttttatgcaaaaacacacttattttttcaatttttaacacatattttagcacatattttggcatttttgggggtttttagcacatatttcagcattttttagcacatattttattacatatttcaggatttttagcacataaaaatccgggccctaatgatg

SEQ ID NO: 103383 - DNA, 94 bp, Heterodera glycines
  Promoter: Source sequence=SeqID_7250; Location=1367..1460; Strand=-; Gene=SeqID_64255
ggtgtgtattgagagaggggagtagtaggcgttcaaggattttggcgattggagagagaagagagatcggacggaagttggcagggttggtatg

SEQ ID NO: 103384 - DNA, 374 bp, Heterodera glycines
  misc_feature (18)..(19): n is a, c, g, or t
  Promoter: Source sequence=SeqID_33948; Location=489..862; Strand=-; Gene=SeqID_63869
tataattaaatatctctnntaattaaaactatgaaaatttctaaatagtaaaaaacattcaggatttattaaaatattgacaaaaaaaatttgtgccaaaatatttagcaaaatattgaggaaaagttaaaatttactgtattttatgaaagctcctaaaatatgaaataaaaaaatgaataaatatttttattgaatttcagttaattaaaaaaataaattaatttttaataaaattgatcaataaatatttttaaattattaaaattaattaaaattggattaatttgtcaataaatatttttagaattatttcaattatataataataataataattaattttcaattataattaattgatcagagagatg

SEQ ID NO: 103385 - DNA, 120 bp, Heterodera glycines
  misc_feature (11)..(11): n is a, c, g, or t
  Promoter: Source sequence=SeqID_37916; Location=1..120; Strand=+; Gene=SeqID_66882
aattttaaatntaattcaaattattaaatatttattcattttatccccgtgcatcaattttttgactctttaattacttaaaatccattattcaattttaatcaaattcagttgcccatg

SEQ ID NO: 103386 - DNA, 315 bp, Heterodera glycines
  Promoter: Source sequence=SeqID_44477; Location=1..315; Strand=+; Gene=SeqID_71965
aaaaaaaattttggatataaaattttgggccatactttaattctaactttgattagaattatgagatggcccttcgctgcgctttgctcatcaaacaaaaacggttaaaaaccgttatgagtccattctgaacatggccgaaattcactttcaaatggcaaaagcattcatacaaaaccgacaagaggaagaggtaaccgaacgaacagtcattttctgaagtcaaagcaaatttcaaatttaaacccttaggcattgcgttgcctcgaggaagtgccacaaacggagataacgcccaaaatattgttcacaatg

SEQ ID NO: 103387 - DNA, 1003 bp, Heterodera glycines
  Promoter: Source sequence=SeqID_6116; Location=1350..2352; Strand=+; Gene=SeqID_60420
aaagccttcacttttcataaaaattttggaaaatatgaaaaaaagtattgtaaaagttatttaaaatcatcaaacataatttaaaaaaattgtttaggttaaaataaaaataatgtgacttttgaattttttttaataaaatacgtctcacatgaaagaatttcatttaaaaattttatcaattgatgtgttaatccattcattaatttaaattattatttctccaatagatttttcgatcattaataaataattataacgattttaatcaaagtaaattttaatggaacttcctgtattaaattatctttttgaactttaagtagtcagtcaattcataatcaattttgtaaaatctttattaaatgcttcataaaatcttaaacatttataaagcatcaaaaattaaacattttctattttattattttataaattgacggatgctaaatctttattaacgtgaataaatgaattaatatgaatatctaatcactttattacacaaattagatatttttgagaatatatatatgatgagtcaatgaatgtttggatgacattttcttgatattggtagtaacatttaacagaatgacatttttgttcccatacacacaaattttttcttaacctttttcatcttttaaggccaatgcaaatgaaatttgctatgcacaattacaatattcctttaatttatttattaataatttcaaatatgaattaattatttggaagtatctcggaattgatattagtttagcagtcattcataatttgtcagatcttgtttttaggtcaagggcaaaaaaggaaaattaaagcaaataccatcgcagattcaagagtcaatcaaaagtgtaattattcaattcgtaaatttttttaacctaacaaattgcatgtcttaatatccatcttttttgaataaatttgtatatgggatttaaaaaaatgatttataaaataataataattatagatttttgtttcattaatg

SEQ ID NO: 103388 - DNA, 71 bp, Heterodera glycines
  Promoter: Source sequence=SeqID_35807; Location=108..178; Strand=+; Gene=SeqID_65277
ggtggggaaaggcacaaaaaaaagaaacgcgcgacatttgaggacgaactcacatttcatttggagaaatg

SEQ ID NO: 103389 - DNA, 337 bp, Heterodera glycines
  Promoter: Source sequence=SeqID_12471; Location=1403..1739; Strand=+; Gene=SeqID_76100
ttcgaactgctcgtcgcactgtggcaagtgttcgctcggaatttcctctgtggcgaatatttaattcggcaaattgattttttcgaagcatcaaaattaaaatagaagaaaataaagcggaagcgaaatctagaaactggtaaaaaaaaaaatttacgggagcgggagtccgaaactttccgggaacggaactggaactcccgtaaaaaatgctataaatttttaacggtagacccggcgggagtaattcaaatttaatgaaacaaaaaaaaattccattctcgagtgtttcaaattagtggaaatcaaattttctaaacttggtattttccggatg

SEQ ID NO: 103390 - DNA, 287 bp, Heterodera glycines
  Promoter: Source sequence=SeqID_4434; Location=2772..3058; Strand=+; Gene=SeqID_54435
ttttgtgagacaaaatgccaatttatttttccaattttaaaacatttaaaaatgcctttatcctgaattcggattagctaatgtgcttgccatgacaaaatatttggccaaggcttaaatattctttcccagaattttacttttactatttttactttaatattacacactgagtaccgtaatttatctaccgtatttcaatataaataaataccgtaatgaaaatctatgcgtaaaaatttttgttaagcgaatatggcctcatacagcggttcttgaggccgatg

SEQ ID NO: 103391 - DNA, 53 bp, Heterodera glycines
  misc_feature (6)..(6): n is a, c, g, or t
  misc_feature (19)..(19): n is a, c, g, or t
  Promoter: Source sequence=SeqID_13312; Location=2201..2253; Strand=-; Gene=SeqID_77160
agtccncgggtttgtaacntcggctgaaacttgtcgccgcttacctaaaaatg

SEQ ID NO: 103392 - DNA, 616 bp, Heterodera glycines
  Promoter: Source sequence=SeqID_902; Location=1..616; Strand=+; Gene =SeqID_63629
ttatttttgttgagctttttctttgcgtttttttttagtcgttaattgtagtaatttgttttaataatgattcgtggtaattgcggatatttgtgtgctgtggaataatcttgtttgtgttttaattgtgcagtcaattgcatttattgcgaattgactgagtcggcataattggaaagaagccgaacgaattggtcaaagtccctaataataatattgtccccaatctctcctgtcctaattaaagactgttcccgtgcccctgccctaattaatctaaggcaaataagcagcgaacagcaccgaacggcgagaagtttttactatttggcgctcctggacagaacacaaggtaacaacgacatcggttcaaatttttggaggatttcggcattttatcgatctctgggggagacgataaacttttcgacttttgatattgttctctgggggagacaatcaacatcaacaatcgttctctgggggagacgaaacaaaaacgcttaaaaagaacaaacaaaaaccaattgtttgttaagttctctgggggagacaaattcggaaatttttcgacactcaagtcacctggggggtgcaaatagtcgattttgaaatg

SEQ ID NO: 103393 - DNA, 173 bp, Heterodera glycines
  Promoter: Source sequence=SeqID_34120; Location=897..1069; Strand=-; Gene=SeqID_63994
tgttgtacaaattgatctgccattgttgttgatgatgattttgcaagactgatttgattgtgtgagaaaatctcggcttaaatagctttcaaaagtgggcgtggcctaattttccggggagtataaaagccccggcaatttgtcagctatgtctcatttgttctgctacaatg

SEQ ID NO: 103394 - DNA, 380 bp, Heterodera glycines
  Promoter: Source sequence=SeqID_39746; Location=990..1369; Strand=-; Gene=SeqID_68244
tttcaggatccgaaaaaatcatcataaaaaaatttcaggattgagaaaataaaacgctaaaaggtttgagattaaaatttgcaaaagttaaattgaatttcctccacctgtcactttggtgacaggtggatgattgatgaccttcccgcggcgctgcgcggcgcgggaaaaaaacacccgcaacaatttgggaaatcggatttggtcaggcggcaacttcaaagtggtccaataggttttggttttgaaacaccccccatcgtggattttttgatggggcggcaacttcaaagggctgcacccctcccataggcacgggctcgtgcgggaaacacccgcaaccaacccgcaaccttttgacgctatatactactgtaatg

SEQ ID NO: 103395 - DNA, 172 bp, Heterodera glycines
  Promoter: Source sequence=SeqID_2717; Location=2211..2382; Strand=+; Gene=SeqID_81237
attgttacttcccctgatcggtcacacggggttcatttatgagcgcccatctcgccaaaattatcgttataaaatgggcgtggcacctggcccgacttttttgcgtataaatacgggctcaccgggtggcatttttcatttggcgtcccttttcaaattcacaattcctatg

SEQ ID NO: 103396 - DNA, 1003 bp, Heterodera glycines
  Promoter: Source sequence=SeqID_9025; Location=718..1720; Strand=-; Gene=SeqID_70039
gttacggtttgctttttaaatggtggggctataacttaccgtattttctttttatccccccggggggattatttttcaacctcctcagaaagggggggggataattagacacggggggataaatggagaaggggggattatttttcgacagatttatttgggtcggggtcgttttggcgccgacgttttggcgccagcgcaagttttttgattataactttttttattgttaaccaaatttaacattcttggtatcattcgaaagcttaacgtgtttagaagctatttctaagcaattgtttcgtgattagacaattatcaaaaaagttataacctgaaataacaaaaaaaccaaaattttggaagttttttcttaataacttttttacaagctaaaaattttttttttttttgtaaggctaatagagcttatgaagggctttcgaatgataccaagcttgttagatttggtcaacaatgaaaaaagttaatcaaaaaactcgcgctggcgccaaaacgtgggcgccaaaacgacccagtcccctttatacccctgtaaattcaggcaaaatgatcgaaaagttaaaaattgaaaagcaaacgattgccaaaattctctataaaagggaccattttttaaaaaattctctcattttaatttctcccaacaaacgcctttctctatttttgaattctcttcagctgctgctccattctattttttaattcttacgctaaagcgtcgttatggttttcattgctcaaaaatgtctaaatttttgtttttcattccaccaaaaaatgttttggttatgtttttcaaaacccggcaaaatccatttgaaaaatttggacccactgactcagcgtttcttgatccggcagaggttacaaaaaccggactcgccaaccctgcttcaaaccaacttccccctttccttttttcctgacaaattttcaaataaaattaaattaatttgcttttcttttttaagcaaaaatg

SEQ ID NO: 103397 - DNA, 1003 bp, Heterodera glycines
  Promoter: Source sequence=SeqID_2295; Location=2396..3398; Strand=-; Gene=SeqID_78975
tcggacgtttcgccaaccgggcgttgtgccaactagtttaaaaaggcgttaagttatattttcatgaattagagactaaaatgaatgaatcattggaaaataaaaaatatgaaatgaattgcaattaattcacaaagaaatgattgaaaaggagtttaaaagagaagttttcaccaaattatcattctttgcattttattgaggcaagctttttgaatttctattcgtctatcaaaactaaaaataagagttctgcaaaagtcaaaaagtcaccgcaagctggaaatcggacgagcagaacacctccagcagtaaagcactaaagtcggtaatactgcagaattgcggtcccgacgaaaaataaataaagttttggtttttgtttctactaggataaaaaatgtgctgattacgacgaacccgtgctcagaatttgcaatagcaatgattttgtctatgatttttcatcgagtacttgatttttttcaaaaaattttatgaaaattaaacgggcgtaaaaaattcatacatacatatttcttatagagcttaaaaagagcttttgcatgatctattgaatgtttgaagaagataagtttcaaattttttttttacgattttttgaaaatttaattactggcccttatgacgatggtcagggattcgaatccgcttggctgcggattaattttttacgatactttataaaaaatcatggacaaaaaacactgattttgcaaagctaagctttggttcgtgatcagcactttattattttgacttagtaggctaaacgccgatttttgcttagcaggcgaaatgtcatacagcctagtcgtgccttgagttattgtttcaattctcttcccctaggtcttctcaagaagtacgcaaaatttctgacggatttcaattgtcttttcaccgattgaacctttatttttcggcattttggttttaagtttcaaagtttcactcctccaattcgaaaaaagggaaaatg

SEQ ID NO: 103398 - DNA, 72 bp, Heterodera glycines
  misc_feature (17)..(18): n is a, c, g, or t
  Promoter: Source sequence=SeqID_19327; Location=1..72; Strand=+; Gene= SeqID_84065
tttaaaaaaaatcaaanntccgtaagggcatattcttcgaccaaaaagtcctcgcaaaaacgcgatgacatg

SEQ ID NO: 103399 - DNA, 226 bp, Heterodera glycines
  Promoter: Source sequence=SeqID_12757; Location=1..226; Strand=+; Gene=SeqID_76465
tttcctcctcccccgttttatttggcaattttaaggactttttcctcgacatcttcagaacagtcggagaaagcagcttcttggaactgtccaaaaaacttgaccgatttatcagcggagtgcgccgaagagcaaactgcccaaggggcacaggcggacgacgcggccaaaacaacggcggaatgggaagcgaaccagaacaaaatggggcaaaagggaaaaaatg

SEQ ID NO: 103400 - DNA, 104 bp, Heterodera glycines
  Promoter: Source sequence=SeqID_17450; Location=2433..2536; Strand=-; Gene=SeqID_81934
ttattttttgccaaacagaaggttttcgccgtctggaaaaatatgccccgtccattctccgccacattctcagcgtcgacgatgacaaaagttcgcggaaaatg

SEQ ID NO: 103401 - DNA, 71 bp, Heterodera glycines
  Promoter: Source sequence=SeqID_41648; Location=972..1042; Strand=-; Gene=SeqID_69732
atcgaagtggtacgattgattcgatgcgtttgtttctgataatttcgaattgatttcagatcacttcgatg

SEQ ID NO: 103402 - DNA, 675 bp, Heterodera glycines
  Promoter: Source sequence=SeqID_19; Location=4535..5209; Strand=-; Gene=SeqID_76508
attattttttaatttattttgctgattttttctttttttgcgttattattaataaatttttgtctgaaaaattttatgtgtaattcttagttaacctttagttttaagtcacaccacctttttgctattattcaaactcttaacgtattcactcggctgattttaaaataattagcttcaaaatacattttcaagtacctgttgaaagtggacaacattggaattatttctgtccttagaggtccctgcgtgcctgcacataagtcccagtatcttgaatgtttgaggtccctgcgtgcctgcacacacacttccattggcgtctgttttaacctcttttcttctatgcatagagagcacaaacagtttaaaaacacacacctttttaatcgtgtgtcagcacgatctgttataacagtaaggttttgtatcaatttagtgtgcgttttataacacaatgtttttataatttttttattttccaatcctataagattttttcatctgtagttgttagcttctaactttattttattatgatttgaagtttatttatatttaataatacttttataaaacatatttatttgttgtgctttaagtacctcccattatcgaagatttttcatataatctatattttagcagcattatactctttaaataattgcgatg

SEQ ID NO: 103403 - DNA, 871 bp, Heterodera glycines
  Promoter: Source sequence=SeqID_7017; Location=2622..3492; Strand=-; Gene=SeqID_63576
gtctgacagtaaaatacacaaaaaagataagaaaatgccatagccgacctgcccgattgtgccaaatcaagaaaaaggaaaataaaaagtgcaaatgcggtctaaaaaatcattccgttgcaaattagcttggtttggcatttttaagtgatggctgcacatttgttgagttcataagcgctttttttgccattccctcgcacaagaatgccgttctgaattatggtgcaatcggttcccttcggtgatggcattttcctttatcttcttgtgtattttactgtcggattgtccactgtccgatcaccacctctgtcggattgtcctcaatgtcggaatgtccaggcacgcaagaaaatcacattcattttctcgtgaaggttgaagttgaacaagacaaaaatggcacggcagtctcgcggagacgcgtaaagcgcttttgggcggtattgtgggacatctgttggaatatttgaccttttgtttgtgattttaaattattgttggcattatgttctcatttttgcatttttatttttcttctcattacttaattaattatatgttctgttctcactgctctccgattctaaaatttttgttcttcatctcctccgacgcttttattcgaattgtgtaatttgatttgtttggaattgatattataaagagttttccaaattcccgctccaaaagctaaaggtcccggtcccaattaaaagccacaattcttcgaccaaatccgatcatttccaacacatcggcaaagctgttgtggtggagacagtaaaggcggttgcccccaaactgatcgatagtttcctaaagaaagactgtgccgaactacgttctgattgcaattgcaaagatg

SEQ ID NO: 103404 - DNA, 622 bp, Heterodera glycines
  Promoter: Source sequence=SeqID_26411; Location=1..622; Strand=+; Gene=SeqID_57144
aaaaaagttaaacaggatgaagtaaatgttgttttttacattattaagaaagatgagatagtacgtaaagtgagagaaataaagataaaaagtaaatgtgacagaacgccaattttaaccataattattagggctgggatttttgggaatcggtcgttttggcgccgccgttttggcgacgccgttttggcgccgccgttttggcgacagagtcgttttggcgccgccgttttggcgacagggtcgttttggcgccaaaaaatcagagacgcagaaataagcggcagacaagcgcctcttcaatttggtgcacaattacattccgtgaacccgaacaatgataacgatcacaattaccacattaacccaaatcaaaatcatcatatcatttttgaatttcttcgtggcgtttcgcgcaattatcatatgaacccatgaattttcttatttgtcttctttttgtttgttattgttagggccccgacttttagtgacgaaaaatcccaaaatagttaactaaaatagtgacgaaaaagtgccaaaaaagtgacaaatagtgacataatttttagccaaaaattgtgtaaaattaatttttattcactgatttcagttgcaaatg

SEQ ID NO: 103405 - DNA, 534 bp, Heterodera glycines
  Promoter: Source sequence=SeqID_19134; Location=1729..2262; Strand=+; Gene=SeqID_83889
aaaattgccaaaatctaaaaaaaatgtacaaaatttgcaatctcatttttaaatttttcagttggcaaccctggcaatgaccaacaagcgatgtaataaaacgccattataatgatataattaaattaattaacaattaattagttaattaagtatcaaataacaatttttcaattaaattaaactcttaaatggggtttgctaaaaatatgccattatttcattctgctgcacagatttggacactttcaatggcattccttcggttgtcgtcggcgccagaaaactgagcgaggaagaacggacggaatgcgcaatttgcctatgccaaatcgatgccggcacaaaagtcaaaccgttgcccatctgtaaggtgtggtgccatttgaattgaacacattaaattaatcattttgtgccgatttagcacatgttccacaacgaatgcattgaaatgtggtaagcaaaagttattaggggaaatatagttaattaattaataaatatgctttaggatcggaggcggtcataatg

SEQ ID NO: 103406 - DNA, 357 bp, Heterodera glycines
  misc_feature (157)..(157): n is a, c, g, or t
  misc_feature (181)..(181): n is a, c, g, or t
  misc_feature (251)..(251): n is a, c, g, or t
  Promoter: Source sequence=SeqID_39026; Location=1..357; Strand=+; Gene=SeqID_67699
tggaaaaagcgagttcataatgtcaagcagcagaagttgaaaagccaaaaagaaagaggtaaatctttataaggcttccctttgaaattatcagtgatgagacgtgggcaataaaacagttaaattttgcattagaatgccttaattttgcattcanaattgttttctcttaaaaatatanaaaatttattaagaagaaaaatgtaagtgaattcttatcaaattctgaggaatgatggaagtgtcaaagncaatttgtcggagggaagaggaaaaaatttttgttgaatttggcaccggaaattaaaacaaatttcattcttcaaagcgaaagacagcaaaaattcaaacaaaatg

SEQ ID NO: 103407 - DNA, 561 bp, Heterodera glycines
  Promoter: Source sequence=SeqID_1782; Location=1779..2339; Strand=-; Gene=SeqID_75930
tttttcattggtaacattttttgcggcatattcgggttggggacatttgtcaatttctggagatgcaatcagctttcgagtgtaaaaaaaaagagagtccggaaggcctatgactaagttttttcataaaatccgaaattccccggtgcaaaaaaaaagttcgtcttaaattggaattaaatcggagtaaaatatcgcccagaaattggatctggtgcacaaaaataaattcattaaattggaatttttgtctaaaatttttatttggaagactgttcaatagaccccctaaaaatgatgaaaacttggaaaattgccgttttttatttgatttttaaaagatttttagcttctttttccatgtttcggtcgggcttttacaccaatttttgggcttcaaatttatcaatttaagtgtgaaattaaattttaacgccaaaccctggtaaaaatggaaaatttgccaaagaaattgaattttactaaaaattgcacatttcacaggcccgatttgccaacatcacattggcacctgtgcaaccagcccatgcggtcggcatg

SEQ ID NO: 103408 - DNA, 246 bp, Heterodera glycines
  Promoter: Source sequence=SeqID_7506; Location=1..246; Strand=+; Gene= SeqID_65053
ggtagggaattcggcggtagggaattgggtcgatccctatttggtgttatgagcaattttgtctgacactggggcgtacccatagtgctgttataaatgacaggttttttccaccttattctttgcaactagcgccgaaaatttctagaaaacaaacaagtccgttaaattttaggaataaatttaattcggaccaaatctaattttcaaactttttacttttaaggctgttccttgtcaattatg

SEQ ID NO: 103409 - DNA, 290 bp, Heterodera glycines
  Promoter: Source sequence=SeqID_16478; Location=1168..1457; Strand=-; Gene=SeqID_80885
aaaatattaatttttcgaaattaagtcaggcgttacttgaaaatcgaattgatttatcaataaactcagtgttcaccgttgaacagaaatataaagaatttttaaataaagttctgaaattatatgatatttttatacccaataggcctctaaaatcgataataaaacaatcgtatcctcaaaaaataagagacttattttcagagaaattacgtttgcataagcttgtaaaaaaatttcctgaaaaaagtgatctcattttaaattacaaaattatttctagggaaatg

SEQ ID NO: 103410 - DNA, 282 bp, Heterodera glycines
  misc_feature (39)..(39): n is a, c, g, or t
  Promoter: Source sequence=SeqID_31291; Location=1..282; Strand=+; Gene=SeqID_61657
ttttattgccgcacaaatcgcctgagggtgagtgccgcncctcagccaaaacggtccctttttgtcgtccgctcacaccttaacgaaaaaagcaccgaacagggtccaacaacaaaaccacacggagaaacgaacgcaatgcgttattaaacccgttttatttcacaataaatacaataaaaaaggcacattttatcatggaaataaattaaaatttgaaaattaaaacaaaaaacaaacaaaaattcacgtgacaatttgaatggctgtcattgtaaaatg

SEQ ID NO: 103411 - DNA, 604 bp, Heterodera glycines
  Promoter: Source sequence=SeqID_6733; Location=2305..2908; Strand=-; Gene=SeqID_46301
ttttcggggttgctgatcacgaatctgatattcattttgactaatttcaaataccggacccgaactcggacaaaaaaccgaaaattcaaaattatcaaaattcacttttatgttcgtatctttacagaatgaccattttttggttttgaaatggtttttgactaatgaaaacactaagaaacatgttttaagagaaatttttaaaaaatttaaaatttaattctcgaaaaatgttcggggtagggattcggaattggtcgaaatggaagccggattcgttctcagcgcctcaaaacacccctagaaaagtgttaaaaagaaatacaaaaataaagtctcaacttaaaaccgactagaaccctatttattacccattttttctgaaaccaaatgaaactgaaattatagataggtaggtaacctaatagagaattttagagttaccgattatcgaatgtacccgtctttttggatagccttaaagtcgtcatgttattttatagtcgtgtaagactgcagtagatcctccaccccttattaatcagactttttctgcttactgtcacttatcccccttctttaaagcttaatactcattttaatg

SEQ ID NO: 103412 - DNA, 218 bp, Heterodera glycines
  Promoter: Source sequence=SeqID_22425; Location=1241..1458; Strand=+; Gene=SeqID_53086
agcattagcatgaaagagcgttgctgactttgtatataaaacaaaaagccccattgctttgtataatttccctatatatataaaaaaaaaaagaaagaaaaacttttttaattaatttaagcatttttctcccatttatcagtaatccttaccaaaaaaaaaaattaataataatgagtgctgaaacaccttccaattcggcggacatttcaaaaatg

SEQ ID NO: 103413 - DNA, 1003 bp, Heterodera glycines
  Promoter: Source sequence=SeqID_795; Location=2915..3917; Strand=+; Gene=SeqID_61501
acttaaacgatcaattaatctcgaaatttttgcaaatatgctttttaaacgggtgaaaaatttctacataacagcatttagtgcacctggaatggaaaatttatatttttcattcttagaaatgctcgaaaaaattcaaaaactacctaaacttattatgcatgagtatagaaaccaagcattagctatgcaaaaaatagaaattggactcaaagaaataaatatatttaaatgtcaagaagcagagaatttatcggacctttctttttcaaagataaatgaattccgagaacaagtgctaaattatagatttgacacgagaatgttgtataataaaattaagataactgcactaagccatttgtttaaacccgaaaaggaaatatttctctcgccttttagaatttctccagggaaagaacttttttacaacatgttccgtacagaacccaaaaaagaaatttttaattctacattttacaattatatttagcacaacctatcttgcgtaatttgaagatcatttacaaataatcacaccatattcttttttgaaaattttttaatttctctttagaaggaataagtaatttatttaaaaaaattttccttggttatgtgctcccaacagcgataaaaaagaaaaaaacaatcgttccgcctaatgttattccgttgaaaaaatcttacgatttttttatatgccctgaggcattttgcgcaaattaaaaattgaaggacgaaagaatgggctgatgtgaaaaaaataaaaaacatgtttgaggcgcaaaaagaagttgcgttatgggtaatataatgatgaaaaaaaacgttaaaaaagagaatagtgtaaaaaattttcattataaataacggggaataaacataactgactatcacaaaaatggcatctttgagcgtgtcccattgctctgctcacccaaacggttattttttttaatttttataattggtttaataaaataaagatgtttgcacaatg

SEQ ID NO: 103414 - DNA, 239 bp, Heterodera glycines
  Promoter: Source sequence=SeqID_26558; Location=206..444; Strand=+; Gene=SeqID_45998
ggtggccaaattaaattttaaaattaatttattatcgaatattgattggtggctcattaaataaattatctatagaaatctttataatgcattaagttgataattttcgcttttcttttgagagaaattatttttaatttcataaatttgttttatttttttttgttataaatgccttaaaaatcatttttatagtgatttgctgacttttttaaataaaaaataatcgcaaaaatatg

SEQ ID NO: 103415 - DNA, 103 bp, Heterodera glycines
  Promoter: Source sequence=SeqID_8234; Location=2193..2295; Strand=-; Gene=SeqID_67384
aaaaatgttgtaaaactgttcagtgcccgcaactattgttttggagtatctataataatatattttatactgtaattaaataaatatgttacagtgtgagatg

SEQ ID NO: 103416 - DNA, 457 bp, Heterodera glycines
  Promoter: Source sequence=SeqID_42787; Location=1..457; Strand=+; Gene=SeqID_70593
ttatttttacatgctttcggatgtgaactgtctgacttttcgctgtctccactcctacacaaacacaaaaacaaaacgaaaacaatattcataaaacaaatattgctaataatttcgcaacttttaaaaaaatcattgttttgtttttcatttttttgacctgcaccaccggggaaaaaaactcaaaaaaatagagggaaaaattggcatagatccataaatttggcaaatacctttttaaacaatatggaagtttcagcaaatttttggcaaacgatttttcaaaatttgaaaaggctttcaaaaaatatgtatcaaaaattatggtaaaactaaaattcgtttttttttaatttttatttttatcccttttataaatgcgcctcatttcagagctaattaccgaatacaaaaattttgatcaaatttccgagtgcaattttttttatataaaatg

SEQ ID NO: 103417 - DNA, 1003 bp, Heterodera glycines
  Promoter: Source sequence=SeqID_20600; Location=450..1452; Strand=+; Gene=SeqID_51150
acatcaattctcagatgcgtgtggtcaattttgcatttattttttaacacagcgatgctccggaatcctttattgtgaggtcattgaccgtctatataaggttcgcccgatgtccgatatattattaagaattttgtcagtaatgtttaatttaattgttctcctaacgatagtcggtcaactcagtggagaaagggttactattctttctgatacaaaaacgacaaatatctcactcactatgacaaagagttcggtcaatgaaaggttgttcggcttcgatcggtcgagattatgtacgataactaggaatctgatttcatggtggagtgtatcaatccaaaatataaattcaataggaaagagcggaaccattaatatcaaactttaccgggattttagacaattaaagccccgagcatgtttttattacaacgatcatagttatttaatttttcaaaacgaaaagacaaatgaaacttcggtaacaagagggagtcaagaaatagttgtcaggaattttcccggtggcgaccttagatttgatcatatgatggtcgacttttcgtaatcagagacgatcgaatagacgagattgacattagatcaatcgagaatttatggacacatcataatggcaccgaaattattactagaccgatcggatcaataccgtcttcatttaccgatttcctaataattgagggacaaatttatctgattaataaaaataaaatatacaaagatcgatttgactcaaatgagatacttcccaaatatgtgtcagacgcgaatagtgaattctttaattttgtcatgttcaaagaatttgagaaaattaaagatttttgtcaatttttgatttggtagtggtcataatttgtatatctgttctcagaattttgaaattaaagagaaaaggcaaaaattcatcatatagtggtgaagtaatgtatataaggaattgcaacgaagatgagaatgcctatctgtgttcaaaatg

SEQ ID NO: 103418 - DNA, 181 bp, Heterodera glycines
  Promoter: Source sequence=SeqID_5618; Location=127..307; Strand=+; Gene=SeqID_58670
ttccccctaattacccccttaggctggtttgaccggtgaggcggcattgacccccgactgtctggtgaacattgagcagtccggcaccaacgattactggggcatccttcacgcgttcccaattaatgaagttcttcgagcacgcatttacgacttggaggccatgctaagagcagtgatg

SEQ ID NO: 103419 - DNA, 1003 bp, Heterodera glycines
  Promoter: Source sequence=SeqID_3059; Location=933..1935; Strand=-; Gene=SeqID_83005
gttttttttgatttgcctcttcaatttctccccgggaaaagcaatttcaaggttgtaaaacccgaatccaaagcaatactggagaattaggggtccatcaatgaatttcctggtgaaacaaagctttttcctccaagagaaaccacattttaaggcttttcagggtcgaaaaatccgtgacaatattggagaatcggggaggggtccacccaccgaaaaagcattttttatttgtctgaaaatttctaaaatgatacatttgaaatggtgccaatgccttcaatgttcatatttccaaatttcattcccacgatcatttgcttgaccctttgaaaattgtttccaaatatgtacagctaccaaattcgtaagattttgttgtttgactttggaaaagcgcaaatttgctccttaattaacgattaacctaaacttgtcctcatttttttcttctccattttgctcctttcttcactttctctttgtctttttgttttctctagcatccattttttccttttctctctcgcggttctttctcgtctaggtatctctttgttttttctctttcctctatttttctcttttcgttatgactctcacttactctgtttctcactctctatttgtctcactcacttcttctcagacgcaatttttctctattttcttcattctttctttttcctttttttcccttccttttccattaggttacctattttcctctttctccttctcttgtctttcttttccactgccatacatttcaattgattttcgcgtttgtctgctcacttctttcgttccctttcttctattgtcccattccttcgtcggccattactttttaaaataaaatctttaaatttaattctttattttcaatgcatttctcgacattttctttgtacaattacctaaaaatttgtcggatttctttgttttattcattcaatttgtttttagcaaaatagaaaattgcaaaagtttcctaatcatg

SEQ ID NO: 103420 - DNA, 147 bp, Heterodera glycines
  Promoter: Source sequence=SeqID_11787; Location=874..1020; Strand=+; Gene=SeqID_75286
ttttgtcaaacaaaaaactgacggcaaagcctaatgaaagaattaattagcaacggaaattttgagcaaaaaatgccatttttttggatgaacaaaaaccaaatggccttgggcaaaatgagcagaagcgcctgagccatcagaatg

SEQ ID NO: 103421 - DNA, 499 bp, Heterodera glycines
  Promoter: Source sequence=SeqID_18157; Location=1..499; Strand=+; Gene=SeqID_82741
atcggattgtgctcccgtgttcgggcttgtggaccaatccaagcaagcgattttcaactcgccgagcgtcttctgatcgaacttgccccaagtggactgtaccgatttggccaagcaaagccccgaggtacgccttcgcactgacgaacagggattgatcccccttgagaccagactcggcaactgtacagcaagtgatgactggaaaagcccaattctgcttccggaccagtcaccgatcactctgctgataattcgagatcgtcatgagaagatgcgacactcagaagtagaagccacgctcacttcattcctggagaaattttggtgccataaagccaggggcacagtgaccagagaggtcaaaaaatgccttcgttgccgacgaatccaaggcccggcatttgctctgccagccatgccatccctgcccactgaccgtgttgtgcgatctgcaccctttgagcatgtcggcattgactacttgggccctacaatg

SEQ ID NO: 103422 - DNA, 1003 bp, Heterodera glycines
  Promoter: Source sequence=SeqID_40; Location=4228..5230; Strand=+; Gene=SeqID_55509
gtcagtccgcaaatgtagcgacacgaatgagaaagaaatcaaaaaagtcaaaaacacgaaattttggtactttcaattagccgccgggctccaaaatttcaaacttttcttaaaaaatggcctaaaaaacgtaagaaagagacgaaaataaacaaatggcaaatggaaaaaataataatgaaaagtggtggaggaagagcaaccatttttatactaatttttacaggatatacagtttaggccccataaatttttttttgttaaaaggcataaaaaacaattttccgtgggtttttggggtcgctgatcacgaatctgacatccattccgaccaatttcaaacccctaacccgaattcgaacaaaggtcgaaaattcaaaattttcacatttctcatttttagactctaaattgataaactgctaataaaatgcaacaatccataaattctacaaagttaaacacgtaatatatataaaataaagtaaagttcaacacaatcaaatacagcaaagtcccaaaatcgacaatatggagatgttagatcaattttcgcatgggtacaattcagcaacttgggaccaaaaatgttgaaaaacggcgtcataatcgccaaaatgcttccgccacaaatgttcagacatgtaccgtatttgctctaattatagcccagtctctattaatttcgcagtctccaattatccccccccctttctgaggagttcgaaaaataatcccccatgggctataattagagcaaatacggtatgtacgtgtcgtacaatgcacgtgaatcaccaaagcgacgcttcgctatattcttcagtttctgccacatactttcgactgattgtgtatgggaccccgtgttaggattgacgaagttttcactgtgattcacagtgtagtgttggtatctattttcgaataatatacgccatcctatccattactctacccctgctggggaaggttaggaatccccccatacgctctccacatg

SEQ ID NO: 103423 - DNA, 429 bp, Heterodera glycines
  Promoter: Source sequence=SeqID_29389; Location=176..604; Strand=+; Gene=SeqID_59888
ggtaattttttttgggtaccatttgcagcatactgtacataaatgattacagtatgaccggtctttccgtaataccgcccccgccgctcaaaaaatgtcatgattccgacaaatactcaattttctaggatatttttagacatagtctacataaaatttctatttttttcaagaaaaaattagaaaatatatctaggatttagggaaaagccaataaaagtctaaagcatagacaaaatcttgagtttttcgacttttgctctatttattaatataattgaggattagcgcctaaactctccctgatcagtattttgatttgtcgtgccgggcgactgtataacgaaaagtaccgtatggaggggaacatataaagggaaagtaccatatgatacatgggttttttttctcaggttcctctttaccatg

SEQ ID NO: 103424 - DNA, 64 bp, Heterodera glycines
  Promoter: Source sequence=SeqID_4960; Location=1669..1732; Strand=+; Gene=SeqID_56374
tttgcgaataattgattataattaattaaaattaattaatttgcatttactccttcaaaaaatg

SEQ ID NO: 103425 - DNA, 499 bp, Heterodera glycines
  Promoter: Source sequence=SeqID_43754; Location=367..865; Strand=-; Gene=SeqID_71355
aaaaaaaaatttttgcagcaattaggccaaacacacttataattaattaggtagtcgtaaattgtgattacaaaaaattatgacattaaatgttacttttctatgccttttgcctacatatatggctttttctcaaaattggcactcttctttaagtttttcgatttggtgcgctacgcttaaattttagtataagaatgcccgtttctccttttcctcctcctcattccattcattcatcattcgcctgatttttgcggttattttgttgctgcaaatttcttcagaaatatgaaccaacgtttaaggaaaatgtaaaagtattttttgatcaaaaacttttcggtaattttgcagtttagtgctttagtgggcccgacgaaaaaccacagcggggggggcttttgatttgaaattttaaattgttttaaaaataatgttttaagctaataatataaacccgtcgaaaactgtcattaataatttgctcaacaaaatg

SEQ ID NO: 103426 - DNA, 284 bp, Heterodera glycines
  Promoter: Source sequence=SeqID_30671; Location=132..415; Strand=+; Gene=SeqID_61079
ggtatggaaagaaaaaatagttatttctgggactttttcagaaatcagaaataattctccaatgtggcccaaattttaggcccccagccacagccccttgcttctcccagttttaagtcttggatttgtcaaataaattcaagacttcaaattaataatcaaaaattctcttaaaatttttttgaacccaattcaaaaaaggaaaaaaatttgcagtcaaaaaattattcgaatttctccaattttgtttccataatttccgaaagttattcggtatcataatg

SEQ ID NO: 103427 - DNA, 96 bp, Heterodera glycines
  Promoter: Source sequence=SeqID_2159; Location=1180..1275; Strand=+; Gene=SeqID_78160
ttaaaaaaataataatttgcctaaatgaaagatattgtaataaattttaatttaaatattttggatgcaattataaaaatataaggcctaaatatg

SEQ ID NO: 103428 - DNA, 286 bp, Heterodera glycines
  Promoter: Source sequence=SeqID_15963; Location=567..852; Strand=+; Gene=SeqID_80318
ggtcaatcggaaatcaaaaaaaaaaaaaatttcgagggttccccccccccttcctcaaaagttggactttcaatcaaataaatgcaaattaacaatttaatttaaaatttctaagattttttgtgaataattggcctaaattttcaaaaaaaattttatattaaaaaaagtttaaggaaaaaccaaaacattgtttaaaaattttcttgaaattttctttgaacacataacaaattgtataaataaataaatgataataattcaggtgagtttcgcaaccaacatg

SEQ ID NO: 103429 - DNA, 253 bp, Heterodera glycines
  Promoter: Source sequence=SeqID_12015; Location=1..253; Strand=+; Gene=SeqID_75541
aatatgtgagtgagcaaaaacattttcaaaaaaaaaatcatagctttaattgaattgctaattgctatcaaattagtaattttggatacaaatttctaagtaaattagcccaattggctaagtgttttttctgcgccatagaattccttaattcaattttcaactttttttttagcaaattcccttcaaaacgcgcatcagtgagccgctcagaaatggacaaacggtgcacgcagtgggaaagatcaaaatg

SEQ ID NO: 103430 - DNA, 155 bp, Heterodera glycines
  Promoter: Source sequence=SeqID_1937; Location=8872..9026; Strand=-; Gene=SeqID_76911
agtgagtgggtggtgttgatgatgaaatcgttgttaccatgcatctaattcgggtccctggattcggctcggaattggtcgaaacggataccggaaaataattatatttttgcttgctctgaaaataatggtgtttccccatttgtgcagatatg

SEQ ID NO: 103431 - DNA, 440 bp, Heterodera glycines
  Promoter: Source sequence=SeqID_9817; Location=2963..3402; Strand=+; Gene=SeqID_72811
ttgggtcataagccaataatttacggtcccgctccagagtccagtagtcgtattcctcataaagattcagaccctcggatcaaacacgatccattttataagggaaacatgaaccaattttttaccaaaaactaaaactttaatcaataaaaatataaagaagaaaatattcgaagattccgagggtgatgaaaaaattggaaaaaagataaagcccttgaaagaatataaaattccatggcgttttgggatggtggccctatgaatttgtgagatgttaactacggtgcaaaattcttaacccaaaaaagtaatctttttaataaaaattttcccgttttagcgatattttgacagtttgtgatcaaaaaaataggaaaaaataaccaaataaaaagaaactgatatgagaagcgctgatcacacaactgatcattatg

SEQ ID NO: 103432 - DNA, 181 bp, Heterodera glycines
  Promoter: Source sequence=SeqID_33397; Location=969..1149; Strand=-; Gene=SeqID_63468
ataaatattttttcagaaagtgctctaaagcgcacccatttttatttacatgttagtttaggcactctgatgctttttctatcaaaaagggagatggagaaaaatttttttaaaaatttttccttatattttggttatatcgttttgcttttggtggggtgcttggaacagtggaatcatg

SEQ ID NO: 103433 - DNA, 188 bp, Heterodera glycines
  Promoter: Source sequence=SeqID_512; Location=454..641; Strand=+; Gene=SeqID_54983
cgttggcctggaaaaaacatccttgggaagattctctcagctttatgaagaaatttttgcgtaagaaatctggtgaaatgaatccaaaaaattacatataataataagaataataatttaatttaattatattaaatcgtattcattcaaataacacagcaataacaaatgattcttttacagatatg

SEQ ID NO: 103434 - DNA, 721 bp, Heterodera glycines
  Promoter: Source sequence=SeqID_18359; Location=1..721; Strand=+; Gene=SeqID_82958
actttattttaaaataaccctttcacaaatttagatctattattaatttaaattattttctttccttgacaatcggaactgaataatttcatgaggtttgattgggttttttaagtaaattttctgatttatattttcttgaaattttaacttaactttttcaattttattaattcaaaaaatgtaaaatgttttttagcttataaagaagttcttttttttaaatattatttgtttaataaagttatatgatcgcgaagatcgcgacgaatttatttaatggaatttaatagttacggtatttatttatttaaaattattcacattttaaatttattgagtttcattttttataattttattacaatgtttactttttaagatcggtattttggtactgttacttatttgcatttctttcattttgataaagataaatgtgaaattttaaagcaaaattgaacatttaaagttcgttaataatggtataattttcatttttctgttatttaataaagcttttatttgtattacaaaattatagagatttattaaatattttgaaataatctcgcagtctccacttaaatagtctgctttttttgttttaattgtgaactaatttaaatataaattaattaaagggctattgctttctttacaattgcttattttgttataacctatttatttgtttattttattttttggtttaaaaatg

SEQ ID NO: 103435 - DNA, 238 bp, Heterodera glycines
  misc_feature (84)..(84): n is a, c, g, or t
  misc_feature (114)..(114): n is a, c, g, or t
  Promoter: Source sequence=SeqID_3456; Location=1..238; Strand=+; Gene= SeqID_84744
tcccgaaaaacgaaaaaagcagcgggaaagtacagtaacgctttttcttcctattcgagatccaaaaaaatttctcagttatanaatgttaccaaaaactgacaaaaaattgcnactggcagtctcttattcttttggaaagacataaaaagccaagaaacaattgttaaaggagtaaattttgaaaaatgtcatgattttaaaagaaaaattgatattcttatgaaaagaaaaaatg

SEQ ID NO: 103436 - DNA, 52 bp, Heterodera glycines
  Promoter: Source sequence=SeqID_13754; Location=1656..1707; Strand=-; Gene=SeqID_77675
attattttgggaaataaaaatcttgatcttgcttaaggcaagaagatttatg

SEQ ID NO: 103437 - DNA, 65 bp, Heterodera glycines
  Promoter: Source sequence=SeqID_34364; Location=284..348; Strand=-; Gene=SeqID_64182
tctctgtcgttggtgcgattgaagtggtcgtcgaggatggcacaacatcggaggcggaggacatg

SEQ ID NO: 103438 - DNA, 1003 bp, Heterodera glycines
  Promoter: Source sequence=SeqID_6852; Location=380..1382; Strand=+; Gene=SeqID_63102
acaaaaaaagcgtttttaaagcagaaaaaagtcgtcgtaaatgaggaaaatgatcaggggaaataaaaaaatattggaaaaaatccattccggtgaaaaatacaagccatttgaataaatattaaccatttttcattgcatataataaaaattttaaatgtccttgaatttcatgaattttccccactatgtccttgcaaatcggcatacccgtccttggaagccgaccttggacgatggcagccctgagttagaacaattaatggtaatagtaccgatggtagtaccccttttttgaaaaaaagttaattttaaaagtcccaagaacaactttctaggggttttcggaatcgctgagcacgaatttggcacccgtttagaccaatttcgaaccccggacccgaattcgaacaaaaattcgaaaattcaaatttttaaaattcaatttatccgacaaaatcgattcatttgcacgaaggaacagcggaatgagcctattcacatggataaaactcagacttgcgaccaaaaattataaaacacgttttcaagatcaccaaagcgctgactccaaataaattcaggaaaatgtgtcgtaggcttacgaaacgaatcgaaacgacttacacaccgtttcaaaaaacgagatgtgtaccaataaatagagagtgccagagaaaaacattatctttttttctctaattttttgtctccttttggtgtactatctaatatttttattattaggaaaaacaacattccttctctccatataactttttttaatccatacaatctgcaccaaattttgcatatcgatagagaaaaaaataacacattcagtaatacatccattttatattttatacactctttcatgagatatattaagatttgtaataaaaaattattttgtgatttaatggcaaaattaaagcgaaatataaaaacagaggcggtgaaacagcggtggaaaaagcaagaggagcgaaggaccaaaatg

SEQ ID NO: 103439 - DNA, 656 bp, Heterodera glycines
  Promoter: Source sequence=SeqID_14825; Location=1515..2170; Strand=-; Gene=SeqID_78979
tactcgctccattcaagccaaagaaatagaccaagtgacggaagccaaaataatgatcttttgatttttaaataataatgataatttcgatgattataatgataatttcgataattcaatttttgtaatgataatttcaataattgtaatgataattcgatatttaattgtttgcagttaattcataataaatgttttttaataaaatcatttttttaattttggtcatctcacaacttttcgcccctaatctccattacctcccaaaccccataaaaaaggcaaaaatttgttatgtttgcatagcaaggaaaatgccgagcgcggaagcaatttgacctttagctcattcctctcttgatttaacgccggctccgcactgcaatggatgtgcttatttattgccttgttgggataattggcggtaacctaaaaagaaatttaccggccaacagttcaagcactttaatcgtcccaatattcccctaaatgcgcatcgcagaaatatgagatgtcgagaaaaatgtgatagactgttggtgggtggggttaagatcgtcatttattcggtgagcccattttggcatcttcttttcccttttttttatctgttaaattttaaattttttagcaattaaattaattctgaaaaaatg

SEQ ID NO: 103440 - DNA, 252 bp, Heterodera glycines
  Promoter: Source sequence=SeqID_14425; Location=1757..2008; Strand=-; Gene=SeqID_78470
ttcggctgtttcttctaagtcatcgttttcgcttgcgtcagaattcgtcgtcgccggaagggaaatattgtggcggaggcgatgctccccttttgtgggttgttcttcattttgttcagttactggttgaagttgggcaagatgaaggacgacgacggcgagaaaaattaggagaaataattgaacattggagaggagaggaaaaggaggacgaagggccatggcaaaaaaaaaaaagccggatcacggatg

SEQ ID NO: 103441 - DNA, 565 bp, Heterodera glycines
  Promoter: Source sequence=SeqID_18582; Location=1291..1855; Strand=-; Gene=SeqID_83213
taaatcgcgaaatatggaaaatatggatatagaactccatactagaagctgcaaaccaagctaaaaatatgtttttcgtgcgtttcaggcctcccacaaccaggaaaaaatatggatttccatataattccgaaccctacttataaagagtctcgattgggatgacattgatgggcgaacaaaatgatcagaggataagagagagaaagagagagaaataagaaattaagtatatcagtcatttaaaaaataaaacgatgacttaagtccgcaatttgcgagaaagcaaatggcaattattttcaatatttattgaaattttttaaaatttttttctcatttgtcagtgacgaaacgatcagtgacaaaatgatcgtccaccgttttttagttcaaaaaatttataaatatggcatagtgtttgtttattttttaaattttattttaataatgatattttccgagtcatgtcctcatgtctgacaatgtgacaataaataaatttcaataatatcaattttcaggggtaacaaaaaattaaatacataaaaaattgtctaaaatg

SEQ ID NO: 103442 - DNA, 867 bp, Heterodera glycines
  Promoter: Source sequence=SeqID_20346; Location=847..1713; Strand=-; Gene=SeqID_50867
ttcttcatatgattagatattccaaagatttctctattatttatttaagtttcaaaaaattttattgagtttcaaaaaagatagggacaaaattagtaagtttaaattttttgaatttttggttataaattttcaaatttttgttagatcttgtgaatttatacttttgttatagtaaatggttttttgggtcaataactattttcaatgtcatctgttcaatttttcatatacttgtgcttaaatattcacaattatttcatttttaaatgatttttgttatttattattgtcagtttatattctaatttttgtaattacaaaattatgaaataagagttttattacaatttttttttgtacaaacttcatttattccagctttatatgtgctatgtatttagttttattatatttatattttaattatattctacgtaaatatttatttgaatttttttttaattgtcaaccttttcaaattttataattaatttaagaaacatcatttttttatctgagcattcttaaataaattgttaattgttagtttttttattttttatttgtctgatcacatttcatacatacatattcaaaattcaaataaatctcttgtcatggcaatttcattttgtttaattatgtatataatctgtctttttttaatttttttttaagattacataaaaaatttattaaaatgacaaaaataattattagataaattttgaattgcattaggaaaaacaatttgtcacttacaatacaatttttgaatccttttgggcttaagaaacagaaatatttctttttataagttatttatttagcattgaaattaattttttagagggctaattcatg

SEQ ID NO: 103443 - DNA, 109 bp, Heterodera glycines
  Promoter: Source sequence=SeqID_13407; Location=1583..1691; Strand=-; Gene=SeqID_47125
ggtaacattctgaaaagacccaaggaattgatgccagctggtttgtggctttgtcttttttggctttaaagttggtttcatataaaatttagttgctggaaaagtaatg

SEQ ID NO: 103444 - DNA, 363 bp, Heterodera glycines
  Promoter: Source sequence=SeqID_5687; Location=1..363; Strand=+; Gene= SeqID_58908
tttggtcgtttgccatcgtcgtaaggcattaaaggcaattaattaatgaattgttgccgaaagatacatgctcaaaagaattattgataggatgaagctggctggctccatgttgctcatcattctgccggcatttattatgataatgtccgcgcctgttgtgtccattttccaccctaccgtaaccaatgcgttcggttcccgcgttggcaatgattacggtagacaagataaaggtcaaacagcaacaagatttttttttcattttgaaatttagccctaaatctcagcaaccgacgagcatcggcaacgggtgtccgacgagctgcggaaagtcgccaaaatattgacggagtgccgatg

SEQ ID NO: 103445 - DNA, 74 bp, Heterodera glycines
  Promoter: Source sequence=SeqID_43206; Location=102..175; Strand=-; Gene=SeqID_70930
ttttttgccaacattcctggtctgttgacaacgattgggccccgcccgtgcgaacggaacgcacgcgcggaatg

SEQ ID NO: 103446 - DNA, 546 bp, Heterodera glycines
  Promoter: Source sequence=SeqID_1472; Location=5555..6100; Strand=-; Gene=SeqID_73748
aaaatccagagactttaaaaacgttgtggtaagacatgaaacggtccaaaatgctagagacatcaaataaattttcctctctagtaccattcaaatcaaaagaagaaaatatatggcgtttacgcctcaatatcatttagtcaatctctcatatcatcaatcaatcattgttaattgctcaataaaaaaacaggcatccatccatcattttcttagactgccagtcgcgttggccgtgctctgtacttcatgtaggagctataacttggatgcaacggattacggggggggggcctgtgttatgaaaatacggtaattttcaaaaaattccccttaaaaaatctgtcgaaatccgttcaaaaacagggccaaccggcgctggagtattacaccaccgtatcacgagaagattttggcgagaagaaagtggcggctgcggcgagcggcggcgacagcgacgcttggagcggcgtcacggcggccgagcgagcggcgagaaatgtgggcggcagcgagccgaacctgttgcaaagcgagttggacatg

SEQ ID NO: 103447 - DNA, 759 bp, Heterodera glycines
  Promoter: Source sequence=SeqID_9985; Location=1717..2475; Strand=+; Gene=SeqID_73029
gcaaaaaagcgcaaaactcgctctgacctatatataaaagctgattgaccaattttattctccataaatattttcaagctctaactttataaaaaatgttaaattctcaaccgttcagtaataaagacatttgtttcaaattgccttgcggtataattatttccgggccatcctcatcgggcaaaacggaattcctactaaaatttattgctgagtgcaatgaactgatcgcacctagtcctatttctattctgtactgttttggtgagatgaattcggcggttccgccactgcaaaaggcgggagttgaggtgtattcgggcgtgccctcggaggagctgattaggcgccttcccaaaccgatgctgctcattctcgatgatctgatgttgtcaatagaggagcgctatctgtccgatttgttcaccaaaaaatcgcatcaccatcagtttgcggttgtgttcatcactcagaatttgtttgagcggaagatcaaggtggctcgcctttcggcgcagtatttggtgctaatgcgcgcgcccaactcactgctgtccattcgaaatattggagttcagctttttccgcgtcaactcgattttttccttgacgcctaccgcaaggcgaccgcccgcccctatggctatttgctaatcgatatgcacgcatcatctgatccagcgcttcgcctccgcaccaacatatttaaagaggagcaggaggaggacgagggaacagttgtgttcatccccaaaaatg

SEQ ID NO: 103448 - DNA, 1003 bp, Heterodera glycines
  Promoter: Source sequence=SeqID_424; Location=5244..6246; Strand=+; Gene=SeqID_52151
tttgtttaacaaaaattaaattaatccttatgaaataataagtcctttgtgataaacaaaaaatgctttctctaattattttcatctccataattaacattaaattactcttctaccaaacataattaaagttgctgttgtccatattgtgtggtggtgccattccccacataattcattcattcattcattcattgtgccatcccccgccaccctccgccccacgccgagccgccgctttccggcacacggaattggaattaatatttgcacacaaaaggcactcactcactcattccacgcgggaaagggtggcgcgtgggtggatgatgaaaagtcaaaaaattccattagcagcaaaatgagagggagaggaaaagggtcaaccgaagcgaacccaacccaattttgaggagaaaagcgaagcatttccttatgaataaatgcacattcaaatctgatatgaattttcaaaaataatttaagtaaaacagaagcaaacaaaaaaaattaataaataggctaaaaatattaatcataaggctaaaataataatataattgagctaaaaatattaattattaggctaaattttttattacgtaattttaaaattttttgaatattaatttaattcttaactgtttactcatttccacaacattttttttttgattactttaaattttgttatcatttcatacaatcaaatctaaacaaatttattattatcttcagtccttttttcctttttgattttttttgtctcaaatatttttctgttttttttatttttgccaatattttttatttttgcattaattatttgattgttttcctctatttttaagggatttctgtcggaaaaggttcttccgtcggcatttctgggaacagtgattgcgtcaacagcaccaattgtcagcagccgttgtcgagcggcggacgtcggccaaaactttcggagaaaatgaaatcattgtcattggactgcgcagaaatg

SEQ ID NO: 103449 - DNA, 53 bp, Heterodera glycines
  Promoter: Source sequence=SeqID_15626; Location=1..53; Strand=+; Gene= SeqID_79916
catctccggcgggtcggtcacaaaatcctttgaagcaaaattgcatcagaatg

SEQ ID NO: 103450 - DNA, 239 bp, Heterodera glycines
  misc_feature (121)..(121): n is a, c, g, or t
  Promoter: Source sequence=SeqID_37651; Location=1..239; Strand=+; Gene=SeqID_66667
ccccccccccccaaaaaaaaattaaaaataatcgaaaatatttggagtttgaggagcaaaagatgtcgtcgttgatagacgatcgtatgaaaattgggtgttggacgaccctcccccttcncctctgacattgttctacttacgagggccgaattaggccgaccctttacaaatatatgatcaataccttatctattgtcggaactttttagtttttttctgaatatggtgacattatg

SEQ ID NO: 103451 - DNA, 362 bp, Heterodera glycines
  Promoter: Source sequence=SeqID_9529; Location=781..1142; Strand=-; Gene=SeqID_71759
tcccttcccttccaagccctgagggccctaattacggacgcgtaagaaggtctcctggaattaattcccctattagcactgggtaatgggacttcacggctttattaaagtaagcgtcagttcatttgtattttcatggttttgtgccgttttaaatctgttgactttttaaattcggttttgaaagatacaaacaaataggtattcattcttcaattccattttcgtgactataaaaatgttttgtttttcgatttttctctcatttatcagaaagaaaaaaacgttttcaacgcaattattattctgccctttgtgacaacattcgaaataaggcaaattgttctaattgccacgaaatg

SEQ ID NO: 103452 - DNA, 300 bp, Heterodera glycines
  Promoter: Source sequence=SeqID_17224; Location=920..1219; Strand=+; Gene=SeqID_81692
tggcgagtgagcgcacttaaagcaaaaaaaggggggataaagaagggattggcattggttggactcacagacgaatttgaccatccgagtcgagccaaatgttctcggcacaaacgctccttcagagagaagagcaaacgcataaaaggaaacaaagcgaagggaagggaataatgacctgtgaatgaccccgcgcgagtggaggtgttcgagtgcgtttagcgtcgccctgagaatgacacgaagcgccgactcgggcaaaccctcggaataaaatgcactgagcaaatgggcacaatg

SEQ ID NO: 103453 - DNA, 403 bp, Heterodera glycines
  Promoter: Source sequence=SeqID_2750; Location=2571..2973; Strand=+; Gene=SeqID_81411
atgtatttaaagtgatttattatttattatttataattttttaaaatgtttattttgtttgttttatttttaataaatttttcttcgagttataatagccctattctttaccctgaacgatccagggacagcgaaatgactgacatttattataaaatagcctcctttgaccattcctacttgaataaaattaatcaatctgaattattctcaatgattgatgaaattgttgaaaattttcaactttgtaatgtagaagaaacgaggtcattatcgagatgggtatactgtatgctactagttttgctatggatagcaattgttatgacaggaatttttctctattttaattccttgattcgaaatttatgtaagcttatgcatatatgtagagacggaaatg

SEQ ID NO: 103454 - DNA, 761 bp, Heterodera glycines
  Promoter: Source sequence=SeqID_3623; Location=1095..1855; Strand=-; Gene=SeqID_51161
tgttgggctgtgatccgaattggaatttttccttgaaagaaatcaaattaaaacaaatctcgccagcagtaaaactgtattttatgcattgggaaattaaattgaggcacggaattccgattcccgaaatttttgataaaaagtcggatattttcggaaattttttgagtttttttcaaaaaaacttgaatttttgaacaaattctgttaataaattgcctgaatttcaatttttcccggcggcgcctatcagctctgccggaccctaaaaatcaataattttgccctaaattcataattttcttaaaaattgctcaaattcgttaaattagtcatttctttaacaaaatctgtttccgaaaattttttggggcctcagaatgccatcccttgtaccaatgagtaataaaactctttttctgggattctttttctagattttatctttttaatatttatgtattttgagtaataaaaaaagttttttcaaaatttcgattgctcgcgacactaaaatttaattgcaaattgaattcttttgcgatgtccataattttgattttactagctcttgtaataacggctcaatcaaatatatttaaaataataaaacatttcataccgcaaaattataatggcccatcgtaaaattgccatccttttggaacaaaaaccaggcaactttggacactgacaatgagagagaaaaataaaggaaaaaaggcatacagtaataaggaattgggaaacggtagaaaatg

SEQ ID NO: 103455 - DNA, 394 bp, Heterodera glycines
  Promoter: Source sequence=SeqID_28118; Location=665..1058; Strand=-; Gene=SeqID_58769
caaatcacaggaaaacccaaaaattcacaggcggttccttgataaaaattctttttttttcaattagccaaaaaacccataaaataataacgcgtctctgtcctaactaagtgatttgcccaaatcaaaacttgattaattgtaaattatttgacataaaataatttctaaattattactatataataaaaaaaaagcaaatttattttaatctttttattatccttctgtattgttggaaacattataaagaaaatgtgcagtgatttgattcgaattgatttattgtaaaaattattgcattaattattatttagaaaataacggcataatttctgtccataatttatccccttaaaagaaatattattattaaaataaattaaataaaatg

SEQ ID NO: 103456 - DNA, 117 bp, Heterodera glycines
  Promoter: Source sequence=SeqID_7627; Location=659..775; Strand=+; Gene=SeqID_65453
agccaccgagacacaatatcatcagcctaaattttttaaatgtactaacaataagtactatttttcatctcaaaaggatcacccgcttcgcagcgaccgtgtcgaaaacgagcaatg

SEQ ID NO: 103457 - DNA, 287 bp, Heterodera glycines
  Promoter: Source sequence=SeqID_39442; Location=1..287; Strand=+; Gene=SeqID_68007
ccatggatggcacctttatctaagcctcgctcggcatgggtcgtcccaccaactccagcttattttgatgtgctcgacttttccaaatatatcaccaagacacggttggccaccgatgaggaagccgaatgggaatttgacgcatattacaaaggcataaatttgccaacagccaaatttgaggtgttcaagagagtgtcagagtttatatacttaaaatggttctcttttaaataaaggaacgtgttgccgaaagtctggcacttcatttggaaagagaagaaatg

SEQ ID NO: 103458 - DNA, 665 bp, Heterodera glycines
  Promoter: Source sequence=SeqID_8469; Location=1266..1930; Strand=-; Gene=SeqID_68181
gttattcataaattgagttacctttaaatgtcgaaaataggtatatatattttcatcaatttaccaaaatatgggtatctcaacattacaagtgcccgatctgtcattctgttagctcatctcgaatccctaaccagaattcgaattttttagaaaatataatcattgtttttttgttgttacaaatattgctagtaccgagttaacacgattaggccccacccaaagagttttctggggctaaaattattttcagtatgtttttttaaattatgatcgccgaggcgaaaacaggaatttgttaggttttgcaccaaaaaatgacaatcttttgccatgcgagatcaatttttcgataaaaatattatattgggctccggcggtgtcgataagtgtcgacgggaaaatttttgggattttatgataagaaaaacattcaaaatttaaaaaatttgtccttttctttaaaatttttatttttgggggaggacaatgtcgaccctgcttctgaatcctttcatattgctgctacaactcaatcattccacagcaatatttgcaataaaatgttaaatcttaaaaaatattcaatttcaagattgagcaaatgccagtcaacatctcagattatctcttggttatttacataatcaaaaaaatatatg

SEQ ID NO: 103459 - DNA, 130 bp, Heterodera glycines
  Promoter: Source sequence=SeqID_8903; Location=1526..1655; Strand=+; Gene=SeqID_69588
aaattttaatttaatggattgaaaaatattggaaaacgaaagcttaagcacccttcttcggccttgctcaagtgccattggcttggcctgcctcgtcgacttcgagccgatcaccacttcagtcggcatg

SEQ ID NO: 103460 - DNA, 704 bp, Heterodera glycines
  Promoter: Source sequence=SeqID_3404; Location=1054..1757; Strand=-; Gene=SeqID_84547
agcaaaattttcactaaaaattaataaattttcgtttatttgttttttttctatttaaatgatttttaatatcgcattagttctattaaaatttaataatattaataaattttgaaaaatttatccattaatttgggaaagtttatgtccatattttttaaattcaatgtttatatttcgcaattttatccttataattttacgctctactcatcacattcccacccattttcaggtcattattttgccgttttttatgctccactccaaccctcttcataaatatgggaatcagcagcacagaatcatcttcatttagtcattctaattgtccttttccattaagttgatttttgattattttaattgaaacattttataaaatgaatttcgaaaaaatctaattatttttgttatttgtgtgccattgtgtatttattctgcccatttaaaaaatgaattccaacttttttaagctaacgaacactaagtaacacaagcaacgagaaaattaagtgaaaatttagaaaattgaaaatttaaacttacctataatcataaagggatttgcaaaaacattttgaatttatggaatttatttttaatatcttatttctggtttaattatttttcttggatttaaatttatcctttttagttgtcttaaacattttcggtataatcactaactttacctacatatg

SEQ ID NO: 103461 - DNA, 321 bp, Heterodera glycines
  Promoter: Source sequence=SeqID_15858; Location=1..321; Strand=+; Gene=SeqID_80189
aaaaaagctaaaaatgggaaatagttatgcgtctgaccactggttatggatgagaatgctcaaaaaaagggaaagagaggaagagaaaatagtattaaaacgaaaataaataaataaaatatcagcgaaataaatcattaagcacaaaaaatttaaaaagtttggggaagcctaaaataaaggacaatctttaaaaaaaggacattttaacttttaaagatccggcccctccaaaaaaggacaaatctttaaaaaaagaacacttggcagccctgcatttattgcattttgatttttccaattatttctgttttacagatg

SEQ ID NO: 103462 - DNA, 796 bp, Heterodera glycines
  Promoter: Source sequence=SeqID_16128; Location=1331..2126; Strand=+; Gene=SeqID_80492
ttttattttaaagatttgtttaaagctaaattataagaaaaaaatttatgccgattgatcaattcaattagtaacaatgtgattaaactcacaaaaattttaactgtttaaatcaaggttgtgcaaaattattgtcatcttttcgagactcgacctatgagagtcgaaaccgagactacaaaaaatgccaacaaatttctgttgtttcgagtgtagttgggaacaaaaataagtttttaaaagtgtccaaaaaaagattttggttcacattcaaagaaataaaaaattttgtcatcgcggtagtggcgagtaatcccaataaattctgagcaaattgttaccaaaattaacactaacttttaacaaatacaaattttccaaaaacttctccccccactcgctcactgcttatgatgggcctaggggttaagcctgagactattgcatttcaattaatgcttcaattctcatgtgttttaaataatctgaaattataaaatagagggttggcaattataatttattcccaaaaaatgaaaaaaaaatttttccttttattttaatggttaaactcagaagatgggaaaactgaattcaatattttgtacttaatgggaaaagcaattaacagtaaattatttcattcatttatgtatgggaaataattgttagcgaaaaatttatgaaaagtcacatttgtttaaagaatagcgcctttaaatgtgggaaatcagtgtgaaatttgataaatggggaaagtgaccgaaattaaaaaatgaaattaattttaataatg

SEQ ID NO: 103463 - DNA, 990 bp, Heterodera glycines
  misc_feature (161)..(161): n is a, c, g, or t
  Promoter: Source sequence=SeqID_3962; Location=5670..6659; Strand=-; Gene=SeqID_52594
caggcagagcctgagatgcggaaaggcgcatccctcccccaaaaggctgcccccctttttctacactttattgaccagaagttaaagaaaagccaagggaaattggtgagtgatcaaaaaggtgaagtgatcaacaactgactcaaatcccaaatctctcnccttaaatctgatcagagcagttgagttaatgggcgggggtgaggaaaatggcaacattggtggcggaagcactagagaaagagaaatgaacgagcgagcgagagagagaatggagaggaaagagagtcgaaaatcgccgcataatattctctgctctctgcttaacgccgcccccggcgttcaattcaattatatttaaatgttgtggaaaatggtgcgtaaattgaaaatgcaatttagtgaagaataatgaataagaaaagattggaagattttgggacagatgtgcagcagcgaaccgtcatttttgttcatccaactttttcgtcatttttcatctttttggcttttccttctctcaaaatttttgtagatttaaattccgaataaatggctgctgcatttctgacgtccgttgttttggtgtttggaattttgattgttagttttataggtttttaaaaattaattaatgataatgaaactttgcttttatttctttaaataataaaattattttgtaaatacccgtaatgataccaaatttgttcaaatttttttaacattcaatttactagtataagttttttttctcaacctgatttttctcgtttcattatgtgattgatgcatgggattatttataaagctggatttgcaatcattaatttattatttgaattttctcatttattactattttgtaattactcatttaattttaatagcataattatttatattttttgtctctttaaaatataaatttcaatttaattgtacggtattttatgataacttttattttttcttttatttcaaaatatg

SEQ ID NO: 103464 - DNA, 66 bp, Heterodera glycines
  Promoter: Source sequence=SeqID_10605; Location=133..198; Strand=+; Gene=SeqID_73839
ggtaaaggacattttttaaattgaactttgattttttcttttccagctaaacgcaacttggagatg

SEQ ID NO: 103465 - DNA, 64 bp, Heterodera glycines
  Promoter: Source sequence=SeqID_13040; Location=1..64; Strand=+; Gene= SeqID_76819
atttattagtatatacttacctaacagtttaaagtaccatttattttttagccttgcgaaaatg

SEQ ID NO: 103466 - DNA, 461 bp, Heterodera glycines
  Promoter: Source sequence=SeqID_38790; Location=219..679; Strand=+; Gene=SeqID_67505
aattggacagtggcgccgaagttttgctggtctccgaaggcgattggattgccaatggcatgccaaaattgtaaacttgttctggactacacgcgtacggaggatagccaatcaaagtccttggtttcttcaattcaaaattaaagtttacttgtggagagaaaccactacggacttgtatgcggtcaaggacaagacaaagaatctgtgtggacgtgattagattcaaaagctacagatcgacttgaaaaatacgtggaattagaatggtgcaacaaattcgagacacaaaatccggaacgaagtgctccaaaatcacgccgaaatcttcagggaaagacttggccgctgtacacggcacatcacgttaaaatttaaaatggatgtagagccaaaaagatgcaagcaggtcccgtgccattcgcgttgcatcccgaggtgtagaaggttaaaaaccaatg

SEQ ID NO: 103467 - DNA, 140 bp, Heterodera glycines
  misc_feature (31)..(31): n is a, c, g, or t
  misc_feature (33)..(33): n is a, c, g, or t
  Promoter: Source sequence=SeqID_33959; Location=1112..1251; Strand=-; Gene=SeqID_63879
cttcttctctttgattttgattaaacctttntnaattaggtaacttcaattcggcttttgattatgtaaatcagttttttacactttgtacatgaatgaattaattattcattttgctcaaatattgaaggtggcaaatg

SEQ ID NO: 103468 - DNA, 877 bp, Heterodera glycines
  Promoter: Source sequence=SeqID_10214; Location=1..877; Strand=+; Gene=SeqID_73339
ttaaattatttattttaatttaatttaattttaattttaatagtaaataaacataaaaatttgcctttctctgtcaaaatgatacaatggaataactaatcaaattgaatttcttcattaattccaaatttaaaatgatcattttcacgacattaattaacataaaatatttattcatttaattcagagtaaaaatttttgctaattatttattttcatttggcataaatcagttgatcgaacagtaattttaattaataaattgccacttccaattaccattatcaattaattaagtaaactaattaataatcaaaaactcctccagggtcattcagtcctttgccgggggcggcggtgaatggtcgccaaaacgcataaaaataacatttccctcccccgccacggcaaacagacactttttacgttgtaaatttacactcgcaatacaaaaaccatcgcccctgggctcatcctgccacaacaacaacaacaacaacaaattggaagaggaattgaaggccgttgggttggggagaagagaaattatccaaggcgacggcggggggggggggggcaaaagtgaattttggtggagttttgcgtaaaatcatttgtatatttgccgtgttttttattttaaattgtattatttttaatttattttgtctacgcaaagagcggcgaacgaaacggtcagtcattagtcgctaattgactcattaacaattaattaccccttttaataattgtctttcctcaaatttacaattagtccacagcacagtcacttttcagcttccgttctgctgatgtttcaccacactttttgcacccttttaatcctcacactttttgcccttttcattggcaaatg

SEQ ID NO: 103469 - DNA, 80 bp, Heterodera glycines
  Promoter: Source sequence=SeqID_1928; Location=1483..1562; Strand=-; Gene=SeqID_76831
atgacaaacttataaaaacaaacaaacaaataaataacaattgtcattaaaatgaagaaaagccatattattcggtgatg

SEQ ID NO: 103470 - DNA, 76 bp, Heterodera glycines; identical to SEQ ID NO: 101492
  Promoter: Source sequence=SeqID_424; Location=4384..4459; Strand=-; Gene=SeqID_52152

SEQ ID NO: 103471 - DNA, 709 bp, Heterodera glycines
  Promoter: Source sequence=SeqID_932; Location=1340..2048; Strand=-; Gene=SeqID_64441
cctaaaaatgatttaaataaacggaacatctgaaaaccacaaatattgaaataaaagatcattaaatccttttcagacgaaaaaaacgaaatttgaagtttctactttttgttcgaattcgggttcgaggtcgaaattgggcgaaatggatgccagaatcgtgatcagaaaccccgaaaacccctagaaacttgctttgaacgactttttaaagttttaaaatttaccccaaaaataggggctaccatcatcttaactattaccgttttaagaatcaaaaatccaaaatttgatcatttcccccaaaaaatgcttttttcacccgttacgcctaaaatctaaaaaattttgtccaaaaagcaaaaaagcctcggatttccaccaccttttttcagtttacggacggtactcagtcggtgaattcactcagaaaagcgaatgcaatttgaaaatttaattgttcgtaaatgtgtttgttaattattacattagattttaaaatccatggatgaattccggggaaatatgctaaaatgagaacactcaacaaacaaattcgattcgtaatagtgttaattaatgtgcaaattaccagttgtgttgcggtgagatcaaatttcttggtttttaaatattttgcataatagggcgtttaaataaaaataaatttgaaaatcaatttgactgaaattctttccatcaaaggatg

SEQ ID NO: 103472 - DNA, 330 bp, Heterodera glycines
  Promoter: Source sequence=SeqID_39757; Location=616..945; Strand=-; Gene=SeqID_68254
caaagaacatgcagcaataagcctgcaaaatcagaacatgcagcaataagcctgcaaaatctaataagtggaaaatacatgagtatagaatttatttttagaaagtgtccacagacttttggaaaaatatatttgcaatttatcaacaattttgagaagtgagttagaaatgataaacttcacgattcaaaccaattttcgttgctctaattaaccgggataaaaacattcgaatcaattaaatagcttctgagataataaggtttatcataaaatttcaattaaaaataaaccctcaattattggtatgaacgatactttccaaacatg

SEQ ID NO: 103473 - DNA, 366 bp, Heterodera glycines
  Promoter: Source sequence=SeqID_34926; Location=1..366; Strand=+; Gene=SeqID_64611
gatgtctcggtcttgagaaattcaagataaatccttctaaaaagcatggggggcatccaggaaaatttatgatgaagctgatgacaaaaaaacaatcattggccattacaatttgccaaaaatggcgctaatttaaaatggaaacaaatgcgtaaaatgtgtgctaattgcacatttgtttcccggctttagcgccatggtgaaatttatacaaaaaaaaacaggttggccaattggtcattgaacaaatttttgttgtttgattttaggcggggaaaaaattttatttatggaaatttgtaatcccaaaaaattatggcttttaaaattttctaaaatgcagagggtgagtcagggccaaaaatg

SEQ ID NO: 103474 - DNA, 118 bp, Heterodera glycines
  misc_feature (33)..(33): n is a, c, g, or t
  Promoter: Source sequence=SeqID_38894; Location=1..118; Strand=+; Gene=SeqID_67592
tgctagtcatgattattaaattaagttttcacnatatgtaacattaattaagtgtatatttttttttcaaatatagatttttgtttatttatggatttagttttttaaatatcaaatg

SEQ ID NO: 103475 - DNA, 1003 bp, Heterodera glycines
  Promoter: Source sequence=SeqID_9050; Location=16..1018; Strand=+; Gene=SeqID_46696
tgaccgacgtagctgaattgcgcgatttggtgttggacaaacgcaaggagtacattttgtgcagcaatgcattttcgctttacggtgtccagaaatttatgtccgatgaggacaggaggaaattcgaccaggaaacgggttagtcagaaaagaaatcgaaatatttctctattaaaaaaacaacgcaatttaatttttatttaattgggtttgatttttcgcctgaatggatttttaacaaaaaaaaaactttttttctgctcatcattttactctcaaaaaatgaccaattttgccttttaattaggagccgccgtgaaaatttttgaaaatttgaggcaattttttaatagattttgtcaaaattacctaatcacattaacgctttttggatgtgtttttaaaccaaattttccgccaagtttataaaatttcaaaaaattctagcagtttgcttgttttttttccaaatacatccttggaaaaaagaactttcaattccaattagcgaggctcaaatccaaggacgtcattggcaaccaataacgaatgacagccttgcgaaaagttaaaatcttaacggtaaaagcctcatttccagatttggcctttagacattgcaccaaattgatcaagagtcttgaggcacaaattgaatctgatcgcactttgcgtccatccgaccaattaaagcatctgcttgccgtgatgaatttgctcaatgtttatttgaaagaagtgctttctatcgttacgcaattaaggtaaccgaaagttttctgttcaaaatggcacatttaatatatttttctccataaagcaaaaactagttcaggaggtttttgattacttttttttacaagttcctaatccgaactcgaacaaaaggtggaaaaaaagttggctctatgctaaataattcctcgaatttttaagggcaattcatgtgcgaaaatcacgccaaattcgtcgtatttgccggttggccaatctcgttgaaatg

SEQ ID NO: 103476 - DNA, 781 bp, Heterodera glycines
  Promoter: Source sequence=SeqID_17564; Location=255..1035; Strand=-; Gene=SeqID_82075
tttttagtaaataagagaatatgtattaattctttaataatttttatataaaattattaagtttattctgaatatttttactcggaaggatatattaacatttggacgaagaaaaagatgcaaaattatattggtttatttataatgaaaaataggcgaacaatattagcgaccaacaaaaaataaaaatatatttcatgatcattttctattgatccattcatcctttcagctgcaaatttgcaaaacaacttattgacttcttgttttccatgaaaagaagcaaaatatatatatatatgtaaataaaaatttcgtggtagaaagttggtggtatagcaaaagaagttagttcatggttaaaaaacggtgactggtggttgctccagcagaaaatttactatcttcttttgctaccgtttttctcgtatttcgtggtcaaatgaccaggtcaaataaccatagttaaatgacctcgtcaaataaccaccttcttttgctacggccccagatgttttttcaattatttacctcttctgggattggatatatttattatagatgttttttaaaggtttaaatttggtactgaaacgtccctttccactgggactgaaatggcgggggtgaaatgcaacccccaaaatcttggtgagtagctacttatagcaaatgatattaaagagaaattgttgttgaaaaagaaagaaaatgaacaacaaatccacccaaataatgaatcagaacatcaatcaaatcattgatatggatgaaaaagatg

SEQ ID NO: 103477 - DNA, 73 bp, Heterodera glycines
  Promoter: Source sequence=SeqID_31954; Location=24..96; Strand=+; Gene=SeqID_62276
tgtgagtttcctttttaattttttttgttcagaaatctgttttgccaaggtgtcactgtacccgttctgcatg

SEQ ID NO: 103478 - DNA, 129 bp, Heterodera glycines
  Promoter: Source sequence=SeqID_38070; Location=1466..1594; Strand=-; Gene=SeqID_66993
gtgattaaaagagattcaacagtgattagaagaggtacaaaagtgatttaaaggtggtacaacagtgattaaaagaggtacaaaagtgataaaagaggtacaaaagtgattagaagaggtacaacaatg

SEQ ID NO: 103479 - DNA, 421 bp, Heterodera glycines
  Promoter: Source sequence=SeqID_7027; Location=4664..5084; Strand=-; Gene=SeqID_63611
attcccaaaaatcgtcattttttaattttttgcacaaaaataaataaaaatattcatgttgcacaacggactcgaacttcccccctttgttcctttactatcttacaaaaatcactgagccacacatgcaaatttttttggaactgggaggccaaaattgaaacggtgtgtattattaaagttattatgtaataagcattttatgaaaatgtgagcacaaaaatcagatgtttaagattgcgataaattttaggtggggggaaccggcattttaggtaaaaaccaaaacctttaaaaataattttcaaaaattgtaatttttcatttttggacaaaacaaataaaacacaaaatcacttaatgcggcaggaaattttaggaattttatttgttccataaccaacgcccgccagcgtccatg

SEQ ID NO: 103480 - DNA, 320 bp, Heterodera glycines
  Promoter: Source sequence=SeqID_4774; Location=1307..1626; Strand=+; Gene=SeqID_55672
agcttttaattccaaaattgttgtttgttcgttttgtttcactcaataaacaaattgtcttagcatttacatctttcactagttgatttatcattttcaatttgattcttttggcttgtatgtatttatctgtatgcattaaaggcgtttatttttgaatttttatgatggccaaactggtggttgaacaggcaattgatgcgagcgagaagtttttgatccggaatgtatcaatatctttttagaagaaatttggtgaaaaaaatatttaggttgtcactggaaaaagtgtcgaactttgcggctgctgttccaaaatg

SEQ ID NO: 103481 - DNA, 84 bp, Heterodera glycines
  Promoter: Source sequence=SeqID_25114; Location=707..790; Strand=+; Gene=SeqID_55845
ggtgaaaaagcaaccgaaaaataaaattcaatttttcttttttcattttaagaccatctcaaagcggaatacattaaaattatg

SEQ ID NO: 103482 - DNA, 589 bp, Heterodera glycines
  Promoter: Source sequence=SeqID_7094; Location=642..1230; Strand=-; Gene=SeqID_63823
ttttcacctcactttcatctttttcacattttcgaaaaatttgatggtttgaaacgagttaaattgcttagcattcgcttagaaaaagattcaccttttcaaaactttttttagataccaattttgtttagtttagttggaaatgaagaaagttacggctgatcaaaataaacaatcaaaaatgtcagtgatcagtgtgtttgaattagcgcgcaaaaaattacgccaaatgtgctatttggcgttatgagcaattttgtctgacactgggcttgacccatagtgaccgcttctacgctttctcttattgctcattcattcttagatttccacatttacttattttttgaaattatattttttaacccaattctacttaataaattttaccaagaaacacatgacaaaaaaacacatatcttttatctatggatttaaatgaaaaatattctgtattgtaaaaaaaaatactatatctaaagaatattataactctgaatttcatattcgtggaaagaaataatcaagaattttaaatttattaaagcaaattttaattttttaatagaaatttcatattagctcaatg

SEQ ID NO: 103483 - DNA, 534 bp, Heterodera glycines
  Promoter: Source sequence=SeqID_2062; Location=1689..2222; Strand=+; Gene=SeqID_77607
ataaatttatttaattaaaataattaattacaagtattaaaaacttcccgtttccatttagtggtcaactttcgtgatccacccgagcgcccgttgaccatttccgcacacatgcgtgcgcgatcggtaagacattccattgttaaatttgtaaaacattttgctttttcgttaggttcaatgagtgattgaacgatggattggtggatcgaaggatggatggatggatggatgaatgaatgaatgaattaattaaattaaaaggaaaataattatttaaataaccgtaaacttaattttttttttaaacaataaaaaacattctgttctgtaaagaatttaaagtggtactgtaattgactgattaaatttattacacaattaaatagtcatgttaaaaggtaacttaaaatggtaattaaatgggcggagtttattttataggcaactgtatataagcataacattttcaccccgcacaatcccgaaatcattcctagaaatttcaaaataaaattaacatttccaaatatg

SEQ ID NO: 103484 - DNA, 158 bp, Heterodera glycines
  Promoter: Source sequence=SeqID_18895; Location=243..400; Strand=+; Gene=SeqID_47550
ggtttgaataaaatatcaaaagcccaataatttgttgtctggtctcaggtcatcaaacttccgccgaatcgtggggcactggtcgcgcagtggcgcgtattccgcgcgtccgtggcggtggcacccaccgctctggccaaggagcgttcggcaacatg

SEQ ID NO: 103485 - DNA, 97 bp, Heterodera glycines
  Promoter: Source sequence=SeqID_22246; Location=1276..1372; Strand=-; Gene=SeqID_52921
aaaaaaagtgtgtataagaatggaaaatttattcatattcattcaaatattcaaagcataattaataattaattagttaataattaatttagtgatg

SEQ ID NO: 103486 - DNA, 539 bp, Heterodera glycines
  Promoter: Source sequence=SeqID_7040; Location=662..1200; Strand=-; Gene=SeqID_63656
gcatcggaattttaattaatttttatataagaaaaaatttaaaaagtgtaaaaaatagtttaaaaaataggaaaaaaatgcgcggccgcgatgcgcgatacgcgattcgcggcatttttttttgcgcggtcgcggccgcgggatttttctgtgcgcgctccacccctgctttctacgagttgccactgaccctcacctctactatattaaaaagttcatcaaaggcaaatagataaatttaaaaagttttgatttttgcactattttgtgtattaggcatcttttttacttcaattatttgcctttcatcattttctttatcccttttaatcctcaatgggtattgcaaattcagttaattattttttcgaatttgccacattcaaaaaagcagtttttcccataattaatatagaaacataaattagtccatttcatcagttaattatttttcctaatttgccacattcaaataagcaattttttccgataattaatatcgaaacacaattacttaagatcatttcaattacccaatg

SEQ ID NO: 103487 - DNA, 551 bp, Heterodera glycines
  misc_feature (36)..(36): n is a, c, g, or t
  Promoter: Source sequence=SeqID_27223; Location=1136..1686; Strand=-; Gene=SeqID_57917
tgcaggtcacatggaattaaaaatgaaataaaattntgtggatgaaaatggttaattttctgggacgtttctgagacgacagttttaagggcggcgttgaaatcccctccccctaaaatttgtctttcgtcattcgtaattttgatatgattggccactgattatgtaaataaagatttatatgtcgagcataaaattaagaaaagcttaaagtgcgaaatagaattaaaattttttaattttaatatataaattacttctcaatgaataaaagcattttatttaaatattctttgcatttatttcaattagtttttataattttgggattttatttattttaattttaatttcggttaataaagctgcaagattaaacggtaaaattttttttttaaattttgattttgattttatttttaaactagtttactttaattaaaattcgacaattttagatcaattaattcaaatctttagatagggagtgttattaattatatattttcctaagtatttgtttttccatttattgaaactcttgtcgaatg

SEQ ID NO: 103488 - DNA, 169 bp, Heterodera glycines
  Promoter: Source sequence=SeqID_10294; Location=2866..3034; Strand=-; Gene=SeqID_73459
aatgacaaaatgaaaatgatcagaaaaagagagaaattgttgaaaaattcaaccaaattaaagagaaaatcaagcaaaaagagagaaaatattcaacaaaagaatggcaccaaatttatgaagaaattgggaagaaaattggagttaatcgtagagtaattgaaaaatg

SEQ ID NO: 103489 - DNA, 564 bp, Heterodera glycines
  Promoter: Source sequence=SeqID_4657; Location=1753..2316; Strand=-; Gene=SeqID_55256
aatttaaaattatttacatttttatgaaaagatcattctgctgaaggagtgatctgctgatcaacttggtgtaattgacttatttgttcagccaaaagttaggccctagcaggaattattttcagttttttaccatagcttagctccgagaagaatttttttttttttaaagttttaatcatatatttttgagcacctaatttatgagcaaacattttcaaaattaatgaacaattcgtagagctgtggaaaggcagtgagtttggatgctttcgaaagctcagggatagggctaaatttaagtgaagaaagttttttgctatattcaattttaacaattttacgcaactttttcttcagcgacaatgtttaaccgtatataatttgttacatactgtatcattgtgattcgaaatcctttcatttgaattcaaattaagtgctaaaaattttggcattatgtttgcatttattcaaattttaaaattttacttcttcaaagttccgccgaataggaaagtttcattccggtttcagcggtttttgcattttcattttaccatg

SEQ ID NO: 103490 - DNA, 163 bp, Heterodera glycines
  Promoter: Source sequence=SeqID_1371; Location=683..845; Strand=-; Gene=SeqID_73089
ttttggtgaataaaattaagaatgatttggaaaaagacgcgggcattcaaaaatgtgccggttttatacttttgaaatcggataggctccgcccacttttcagctcgacaagttcatccgctcaaaaccaaaaatcattttaataatttcttaaataaaaatg

SEQ ID NO: 103491 - DNA, 271 bp, Heterodera glycines
  misc_feature (17)..(17): n is a, c, g, or t
  misc_feature (48)..(48): n is a, c, g, or t
  misc_feature (75)..(75): n is a, c, g, or t
  Promoter: Source sequence=SeqID_7862; Location=1..271; Strand=+; Gene= SeqID_66212
ataaatgtgatttttcnaataatttcttttttaaattttcattactancagtaaaaagataagcaagatcctctntaaaagggattaaaattacttttgataaaaatggcatgaaactaataaattctttcaaaaaatttccgtctattttttcaaatttcatgaaactgctgtgtaaaaggggactctaaaagttaattttttaaaataacttttattttttgtttattcttttattgtaaaaaactaataacttttaaggttaaatatg

SEQ ID NO: 103492 - DNA, 148 bp, Heterodera glycines
  Promoter: Source sequence=SeqID_6759; Location=3814..3961; Strand=-; Gene=SeqID_62775
gttgctcaaatcaacgcgtatgtgagcgtgctaatttaagcctcaccaaagaacagcttaaatgcctgattttttgtgatttcactaagggatgagcaccacgatttgaggcagaaatgtcttaaaatgattgaagctgagaaaaatg

SEQ ID NO: 103493 - DNA, 835 bp, Heterodera glycines
  Promoter: Source sequence=SeqID_23329; Location=1..835; Strand=+; Gene=SeqID_54040
cgatcagcaaatgtcaaaatttcaaatattttcattctttaatgtaaatttcaaattaaagaaagcaataaaaaggactctgatagtgtgataaagtgataggattaagtgaaagatgtgagtttaattacttcaattcatttaatttgtatttgatgaataaatatttttcgcagataatttaacgttgggtgctttttcttattttgaatttttaggggtttttctttctttttttttgccccaatttggaaaaattttcgagattttgttgagaaatatgcaaaaaaaaagaagaaaaaataataccatcttatccgatcagcaaactttgtgaagaaacggcacagaaaaagccaagaaatgaatgaatcatccattcacgtacacaaatgtgtaaattcattcataaaacaaacaaaaatggagttgaaaagggaaagaatgaagaaagaaagcatttgtctccataaaagtgtttagccatgagatttaggcacacatttggcgaaaagtctttcactattaaatgccaaaatcagtcgacaaaatgcaacccttattttattatttaaataatttttattaaaattatttatttttactgttcttggtgtggtaatgttgtgcaaatttttagtcatttcatactttggcatttttctattgtaaaaacagaaacattttgcgcaatgctttttcctcaattctttctttcatttttgttcattttgttattagcggacggaatggcgcaacaatcgaacaaagtgacagggccaaggcaacaatttatcattcaattaattaattatttttaatttgatttcaaatg

SEQ ID NO: 103494 - DNA, 146 bp, Heterodera glycines
  Promoter: Source sequence=SeqID_9333; Location=1..146; Strand=+; Gene= SeqID_71026
aaaagaagaagcaaaaaaaattgggggagggagaaaaagaagagaaggataaaagcagcggagggattgggtacgaactgcgctatttgggctacacaacggagaaggacggcgagcaattgctggagtcgttgcaggacgagatg

SEQ ID NO: 103495 - DNA, 120 bp, Heterodera glycines
  Promoter: Source sequence=SeqID_22096; Location=1663..1782; Strand=+; Gene=SeqID_52745
tatcgggccaggacgttttcgtacgagtgagtatggaaaaaattgcattcaaataatttgttaattttttttaattacttttaatgttttgacagttaagcttttattaactacaaaatg

SEQ ID NO: 103496 - DNA, 69 bp, Heterodera glycines
  Promoter: Source sequence=SeqID_12169; Location=1778..1846; Strand=-; Gene=SeqID_75744
tgacttgtaagaagaagttcaaaattcagcgcacatttcagggaacactcgcgaaaacttaagaaaatg

SEQ ID NO: 103497 - DNA, 735 bp, Heterodera glycines
  Promoter: Source sequence=SeqID_40939; Location=830..1564; Strand=-; Gene=SeqID_69167
atattatttataattatttttttattaatttatatacccccccgttttttttctctcctgtctaacagttaaagttaatgattttttcttgaattttttcctttcgatttgtacaaattgagcattttcattttccctccccccattcattcatttgctgctgcatttcatgtggtgtgatgatgacggacagcagcagaacatttcacattcatttaacttaatcattcattttgatcggaaaatgaaaataatctttgccccgctactaaaaaatcttaaaaattttctataaaaaagttgcaaaatttcagttaaaacaaatatttaaaatttctttaaaatgcatataataattattattaatttttcattagtaatttctttcaaataaaaaaagaagaatttttagggtccggcgctgccgagaggcgcaaccagcaagaaaaaaaaattgaaattgttaccatttttaacagattatcacccaaaaaaaatcgctaagttttgataaatttagcaaaattttcggataaatgatgagataggcctagaaatagtatcaacaaggaaaatcgaaattttcagctaaaatactattttcccttaaaaattaggggtgccgatgggtcttctcatccatccctatttgttctattgccaccctaaaaattttctacacaatttttcgagaaaaaattatttttattttttttttttttgcagattcaaatg

SEQ ID NO: 103498 - DNA, 365 bp, Heterodera glycines
  Promoter: Source sequence=SeqID_17923; Location=1..365; Strand=+; Gene=SeqID_82480
cgatttttcaaaaaaaaattgtaaaaattttttccccggtcgatttttgtaattttttgtgtgcgctgtttttctccttaaaaaagatatttaatttttttaccatttgtcaaatttatgaagctaaacaaacaccgccaaaaagcgcaatttaattatttaagaaataagggttgtaatttcataaaactaacagctgctgcattttcatttcttattcaaattaaattactttttgccaccaaattaaaaattaattattaaatggaatactaaaaaattttcggagaaccgatggacagacagaaaatcataaacatttccgattcaaaaaaattaattaaattttaaggtgaacgaacatg

SEQ ID NO: 103499 - DNA, 228 bp, Heterodera glycines
  Promoter: Source sequence=SeqID_26569; Location=671..898; Strand=+; Gene=SeqID_57304
agtgaattaaaaaaaataaatttaacaatatgaactaactacaatttaagtgaaacaaataaatgattctaaaaaaataaaaatattcaaatatacgagtaaatttaaaaaatgaaaaatatccaagcaaaaacagttttgcttacaattagcacataaatagactgttatttcattcccaaagtcaaaattattagctgcgaggcgatattgtattgctctaagatg

SEQ ID NO: 103500 - DNA, 373 bp, Heterodera glycines
  Promoter: Source sequence=SeqID_4501; Location=1631..2003; Strand=+; Gene=SeqID_54680
atacttgatatcattcggtagccctaagagttttctattttcatggaaaatattaaaaaaaaaatttgttataaatttaaaaaaagatataacctcagaactcaaaaaaaaaaaaaattcatttgatagtttttgacggtgctgggacgttagtcaaaaaccatcaaatggaaaatttttgacagaaaattattcataacttcgcctaaaatgaacaaaattttaaaattttgttatctttcgtatgcttatatttcgggcggcaccgatccaaatctcggcaccggtccgaatctccctccaacctttggctttgaattcttttcctattccatctaatcgccccgtcccctaaaggtttaaaaaaattatg

SEQ ID NO: 103501 - DNA, 972 bp, Heterodera glycines
  Promoter: Source sequence=SeqID_32269; Location=1..972; Strand=+; Gene=SeqID_62584
tacttttccattatggtacaccccgaaacttcttttcattatatttttttagacctattttaagcgctgaaaaatccggcattgtttatttaatttaatttacaagatttctggtttttatgaaaaatttagcaaaatatttttaaaattttgggtgagattttcgttttaagaaaaattaaataattgcagctatataaattccttttggaatttccgtcctattagaataaattaaattaatggacttattatatagtaaaaaaatatattataaaaattttaaaaaacgaaagccaaaacttaaaatatgaatgagaaaagcagtaaaaatttttaaattaaacatgtatggtttttataatgaaaagtgaattttctaattaataaatattttattattaatatgaaaattttctttaataatatttaaatttattactttacttaattgattttataaaattaatcgataaaagacatgagaaaaatcaagggtttgatttgatgggtttttgactaacgccctttttgatggtttttgactaacgtcatagcacccgccagaccccttgttctcaaaattttaccttgaaaaagcgcgacgcagaaaatttttattgattttttctttcgaatagaaaattttcatatcgatttttgaacaattaatttgtccatcaaatgcatggccaaacattttgccgtcagaattggcgttgtcggcttagaaatgaattgtccctatccaatcccaaacaaattcagcaaatcggaagagttcagatacccgccatgagatgttgatagaattggtgtaagtaaatttaataaaacacaaaaatttggaataaatttttattgtttcaaaaaggggtaaactgaaaaggcatttgaaattttgttcagattgatgactctggcgatatgaaaatcattcaaaagcgtattgagtcgtcgcccaaaaaaatg

SEQ ID NO: 103502 - DNA, 197 bp, Heterodera glycines
  Promoter: Source sequence=SeqID_20615; Location=433..629; Strand=+; Gene=SeqID_51172
agtctgtagaacttttttagtcaataaattcattctctggactaactggtgtgggtcgaaccaactaaatgaactaggcatagggagtattgaataccaaagtatggtgtcagattctgcttctcgggagagcgtggagttcctggttttttgtttggacaatataaaaatagaaaaagtttatctctatttagatg

SEQ ID NO: 103503 - DNA, 160 bp, Heterodera glycines
  Promoter: Source sequence=SeqID_24311; Location=700..859; Strand=+; Gene=SeqID_55035
tctttaacagattttcactgaaaattggcaatttttaaggtcaaattttgaaaattttaggggaaatgttgggagccctgaactgaagtcattaaaattaaaaaataaaagttgttttaaaattaaattttaatttattctttcaatttcagattttatg

SEQ ID NO: 103504 - DNA, 1003 bp, Heterodera glycines
  Promoter: Source sequence=SeqID_6260; Location=1177..2179; Strand=-; Gene=SeqID_60903
atgtaatgtaatgtaatgtaatgtaatgtaatgtaatgtaatgtaatgtaatgtaatgtaatgtaatgtaatgtaatgtaatgtaatgtaatgtaatgtaatgtaatgtaatgtaatgtaatgtaatgtaatgtaatgtaatgtaatgtaatgtaatgtaatgtaatgtaatgtaatgtaatgtaatgtaatgtaatgtaatgtaatgtaatgtaatgtaatgtaatgtaatgtaatgtaatgtaatgtaatgtaatgaaatgaaatgaaatgaaatgaaatgaaatgatgttaattcctacctaatgggagcgccgtgcggactagaaccccaaagcatttaatcaaaagcgttaaccactatgctacggcgctcccattcgctaattattatttctaatatttatattcaaaaattaatttaaatatatatttttttaattacaaattaaaataaagcgtcaaaaatacttgcgcaatggattagagccctattcagaccaaaataacgagttcgaacaaaatgtcgaaaagtcgaacattgttcgaactcttcaaaaatgatcaggaagacatttccagacaggggttcctccaagggggtcaaatgttgttatttttgctccaaaacgacgtttagacccacttttaggagttcgaacaaatttcattaaccatttccggtcacagaacatttctaagacctcaaaagagactttaaatgtttgtacagtgactgggaaccctgggttattgaaaataacgagttcgaacaaaaagtcgaaaagtcgaacattgttcgaactagttattttcgctcacagagcacttgtaagacctcagaaaagagtttaaagacttgtaaattgattgacagctctggattgctgaaaataacgagttcgaacaaaaggtcgaaaagtcgaacattgttcgaactcttcaaaaatgatcaggaagacatttccagacaggcggttcctccaaggggggggtcgaaatg

SEQ ID NO: 103505 - DNA, 219 bp, Heterodera glycines
  Promoter: Source sequence=SeqID_18172; Location=1..219; Strand=+; Gene=SeqID_82755
cttattcttttgtgtccatattccctgcaccaatctttgctgatcgccccgagccaaacaaagaaagataacatctgtatgaccatttctacaatgaaaagacgacaaattgacaaaagaaacaaaaatttggagaactaaagtggatgggaagagggggggggggttaagcgatcgggccatactccgctggtcatttttccgaatattcgcgccatg

SEQ ID NO: 103506 - DNA, 991 bp, Heterodera glycines
  Promoter: Source sequence=SeqID_14385; Location=798..1788; Strand=-; Gene=SeqID_78419
ttgtggatttctttctgcttcccgtttgcatcctgaaaacagatcttatgaacgtggtgatgttttgttagtcgttcaaaaagatcgaagatatattcggttttaaaatcttcctgtataagcatttcaccgccgctaatggaaaatgtcaaggggaacaatgccgataataaatcgttatcttaacgcagcttttaaaaagttacataattttcaaaaccttccgataacatctccaaaatttcatccaaaattagggcaaatgaggcccctccggctgctccgatgagagtggataatacggtttttgcagttttaagggtttttaaggaatttaataacattacggggttgcaacagcaagaagaaagagagtaaagaaacaaaaaaataataattttcattttgactatgaggagtgtgatttttgcagctaatcagattacttaaataatgattgattggtcacagttatatttggtgtagaaactgttacaataaaagaaacctaacggcttgaatataattggtgtgactatttgcgcggtgattgtgacaaagcaaatcagcaacatttctctcattagtgtgactggtttccgataaaaaccagaaatcgtcgattgcgcaaaaaactgtgactgtttttcgctgttatatgagcggaagaattatcactgttaattcacagatttaacattcttcccaagattcatttttgctccctttcctgtcccccccccctcctctccccgccaaaagggagaacacggcacggcattccctccggcattatcctgccaaatcctgaataattacatttattgtctgtatgcacttaatatttttattgacttatatttgccttactttttttacataccgaaattttcctaatttagaattataattttctatttaatattggtcacctaaattaagtcaaaataaatgataactaaaataaatagtatttttaagaattaaaatg

SEQ ID NO: 103507 - DNA, 840 bp, Heterodera glycines
  Promoter: Source sequence=SeqID_13103; Location=792..1631; Strand=+; Gene=SeqID_76895
acactattcaagaatttcgacagtgtttttaccaagataaatttgtttattttgagtacactgttgtttttaatgtatattgttaattcgctagaatacatttgatgaaatgcttttagttttctttttctttagcattatgacaataatccgtgattttttgtgccgttcgtcgtaccaatcgttggctcatttgtgccgtaatcaaattcgcgtttattctgtagaaagggagggggcgggcacggcttcgggcattgaacacgcgctcaaattcaacaaagcgggagcagtgcacaaaaaagagttgaaggattacaaatgcgtcgaatatcttcaccaaaataattattccttttatgacaaggaggtgggaaaattacaaaaaatataacggtcaaaatatactaacttaagccttcattgaaaaaaaatacatattcgggttcgaaataatttaatgccatattcatgatcagcgctctctaaaacccttaaagcatcacaaaactgctcaaaaccccctttttgtctctttttgtgggaagtaaagccgatgattaccaaaatgacataaattcctttttaagtgtgagctgcagcaatttcgcgtggtgcaaccgacgaacaaattgcctgacaccgaaccgaagttcaaatcatcttaaaccgattgatttcatgaaaaattttgttttttaattaggaaaataaaataaaactaaaggcaaaattgagagattgttcaattaaacagttaatttaacaaatattttatttttaatatatttttgttagttaaaattttaattacacttgtataatccaactcaaaagatg

SEQ ID NO: 103508 - DNA, 57 bp, Heterodera glycines
  Promoter: Source sequence=SeqID_4848; Location=1256..1312; Strand=-; Gene=SeqID_55945
aagcagcgagagttggagctgctaaaagagctgaagccgtggcgtggaggctacatg

SEQ ID NO: 103509 - DNA, 449 bp, Heterodera glycines
  Promoter: Source sequence=SeqID_1306; Location=591..1039; Strand=-; Gene=SeqID_72237
gacgacgacaacgacttccgccgaaattctttcggaagattttctgagaaaaggttataaagagttaattgatggaaatgatgtgaaaagggaatggggaagaggaaaattcgaaggggaaaagtggattgaaatttgaaaatttttatgaaaagatcgatgaattgaagagatttattcgatggtgatgagtatgaagtggtaaaaaatgagaaatgaaagtgaatattaaagagatgagaaaaaagttgatggattgaaatgagacggaataacgcaaatgcgaattgaaattgggggaataaaaatcgaaaaaatatttcgacttttccgaaccgaccaaagcctgcattttcaggaattttcgtggcaatgctccgcaactttctcctcaaaaattctcaccaaatgcgagtcacagacaacaccaaattgatgtacagacaatg

SEQ ID NO: 103510 - DNA, 374 bp, Heterodera glycines
  Promoter: Source sequence=SeqID_16987; Location=1..374; Strand=+; Gene=SeqID_81407
gcagggatggcattccgaggccccaaaaattttcggaaatcgaattccgtgccatccctggtctcatggtattatagttgtcctaataactaagagaaaaacttttttttgttaggtattcaataaactttttaatttttaactataaatttcgttgttaaacctaaggttatcatgacaactcatacacaggcaactcgaacaatggcttattgttagactaggcctaagtttaggcttttgtaatttttttttcttatattagttgaatttctgttgacatcaataagtgtgcttagagttgcttttgcacttctcttttatatgcaaccacgcgaaaacggccacgcgaaaacggccctcacgcgaaaatg

SEQ ID NO: 103511 - DNA, 208 bp, Heterodera glycines
  Promoter: Source sequence=SeqID_8578; Location=1..208; Strand=+; Gene= SeqID_68584
tgatggtgctaggtcgtttcataaatccgccaaatcgttattttgtaaatccgcaaatgagcgttccataaatcagttttataaaccctccaaatgtgcgtttacaaatccgctaatttcattaaattagattgctatttaaatgtcttaaatggcttgttttccattgtaattttggcccaggaacgaacgaatgaactccaaaatg

SEQ ID NO: 103512 - DNA, 97 bp, Heterodera glycines
  Promoter: Source sequence=SeqID_15273; Location=1487..1583; Strand=+; Gene=SeqID_79487
aaattatacatataaattcaaaaattaggctgatgatgctctatttgttgaatttgccaaaggattagcgacgaaatttgagaagttttttaagatg

SEQ ID NO: 103513 - DNA, 54 bp, Heterodera glycines
  Promoter: Source sequence=SeqID_25825; Location=2069..2122; Strand=-; Gene=SeqID_56587
tgggctttcgaagagagtgacatttctgtcgccattttgctgaatctggtgatg

SEQ ID NO: 103514 - DNA, 422 bp, Heterodera glycines
  Promoter: Source sequence=SeqID_6518; Location=1674..2095; Strand=-; Gene=SeqID_61876
ttgatgtatatttttctgatgattacaaaataaattaagattataaatgcctttattctatcataaaattaaaaaaacaaacaataaatgtattttttaaatgcaaaatatgtatataacaattcaaatggttataaaaataacaataaattatatgctttcgtatttttcttctgcgcatatgctatgaagaaggtggctcaaaaatagctatttacgttaaaatttatgatttggtaaagttttttaaggtataaacgcatattctgggtatattcgagaaaaattttgaacttatttaaagaattttggaaaagatttaatttattaaaaggtttattgttagcatattataaaaaagtttaattagaaatggcacatatatttttaaaagtcaaaattatttgcaatttttagagatg

SEQ ID NO: 103515 - DNA, 271 bp, Heterodera glycines
  Promoter: Source sequence=SeqID_36380; Location=1..271; Strand=+; Gene=SeqID_65704
ggctaaaatctacttaaaaaattttcatttttcctataaaaatcagcggcgaagggacaatcaatcaataaacaattaattaattaattaatcaatcgacggacactttcatttgattcattgtcattaatcacagtttcacaataactaaatacttttatttaaaacacaaaccatttttattgacgtatttgaatttatcctaaattttgtggtttatttgtgcttttccattctattattgtccattaaaaagtgtatgtccgtaatg

SEQ ID NO: 103516 - DNA, 546 bp, Heterodera glycines
  Promoter: Source sequence=SeqID_5919; Location=2438..2983; Strand=+; Gene=SeqID_59683
ttgtctctaaaaaaaatgatagcttgtttattcaattattggcttatttagcacaccatatcacacgtaaattatgttatagataaagcagcatgattggatttatcagtcaacactaaaaaattaaatttgcaattttgaaatttgcaaaacataacgccaaacatgtcaataacaaaaaaacaattgtcttaggcttaggcttggcttaggcttctttaaaacgtagctgtaccggacctatacttttgctttcctttctctatttttttctctttagctttatctgtttcatattttgttttgcttttcctacttaattaaaaattttatttccaaataagtttttattttccatttattttctctgtcaattttgcggccacaaagtctctgtcactcactaatttttttcaatttttaatacttttaaattgtcaaattcatttttagcttgtctttcactgtcgggtattaattgattgtttccttctgtgttgccattttcatttttgctctgcttttctctctgtctctgtgtgaatg

SEQ ID NO: 103517 - DNA, 1003 bp, Heterodera glycines
  Promoter: Source sequence=SeqID_6702; Location=2899..3901; Strand=+; Gene=SeqID_62550
gaccatcgccgcgggggtggctttttcctccacggcaccgtccccctccccttcctccttttttgcctctttttgcccctccccgccctctccgctcattttatgctattgccaccactttcctaaataaaaaatgcacggatgaggcgaataggaataaacgaatcctcgacaaagccgtgggcaatacgtcaaacagaaataaatggcttcgctcggggcaaccgattcattccaatggcaccaaatttggtcctaagggatacaattaattaattacttttcaatagcacattatctctatacaatttgttttgattctgtgttatttgtctcgctgataaattggccatccaaaggagctcatttttgtcctctgttgtcgccattggtcggctctcgaattttccttcagccgagaaatgtatcgggtaagaaaaatgccgagtaattggccctaatcggtcgcgcaattctaatttggaattccacgctaatggcacctccggggggggggggaaggggagcagtgccatcattcgcattctaaaagcggtgttttctgcttcgtcgattttgttaaccgtgaaacgtcaggcattcgtcccctgccctcctctcctcccattgtttctccctcccccgcccttcgtcgcctccctccctttctttaatctttgcgttaatccgctgattgcgcactcattggcactaatccgtggcattttgccccagggcaaaccttgttcagttggccgattattctttattggtttcatcgtcataatccacgttaaatttacatttgtcggctctctctccgctttccccccccccctcctttttattattaaatattcccatttttataactttttattttccaaatcctctcaagtttttctccgttgctgaagaggccgtcagcagcacttcctcctccgtttcgccccattcgatttgtcctcttccctccgcgccgctttttccctttcccaaaatg

SEQ ID NO: 103518 - DNA, 382 bp, Heterodera glycines
  Promoter: Source sequence=SeqID_4288; Location=712..1093; Strand=-; Gene=SeqID_53894
taagtatcaaacgtaattgtatagctggcacaagaagtgatggcacaaataaatttctaaacaaaaatggaaacgaaaattgaaatattttataaaaaaatgtaagcagcacaacacctccttgaaactgttgacccaatcgacgtttctttctacgctatttcggcataattggcataacagtcgcttcggttggccatttggtgtcggcgtgtgcacccatttggacaacgcttggccagcagaagttgcatttggatcatcgaaatcatcaatcaccgcggcgggaaacaggtggccggaactgattgaattcaattgatcaagcaagatcagtgagaattgttgatgaaatgagacgacgcaaattgtccaaatgatg

SEQ ID NO: 103519 - DNA, 114 bp, Heterodera glycines
  Promoter: Source sequence=SeqID_553; Location=1..114; Strand=+; Gene =SeqID_56129
atttgcaacgccactaaatgacccgggcagacagccgttattgttgcgaaattggggggggggacggcatttgaaccgattgatttgagggttgccatccgaaaaggcgaaatg

SEQ ID NO: 103520 - DNA, 330 bp, Heterodera glycines
  Promoter: Source sequence=SeqID_715; Location=3153..3482; Strand=+; Gene=SeqID_59671
ataactcagtttgttgataagccattttgttatcattcgtgatggattacccgagaataaatgagcgtgaactcaaatttcccattccctccgggattgttgtcagcgggccctcctcttcgggtaagacgcagttggtccttcgcctgttggcacacgccaacgagatgtttgatcccccgccgaaggtgataggtaagtccccaatgccacgagtaatgagcagtccccttgggtttagtttgggcttacggtgagtactcctcgcagatacccgagctcgagaggcagggggtagtcccgcacgcaggcccaccctccgaagaaatg

SEQ ID NO: 103521 - DNA, 94 bp, Heterodera glycines
  Promoter: Source sequence=SeqID_19214; Location=195..288; Strand=-; Gene=SeqID_83958
tttcaagcgacctattattgccatttttggattttaagcaattattttaagtaatatttttggtaattaattaattttttttatttaggaaatg

SEQ ID NO: 103522 - DNA, 69 bp, Heterodera glycines
  Promoter: Source sequence=SeqID_9410; Location=833..901; Strand=+; Gene=SeqID_71311
aattaaatcattttttaatgttaattaattttctaataaaagtttgaaagaaatttcggcaaaaaaatg

SEQ ID NO: 103523 - DNA, 503 bp, Heterodera glycines
  Promoter: Source sequence=SeqID_26569; Location=1..503; Strand=+; Gene=SeqID_57305
ttaaaatcataaagcaaaagtcatttttttaaattttctttcaaatttaaaaatcaataaaacgcttttttgaggcgcgctttttccaaaaaaactttttgggaagagggggcaggcggcgccggcaggcgccgccgggaaaatttttgaaaatttgattaaaatttgttgacagattttcaccaaaaaatcatcaaattttgtgatttttgtatcatttttctaatgagaaataagagttttggcgcgccgctgagaacagtttttcatcaaattaccaaattttgcgattttgggccattttctaagaaaaaataggagttttgggggcccggcggtgcccataggcgccgccggggaaaaaattggaaattttggtcatttataaacgggttttcactgaaaattagccaatttataggtaaaattttgaaaaattttatgggaatttaatccaattcttaggggtgtaaaagtcgcatttcgcgccaaaaagcgaaatg

SEQ ID NO: 103524 - DNA, 145 bp, Heterodera glycines
  Promoter: Source sequence=SeqID_2242; Location=6038..6182; Strand=+; Gene=SeqID_78668
tttgatgatgattttgcaagaatgatttgattgtgtgagaaaatctcggcttaaatagctttcaaaagtgggcgtggcctaattttctgggagtataaaagccccggcaatttgtcagctatgtctcatttgttctgctacaatg

SEQ ID NO: 103525 - DNA, 882 bp, Heterodera glycines
  Promoter: Source sequence=SeqID_23775; Location=236..1117; Strand=+; Gene=SeqID_54476
tgacggcataagccgcgtcagcgtgccgcgcctctccccaatatttggaaccgtcattttttgtttttgatgttcaaatttgtctattttgtgacggcagaaattttgagattattgtttttgctgtcctccggcatcccgtttttaattgatctgtgaattgtaaatagcgatcaatacaaaacgtagaaagggcacgatcaatacaattggaaaagcatgcttgttcaatgtgttagtcaaattgaagggccgttgctggccatttttgggaaaatttgaaaagtggcgaaaaacagttcgccaaaatttttgaaaaatacacatctaataaaattacagcaagttttcgagttttttgatcagaaattcgaatgcctcacggcagcagggatatgtgtgttgccttcaaaaaataggcaatcgaaaacggtattccgacggctaacaataaaacatttgggcaaatttttaaaaaagaagctaataaaattttaaaaaaatcgccagaaccaagaagaatcatacggaaaacagaaagttttccggaaaaacacaagccaattcagaaattattttcctgataatacaaaccaaaacataaatagttgtccggaaaatcacaaaccaaatcaggaatttatttgcggaaaatttaaaaaaaaaacatttgagttttgtgtaaaacacaaataaaaatgttaaaaacaatctttggaaatataaatcagaaatgtgaattttgtttttgtttatacaaaaccaaaaacagcaaaatgtttccggaaaaactcacagcaaaaaagaaattttatccggaaagctcaaggcaaaacacaggattttatttagagcataaaacaaaatccaagaatagaaatg

SEQ ID NO: 103526 - DNA, 272 bp, Heterodera glycines
  Promoter: Source sequence=SeqID_2204; Location=803..1074; Strand=-; Gene=SeqID_78466
tgacacatgggaaaagaaggtgaagtcaagagaaattctaagtgttagatttttacggagaataaaaaatttaaatatgaataagtgtgtttttaaggcaatttcgtcaaaaggatcgatttaaaacattgacggaatgatttcgatgggacatttgaacaaacatttgatgaagttggttttgtgcccaatttttgatgatgaatacaaatttgcaagcaaaaaccgcttttcattcctttgccaatgtttgcttattaatttctctgatg

SEQ ID NO: 103527 - DNA, 531 bp, Heterodera glycines
  Promoter: Source sequence=SeqID_7770; Location=1..531; Strand=+; Gene= SeqID_65893
ttttatcccactaaaattgggccaaataccccacaaacaagaggaaaaaaaataaatttttataagaattttcctcaaaaatgcaagtggtcaaataacccgagatagataagaacatagttattatgtataattaacataaagtatcagtgaagcatattttcatattcaaaaagtataaattcaaagttattttttgaattttatgtttttttcttctttttcaatcatttttctgtttttctgtaaagatgttttgcttttgcatgcaaaaattctttttaataaatagaattttaataaatttaaaaattgtgttttcttagttacaaatgcaatgatttggcggcggcaaagcgcatattgccaaattgggcgctcgaattcaacaaagacatatcgcaaaagcattacacattcattagcgacaaatttgcatcagaaagcggcgacatcaaagcaaattattcaaaatggtttagcgccaacaaattagcagacgaatgcgaactgtcgcacgcatttcgtatg

SEQ ID NO: 103528 - DNA, 110 bp, Heterodera glycines
  Promoter: Source sequence=SeqID_12310; Location=1..110; Strand=+; Gene=SeqID_75897
attttcctatcgtatttcattaaattttccaaaaatttttcccggcgtcgcctatcggcaccgccgggccccaattgaaccattattttttgaaaattagagccaaaatg

SEQ ID NO: 103529 - DNA, 348 bp, Heterodera glycines
  Promoter: Source sequence=SeqID_10149; Location=1877..2224; Strand=-; Gene=SeqID_73249
tctgtaaaaaatcaataaattggcttgggtttcactgtgtgtttgaattggcgccctgttgtatctttctctaacaactactctctcgtctatgtgtttgtggatgggcgtggcctatcgcttaaaagggacagcccgtctggaggtcgctgcgcgctaacacccctctcactatcaatcaataattacgtgttttttcgcaggttcattttatgcttttaacaattataatcataaactatttcttaatcgtaatggccccgagaaaaatcaatgatcaattggtgtttgagaacaaaagtaatcattttttgagttttttataataattttaaatttaaagaaatg

SEQ ID NO: 103530 - DNA, 162 bp, Heterodera glycines
  Promoter: Source sequence=SeqID_26990; Location=1162..1323; Strand=-; Gene=SeqID_57722
gcacaactttttttaaagaatttttttgaatataaattaaaaaaacacaatcatgatttgaaatatctgccgttattgataatgagtttactatttatcaggcaagagataaatcccattagaaaagtctttaaggtagttatagttgataatgtaaaaatg

SEQ ID NO: 103531 - DNA, 160 bp, Heterodera glycines
  Promoter: Source sequence=SeqID_3096; Location=1..160; Strand=+; Gene= SeqID_83178
tgatgtccatcatgcactttgttctgttggatgtgcgcaacgcgtcaatgctctccccgtttttgcctccaccaaactctcggtgcattccgcgttggcctacccatttgcaacaccaaatttcaaccggcaatcctcgacatcctcaacagcacccatg

SEQ ID NO: 103532 - DNA, 112 bp, Heterodera glycines
  Promoter: Source sequence=SeqID_18746; Location=1..112; Strand=+; Gene=SeqID_83419
tattgttctggtgctgatcattccgactctttcccaggtgtgggtaaccaaaagtttgccgtgccgccatctgtcgtcaaaatcaccgcagcgaaaatcgtcccgagcaatg

SEQ ID NO: 103533 - DNA, 169 bp, Heterodera glycines
  Promoter: Source sequence=SeqID_25861; Location=426..594; Strand=+; Gene=SeqID_56631
agagacaaaattttcttggtttttagcaggccggttttatgtcgctagaccaaagtgatcaatattttgtctaaatcttcgctaacgagtcacctaagctcttcaagctcattaaaaaatttctaagccttttttattggagactagagctaggaaaattataaaaatg

SEQ ID NO: 103534 - DNA, 219 bp, Heterodera glycines
  misc_feature (76)..(76): n is a, c, g, or t
  misc_feature (93)..(93): n is a, c, g, or t
  misc_feature (110)..(110): n is a, c, g, or t
  misc_feature (127)..(127): n is a, c, g, or t
  Promoter: Source sequence=SeqID_2428; Location=1433..1651; Strand=-; Gene=SeqID_79679
tgaatatttaaggcgaatgaatatttaaggctaatgaatatttaaggcgaatgaatatttaaggcgaatgaatatntaaggcgaatgaatatntaaggcgaatgaatatntaaggcgaatgaatatntaaggcgttcttttgttttttaaaagcatagatattttaatttttatttaatattttcaaatttttcatatgtactgactattttttggatg

SEQ ID NO: 103535 - DNA, 194 bp, Heterodera glycines
  Promoter: Source sequence=SeqID_7309; Location=1859..2052; Strand=-; Gene=SeqID_64418
aacggagtatttttgtttttactgtattttctttttcaaaaatatttttataaaaaattgattaaaaattgtaaaagcatttttctaaatattttatttatgaaataaattgtacaaaaatttacatttaaaatagaaattttaatttactagctttggatttccaggccaagctgaaaaaacgtcacgacatg

SEQ ID NO: 103536 - DNA, 216 bp, Heterodera glycines
  Promoter: Source sequence=SeqID_16349; Location=1..216; Strand=+; Gene=SeqID_80741
tctcatgcaaccgttgcaattcggtatgaacggcatgtatgcgccagtcgcttggcctcagcaaccgatgatggcttatccaccaccaaattttcaaatgttttgtccgccaaattttgttccgcaaatgccggttcaaaattttgtgccatttatgaataatttggcaccaaatgcatttcaaccaaaattcctcaaaacgcaattcaaccaatg

SEQ ID NO: 103537 - DNA, 526 bp, Heterodera glycines
  Promoter: Source sequence=SeqID_26670; Location=402..927; Strand=+; Gene=SeqID_57427
ggttcgtttttaaaattaagatccccgacaccaatcctagatttttcaagatttccagttttgaaatacgagtccttttttcatttttttttggcatcttgctctcgggttatcgtttttggaaaatgaaactaaattttaaaaatcttgaaattattcgatagccctaaatgttttctattatcctgtaaaatttcaaaaaaaaaaattcgttaattttcaaaaagttatgacctgtgaaattcaaatttttttttgtgttgaacatttttggtcataactttcttgaaatttaaagaaattttttgaaattttttaagatcatagaaaacaagttttttagggctaacaaaatgctatcaagaatttatcaatttgattgcttttgttaaatcaaaatttccataattatttttgcgtcaggcatttccatcaaaatgcccccctcaaattgactttttgccttaaaattttttacaaattttagaaaaacgacaaaagacccttcgacatatacagcaaaatg

SEQ ID NO: 103538 - DNA, 490 bp, Heterodera glycines
  Promoter: Source sequence=SeqID_10494; Location=2196..2685; Strand=+; Gene=SeqID_73708
atgaattgtgaaaaattttaatttgtcataataaatttcataatattttgatttatatacgtataaaattaattaaattattattagatggccggatttggatttatatgtgctaaaaacccaataatgtgagaaattatgtgttaaaacgaaaaccataaagttttaaaataggccatttcattccgtcaaatattattttgcttttttgtgccaagtaaagaaaaattgaaaattttttagtcgatgaaaatttttttaaaaattaatttttcttaacaaattttaaattttttggccatatgcaaaaaatgcgataaaacttacaaaatataattatatgtgcaaaatgcataaaatatgctttttttattcggtaaaaggggattcgtaaaccggtaacagtttttcattgtggttttgcgaaaaaacaaaatttgtatatcctaaaaatggtaaagatattgatgcaacaatttcggaaataatg

SEQ ID NO: 103539 - DNA, 108 bp, Heterodera glycines
  Promoter: Source sequence=SeqID_27957; Location=1698..1805; Strand=-; Gene=SeqID_58615
actgaatatgttaagagtcagtccaatcaaaaaaaatattagagtttaagggcaaaattttttggcgattgtgtaaatttactgttttttggtaccgatgccaaaatg

SEQ ID NO: 103540 - DNA, 427 bp, Heterodera glycines
  Promoter: Source sequence=SeqID_29578; Location=366..792; Strand=+; Gene=SeqID_60056
tctcaccataacaataaagaattttcttaggcggtggttcaattaaattcttatgatgttttaaaaaccgtaatagccaacgggtcttaccactcccggtagcccctgagagaattagagtgaacggaccgcgaaacatttttaattcctcttatttatttgacctatttatattttcatagggaacatgtttcgcgcatttggggcatagccagaaattatcaaaaaatgatgtaccgaaatgcaaaagactgtggcttttacatctcttacaaatctcgtaatgacaggggcagtaatgacaacacttaattttatgtggacagttcattttttcaatttaattttatttttggttgctatttatagaaggggtatataaagggagtgaaaggaccatttgattggtacattgtatcaaaaaatg

SEQ ID NO: 103541 - DNA, 1003 bp, Heterodera glycines
  Promoter: Source sequence=SeqID_8107; Location=385..1387; Strand=-; Gene=SeqID_66991
ttccatacgacctctgctcgataaagcatggagataatatggcatcatcataattagggatgccaaaaatatgcacatgcatattttttcctggactgcgggatgcctgaaacgcacgaaaaacatgtttttagcttgatttgaagcttctaggatgactttccatgtgcatattttgcatatttgtgcatatttcgcgatttatgtgcatattttatgtgcatattttggcgtttttccaaaaaacctctaatagatcggcccccgacagacaaattggcctttttgacctcaaaaaccggaaaattttccaaaaaaataattttttagcaaaattttcacgaaaaatattgaataaataaattttctcaaaaaatggttaatttaggtcaaaaataagcaaaattttgcttttcaggttgatttttcgcaaaagatgagtaaatttttgctttatcatgtttttttctcctaaaatgatttttaataccacatttagccatttttgaagattttactttatgtttaacaaatttgaagaaattttgagaaattacaccctcaattggaaaattttatgtgcatatttttcacttatatgcatatttcacgatttttggtgcatattttagcgcatattttacgattttatgtgcatatttttggcatccctaatcataataaaaccgagctaagattcgcactcagcacttttttccgggcggtgccgcggtgccggttctttttaaaaggaaaaaagctgaaaattttactggcgcaagctaggatttttcaaaaaaaaaatttggaaagtgaaaattaataattttttgaaattttttaacaacaccaaaatatggaaaatgaaaaaaatatggtaatttaaaatatcatttttctaattttttctttttttactgaatttgttctgaatttgagttacgaatccccccggcggccttcaaccgaaattgaaatcatgcaacggaagtgggacattatg

SEQ ID NO: 103542 - DNA, 377 bp, Heterodera glycines
  Promoter: Source sequence=SeqID_10934; Location=1318..1694; Strand=-; Gene=SeqID_74241
actgttattaaatgctaattaacaacgatgagtaataatcattaagattcgaattggcgctgctgcgttcgttcggcaacttttcgaattatctcgcaaaacaacgtgtctaagaattccattgggacattgtgtgattatgtttttgacaacaaattgaccaatttgggattcactaatttcgtttcgtttgcggtaagtgccaattcaaacaaatatttaaatttgacattcgtggaccagccaatattgaagttcatttatttatttgcctggtgtaaagaaatcataacaaaataaattaatttctaaaacataaccaattgacgacgcataaacaaaaattaaattagatgatttaaattaaggaattgatg

SEQ ID NO: 103543 - DNA, 816 bp, Heterodera glycines
  Promoter: Source sequence=SeqID_263; Location=663..1478; Strand=-; Gene=SeqID_80330
tttttctcattaaattttgccaccttttatttaaggcttttaatttttcaaaatttggctctattttttggataatttcctttgttttattgaatatccgcatgcattctccgggattattttgatcatattcgaatttgttttcctcaatttttgttttgatcgtttctatttccctttttaatacgcgattaaggaggggtattttgctacgaagcgtaccggacatagtttgtattttaaaaattcaaaataattaactaagtacccttttatggttatttagtggataatcactatcgagtcgaattttaattgttttatcactggttaaataatttttattaaaatttaatgatcacagaattaataattgttatcacaaatttaaaaatttgatcacagaattttatttgtttttgttaattatttgctcctttttttcataaaattctttcaatatattctccgtatgttttgggcgaagtttcgttaatttgtattccgtttgtgtttttaattttataagttcagtcagtgtagtgcttttcgccacttgtttctttttcgtgttggctttggtcgtcggagtaattgaattaggagtcgctctgtccacttaattatttaaattagtgatgggtttgctgtagggtttattatgacttttaattatgtttggctttttatggtgtcctttttcggttttttgattgggtttggtgatccgtgtgtgtgtgtgtgtgttttttttttaaattgggtttgtcaacccttgattttgtatgtgcttggtgacccttatacttccggatg

SEQ ID NO: 103544 - DNA, 364 bp, Heterodera glycines
  Promoter: Source sequence=SeqID_24943; Location=1..364; Strand=+; Gene=SeqID_55679
cccccccccccccccccccctctcgccttaacggggagggcatcggtacccatccattccatcaatgctcaaaaggttcttctgttcgttcgtcccctcctcttccatcatccgcacttcttcttccgacagtttcttcattcattcatctcttctccttttccccgtcgtccatcgcttttactttccgaaaaatgtccataaatgaaaagtgcagatgattttgtctccgctttatccttttggcactttgtccatttgtttcattttgtcacaatgttttgccaaattcttaatccccattaattttccgtttcttaggcttttcctccgattgttttgtgctttcttctccctgccaatg

SEQ ID NO: 103545 - DNA, 220 bp, Heterodera glycines
  Promoter: Source sequence=SeqID_24700; Location=712..931; Strand=+; Gene=SeqID_55450
aacgctttaaacagacattggacgacatttaaatgatgtgtaaaatgacaaaatttctacaatttattcatttttttaaaataaagcatttcactaaccaataaccgaagaaattgttgttttcgctgctttttcgctacacatttcaattcgtttgttttcatttgcttttcccattatgccttcagaatattcccgatgattggcaaataacaaaatg

SEQ ID NO: 103546 - DNA, 300 bp, Heterodera glycines
  Promoter: Source sequence=SeqID_35514; Location=119..418; Strand=+; Gene=SeqID_65057
ttgctgaggggtgttaatgtatctgcaacatcaggagggacggacgtgcccgagggtatatataccaatgaaattttccattctcttcaaaacaaacgagttgctgaaatccaaattgaaattcagaacgcatttggacgatacgtaaagtttaactggggtacttgcatcatcacgctacatttcaggcgtaaacttttttgatcaacaccgaaaaaaatgacgcacataccttttaatcccgactctgtagattgggcgccttttttggcactacagcaagaggggaagggcgaaatg

SEQ ID NO: 103547 - DNA, 295 bp, Heterodera glycines
  Promoter: Source sequence=SeqID_3827; Location=3173..3467; Strand=+; Gene=SeqID_52026
tgccggattctgttgattggattttttgcatatgtacataattaaaattccaaattcggcgcaaaattttcttaaaaatcgttaaataaagtattaactttgaagaaaaccaagtaaaagtcaaaattttccattttggcttatttgaaataaatttcttattttttgaaagtttaaatgaccaattagttaaatgtctgaactgagctaattaataggatgattgactaattatgaaatgccatactgaaacttgcctggaggcaagtaacaaatgcttggataatgggaaatg

SEQ ID NO: 103548 - DNA, 1001 bp, Heterodera glycines
  Promoter: Source sequence=SeqID_14309; Location=1..1001; Strand=+; Gene=SeqID_78334
ttcaatgagtaattttatagtaaatcagaaactattaccttattatcaaaaatataatttaggaaatgctacttaatatgatagatttattttatgaaaaaaaacttatggctgatgaaacggcataaaatcgcaaaaaaataaatagttgtttccatttcaaacaatgctttaagaaaaatataaattagaccaaccaaataaaccgtaaatcagtttttcgattatggaaactaattcttcagaccatgattataagtaattgagaacgaatgtaaaaagtaaatattttcctagttaactaaaatttcaccgcacttaattaattaattttttattaaatagttttcaaccaatgtgcaaaattttaccttttgtgacagagcttgactttactttcgtaggttttttttatgatgtcgtacagtaacggatacattgccaggctttacagtagattttacccaattaattcgaagcaaaataaagaattgaaaatacaattaagatactgcataaaaaagctgtttttcattttttaattatctttaaatattcaaatgaccgtagattcaacctcttttttaattaaattaaaattttaattcgagtttcaaaacctaacggcaaaatgaaataaattatgttttgttaattattacaatgggccaacaaatttaagatggcattgctttaaaaaggagacttaaagccaaaagtgattctattgattctaattaaatttatttatttaaatttattaagatagcgatattaatatcgattcttatgaagcagaaacaagcgcaaaacggcaacactttatataatgtaaaaacaacccaggatttattggcaattttgtgtgttatcaaatgattaaattcagcaacagactgtggtaaaataacaaatggaaataatttatttgaaataaaatattataaaaaaacatactttttcgtgaacctactcttttcttgaaactttgagacaaaatg

SEQ ID NO: 103549 - DNA, 1003 bp, Heterodera glycines
  Promoter: Source sequence=SeqID_21755; Location=512..1514; Strand=+; Gene=SeqID_52352
gaaggtccaaaataagtacatacctatttctaaggtcgactaagtgcgataaaaagcaaaaatttcgaatgtgtttttcgtgcatttttcggagttaaagccgcagaaaaatgatgtttcattccttcgctattctccgttgtccttttctctccctctccctcgctgttcagtcattttcctctgtcttctttcgcctccactctttcccttcctccgtttgcctttcctttttctcttttctgttgacacaatcctttgccttctttcctttgctgccgcctgttttctttgttgctgttgccaacggcaaattctttctcccctttccctttctctccactcttttcccctcctctcttcctctcccctttcatcattcacggggttattatcattctctttcccttcctcttttccactcgtttttattaattttttgggccattttgattttatctattgctcaatttccaatgcatttgttttatatcgtacaatacaaacagcagaaaaggcgtcactgctcactatcattgccatcgacaaccgcactttgccagcacataacagccatcaaaaaattccattgccaattgaatgtattgacaaaattgaactgcattacacgcttatcattgtggttgaaggatcataataaattcataagctttcctaaatatcattattatttatacagttgtgggtttttgggtaggaaaagcagtttttcattttttacgagatttgttaaattaatgtgtaacacccccaaagtgtatgatgaccaagacgtacgttggagttcagtgagaatgagtgtgtggtggtgtctctgttcgttatggtctccgtccccatttatgtgcatcaaagaactcgcaagtttttgttcaaaaaaataccgaaatacaacaacgggaaaggaatcaaaatttcaaatttttctcacctaccgcgcgttatttgcgcaaaatacgaaattttcagccccaaatgaatg

SEQ ID NO: 103550 - DNA, 132 bp, Heterodera glycines
  Promoter: Source sequence=SeqID_24100; Location=1..132; Strand=+; Gene=SeqID_54800
acattatggaaaaaaatcgatgcgataatttccatttttaaacacaatttggaaatatcaagttaaattgagagaagtttttctctcaaatttccttactatttttctcttctctgcccgccgctaaaaatg

SEQ ID NO: 103551 - DNA, 110 bp, Heterodera glycines
  Promoter: Source sequence=SeqID_28924; Location=555..664; Strand=-; Gene=SeqID_59495
tttttaaattcgcataatcattttcaattagtgctgcaaaatttaaattaatttttaaccgattattttattatttttttttatttttgcgtttttaagcaccgaaaatg

SEQ ID NO: 103552 - DNA, 352 bp, Heterodera glycines
  Promoter: Source sequence=SeqID_4803; Location=2013..2364; Strand=-; Gene=SeqID_55776
ttcagacctgctgatttaggggagaaaaaacatgatgtgagaaagtatgggaagcagcttgtttttcctccgaaaaacaataacattttctttttgaaaaatctcaattcgataaatttatagttttttttaatggaaggcgtagtgcagctgtgaaaacaaatggcgttactggaaaagtggtagaatttgatttttttagttttctcgcgttttcagggtcactgatcaaaagaatattaggaaattttttaattggggcgaaccttaccaccagcccgcctccagaaaatctaaaatcaatctaattgtaagctgaagaccccccccccccccaattttttgcaatatg

SEQ ID NO: 103553 - DNA, 213 bp, Heterodera glycines
  Promoter: Source sequence=SeqID_20743; Location=439..651; Strand=-; Gene=SeqID_51310
ttagcagggggcgggcaaaaggacaagcaaaggagcagcaacagcagaagcaaaagcagtgtcccaccaacgacaccttttgacagaatgccaaaattgcatttaaaaatatatttttggccaaaaaataaatttgaaaataatttaggaacggcggcagagaaagcggcggccaaaaagcgcaactcgtcaaccgccagcaaaaagaaaatg

SEQ ID NO: 103554 - DNA, 427 bp, Heterodera glycines
  misc_feature (138)..(138): n is a, c, g, or t
  Promoter: Source sequence=SeqID_28677; Location=1..427; Strand=+; Gene=SeqID_59265
tggctgcattcaacaagcaatgtttgtaaaaaatggaatttaaaattttcaaaaaatgtttgaattcggttcggcgtccgaaattgagcctaaagaagaccagattcgtgctaagcacctcggattaccccctgaaanaacattttctcaaaacttatttaaaaaaagttttcgggaccaattctttaccattgcccattaaaatactataaaaatccgcaaatgatgaatttttttcgctttccgcacgtttttcttacaaacccttgtaacaaattgataattgctacttgttttatatgttgccaaaaatgggatggggtgggcattctcttaaatcaccatcaaattcaatgactttttcattacatttccatcccttagacttccatttgacttttgaccattttctccgtctttccttatg

SEQ ID NO: 103555 - DNA, 518 bp, Heterodera glycines
  Promoter: Source sequence=SeqID_31718; Location=1..518; Strand=+; Gene=SeqID_62024
aagcatcagagagccttatttaacttttaattaacatttggtgcgtttcagagcacgttctaaaaaatatttatgaattaattttgcaaaataataaataagtaatgaaaaagtcagaatttcgaaaaattttaaaaacaacaagcgttggcattttttcaggttaagttagtcctttacaatggagaaggcctgcaaaatttggagagattatatcgattttagtgcgctaggttcgatgaaactttttaaaatataagcctaaactttttggcctgtttaaaaaggaattaaaaatttttaaaatatttattcatctcccttttgatagaaaaagcatcagagagccttatttaacttttaattaacatttggtgcgtttcagagcactttctgaaaaaatacttatgaattaattttgcaaaaaataaataagtaatgaaaaagtcagaatttcgaaaaattttaaaaacaacaagcgttggcattttttcaggttaagttagtcctttacaatg

SEQ ID NO: 103556 - DNA, 420 bp, Heterodera glycines
  Promoter: Source sequence=SeqID_8928; Location=3565..3984; Strand=-; Gene=SeqID_69676
tattatttgtctagcgaaatttttattaatttttcttctcctaacatattaattaataattattgaacttaaaaatggtagtaggcgaaaagcttaaaatttagtgtggttgatgtcattcatggccatggccatagtcaattagtgtcgagccaaatttttttgtaagcgcattggcgaaagaaaaaatttaaatttttaatttattttaacatcttttcattcaattcagaatcaattgaaaaaataggattttcgatttttgtgttcgagttcgggttagggattggtaaaaattggtcagattcatgatctgaatactctcgactccagataatattttcatgatttttaaacataaactttttgtcaaaacaaaatgtccacttagaattcaaacttcatttgatggtggcaatg

SEQ ID NO: 103557 - DNA, 422 bp, Heterodera glycines
  Promoter: Source sequence=SeqID_18604; Location=1766..2187; Strand=-; Gene=SeqID_83254
atttagcaagaagaaattggtggtcgacgggagacggacgaagaaaacaatggagaaaacaattcgattttgaatagacacagttcgataaaggtttttattcgtttttacaggaaataaaatttttttttaatttttgagcttcattaaaaactgtgttatcatttcacttatatttatttgctttaaaaacctcaaaatacagttacagcgtgcatgggactcgaacctgagaccccccccccttttggtgactaactcacagaccactaagacgaaaaatccagcatatttgtacttggagcccaaaattgggccgctgtgtgtaaggttcaaaattctgctgggtttactttgtttcattactcaaaattttgtttttttttctcaaaattcttgaaatattttctgttaaggaaatg

SEQ ID NO: 103558 - DNA, 709 bp, Heterodera glycines
  Promoter: Source sequence=SeqID_11538; Location=1..709; Strand=+; Gene=SeqID_74976
cgcatgacaaattcgtcacgcttttgtctttgtctctttttgctgtaccttggcgtttacaaattcgttttaagaattattccttcccactcaattctttcgtccttattgctaggtcgacaattggtccgtgggcgtccttctatacgaatttctctcgggcagacctccgtttgatctcgaaaaacacgtggacactttgaacaccatcagaaaggtggggaaaatgaatttgagtgaccgtactcttttaaaaacttttttttttctgattttccattgcgcaattaaatttgggcaacggtttagagatcattggtgccgataattttctttttatttcgggaatattactaggggtaatctgaagcgctgagcacgaattggccgttggtcaatttcggacccagaatccggattcaaactttttcgtcaaaccataaaacaatatctttttatacaatgtttaaatgccatgcatttacaaagaaaacaaatttgaacggcattcttaaaaagggaatctttgagggtgcttttcactaatcagaaacttcgaatgaataagtgagtgcacaacatattcaggtggcctatcaattcgcgagttcgtttcccgtcggcgccagagacattgtgagcaaagtaaggaaggaatgaattggaaggactaaaaaccacgaggagaaggaccttttccaaaccaatg

SEQ ID NO: 103559 - DNA, 515 bp, Heterodera glycines
  Promoter: Source sequence=SeqID_15876; Location=170..684; Strand=+; Gene=SeqID_80208
ttaattttttcaggatttttttaaacattttttcgggatcttcgttttctgggcatttaaaataaaaagttgtcacgagctcttttatcccaaattttttattttcgtttgtgtgactctccacttcttcgaaacattttcccaaattagcactgtttttgaaataatttttggtatttttcgagcggcggatatcttttgaaatttcttggaaaatttctttgaccaaatttgattaatttaaaatattaaatgaaataaacattaatagaaaattatcaaaacaaaaattattaataatatccaaagggcaaaacattaaagtgatcgtcaataattccttttttctgcaccggcgtacgcttccacctttatcttcaaaaacatccgcacatatcctttgaacagttgactgtcaaactgctcaaaatgataggcccgatagaagcctgtgacccgatatcccagctctaaagccttccgtaactcaattgatgtgaacgttcccaaaaatg

SEQ ID NO: 103560 - DNA, 538 bp, Heterodera glycines
  misc_feature (18)..(18): n is a, c, g, or t
  misc_feature (26)..(26): n is a, c, g, or t
  Promoter: Source sequence=SeqID_14076; Location=2031..2568; Strand=-; Gene=SeqID_78051
actattaattaattttanctataacnttaataaaataatttgtttcagcggctacgaggttttatacttcatgcattaagagtgaaaatcagtaaaatgctaatattcaaaaacaaaaattcaaaaattataaattaaaaatttattattattgcaaaattaatcattgacatctctcttttaatattgttaaaatttatataaaaacatttgctgaaaaaatccaaatattaatacaaaattcgatttatataaaacattaattttaatgattttttaaattaaacaaatattaacttgcaaaagattttttaatcaaaataattataaattaaatttttggcttgggttggcaaagaaaaaatgctgctttaaaaattattctattttaatattttataaattattatcatgttcaattaagacagcttaattttttcatttatatgctttggagtttattttaaaacgaaaaagaaattgaaaataaagcaaattaatatttatatatcctttatagtacgctgcagggaaaatg

SEQ ID NO: 103561 - DNA, 336 bp, Heterodera glycines
  Promoter: Source sequence=SeqID_25089; Location=1..336; Strand=+; Gene=SeqID_55825
gtaatactgtgctttgtcccccccccccttttcgaaaattttttatgatttcaaaagtctaaaacattttcccaatggttttcggggtcattgatcatgcatccggcacccatttcgactaattcggaatcccggcttcgaattcgacaaaaagtcgaaaattcaaaattttcgaatttcctctttttagtctaaaaatttccaaaaaattgcgttaagttgaaaaaaaaaactttttttgaattattctggtctaacttttttgaaccttaacgaaatttttcagaattcggcaggattaatgtaaaatccgcccatttcagattatgaaatatg

SEQ ID NO: 103562 - DNA, 378 bp, Heterodera glycines
  Promoter: Source sequence=SeqID_10149; Location=872..1249; Strand=+; Gene=SeqID_73250
tgccatgatgaatgcccctctcaagctgctgtggcgagagaaaacttccctttggcacacggaaacggtattttcggccgtcgtgcaggtgaacaatcacatattgtcggtctgatgtacccagctttgcccaacttaagccaaaaatcggacccaatagccatgattttcgcccacctgtttgggtaaattatgcctgacagtccaaccatccacccgaccccatcgaacaccaacttctttggcaagtgcactttgaatttgtttgttttatttccaacaaagccaggcgtgttgctcggcaaaattacaaagaaagagtttgtcatttgatcaacaagtataaattcttcaaaatgagatcgtccttatatcatg

SEQ ID NO: 103563 - DNA, 294 bp, Heterodera glycines
  Promoter: Source sequence=SeqID_29096; Location=1..294; Strand=+; Gene=SeqID_59653
ttgattctgtattccgctatgataccgtatcgttttcccgtctctaccaattctcttttactccaactgcaatcaaaaattgtttgactgtgtgactttgatttctcataatctgttgtttcttttttttacacataattgttttgtattcttttgacgattaattttttttatctgactttctttttatgttaatattttcgccaacagttgcatttcaatcactttttgtttttcattcgcaattcgtttgccttatattcgatttgtttgtttttagggtctcaaaaaatg

SEQ ID NO: 103564 - DNA, 833 bp, Heterodera glycines
  Promoter: Source sequence=SeqID_7825; Location=535..1367; Strand=+; Gene=SeqID_46477
ttaatctaaaagcaattctgataataaaagagaaaaaaaaatttttgaaaaaatttgacccaaaaccgggatccaaactgaatgagtaccttttccgcctggtttggggtgtctatgatgacttttactagtataatgcctatttttgactttttgtgcttaatgcctatttttgtgcctattcgccatttttggcgcttttttcaggattttcggaaaaattcttaactaaaatgaaaattacacccctaagaatcgatccgaaaaattttcacaaaaattgatccccaaaattcaattatttttttcttaataaaaatttttgaaaaaaatgtccttattcgataaaactttaaaacaacaattgaaatataagcaaaattaagttttttgattaagtcgtttttacgtgatttgctacctaaatagtgttaataagaaaaaaattttttgcctatttttgtgcctattcgtggatttttgtgtctatttaatgcctattttgcgattttttatgcctttttaggtgcctatttcgcgattttttgtaccaaaaaatggaagccctaattatgaatgatcaaaatcaaaatgaacagcataaaaaagcattgaccaatattttgaattagcgcgcaaaggcaactcgtacaattaaaaaataaagcataggctcaagaaagcctaagtttcggcctaaacctaggcgtaagtctaagcctatgtacgagttgctttttgtacgaattgtcataacacctgaaaaattaatattagactaatccttagatttggcgttttttactattgaatgctcagaaattgctcaaatg

SEQ ID NO: 103565 - DNA, 302 bp, Heterodera glycines
  Promoter: Source sequence=SeqID_10631; Location=274..575; Strand=-; Gene=SeqID_73866
tttgtacggcgactttctctttgagctgttctcaaaattgttttacccggcagaggcaaatgggcccaaagggacggccaatgataaaatggcgcactatcagcaacagcagccccttaataaggtggtccccccggcccttccctttggtgtatttggtgagggtaaacaaaatggaattggaaagagaagggaaaggcggcgaagggacggacattttgcagcgaaacttcgatttaccaatttattcagcagattgagggggggggggggaagtgttgtttggtcaattcaccacgatg

SEQ ID NO: 103566 - DNA, 930 bp, Heterodera glycines
  Promoter: Source sequence=SeqID_13058; Location=1..930; Strand=+; Gene=SeqID_76837
ctctgcccatcttttttaattattattttaaaaaatgaatttgaacttttgaagccctcaaaactaataataaaaaggttcccatgcttgtgattatgaatatttgatgtttccaaatttggcattttatgccaattttagcacaatttttgttggcggaaattttcgctctgcaacgataattctttgttattcaattattgcgtgtgaagcatgaagaaaattgggattggacatataattacccactctgttggccatatgactaaaggccctccactaaaaatggacgcaaaaattctcaagattttttttttgctggggtgagcatgactattataaaacacgtaatttttagttcacttttttgtgccgttatcttattaaaagcctaattaaggaaataaaaatttaggggtataaaaactttggcgttacctttcaaagtcgtatattttgaattttcttaaaaaatttggacccttctggttttatcattttttttttttggaaataatatatagtcatgagaacttatttctggctttatttgtttctgatcatgaatgtgacatctattttagcctgtttaaccaatttccgacttcctaatttaatttgaaaaaataaataaatcgaaaattagaatttacaatttttgttcatgttacgctttagtgattagaaacagatcaaaatagatgtcagattcgtgatcagggactcaaaaaatcaatcctctgggaacaagcaattatatggcttttcaagagcgcccgaattattaattttttaaataattgtgtttttataataaaattttttttaattttacattaaaaattggaaatctatgcaaacaattctctttggtaatttaatttggtatttccaatttaattaaatttgtttgttttttagattaaaatg

SEQ ID NO: 103567 - DNA, 236 bp, Heterodera glycines
  misc_feature (37)..(37): n is a, c, g, or t
  Promoter: Source sequence=SeqID_21912; Location=877..1112; Strand=-; Gene=SeqID_52545
aaaaacttcaaaaaaattttcaaaaaacgtcattttnttatttattttttaattgattgacaaaaaataagtaagaatgttactgccgtggagcggattcgaacctccacctttttccctttacttcttacaaaaaccactgaaccacacttacaagcgcttttttcgctggtgtggttttgtttatttttattttttttgcaaatttgtttttttaagtcgattaattcacaatg

SEQ ID NO: 103568 - DNA, 116 bp, Heterodera glycines
  Promoter: Source sequence=SeqID_35342; Location=210..325; Strand=-; Gene=SeqID_64919
ttttcagggctagttgattcggcaggtgagttgttacacactccttagcggattccgacttccatggccaccgtcctgctgtctatatcaaccaacaccttttatgaggtctaatg

SEQ ID NO: 103569 - DNA, 119 bp, Heterodera glycines
  Promoter: Source sequence=SeqID_18824; Location=716..834; Strand=+; Gene=SeqID_83514
tttgtttaatagttaagagattattattattatttctgtaaagctttattgtgtatatataatattttttaaacatggataatataagataaaccgttttgcaaaaaaaaaaaaaaatg

SEQ ID NO: 103570 - DNA, 419 bp, Heterodera glycines
  Promoter: Source sequence=SeqID_4388; Location=941..1359; Strand=+; Gene=SeqID_54265
agcaccgaagaagaagaagaaacagcagacagaaagcacgatcaaaaaacatcatttccaccgtttcgcctatcgcttcttgattttttaaatttgttttttatttatttaatttcacttctcagatggttttcgtcttgttccttaaataccaaaaaaatcccttcctccaatcaccgccattttttttgatgctcctttgaacatcaccattatttattctgcgatgcacttacgaattagtgttggaagaatttgacgaattgttcacttctgtcagaatttgataaacacacaaacaaaagggaaattagtgacgtaaactgttagtattattcaattattaagtatttaatctgttgcttaatgatgcgtgaaacagcctttgttaaaaactagcaatgaaattaaaaagaatg

SEQ ID NO: 103571 - DNA, 609 bp, Heterodera glycines
  Promoter: Source sequence=SeqID_25264; Location=2059..2667; Strand=-; Gene=SeqID_56012
gttgcgtaatgcataaagtgccaaaaattcaaaaaaacctcccttgatcaagacagagaaaatttatttattcttagaacataattaatagcttagaaaaattttaatggaaaagtaatttttataatagctttatgaaaatttaaaattttttttgaaatagagaatatttattatatatttaaattgttgccaaatttcattaaaaacaataaattaaaaatatattttggtttagaaaattatttttcatttcattatgatttagatgaattcattgtaacattctcagagacaaaaaaaaaccaaattattaattcattatcctaacccaatgcttgattataaacaataaaagcctaagacaagaaagcgttaataatacggcatccaacgctggtaaacaaaaaaaaaaacaatgtttggcgtaaagtaaaattgaaacgcagttttaaggaaaattttttttttaatttctttaattgtattcgttcgaaaaaataagagatactttattagtctaattatcataattttcagtatgagaaattttcctttttttagtcagacaaaaaaaaatttgtaaatttttttccagattgaaaaatg

SEQ ID NO: 103572 - DNA, 104 bp, Heterodera glycines
  Promoter: Source sequence=SeqID_30998; Location=476..579; Strand=+; Gene=SeqID_61351
cctgaacagagagacgctcttaaattctcaaaatcgctgcacctccgcggtaataactcggtgtaagcgtccgaaagcgttcttggcccgccgtgtcccaaatg

SEQ ID NO: 103573 - DNA, 169 bp, Heterodera glycines
  Promoter: Source sequence=SeqID_5574; Location=762..930; Strand=-; Gene=SeqID_58530
ttaataaatatatttgttcgatcaaaattcactaataaagtgtgaaatataattgaagtattgggaaatccaataaaattaatttaatttaaataaaataaatatttaaattaattcttattgactatctgaaaagagagtcaataaagtggtgccacgaccaaacatg

SEQ ID NO: 103574 - DNA, 874 bp, Heterodera glycines
  Promoter: Source sequence=SeqID_12489; Location=445..1318; Strand=-; Gene=SeqID_76124
tcttttaaaaaaacaagaaataataaaaaacaagaaaataatacaaaaacaaagaaaatataaaaaaataaaatgaaaacacaaaaaataaagtattgtgtttgtccaactaaatgtattatagcaaatatttttgagtatttaaattattttatataaatagatttttcattagaatttgtgatgtatttgtgtggactcaatgtctgctaccttcacgtggttgagtctggaaacagaattaatttcctatcatttaagtgaggcatttaaacaatggccaaagcagaaaatttttttttctttttcattggggcgcaaatgtggcacaaccccttgggcccccgctaaaaaagggttttgactcattagtgttaaagaggaggaaattccggtcataaaaagccaatgcatttgtgtatttttcttgtttctgctgctgtgtaatttctaactcatcaagaatagtgatcggagaagcgatcagaaaatgggaagttgccgccgctttctccgcgcagtcgccgtccctccgtctgatcgatgcgtcgccggcttcgcgcgatttgccgctaaactcgcgccgagttgccgacattgatattttctttgccgaatttgggcacggcgacagcgaaagtttcgatggcactggcggactggtggcccattcggcctacccaccgctgggcattgtccatttcgacgccagcgaacgatggcaaattggccaaggggcggagacaggtaaatgggccaaaggcaaaaggaacaagcggatgaatcatcatttgtgatcggaaaaacaggagaacgggggaggagcaatggcattggtggaggacgacaaaagcatcagccgaggggacaaatg

SEQ ID NO: 103575 - DNA, 918 bp, Heterodera glycines
  Promoter: Source sequence=SeqID_42322; Location=1..918; Strand=+; Gene=SeqID_70249
tatatgtgatttaaattatccttttttctgtttaaaaaagttttgttatttattattacatatggtaccaaattatattcatatgcatgttttttttaatacaggggccaatttcggtttttgtactcagaatttaacaaaaaaaatttgattttttatgtagtaaaaataataaaatattttacgatttaaacagaaataaataaatgattttttaattaaattttcaactttaaaaataaaataaattttgaaaaaaattcgttttcgcgtttcgcttttttgttttcttttttgggcgtttcgcttttcgcttttcgcctttcgttctgtatttttagtttcgcacagccttgatatatttttttcctgaacaagcaagggttctgaaacacataaaaaacatgtttttagcttgggtgacattttagtccttctttcggaaattttaatagaaaatttcaaatattacccccaattttgaaaaattgtggtggatatttgtattttatggtgaatgtttttgcgcatgttttacaaatgaatataatttggaaccctatttattaccatattgttttgttttttgacacgacgcggtttttaatttttttaaattattttttagtcaattattattgtctatataattcaatggtttgaacgaagcaagattttggaaacgcttctaattcagggaaaaattccagcaaagagtatgaaaggggtttaacgctccctacaaaagctgattagaagggttcaaagctccctacaaaagctgatgagaatggttcaaagctccctacaaaagcggttgaaaaggttcgaagctcctttcaaaagcggttagataactctctaaacaaagaattgaaacattttgtaataaatttggatgattcagacgaagatatg

SEQ ID NO: 103576 - DNA, 673 bp, Heterodera glycines
  Promoter: Source sequence=SeqID_14735; Location=958..1630; Strand=+; Gene=SeqID_78866
ttataaaataaggtatgaattatgagatttgtattaaaataattaatatattattaaatcgtatacaaatttatatttaaatagtgttattagggtttattaaatgagtagtataagggtcagcaatggaagcaaatgctgggaaataggaactgaggtaattgaattctaagagcagagcgctgcggaggctttttggttagaagaggggagctggacgttgcaggagttgcaaatgaatggaagaaaggggcttttcgctgggaatggtcgggtatttatacccacactagtgagctagaagtacattttaattaaattctgaggttatatttggacatagcggtgtgaacattattaaattttgggccgtgtcgtgtttcctacatgaaatagatttaatgaacaaaccaaagtgtttacggtttaccttgatttaattaaaagcacggttttaagtgttcgaaggttccgcatctaaatttaattagaaatgcacaaacagaacggattcacatttatttaattatatggacagcgacagcaaactaaaaagagttataattaaatgaatctaatattattacatttattttacaccgacagttttaaatgaattttaatttttaggtaatatttaatatacaaataaaaaattgatagaccatgcatg

SEQ ID NO: 103577 - DNA, 1003 bp, Heterodera glycines
  Promoter: Source sequence=SeqID_3185; Location=718..1720; Strand=-; Gene=SeqID_47548
taaatttaaattaaattttttaaaaaattaaaaaattttttttgaatttttaaaatttccctgttggtcccggttcccggtcccgaagaaaaatcgaggtcccagtcctggcttctcaggtcccggcaagtcccggtcccggttttgcctaaaattcccggtcccattgcactctagtaaaaacccacgaaatgtccagaaaaaaattaaagtataacaattcgtaaaataagtctattttagggttttcggagtcggtgaacttattttccggatttttataaaattgttgctgcaaatgccttcaaaaattttgtaagtttattttttctttttgccgacatttcgcattttgttcgacttttaccagagttgggatatgaaattttcaaaccaattttgaaatattaacccagttttggccaattggggacagaaaaggcataaattaattttacaattttcacacataaattattttttgtggcggcaggacgttaagcgacgaaatgttgatgaatttgacgagattttgcgcaatatcgctgcctttatgccacctgtctgactcttttcatgatttaattgaattttaaatatttttctaaaatcatagatattttgtcaaatctatgattaaaagtcatcagatgttaaaataaatatcatattcgtgatcagcgaagttggaaaccccaaattacgaattttggaatttttttgaggggggggggcgacataacccggaagtaccaaaattcatttaacaacaatttattttgttgcaaaaaacttaattgttaattgggtaaaaatgcgctaacaattaactgagtttttttttcgaattcgggtccgtggctcggaattggaaaaatccaagttcagcttcgtgatcaacacccttgaaaaccccctgaaaatgatttcaggacaatgttgacctgctgaaaaagggagtggtcagaaaggcgaaaaacaaacagcgaaagaagcgaaaatg

SEQ ID NO: 103578 - DNA, 227 bp, Heterodera glycines
  Promoter: Source sequence=SeqID_13604; Location=1443..1669; Strand=-; Gene=SeqID_77508
actttaaaataaagttgtatggcatttgtattgtaatatagaaataaacttctataagaacatcgttctgcattccgaacgccggacccgaactcgaacaaaaaatcgaaagtcaaaattttcgaaattagtgtttttcttcaaatcggtttaaatacacagaaacaaactgaaatacatcaatcctgcaataggagatcatttatgccgtttttgaacaaaaaatg

SEQ ID NO: 103579 - DNA, 790 bp, Heterodera glycines
  Promoter: Source sequence=SeqID_9552; Location=1763..2552; Strand=-; Gene=SeqID_71862
tggaattattcaaaagaccaaattttgggattttgagacaattgtgtaagaaagcagaggagttttagggatccgatggtggcgccaccggggaaacattttggcgattttgttaataaatttgcaccaaagattaatactaattttgaaaaaacggaaaaattcaaaattcgctatggtcaatttatatggtaggatgaacattattatagaatgcgttaacataaaaataaatgaataattcatgatcagcgcctaaatcacctttcaaaaaacaattaaattttcatgggagtcaaaaaacccataaatgaccatttattttaaaaaatttcattctaagaatgaaaaattaaaccattatattcgaaaagggatgagatttatctttttccatctaaaagtccttatccatgcatatgtacaaatcaacaaattcaaatgaatttgctttgttctcctcatcgtttttcgggtcataattttgccgcaattattttgttattttgtgccctcccgcataagaaagtgaagctcatcagcagcagaaaatcctttacattgcaaatctttttttacaattatacaatgagtaatgttcatttttaaataatacataataacttaagctaataataaaatgtaaattatcgtttaaaaattaaaatgttaaacatctttttttttctttaaattgacttacgctctgaaaacaaaattttctttttaccgattttggcatttgaattgataaaattacgagtttggcaattgctttatcattacaatg

SEQ ID NO: 103580 - DNA, 173 bp, Heterodera glycines
  Promoter: Source sequence=SeqID_12813; Location=1342..1514; Strand=+; Gene=SeqID_76538
ggttgcttgttctgctgatcagtgccaatgaggggattgttggttcatctccgctgatcagtgccggtgtcggcggcagatttggtcaatgatgccaaaacgcaaccgagcgagattgaccaaaaaagccctgattcaaatccattttttgcaggggcctcgaaggcgcaatg

SEQ ID NO: 103581 - DNA, 114 bp, Heterodera glycines
  Promoter: Source sequence=SeqID_38905; Location=551..664; Strand=-; Gene=SeqID_67603
gaaacaacaggaaaagagctggtaaaagtgtgtctttccagccgggctgtgtgccgtacttttgaaaagaaagtgaattacgctgtgtgcgcataaaaaggaaaagagaaaatg

SEQ ID NO: 103582 - DNA, 447 bp, Heterodera glycines
  Promoter: Source sequence=SeqID_26257; Location=271..717; Strand=+; Gene=SeqID_57004
ttacggtgagccaaaaaaggagatcacttttttggcactttgtccgtctaattggccccaaatttacgcaaaatcaaagtaccgagcccacaaaattggctcggaattcgagaccgggactgggtccgaaattgaaacagtccgatccggtgagtcggcacaaaattccactacttaaaaaaggccgagactcaagaccctagaagatccccactaccatcggcataatttcatgtaccttttttcctcttgcagacgattgccgtgattttggtggccctttctctgtcgttgggcccaaaaattgatcagctcggtgagtctgatcagaaatctcaaaactgatgtgaaattggctaatgtttaagtcagcgaatcgttggagtccagccagctgagctccgctgaacttctgttggggggaccgaaacggacaacggccgaatg

SEQ ID NO: 103583 - DNA, 269 bp, Heterodera glycines
  Promoter: Source sequence=SeqID_8491; Location=894..1162; Strand=-; Gene=SeqID_68271
taatcctcccctaaggcgttgactctctgtccgccttgctcaatcggcgcgtctctcctcctcaccaccactctctgtcgccctccgccgctctttccgggggtgccgcgtccattcagttgcgccgtgccacatgcggtgaactggacaagtcaaagcgcggcgaacttggccacagcattttctatgtggatgagcccgactcgccgtccgcggatggaccgaacgcgtcgcattcgttagccgcgactccttcctccgacgaaatg

SEQ ID NO: 103584 - DNA, 412 bp, Heterodera glycines
  Promoter: Source sequence=SeqID_2568; Location=1030..1441; Strand=-; Gene=SeqID_80435
ttccgagaccccgaaaattttcggaaatcagatacaaccgggaataaatgttagaaatttcaagaaaaaaatcatagaaaaatttttcttaggattctaagaaaaaaaaaactttcaaaaaattttccaacaatttttcaaaatttaatgatgaattactaagttttctcaaaaaaatttccaaaaaatcgttggaaaattttttcttcgaatcagaaatttgttggaaaaaactgatttttccattttttgttttttccttaaacatttttttttcatttccatgttctgtgtgttgttgtttgtagcgcttttcccgaccaatttccgtttccgcgatgtgctgctgttcgccatgcatttgtggaccaccggcggggcccaacaacaataccgggcacagcacatgatg

SEQ ID NO: 103585 - DNA, 133 bp, Heterodera glycines
  Promoter: Source sequence=SeqID_1259; Location=6092..6224; Strand=-; Gene=SeqID_70945
tggcaaagctgagagagctttcaattccgcgattgatcaaaatcgccacgattaccaactgatcagaacagcgatcatacggcaattagacgatacggatgcaaaacaattgacggcgtttggccaaccgatg

SEQ ID NO: 103586 - DNA, 127 bp, Heterodera glycines
  Promoter: Source sequence=SeqID_23180; Location=1..127; Strand=+; Gene=SeqID_53886
tttttaaattttcccaacaaatttttttaaaagctttcgtttttaagggacattttccatcagcgtcactatagaagcggctttaccgcctcatttcccattcatttgccttacaattgccacgatg

SEQ ID NO: 103587 - DNA, 383 bp, Heterodera glycines
  misc_feature (20)..(20): n is a, c, g, or t
  Promoter: Source sequence=SeqID_39872; Location=967..1349; Strand=-; Gene=SeqID_68344
acaaataaacatcaaatttnaggggtgtaaaatgacaaacttcctaagtgaacaaacttatgccaaatcgtagttatattattttttaaaatcaaaatttgccaagaaaattaataaattttggagacaaatttttgagaaaatttttcatttattagtagggatgcgatttttggattttaactgcgcgcctaaagtgtatataaaagcaacctgcttcattcacattcacttttgccaacaccaccaactgttcactcgtaatttctgaggcatgtgttttttttttgttgcaatgtttgactttttttcattttacagaaaccgacagttttgctcacgttcaacaacagcgccattctcagcaacatcgcacaaaaatg

SEQ ID NO: 103588 - DNA, 1003 bp, Heterodera glycines
  Promoter: Source sequence=SeqID_22257; Location=360..1362; Strand=+; Gene=SeqID_52926
accgggatcccttccgaccattttaccaatcacgcgggatcccgcgggattgaagtcatgataatttttccaaaaatctccattttttaattaatatcttgaattttaaattaaaaaatattgtcatttgctaatttttcttaaaaaatccgtaaaaatcccaaaaatttccacagatctccaaaattccaattaaattttcaaagtttaacgtaaaagttggtcattttgtgacttttatttttttcaaaaaagaattatcaaaaatttttttaattcctaaaatattattttaaaacttttaggtaatattatgacacaacaatttctaagaattttgtgaaaaaattagattagaaattgttgtctacgtatttttccttcggtgcatatctgcagcgccggactctaaaatccttattttactgaaaattttgctcaaaatcgcttaaaaattttggtttttttggacaaaatctgttaaaaatcgcatccaaaattacaaaaatttttcccggcggcgcctatcggcgccgtcggcctccacctggttccctaaagtttttgaaaaaatctcagcaaaaaaatcataaaaatctgatttttggctccgatgcacttaacgatttgctaattttcctcaaattgttaaaactgatcataggaggcgaaaatataaaaatttatattaattaaattgtaaaaaacaatttaaagctatgttgttaaatgttctaatcctaaaatctgattttttaggcatgatattcgaattttgaaaattttctaaaaacctgatataattcccattcctatttttcttcaatgggattgatcaattataaatattagagaagcattataacaaaacttgacacaaaacgtaaaaaaaattgagcttttgcaaatcccgataatcccgcgggatcccgaaaaaaaaatcttcgggattgatcgggatcgggattcggtcgggatccgtcccgatcgtttttacgaaatg

SEQ ID NO: 103589 - DNA, 830 bp, Heterodera glycines
  Promoter: Source sequence=SeqID_27234; Location=1..830; Strand=+; Gene=SeqID_57928
aaagggaaaagggaataattcagggcccaaagtgcgcctgaatcgataattagctttgcaccatcgaatattacatataaattagccctatcaaatttcccttagggcctcagataatgactatctctttttcgaccacaatagtaccgatcaaagcgaaaatgagttaattcaggcagcaatgagcgcctgaatctctaaatatcttggcactttggaatgttgcatacaaattagccctcttaaattttccttcgggccccagaaaaaggctatctctttgtcggccacatcatgttccgatcgaagagaaaatggctcaatcgaggtgtcaaagaatgatctaatttccacaatcggggcgcaaatgttcagtcacctctcggggaagcttctttcttcttcttctctatctcactagggttgtctattttttatgagttattttttttaatattttcatataacaaattaaccaatcattcgccacatttttacaagcaaaatcaaaattgtaatgtgcgtgtaaattgatgcaacagcagcaggaaacggaaatgagtttggttgtccacgctttttgtcatttgaacatttatataaaaatgctgcaaagtgatgatgatttgtttattatatttattttttaattaaataaaatgaatttccaaatttgcttgcttctttctgtgcttctttcttatgcaatttgtggaaaaaatggcaatattttaatttaaaaattgtttattattcttttaaagcaaataaatttagacaaaaagaaggcaacagtcaacaatgataacaataaatctgtcccaacaatg

SEQ ID NO: 103590 - DNA, 285 bp, Heterodera glycines
  Promoter: Source sequence=SeqID_1417; Location=2281..2565; Strand=-; Gene=SeqID_73411
cctagaaatggaaaactttcacgaagattcaatctcttaaattttattttttaaataaatttttactaagttgattgggtatttgattgggttgtgcaaaaaccaaaaaacaattttctataaatcgaaacaaagtattgtttgcttattttgatcggtcatagcgccttactgacatttgcggactgatatttggggacaatttcgggaaaattgagtccaaaaaaataaggtaatgttagatggatattattgagtttcagattttaattcaagcataaaatg

SEQ ID NO: 103591 - DNA, 1003 bp, Heterodera glycines
  Promoter: Source sequence=SeqID_7887; Location=1197..2199; Strand=-; Gene=SeqID_66284
aaaattttcttaagtaaatcaaaaaatttaaaaaaaatttaataaacttcttattgaaattttgagcattttgacgttccgtaaaatattatctatttatttcgaatttataaaaaatattattttattttaataattaactaaattataaattctttcgtgaaaatatttctacaggttcccgtataaaaccaatttcaatcatcaattaatttaataaaagcaagcaatcagaatcaatttgtctttttttccatttttaggttcaattttgcgttttaatttgattaatgtctcaaattcgttttcatttttgacaatgttgagaaaaataataaaaataaattcaaaaattaattcatcatatgatcaattaacctgttgaggcaataatgatgaacatttaaagcgctatttgcgcaaaaaaagggcaaaaagtgggcaataaaatgggcaataaattttacgtcttcaatcaatatttattaaggaaattatttttcaataaaaaacaaacagaaaatgtgcataaaatggcaaaaaaaaaattttgaaaatgaggattttactttgccaaataaagaaattaaaactgaaaataacccaaaatgacaaaaacgtagcaatgtataaaataattaataatttattcaattagcacaataatcaaaaaaaactttaaaaaaatatttccgggtatttgtatataaataataataatttttttttattaaatcggctcaattaatacaaattttgaaaaattaaaaaataaataattatttttaaaagatattcatcaaaaattgatgttgctgttctcgtctttcttattccttttctttatttgtaataaacattgtgtcggtctttatgacccagaaatatacataccacaggttactttttagttgccaaatttttaataattttaattaaattaaaattattttataaatgtttttatttataaaattagaattttttacttttttagactatg

SEQ ID NO: 103592 - DNA, 958 bp, Heterodera glycines
  Promoter: Source sequence=SeqID_1107; Location=5398..6355; Strand=+; Gene=SeqID_67909
ataaattttgtcaccatctcttctctctccccccatcctttggtttaccgtattatttccccctcccccgccgcctaacactttaatggttacattttgcgtttgcgcaattcaccgatggctgagaggggtggggtgggggggagtgtttgcggcgtccgtctgttgtgcatgtttagtgcgcgaaagggaacagagaaagataggggggggggaagggattcggttgcatgattatcggggggggggggaacgattggtcgcgttttgttgtggcggagtgagtgaatttgggggaggtaataaccgctgttgtaacagcagtgttcattgtcattatgtgggcttttattgtgaatgctctctctctctctctctctctctctttcttttcttctctcctctcctattctctctctctctctatttctttctttctctctctccctcactttcgctgcgtttgttttgccttttcttttgttcattttttcaaagttatgtgtggtgtgatatgtttcttttcctttctgctgagtctgttgcggcgtttggaatttaatgcaaaacgctttttcaattttttccagaatttttttgaatctatgaataatttgatgatttaattttatgtacaatatgtacctgtatatgggtttcatttgcctataatcgttttgtgaagaatcaacaaaatttagtgaagagagagagagaggcgagaaaccggttgtacgcattttcattcgtccggtaataaatgcgcaaaaagaagaagaagagacccatcccttcaattttttatcacattttgttggaacgagcaaaatatgagcagggcaaaaattgaaatatttttaaatttagttttggcagatgaggggaccaataaacaaaaaccattacgcttaattgattaattagtgttttgttgctcagattggctaacatcagcatg

SEQ ID NO: 103593 - DNA, 303 bp, Heterodera glycines
  Promoter: Source sequence=SeqID_42637; Location=1..303; Strand=+; Gene=SeqID_70489
ttcatcgaacctggttctttctattctctttcaaatcctcccccattttttttacagcttaactaggccctattaagcttatttccagaaaatctcgcatgaattctcatttttaaattttttatagatttttaaatgtttgcattttttttggcttaccaaaacttcatcgaacctggttctttctattctctttcaaatcgccccaaattttttttacagcttaactaggccctattaagcttatttccagaaaatctcgcatgaattctcatttttaaattttttatagatttttaaatg

SEQ ID NO: 103594 - DNA, 87 bp, Heterodera glycines
  Promoter: Source sequence=SeqID_17333; Location=1..87; Strand=+; Gene= SeqID_81814
cagcattcatctcttctccattggctgtttattgcatgatgagcactactcatcccttgcccgccttatgatcagaaagataaaatg

SEQ ID NO: 103595 - DNA, 198 bp, Heterodera glycines
  Promoter: Source sequence=SeqID_4014; Location=777..974; Strand=-; Gene=SeqID_52812
ttgaatgacgcgcatcaaattttgtttgcaattccaccatcattttagataagcatttttctgacgataaacttctgttttttgttaagcttttacacgtaaatttgtatcccattgataacaattttgtttctttttttggtttaatttttccacttttttgtgattttgatacttgttgagtacactttggacatg

SEQ ID NO: 103596 - DNA, 1003 bp, Heterodera glycines
  Promoter: Source sequence=SeqID_5858; Location=511..1513; Strand=+; Gene=SeqID_59461
taaaaaatttaatcaaattccaaaaaatacaacaaggaaaattattattattttttagtctttttggtcatattttttgatataaaattaaatttttgatgaaaagtcggaaattttcggaaatttttttaaattttttttttcaaaaaattagtaatttttgtacaatttctgttaataaattgaactgaaattttcaaaaaatttcccggcggcgcctatcggcaccgcccgaccctaaaaaacattaattttcttgcgaaatttgctcaaaatcgcgtacgtacattaagaagcggcgaaatatttatttgtttttttcatatttcttaaaaattcccccctccaatgactttggcagttcataaagttgtttatttacatattccaatcgaatgttttggctgcgatccgtccccacatgaatatttaattcggcaattcattcataatgggatcattcatcagtcagcttcatcatcatcacctttttgtatgtatcagcaccatcattttgtatttgtattgctattattcacataatttcataatcatatttggatcaatttttatttgcttaccaaaaaatctgttttgctttttcaatggttttggatttagttttaccaaaagctgggccgtgtcggcggataccaaaaagttgtgaattgtaaaaataataattcaaatttggattaaaaaatatccacaattttctactttggatatttttcaaaacaaattatttttcgaataaattaaacacccgaaatttttgttttagggtaaggttcaaaaaatttaccaaaatattgaaataccaaaattttatttaaatatttaatcaatggaccaaaatatttttgacatagagtttttcatgcattttccaaaaatataattcaacaatagcgttttaaaattcttaatccaatctttttaaaccccccttaatatgggaagaatcaaaaaacattccaaattacgcttaattgcaataatg

SEQ ID NO: 103597 - DNA, 249 bp, Heterodera glycines
  Promoter: Source sequence=SeqID_2490; Location=4375..4623; Strand=-; Gene=SeqID_80030
attgcgtctcccttaaattgcacaatctttttaattttaattgtttagagcgttattttatgcgcttttatttttcattttaatgattttttttgcttattttataattgtttaagcctgttatttgctgccttttgccttgctttaaagagctaccaaattttattggtaagaattcatttcccaaaaagagtgtgcctatacactttaactttattacagactttgtcctcaaactgttacaaaatg

SEQ ID NO: 103598 - DNA, 91 bp, Heterodera glycines
  Promoter: Source sequence=SeqID_30998; Location=648..738; Strand=-; Gene=SeqID_61352
tgttttcttatatttttctttaggcgaaagtggggtcgggaaatccagcctaatcgcgcgatttgtagatgataaatttgacccggacatg

SEQ ID NO: 103599 - DNA, 56 bp, Heterodera glycines
  Promoter: Source sequence=SeqID_2587; Location=1074..1129; Strand=-; Gene=SeqID_80566
aatggactggcgaaaaagccaatttggggcatttaaaaataattaaagagtaaatg

SEQ ID NO: 103600 - DNA, 265 bp, Heterodera glycines
  misc_feature (27)..(27): n is a, c, g, or t
  misc_feature (32)..(33): n is a, c, g, or t
  misc_feature (42)..(42): n is a, c, g, or t
  misc_feature (57)..(57): n is a, c, g, or t
  misc_feature (127)..(127): n is a, c, g, or t
  Promoter: Source sequence=SeqID_9792; Location=1..265; Strand=+; Gene= SeqID_72697
aaaaacataaaaattttataaaatganttcgnnaattatttntataaaaaatatcgnacactaaattttcaaacggtaccgacaaaaaactggtaatttctgtgttctaatattttttaaagttttntaattaatttacaaacctaaataataatatttattgcgcctctgatatttgcgcctatgcttaaaagcagtctcaaaacttttttttaatagaaaaataaagcaattgttattattaaataaattgtttgaataaatg

SEQ ID NO: 103601 - DNA, 334 bp, Heterodera glycines
  Promoter: Source sequence=SeqID_44918; Location=1..334; Strand=+; Gene=SeqID_72319
tagaaaattttaaagtttaataatttaaattacatataatttcattatcactttcatttacatacactaagaggttaattttcgttaaattttataaattttaatataatatttgaaattttgagagagagaattttaacatttacttagctgtaatccttctgagattttacgaaaattttctgaactttaaaattcgccagctcatcaatattaaatttcgtcaatttttttaatttaaaggtgtacaaacaaatttcattatgcaactaaaagcctttcatttttatataaaattgcttaagctcattaaattaaacaaattttcagaatg

SEQ ID NO: 103602 - DNA, 312 bp, Heterodera glycines
  Promoter: Source sequence=SeqID_4530; Location=880..1191; Strand=+; Gene=SeqID_54790
ggtcataggtttcaaacaattccctatatactgaaagtcaaactggtaaatttttgtaaaaaggggccttggaatggaaaaaatttggttgaaaaatcggttttttttttaattttttcaacttttttttattctttttaaagacattttgccaaataaaaagttttttgattctttccttctgtaaccgtgggacggagcggcgaattacatattttctttcatctttccctaccaccgtcacgtcacgttgtccattgacaatttttcagctttttattgagttttcgttaaattttcatcttcgacatg

SEQ ID NO: 103603 - DNA, 164 bp, Heterodera glycines
  Promoter: Source sequence=SeqID_1617; Location=1074..1237; Strand=+; Gene=SeqID_74862
aatgatgcgttgtttatgacgaaaacgcaggcgcatgcgaccatgccgcggaacaccacgtctcgcataaagtgcagtcgctgatccgcgtcatcaaccctgacgacaggctttgcctggcgcgtgccgtccttctgggtctgagagaccgagagacgagaatg

SEQ ID NO: 103604 - DNA, 268 bp, Heterodera glycines
  Promoter: Source sequence=SeqID_17658; Location=1..268; Strand=+; Gene=SeqID_82186
ggcccggtgaattgctgtggtggaatgcctccaaaaaattgcgaatgctgctgcggttgctgtggttgaacactaccagcaacgggcccagtgaattgctgtggcggaatgcctccaaaaaattgcgaatgctgctgcggttgctgtggttgtacactaccagcaccaccaccagcaatgggcccgggaaattgctgtggcggttgcacgcccccgccagcagcaacatgctgtactgatggtggtggcgcagtgaattgatgtgatg

SEQ ID NO: 103605 - DNA, 152 bp, Heterodera glycines
  Promoter: Source sequence=SeqID_7054; Location=4486..4637; Strand=-; Gene=SeqID_63679
tcctcatattgttttggctgttcatttactcgctcattttcttcctttggttatggcggaataacaataatttgtcatcatccgtcaattgggcacagccgagggcaaagcgtacaatttttgccgattatcaatgcccaaatcagcaaatg

SEQ ID NO: 103606 - DNA, 70 bp, Heterodera glycines
  Promoter: Source sequence=SeqID_7127; Location=2138..2207; Strand=-; Gene=SeqID_63910
ggaaattccccgggtttttggggcctcgttttgcgaaccctctttttttatcatccttatactatacatg

SEQ ID NO: 103607 - DNA, 836 bp, Heterodera glycines
  Promoter: Source sequence=SeqID_11735; Location=1..836; Strand=+; Gene=SeqID_75219
cgttttgccgaagttgagttggaaccgtgctgacaaaaggttggattgttgtttttggaaaacagagaatattcgctccacatccctttgtttaaggttttcgtataatttttgtttcaatcaaaagcttcaactcatagacattttcaacagacaaaacaaagttcgaaaaactcagttttcatacttttacgggttaggaattcaaaattgggcaaaatgggtatggtattcgtgatcagcgacccctaaaacaactgaaaacaaattttcaagttttttggtcaaaaaaattattatttttttttttgcaaaaagagggttcccctttgattttgaaaaaactcaaaaaatgcaactttttcttttctccattggggtattccagggttttttttctacaaattgctgatttcgggctttcccgtgattggctctggaggcgttcatttttaatttacttcttttagcaaagcctccggcggtggctgacattgacgtttgtttgttggttgttttttgccgctcaatgtgatctcctccgacttttggacttcaaaatttttgccccgttttgtgggaaattggattatttacattgttttttctttgttgctttgccagtgactttttttgtttgatgcgcaaacgaccacattattttgcacaattacttcttataaatgtatttcttttactatatgtagaacataaaaatgaaagacatacctatttatgtatttattatactataaataataattataaaatcttaacaaaaatatatatgatgatttccatgcacaatttttgacatttttcagctgtccaaaatg

SEQ ID NO: 103608 - DNA, 441 bp, Heterodera glycines
  Promoter: Source sequence=SeqID_18189; Location=849..1289; Strand=-; Gene=SeqID_82777
ataataagataaaaatagattaaatgatcacggatttttagtgtaaatcttctgcttaataaattgtagaggtgcgggaaatgatcagattagaaaattttggcagaatggcaatagagttaattaaaaatcaccattttggtgaatttttggaaatttttcacatttaaaaaatattagaatataaagatgcaaaagattaaaacgaacaaaaaattttcaaaaatatttaaattgactttttcgaaaaaagtgaaaaattttagccataaaactaactattacaaatagcacataaatactatcgtaaaaacgaaactacctatattcagaatgagaatgaaaatgaagaccggtctcggaatttattagcagaaccatcaaaagcgaaatccaagcaacaaatagtgccaacaaaagagtcattaacagaaaataatg

SEQ ID NO: 103609 - DNA, 246 bp, Heterodera glycines
  Promoter: Source sequence=SeqID_5465; Location=4062..4307; Strand=-; Gene=SeqID_58154
attgcatcatttgtaagccgatttttttgctgctaattcaattctccatcaaattgcatcatctatcccctgctttttatgagaagcttaaatccaaataaaaacgaaattaaaaaatatttaatcacaaattttattgtttggttattcaattttccttaaatttcttcttaattattctttaaaaatataaaataaatttcgatcgaaattcagcaaatttaaattcaaaatatttaaaaaatg

SEQ ID NO: 103610 - DNA, 90 bp, Heterodera glycines
  Promoter: Source sequence=SeqID_43776; Location=1044..1133; Strand=-; Gene=SeqID_71370
cgtcagcaggtgaaccagcagccatttcaaaatgcacagcaacaggcggtcctacaccaggcgggcctgagtggacttgaatatgcgatg

SEQ ID NO: 103611 - DNA, 217 bp, Heterodera glycines
  Promoter: Source sequence=SeqID_1343; Location=5133..5349; Strand=-; Gene=SeqID_72928
tggacgtgtctcgtgcgtccaatcccagtcttcctcctcaaattcgtctgccatcgtccctaacttttccggcaaccaattgcagtcgaatgcgaatcatttgctcggcctgaatgactcgtggctaaccgtcggcggagggaaaagtatcgccgcgggtggcggcgaatcggcaaacagtggcggaagcattgacggaggattcggggaaagtatg

SEQ ID NO: 103612 - DNA, 362 bp, Heterodera glycines
  Promoter: Source sequence=SeqID_37763; Location=971..1332; Strand=-; Gene=SeqID_66758
tgaggcgggccacgccaaaataacgtggcgcaacagcccaaggaaatttttaaaggtttgttcaagcatggatgtccgggtgcacttcatcaccccccccccccccgtttcgttttcattccccaaaaatttaaaaaaatgttggttgaacaattttttagaaaatttttgaaaaactaagcaattcatctaaattttgaacaaatggaaaatttaaatgcattttccgttattttctcatataaaatatttggggttcttgaaaaaatccctttttgattaagatgaaaattttgagctcgagagaaggctggacgatgcatagcgggccagaccccgagacttacacgcggagggaaatg

SEQ ID NO: 103613 - DNA, 87 bp, Heterodera glycines
  Promoter: Source sequence=SeqID_13861; Location=2073..2159; Strand=-; Gene=SeqID_77807
attttgccaaatgtcctccaccatcaggtcagacatgacaaaaaacgaggtcagctgaattacgcaagagtttacagaggcaaaatg

SEQ ID NO: 103614 - DNA, 114 bp, Heterodera glycines
  Promoter: Source sequence=SeqID_39048; Location=595..708; Strand=-; Gene=SeqID_67710
ttttggaagtggaggtcagcgggggggggggggggagaataattcaaaaattaattggaaattcaaaaatgattcatcactttttcaaaggaattgcgcagtaacaaatggatg

SEQ ID NO: 103615 - DNA, 354 bp, Heterodera glycines
  Promoter: Source sequence=SeqID_12055; Location=1399..1752; Strand=-; Gene=SeqID_75583
aattttatttttgggacaaaaaaatgaaaatttccaaagttgtacaaatgtaaaataaaaaaaatgagcaaaaaacagaaaaaaattgcaaaaaaaaatacaaaaatcgaaggtcaattgaattaactctaaataaatgtgcaaagctttgatgttatgatgttcagaatattattatgaatttcaaagaagaaaataattaatgtattagttttgaattctaccaccaatttaaaaaaatcgctgaaaaattttggctaatttcaaacgaacagattttgtaagaatttggcttaacattaaacagaatttcgaaaatccgacaatttccctatagtaagaagctaaactatg

SEQ ID NO: 103616 - DNA, 89 bp, Heterodera glycines
  Promoter: Source sequence=SeqID_21282; Location=321..409; Strand=+; Gene=SeqID_51878
ggtatgtagtaagcgtggcgtacagaagccccgaaatgaaggcatccctcggcactttgtaggggcggtacgatgtgcatctgctgatg

SEQ ID NO: 103617 - DNA, 64 bp, Heterodera glycines
  Promoter: Source sequence=SeqID_24204; Location=1..64; Strand=+; Gene= SeqID_54921
tcggcaagacgacggccaagtcttgggactcgaatggaatgcggagacagacgacctacgaatg

SEQ ID NO: 103618 - DNA, 897 bp, Heterodera glycines
  Promoter: Source sequence=SeqID_7515; Location=474..1370; Strand=+; Gene=SeqID_65087
agttttgtacaaaataatccaaatcctagaagattttgatttaataacccgaaataaagaacgcatacgtaaatatgcattctttattatttgtgcgacatgattggaaaattgcaatttattatcaatatttatgcctaaatccctaattgtatccacaacatttattatatttccatcaattttatatatttctttggggtttttgttccctaaatgaagtacaaaagtttttttaattgagattctgatttgccatttatttgcccattcggataaattatgcaatgctttatgcataatttctgtgtcagctctcgctttataacaaatatacaatttaacatcatcagcatataatttaattctcactcctgatggcaaagcatcaggaagatcgttaatatagatcaaaaataataaagggcccaggacagagccctgggggacgccagagcaaacttttttattcgaggataaagcctcctcaattttaacacgaaaagtcctattactcaaaaaatcctttatccaaattaaaagtttgccccttataccaattttttccaatttgtataaaagtaattcatggggcactgagtcaaatgctttttgaaagtcaatataaatacagtcaacattttttccatttataattgcctcataccaatcttccacaactgttattaattgactcgttgtagacctatttctaacaaaaccaaattggtattccgaaatttttttgttttttagtagaaaattgtaaaatgtctgcttaaaattctttccattaccctgcaaagtgagcaggttaatgaaattggcctatagttttcgggattatttttgtcaccctttttaaaaagcggaaaaacaattgattccttccagatg

SEQ ID NO: 103619 - DNA, 181 bp, Heterodera glycines
  Promoter: Source sequence=SeqID_14791; Location=336..516; Strand=+; Gene=SeqID_78940
ttcacggtcaaatgggaatcgttccgcttcctcccccaagtcgggaagagagccaggagggcgaaagttccatcagcggcaggtggaaagccaaacccacctgatcacggctgggtttcaacagaacgatcagtcaaaccctccgccaagagagggggagattgttcaatccatggggatg

SEQ ID NO: 103620 - DNA, 405 bp, Heterodera glycines
  Promoter: Source sequence=SeqID_33419; Location=1..405; Strand=+; Gene=SeqID_63482
ttcaattatttaaaaaattaattccctcccaaatttctcttcgtcagcaatttgtaccgctccaattcgttgctgttgcggcgcaatgcgttgatgcattatttgaacgaaatttcggcaagtgtggccacagtggaagtgttcagcctgtccctgttctccattatcaccatccgatttgattatgcgcgtcagtaattaaattatgcatttattattattatttttatacggattaaagtgtcagtaagtcacagctttaaatcccggcttttccggtcctagtgaatttcggtcttcccaattcatacgacattttaccaaaacttttcctgcttcaactaactaaagggctttttcaatttaataaattatattttattttcagatttttacaatgcaatg

SEQ ID NO: 103621 - DNA, 781 bp, Heterodera glycines
  Promoter: Source sequence=SeqID_38182; Location=336..1116; Strand=-; Gene=SeqID_67077
aaaaattaaaaaaaaaattttgaaaatgtatccctaaaaaatggaatttttttcaaaaaatgatatatcaaaaattaatttttgaaatactacaatgtgattctaagcctattttggtcatttttatggcattttatgcctctgtttcactttttatgaaaaattttcatccaaaaaataaccgtttaaaaaattttatttacatattttagtacatacttgggggtttttgtacatatttcatacatattttagcattttttatacatattttatttacatagaatgatatgtttcgaaacaaaaaaaatttttttttttttgtaaaggaattggaatgctaggttttaatgaatcatacatttatgattaaataaaaagtttttcaattatatgaaagcatttcttataccgcttattcattcttttgaagaaaacaaaacaatttgtgcatggtattaaaagcataaaaaatgacgttagttttacatttgttgatttaaaatattaaatttatttataaaatatttttataaaaaggtttcaagtaaccatttttaaattttaataaaatttatatttttatggcaatttaatgagaaataaaattagatattttcaaagattgaaataaaattttcaaaagataaagaaattttacaaaaaagaacgcatttaatcttggaaatattaattattttatttctatttatttattttattttaaatataaagaaataattataactttttttaatgtaattaaatttcagtgaaaatg

SEQ ID NO: 103622 - DNA, 159 bp, Heterodera glycines
  Promoter: Source sequence=SeqID_40330; Location=1..159; Strand=+; Gene=SeqID_68697
gagcaggaagagacgcagttggacccgaaagcgttggaggatgaacagaacgaacagcagcagcaaacagaggagcgggacacccagcaacaggacagcaatgagaccggggaccatgaaaaaggttggggagtacagcagcagcaacaacagagcatg

SEQ ID NO: 103623 - DNA, 171 bp, Heterodera glycines
  Promoter: Source sequence=SeqID_598; Location=1..171; Strand=+; Gene =SeqID_57252
catggaagttgacccgacaccttcaacatcagccgcaagcagcagtggacttataaacacgctgatggtcatcagcatgttcgcgctgatatccttcagccaacagcagcggcaccgttacgcattcatcgagcctcattgagccaaaatgcacaaagattccttcaaatg

SEQ ID NO: 103624 - DNA, 826 bp, Heterodera glycines
  Promoter: Source sequence=SeqID_7388; Location=1..826; Strand=+; Gene= SeqID_64682
attttgggtttactttactatgctggcccatgaaaacatgcagtttttccggtgccaaatttttgtgaattttcattcggcgcgtcataagcggattgtttggtggcaaatgcaaacaaattttgtgttattcgaatgcgctcggcgggttcgacatttccaaatgtatcaacaaagggtctatctccactctctggcgaggtatggccagccaaagcagagtggggcataaacaagaattttttaatctttggtatttcctctattttgtgcctgctctacatttatgtcttgtgccaatatgcctattgcaacagaaatttattcagctttcccgacaaattgttgagataattattctagacgatttttttatatctcaatgcttaactatcgcatttttgtttggcaactggtagaaattggcagtgaaaaaaagtttgtttgtaactatttacaataaaaatttatgtagcatttctaaaaaggatgtaaaaataagttcttgcgtaatatttttatattgtgtgttgaagaatttgagtctgcttctgatgcaagtggaaaatttttcagcttttctcgaaaagttttttcccagaaaaaggatgggacaaataaaaaactaaacatctctcatgacaatttaaattcccttacattttgggtttactttactatgctggcccatgaaaaaatgcagtttttccggtgccaaatttttgtgaattttcattcggcgcgtcataagcggattgtttggtggcaaatgcaaacaaattttgtgttattcgaatgcactaggcgggctcgacatttccaaatg

SEQ ID NO: 103625 - DNA, 904 bp, Heterodera glycines
  Promoter: Source sequence=SeqID_25515; Location=986..1889; Strand=-; Gene=SeqID_56260
aagcccaaagcccgttctgaaaagcaccgacctcaccaaagtgggtgaacagagagataatgagagagagaagcccaaagccagcgctgaaaagcaccggcctcacaaaagtgggtgggcagagaaagagagagagaaagccaaaagccagcgctaaaaagcaccggcctcacaagtggatgggcagagaaagagagagagagagaagcccaaagccagcgctgaaaagcaccggcctcacaagtggatgggcagagaaagagagagaatgagagagagaagcccaaagccagcgctgaaaagcaccggcctcatcaaagtgggtgggcagagagagaatgagagagagaagcccaaagccagcgctgaaaagcaccggcctcatcaaagtgggtgggcagagagagaatgagagagagaagcccaaagccagcgctgaaaagcaccggcctcaccaaagtggatgggcaataaattttaaaatttgtcgagaaaattcgtatgaaaggaaattatgaaagggagaaaaaagcggaaaatttaaaaccatacaaattgaaaatgaattaataaaaagaaaattttaaaaaaaacaaagaataaaagttgtaaaataggacaggaggaaatttttcaacaaataaatttaaatgaataagtacattgggaattggaggcgtaatatgcccctagtaaaagattaataaaatatgtgtgtgtgtgggagaaattgtgacagaatttgcttgaggtcaaactaagtcaaatcaaacagaaatatggggtgggacgaattggatagaaattaagtagaatattttaaaaatgtatagctcattttatgtctttatttaattaagttggattaatttaaatataaaaaaattttttgatttaaaaaatg

SEQ ID NO: 103626 - DNA, 144 bp, Heterodera glycines
  Promoter: Source sequence=SeqID_18388; Location=1..144; Strand=+; Gene=SeqID_82989
gagattcaaaaagtggtgttaaacatatgcaccactgaaaatggggtatggtacataaaagtcaactgtaactcgggtttgaaccgatattttgcttaatgattgatatcattcgaaagccctttaaaaatgctacaaaaaatg

SEQ ID NO: 103627 - DNA, 776 bp, Heterodera glycines
  Promoter: Source sequence=SeqID_2336; Location=1..776; Strand=+; Gene= SeqID_47258
tgagttgggttaccccaaattttctcttacttttcttgtatttataattctagaaacaataaactgtagtagagccgaaaaaacacaatacatataagtcaaaatacacaatcaattaaaaaacagttaggctatttttgcgaaaattattttaaaaaatcaggactctattttaggaaaaacggtataaaacaaaaaatgtttttcttttaaaaaatgtgtaggtagtatgtattccaaagcgaaattaatgaaaaagaagagagaaacgacgccagagtgtaggcttttctctgcacctatatctctctgcccgtgatgcattcgaccttgcaaaattacattcctaacttgcctatttaatcaattgattgtgagactaatcttccttcagcttattcaggtcttcaaaaccggcataagctgcaagggagcgagaatgtacaggaggagcggagccagacaaagggtctgcggcccgtggttaatattttgcctattcgttagcacgcgttcccatccctttctgattaatgctaaaatacccaacattaatacatattttggtccttcttttaagattgagtacaatcattcaacagatttcattcttatcgtgtgtgattttagattttaacgttctattttcatctttggatttaccgctgatcgaatcgcaaaagggaattgtttggtgcttcgttttgtttcggttcgatcggcactgggtttataaataaaagttctttttcagttgtcttcagtttattgagatg

SEQ ID NO: 103628 - DNA, 791 bp, Heterodera glycines
  misc_feature (13)..(13): n is a, c, g, or t
  misc_feature (31)..(31): n is a, c, g, or t
  Promoter: Source sequence=SeqID_29512; Location=1..791; Strand=+; Gene=SeqID_46168
agaaggagtcaangcagcggaacaacaagcnggacagtgaaataggagggcagtgagttttgtcccggccaaaaattcgttggacaggacacatatattttctttggcgttttgtttgttgtttgttcaaaaaagacatggcaattaattgtatttcgggcattgaattgaatattattaaaaccaaccaaatcatatattattgtgtattacctattcccattcgttttgttcgccgcgtcctttcacaattcattcattcatcgtttttttttgttgccatttctcgccgttttttgttatttatttctcttttggtctttcgttcgtttgctcttttgtcgtctgtctgtctgtctgtcattcattcaattcatttattgattcaaccattgcatctcagttttgtttgtttgtgtgttcagttctgtttcacactgcgcctctccttgcaataaaaagtgcacttttatgaaaccaaacttaatcaaatttgtccaaaagtctcccattattttctgtatggtccattttctcctcaatgtatgtaccaaatcaacaaatccaatgcgcttttcatacccattttttgccattttgcattcgtttttttccaccgggggcatttccaatcggatttaaatttgcatttgtttttcattcatttttgatcaggtcagtgcgtgtcttacacttacttttttaagaagaaagttattgctaaaattttgcacatgaattttgagaatttccaaaagtactaagaaatttaaaattaaaaaagtaatatg

SEQ ID NO: 103629 - DNA, 199 bp, Heterodera glycines
  Promoter: Source sequence=SeqID_7978; Location=4851..5049; Strand=-; Gene=SeqID_66565
actcgccgacgccgactcgccgatggtcgactcgccgacgccaactcgccgatggttgactcgccgacgccgactcgccgatggtcgactcgccgacgccaactcgccgatggttgactcgccgacgccgactcgccgatggtcgactcgccgacgccaactcgccgatggttgactcgccgacgccgactcgccgatg

SEQ ID NO: 103630 - DNA, 77 bp, Heterodera glycines
  Promoter: Source sequence=SeqID_8872; Location=2486..2562; Strand=-; Gene=SeqID_69482
ttttgaccaattgcattcttctcaaaggtttctttccccctttacttttctattttttcattttcaggtccacaatg

SEQ ID NO: 103631 - DNA, 220 bp, Heterodera glycines
  Promoter: Source sequence=SeqID_43056; Location=74..293; Strand=-; Gene=SeqID_70823
ttttttctaaaattgattttgattattttattttatgaaaactgaaaacaataagatttgatcgaaaatgaaagaaaatggccacccaaaaaaaaatcgggcatgacccctctcctgagcgatgatttgggccatttttggagagccaaaaacgcgcataggtcaccccctacacgtgtttttaaccttccggcccaaagccatcacattggagggcatg

SEQ ID NO: 103632 - DNA, 198 bp, Heterodera glycines
  Promoter: Source sequence=SeqID_22374; Location=2490..2687; Strand=-; Gene=SeqID_53044
aaaggctcgctaagagcattattaataaatgaagaataattagagtgtattttttattatttgccgggaaggacttatttgtggtggactccaagaggcatcggataatctgttatcacgttctcaatttaatttgacatttaatttatttatcacgaaaattaaatcccccctttccccgcattttcagctgtgatg

SEQ ID NO: 103633 - DNA, 249 bp, Heterodera glycines
  Promoter: Source sequence=SeqID_1225; Location=850..1098; Strand=-; Gene=SeqID_70167
tgttcagccggtttggagcagataatggactcggaaattcggttccattttttgattgatttgtattccttttattttcctgcaaacgacatgcgtaaaactgggatttttttttcaaatttttttgtaacactaaccaagtggttcctaatagtattattattttttctccaatagattggactggattttgctgttgagtcgggtggccgcaatttgtcggccggccagcgccagttggtgtgcatg

SEQ ID NO: 103634 - DNA, 416 bp, Heterodera glycines
  Promoter: Source sequence=SeqID_6830; Location=3175..3590; Strand=-; Gene=SeqID_63019
tttttctggttgagggaacaaattttcgaaaatttttcaatttgcagaacccttgtgcacctcgggaaaatccaaaaattttcaaaagtcccttttttcttctttctcaaactaaatatgaaatttaggcagagccattgtcaccgaatgacctggatgagctagaggagcgtgtcaacgattttaaatcttttttgtctgcccaggagcgaatgcgcgtgtttctctcaaagaagcccaaggcacatcttttgttgagccattttgttcccttcgctcgcgagcacaaatttcttggccttttagatgaacagggttgtggtgaaaaatgttttctatcccattaatctgaatttaaacgtgacgaggcgctccattcagtttggcgccgacttgagcaactgtggaagtgtatg

SEQ ID NO: 103635 - DNA, 285 bp, Heterodera glycines
  Promoter: Source sequence=SeqID_14867; Location=1..285; Strand=+; Gene=SeqID_79017
gttcagaacaaattggtctcggcagagtcaagtgtctcctcctatccgttgaatttttcaaatgaaatgaatgctcggcgctccaattctccccccgtgccgccccttcctttagcccctcctccgcgtcgtgccaacaaccaacatggcaatttatgttgcaacaatcacaacgatatcctcgtcgacattttcggacaaaacaacgcacacgttcttcctgcagtgaatgccaatgaaatattcgacgacgaattcgacccgcgagcggacgagaaaaaaatg

SEQ ID NO: 103636 - DNA, 334 bp, Heterodera glycines
  Promoter: Source sequence=SeqID_393; Location=1217..1550; Strand=-; Gene=SeqID_51215
ccagaaaatgcgacaccaagaaaatccgacaccagaaaatccgacaccggcggaaaatgcgacaccgtagaatttttttaaaaaacggaaaatccgacaccgggaaaatacgacacctaaattaaatttttaaaattatttttaatttaaaaaatgaaaatgaactacttattttccttaaaatcgaacattgagctataaaaataatttaaaatgatttaagtaatataatataaaatgaactatgattagttcaagacaattctcatgaccctttagtaaagtggacagcagataatacaaaaaattcttatcagtttccgatttgcatatg

SEQ ID NO: 103637 - DNA, 274 bp, Heterodera glycines
  Promoter: Source sequence=SeqID_3911; Location=508..781; Strand=+; Gene=SeqID_52396
aaaatcaaaaaagtgtttgaaaaattcaattaattgcttgggaacatctaaaaatatctaatttacaataataatttgtttttaaatatatttaatcattttttgaaaacttgaaaaaatatcggtcacttgaaataataaattctaaaattttgtccaggaaaatccaggttttttcctgttttgcctggacctggacctggattttttttcacatttgacctggacctggatttcctggacaaaaatccaaaatccaggttgtcaaaaaatg

SEQ ID NO: 103638 - DNA, 1003 bp, Heterodera glycines
  Promoter: Source sequence=SeqID_5206; Location=1601..2603; Strand=-; Gene=SeqID_57268
attctccgaaaaatttttcaaatttcttcctaaatttggattggcgtactatgtttaagcaaaattttttcaattttggcattataatttctttcttgctgttaattttggttaattattgcttgagatgaattttaaaaaatgtctaattttgaaattttatggcataatgtcaatatttatctgattttattcgcaacccaaaatctgattttttgagcccgattttctgattttgaaaaattttcgatcgaagccctgattgtaggcccacttttcaaaggctattcggtaggttttcccgcccctaccacctatgaatttttcaaacattttccccattctcagaattgtaagtgcaaaggaattaaaatcacaaattatcaaaattcaattggtgttaacatttgtggtatcactcgatagacaattaattatagttcttaattacatctcacagttatgagtttttcccatttgtttttcgatttgtaaaatattttttttaatttgatacttaaataaatttatcaaacgaaaaatgttgcaaaataactaatgaaatttatacatttgcacagaaaacaggaaattatactgcacacacattaatattcttttttaaaaatattttttgcaaaacataaaacaatattaattattggcaacgtgtaattattgttttgccagcaaaataattgtgcaaacgatacatttattttacatctttattattattatttttattatcattttctgacaaatgacaatgaaagaagcaaaacgaaaaagcctctctctattttttcttttatttttaattgttttaatttcttcaaatttcgttttttgtgggaaaaacaaaagggtaaataaagtgagcaacgataaggtgaagcaacctgaaaaaataacaaaacaaaaaatagtggcaaaagagcgaagccaaagcattgaaaatgcggcaaaattaacgcatcaatgcccaaaaaaggaaaaaatg

SEQ ID NO: 103639 - DNA, 461 bp, Heterodera glycines
  Promoter: Source sequence=SeqID_5748; Location=1..461; Strand=+; Gene= SeqID_59112
tataatattttcttatctctttttctttcttttatttctatcacagagaataaaatgatgggaaattctttgtggtaaaataaatttttttagtttaatgcaactgaaaataaaaggtttcaagccacaaaatcatctttatttgatcatttgacaaattacccaataaaatatgtacatagtttgtttgttttctgtccttgttttgtattttatatttttctgcctttttaaggcgaattaacggagaatgattttgccattaattttattcattcaccattttcgtaaaatgaatttcaataaaaataaattttatttaaaaaaaaataattattttattctttttcataaaaatggttttaataaaatttattattttattttcaattaactaattatttttttttatttaggaaattgctttattttaccacagaaaaaaagcaaacaaagaaatg

SEQ ID NO: 103640 - DNA, 227 bp, Heterodera glycines
  Promoter: Source sequence=SeqID_44023; Location=964..1190; Strand=-; Gene=SeqID_46764
ttttgtatatgccgtctctaatatcaatttgagttgggctggcaaaagtctacacaaattatatttggtgccatattaaattatatagcaagcgtgttggttccaaaatagttgtctgagctcgggttttgcagaatcattggttttatctatggtattcttcaagtacatctttaaaatgttttaaagcagattaaacttcatttctatccattcttttcaaaatg

SEQ ID NO: 103641 - DNA, 728 bp, Heterodera glycines
  Promoter: Source sequence=SeqID_220; Location=2724..3451; Strand=-; Gene=SeqID_47185
tttctgtaaaatattccggctttatttcctctatccgtattttgagagatttgacacttctaacttttttaaaacgatcgaatcttgataaatttggtatcatccgaaagctcttgacgagctgtctaaaaggcagtgaataaattttcttgtgtgttttaatctcaatgtttatcaatattcaacacttttggtatggaaatcaaatgccttagtagggaattggcggtagggaattggctggtagggaattggctggtagggaattggctggtagggaattggctggtagggaattgacggtagggaattggctggtagggaattgacggtagggaattggctcgatcccacagatacaaacccttttttaaataatgaacatcacgccaaaattttcataaaaataaaaatgtaaaactgaaattctgctaaattactttctgcatttgtagattcctctttttgtctgtacaactgcgccactaactttgattttttttagttcgaaataccaacttatctcacaaatggctaaacaaaagggtgaaaagaaaggaaaaagtgcgctcaacaaagtggtcactcgggaatataccatccatttgcacaaacgcatccacggaatgtgaggctgagattatttaagcaattatcccttagatgattagaaagggagtggagaaataggagaaagcatctcatattccgtcttcctaatgaaaatg

SEQ ID NO: 103642 - DNA, 1003 bp, Heterodera glycines
  Promoter: Source sequence=SeqID_2470; Location=265..1267; Strand=+; Gene=SeqID_79880
gctacttttagtgacgaaaaatatcgaaatagttaactaaaatagtgagtaaaaatgccaaaatagtggcaaaaaatccgaaatagtgacatattttcagccaaaattttgtcaagagaaaaaaatttgggggaagattttttaagaaaattttccaattctcagtggtattttttgaaaaatttttaagtcgattcttaggagtgtattttttgggtttattgcatttttgttaaggaattttccaaaaatttcgaaatagtgaaaaaaagaaatgcgtttttgagctcttttcttcaaaacaatcgagcaagaaaaaagaagttaaataactaaaagtagcgaccctagtgataaagcagcacacaaaaaaagttatctcttaaaaccgcaaaaaatgtagaattttcgaagttttttgttcactatctttcgttacagttcgacaatttagttcgttagcttagcccttaagtttctctctattttaatgaaaattttcaaaaaatgagaccaattaaaaaaaattatggacgagaatcgtaaaaaaattttcatccatattattcaaaacataatcaaattttatgggctattaaatgacaccaaaaaattataattttgtcaactttttcaaaagttatgacgattttttgtcgaaaataacgtacgcagtgtatgtttttatgtgcattttacaatacatatttattttaacatttttttctcatctttttcgggtgtctcttcttcttctgacttctctgctgaccagagctggccgtgatcacgggaatcacggggtttttggtgtgccgtgatctcggatcacggattttttctatttttccgtgattttcatccgtaattggcattttatataggggaatttttattgagacgaaaatatgaaattgatgggaaaagagaaaatttttgagaaaaaaattaaataaataaatcatttctgttaaaaattaagacatgtatatgtagcttaatg

SEQ ID NO: 103643 - DNA, 193 bp, Heterodera glycines
  Promoter: Source sequence=SeqID_11434; Location=1427..1619; Strand=+; Gene=SeqID_74830
agtcgaatcaatcggcttcgtctctacggccaattctttgtagtagtctttggcctagtcgatgttaacccggataaatatttagaaagggaaagagagagagaccattttgttattatcagtgattatatgttttcttcgtacaattcacccaaaatagtttttccaagcgttcacagttgaaacgacaatg

SEQ ID NO: 103644 - DNA, 1003 bp, Heterodera glycines
  Promoter: Source sequence=SeqID_123; Location=2134..3136; Strand=-; Gene=SeqID_73167
tcaagacttaaaattttatgagtttaaacaaaattagacgggttctaaaattttatgagtttaaacaaaattagacgggttctaaaattttatgagtttaaacaaaattagacgggttcttgttatttcggggccaactaatctgggtattcagatctaagtccaaacagaaactaaatacatgtttaactatgcgtttaaacaaccgtaagaattgactaaataataagattgaacaggtttccatagataaattttttaattttcaataacatagaaatttttgagcacaagggttgttaaaatttactaaattttaatgatttatataacattttatatatttattttgttttatttttttaaatccctccctctggtgcccaaacttcatgttgccaccctgactccccaagcctaaaaaaagttttttgaaaaatgccgcaaaaaaagccgtttgaatcacgaatgcactgaaaattacgatttgcttattcatttgttccccaaatttcgatcagaatcctcgcctaccggcaccgtcggaccctcatgtttcccaagttttttttttgtaaaaagtgtgcaaaaagcgtttttaacagcaaaaaacgctgtcactttaatgttgagacttctgagacttctacgcaaaaattccctttgatctacctcatttttaatgtgtttttgatttatttggattcttttcatttaaatttctcgatttccgagtcgagaaatttctcggtttttggatctcttatcgtttccggggttatttctcggttcccagtaaaaatcacttctcgcacatccctactttttgtccttttcatgcattttagatgcctttttttcgtgtctcttttaggtggctatttaaaaaaggtcgttttaaatccaaaattacttgagaattgggttttcttttgctcattgcttttgtaaaaatttcgtaaaaccattactctttttaagccaattattctgttcaaaaatg

SEQ ID NO: 103645 - DNA, 563 bp, Heterodera glycines
  Promoter: Source sequence=SeqID_29655; Location=329..891; Strand=+; Gene=SeqID_60131
tttttctgcaattatctgtaaaaatttgtgtgtgctttaaatgtgaaaagtgtgtcaaagaaaataaaaatatataggtaataattcattttgaaatgggaactttatacgttttttgtggcatattttaataatatttattgaaaataattaagcgaaaagtttaaattgttagtaagcagcaattaggaggacaaaaaattacaacacaaaaattaaattatggcgaaagaaaaattgcgtaaaaatataataaaatgaaagtaaagcttcgtggaatggaaaataaaatcaaaaagtcacagaataacaaggaaaaaatatattatacaacatttcggaaaaagcctgacattagcctggggaaaaatttcgattattgcagccataatttttggaaaattaccaaggaaaacccaaaaattcggggaacaaaaaagttttcgggttgacccatcaaaattttttttccttggttaacgacatgttcagagcaatgccaataaaaaaagttttttgtctccgatcagccgtcagtatgcaactcggccaacggcataatg

SEQ ID NO: 103646 - DNA, 209 bp, Heterodera glycines
  misc_feature (152)..(152): n is a, c, g, or t
  Promoter: Source sequence=SeqID_26441; Location=860..1068; Strand=+; Gene=SeqID_57175
aggaaaagaattccgaaaaggtgccaatttacccattgaaaaaggtgctattggcatggatgcccaagctgctttcccgatgatgcggcaattgtgggcggaggagaaacagccggggccctcagggcccgggacgccaaaacgaacccggntacattgcgcgggagtttgaggtcgaagtcgtttgggagtgccacttgaacgcaatg

SEQ ID NO: 103647 - DNA, 66 bp, Heterodera glycines
  Promoter: Source sequence=SeqID_45061; Location=935..1000; Strand=-; Gene=SeqID_72449
aaaaaatattatgaaacaaaaaaatcgatttttcaagtgtcgttttggggtactcaaacatttatg

SEQ ID NO: 103648 - DNA, 1003 bp, Heterodera glycines
  Promoter: Source sequence=SeqID_16009; Location=1639..2641; Strand=-; Gene=SeqID_80363
tttgctaaaatttctctttgttgtacagtacgagttgagaaaaacagtacgagttgggtgatcgcaattattattgaaaatgaaggattaaaaaaactctaatttaatttttattttaaaacttatgaatcattttctaattttgacttggtcaatgcccttgttggaattgaaagccatttattttttctgtaaaatattcttaaacaaatttctacgttacatttttaaattagaattttttaaaagcattaacgaaaataccgtttttaccataccatttatagagagtttcacgtttggctcttatttatcaaaacacattcacgtttgtttatccgtcaattatcaaaaaaacttaaccaaaaggtccgacttttaccgtaaccgttccctaaaaagttatattcatttctttttataaaatcaattcgtatagtaaactaaaattctttttgtaaaatcattttataatttattccacttttttgccacttccgttcatctctgggaaagcgatttctttttttgatcactgctttagtggacaaattactcacaaaatgggcaaaacagaggtgaatcaccgtcactcgttgggaaaagcagaaaattccgatgttaacaaatgaacaaaattatggggctaccagctaccagcagcagttggggatgggcaaaatggtgactcaccacttttggcattggaattcaaaaagccaatttctgtgtaaaaaaccagtggacaatttgctgggaaattggggcggagccgccgcaagcggacggacggatggacggacggccatcgacggatcggtcggctttaagcccaaactccgcccaaaatgagctgcataaatagccgctgataggcccagcaaaatcataccgcttcagctcacttcagaaaaatcactaaacgatttcaaatccctttaggaaaattattcaattcttcaactcccttttatccccaaatccgaaccataaaactccaatg

SEQ ID NO: 103649 - DNA, 891 bp, Heterodera glycines
  Promoter: Source sequence=SeqID_15088; Location=133..1023; Strand=+; Gene=SeqID_79263
tagccaaataattaatgtagaacaattttcttttagtacattctgttgttttcgattatagggaaaccaaaggcattaaaaacgggtcaaacgattacttcaaagaaaaattaattcagtggttttccagtgctgccagaggggaaattcttgttttttaaaaattggttagaaaattttatacctaaattatcggactattttaatttcggttatacttttctcattcgaagttttgttcatttttcccttgcaattattttaggttctcttccgtttggtgtacaatttgaatttgccctgtgcgtttgagcgtcaactgagtgcactgctcgacgttcttcccccgccgctgttcaccgattatggcgcacaacggctgggcgccgcaattccgatgatcgacaaaaagtacataattaatcaaacagacaaaaacgaatttttatcttctaaatccttcgaggattaaaaaaaaactgaaaaaatcggaatttcaaaaaaaaaaaacttaaagaatattaggaaaatccattttgtatgaacttttcttatatctattcctggctaattaaaataaacccagtgaactgctccaactccttctctccgtccccaccggcagtcaggggccaaagggtggcaaccgctctgtcggtttcatcacctttctgcgctatgcgtttggtcaaacgcaacacgaacgcggcaccaacgcggaaaacattgaaattttgaaggaccgacggcgaacggtaatttggcaatggtaaggcacggaattgccacggcattttggacaaaaataaatatgtagccacaaaatgggaacggagggcctgcaatttggtccattaacaaatgccaaatgttctcttcaggcttccaatg

SEQ ID NO: 103650 - DNA, 323 bp, Heterodera glycines
  misc_feature (32)..(32): n is a, c, g, or t
  misc_feature (58)..(58): n is a, c, g, or t
  Promoter: Source sequence=SeqID_8129; Location=1..323; Strand=+; Gene= SeqID_67069
tttaaatagtaaaaaataataattaaaaaaanaattttttctaatgcaaaatttattntaacattgcatttttcgctgattaatctctcccacaaaatcagtgtgcgtcgccacattgaatcaatcaatgattagaacgagcatttctgtgaagcttacctttccaataagccctttaattctacaaaatatattcatttttaaaaattaaatttttatatttatgctaatttttaatttaatgccaaattttgaattaaatttttatattttatactaatacagtaaacttccaatcgtttctacaacaaattgcccaaatg

SEQ ID NO: 103651 - DNA, 240 bp, Heterodera glycines
  Promoter: Source sequence=SeqID_5948; Location=504..743; Strand=+; Gene=SeqID_46150
ttttcaaaataatacattgaatacaattgttttcattttactttgaaccaactttaattgaacttcacgtccaattaattgaccaactctcggtttttagaccttttttttcttgattgaaaaatttatttggacccgtaaagcgctggaaacatccaacaatgcaccgcttttttgcttgaagcgctcaaaagtgacgacgagtcccaagggcatttgcagactcgtctgctggaaatg

SEQ ID NO: 103652 - DNA, 348 bp, Heterodera glycines
  Promoter: Source sequence=SeqID_39541; Location=765..1112; Strand=-; Gene=SeqID_68092
aaaaaaaaataaaaacgaaaaggactcagatttcggaaagattttttaggagcaagttagctcggcgctcatatcagcgtaagttagtcctttgccggggagtatcccggtaaagttgggtatgcttgtgctcaattagcaaaaaatatgagtgatcaagctctcactaaaaggttatgcttaaacttgttcccaaagttaaaaagcaatgaaaacatgtttgaaattttatccgcctcccttagcgatagaaaagcatcagagaatgttcttattttgtaaataaaatttggtgggtttcagagccctttctgaaaaaatatttatgaattaattttgcaaaaaatg

SEQ ID NO: 103653 - DNA, 184 bp, Heterodera glycines
  Promoter: Source sequence=SeqID_19502; Location=704..887; Strand=-; Gene=SeqID_84226
ttttcataaaatcgcatcacatcatctctatcccctttttacataacaaatgatgactaattagtcatatttcgaaatttaaaagaattatgttaaaaaataatttagcttagacagacaaatatttcaattctcccaattttataaagcaagtaaaatgtttcttcttttcttattatcaatg

SEQ ID NO: 103654 - DNA, 331 bp, Heterodera glycines
  Promoter: Source sequence=SeqID_20545; Location=460..790; Strand=-; Gene=SeqID_51082
tctcgtcgcttcttgcgacaacaacacttaattgtcttggccaattggatgtcgttttttgaaagcaaatagcgggaaaaaagtgaatggggaggaggaggagggaatgggtaacacttggttaaattttacataggtatacacaccatccgaaaaaacgagatgtgtaccaataaatagagagtgccagagaaaaacaatatctgtttttctctaattttttgtctccttttggtgtactttgggattaaatttggaaggtgctaatttttcaagagatgaagcgttgcatgccgtgtggcggcgacttgagcagctttggaagacgatg

SEQ ID NO: 103655 - DNA, 277 bp, Heterodera glycines
  misc_feature (80)..(80): n is a, c, g, or t
  misc_feature (85)..(85): n is a, c, g, or t
  misc_feature (113)..(113): n is a, c, g, or t
  Promoter: Source sequence=SeqID_30622; Location=1345..1621; Strand=-; Gene=SeqID_61031
tttttgagcaatgataaaaatcttgtgaaaactatgtttaatttaagaaataaaactaattagtaattaccttaataatntaatntaattgatcatctatagaaataatcatntaattcttttaaaaattattttctttcataattttttaaataaattaacacaaaacatttaattcacttttttagcgatttaaattaattttcatatgattttgataaaatctgatgtttaaaaataaattttgctgacggattgtccgggagtcggcaaaatg

SEQ ID NO: 103656 - DNA, 110 bp, Heterodera glycines
  Promoter: Source sequence=SeqID_3688; Location=740..849; Strand=-; Gene=SeqID_51465
aaaattccattgcttttcgctgtcatctgtttattcgaaattcaggttgttaataatcccaaaataatttttttctgaattttttaaattttaacaggtctttgcacatg

SEQ ID NO: 103657 - DNA, 562 bp, Heterodera glycines
  Promoter: Source sequence=SeqID_2903; Location=1..562; Strand=+; Gene= SeqID_82283
aataaattttaaaaaatccaccaaaaaataacattaaaaattttcagcaaaaaaagcctagtaattttttcctttttttttatcagccaaagaaaaataatttgtatttttttgatgaactaatgaaaatgattaatgcttttttggcttcaaaagtttttttttcttcaaaacattttgatttgtttagataaaattttttatgcctttctgaaaattgcgtaaattatatctactaaaaatagtaaatttttcttttcttctttttctgtcaattctattatattattggaacgcaattattttgaattatttattgttaacataaaatgaaaaaaacactgcaaaaaacaaatatcccccccccccccccccctccctttggtaatcccttcctattgaatcggtcggtcgcattttcattttaccatgaatcatgcagaatcgctccactattagaagggggggggaatgtggactgaaccagttgggtttacaaaaaacgatttatttgcatgttttattggttttatttgtaaagttttgaatacatattagtatg

SEQ ID NO: 103658 - DNA, 60 bp, Heterodera glycines
  Promoter: Source sequence=SeqID_18167; Location=275..334; Strand=+; Gene=SeqID_82747
taagatgacttttttctaaaatatttgattttagaatttttcttttattattgtacaatg

SEQ ID NO: 103659 - DNA, 280 bp, Heterodera glycines
  Promoter: Source sequence=SeqID_16592; Location=690..969; Strand=-; Gene=SeqID_81003
tatatgctgatgatgttaaattgtatatttgttataaagcaagagccgacacaggaattatgcataaagcattgcataatttatccgaatgggcaaataaatggcaaatcagaatctcaattcaaaaaacttttgtacttcacttggggaataaaaaccccaaagaaatataaaattgatggaaatataataaatgttgtggatacaattagggatttgggcatcaatattgataataaattgcaattttgcaatcatgtcacacaaataataaagaatg

SEQ ID NO: 103660 - DNA, 124 bp, Heterodera glycines
  Promoter: Source sequence=SeqID_10312; Location=2260..2383; Strand=-; Gene=SeqID_73492
aaagtgcaatgtttgtggtgccaaaatgcgtataaatagtcaaagaatggcaccaaaaaaaccattggaattatttaattaaaaaaaacaattaattaccgccaattgtccattagaagaaatg

SEQ ID NO: 103661 - DNA, 436 bp, Heterodera glycines
  Promoter: Source sequence=SeqID_1584; Location=1..436; Strand=+; Gene= SeqID_74626
atttattcaaaaataaaaataaccaaaagaagggcattgctgccgcttacacttgaggtggaaatacgacaggtcaaatgggtagtagtgatagaagacaattaacattggtgatgaaaaaaatgaggtcaatgggcagttgtgatatgagttgaaatttaatttaaagaagcggaaaagtcgacctccagcaaagggaaattggtttttataacaatttgagtaaaaaattttttgtgggaaatttttaagaaatttgtagtagaaataaatggaaaaatgaaatgaatttcaataaaattaaaatgaaaataatgcaaagaagtttttatgtgagaaaaagaaaaaaaacattgaacgatttgatgaatttaaaagtttatatggccaaggcaaacagaaagaatttgtgaaggaattgggcatttctgaaatg

SEQ ID NO: 103662 - DNA, 309 bp, Heterodera glycines
  Promoter: Source sequence=SeqID_13795; Location=1614..1922; Strand=-; Gene=SeqID_77724
ttttcattttcatttcccttttcattgagttaatatcggcaaaagtgccgaaggaaacgatcactgtgccatccctggaattgtccacgatcgctttaaaacaaaaaatttgttttgtttttttttgtactttttttatgaaatatttttaaataaaagtattttagttttttaataatttcataaaaatacttttttttcttatgatttttaaaattgaatatatgaaaacattgaaattatcgaaatagaccttctctattttctaaattataattaaccaaattgattaaattaattaattaaatg

SEQ ID NO: 103663 - DNA, 436 bp, Heterodera glycines
  Promoter: Source sequence=SeqID_17152; Location=1..436; Strand=+; Gene=SeqID_81590
ttatttcgtaatgtgcacgtgactttttttttgttccaactatttcgcaatatgcgcattatttgggtcacctgtcaataaaaatgattgatgtctttcaaaataatgaatctccagacgattttttttacatttttgaataaaatggtcaaagctgtcaagaaaaatgattgatgaccctctaataaagtagacccagacagtcacgtgactagacccctcccctttttatccatttcgtacacccggccaaatcgcaaatcattcaactaaatagttggatttcattaaactcccttccgctctaatttattttactccgctctatttttctacattttatttcaaatctactgctattttcctccgtcaatttcttttcaaattcctctgctttttaattctgcttcaatttcgcattttggtttttaaaatg

SEQ ID NO: 103664 - DNA, 201 bp, Heterodera glycines
  Promoter: Source sequence=SeqID_12279; Location=3199..3399; Strand=+; Gene=SeqID_75872
attttttcatatttacaaacatggaaagagaaattatatttcgtctttttaaatcaattatttcatcataaaagcaagacaatcgaaattcatttctaatttatacttaaaaaatatatttttttataaattttactttaaaaaaataatatcctaagctgaaatcaaaattatcattttatgatttattactaaaaaatg

SEQ ID NO: 103665 - DNA, 288 bp, Heterodera glycines
  Promoter: Source sequence=SeqID_20759; Location=1..288; Strand=+; Gene=SeqID_51325
aaaaaatcccctccccctgataaatttttgtaattttcaacaatatttgattaaattatggcattaggtcaataaaatgtaaatttttttctcatggttgagaattttgaaattttaggcataaagtcactatttttcttaaaaaaggagcccaaaatcgcaaaaaaaaatgttggaaaaaatccattctggcgaaaaatacaagccatttttataaatattaaccgtttttcattgcagaaaataattattttatgtccttggatttcatgaattttccccactatg

SEQ ID NO: 103666 - DNA, 111 bp, Heterodera glycines
  Promoter: Source sequence=SeqID_2838; Location=405..515; Strand=+; Gene=SeqID_81865
agtgatctgacaattttgaaaggctgcctcatgtatggcgaaagagtggtcattccgaggatttttcaggccaaaattctccgattatttcacaaaggccaccccggaatg

SEQ ID NO: 103667 - DNA, 242 bp, Heterodera glycines
  Promoter: Source sequence=SeqID_23786; Location=1068..1309; Strand=-; Gene=SeqID_54487
gaaaaacaggaagccgagaaaaaggtgatctttaagctggaaaattggcgcaattcaattaattttttcctgattaattaatagattttttagtttaattttcaaaaaaattttaaaaattcagtattttatgcttttcaagattttttaacgaaaatctcctgggtgtttaccgctgtgaagtagcgttgcataaaactgggctcccaataaatggcacaaaatattttaataccataatg

SEQ ID NO: 103668 - DNA, 458 bp, Heterodera glycines
  Promoter: Source sequence=SeqID_30794; Location=1047..1504; Strand=-; Gene=SeqID_61182
ggggggggggtgggggggggggggggggggggggtttaaaaaaaaaaaaaaaataaaaaaaataaagggggggtttttaaaaaaaagaagaggttaatatttttttttttttaaaatttgggttttttataagtggtttaggggattttttaggaaaaaaaagggggaaataagggaatttttgagaaaatttaaaaagggagaatggtaaaaaatttggtaaattttaaaaccattaaaagtttccaggatttggagacaaaagattcttgagttataagacacaagtggctaatgagtgaaaaattccaaattggaggacccttcattattaagaaaaagaaatttcatcgggacgggggtaaaaaaaaaatcaaaaatttacaattggaggctgtttgtaatataaatttagcaaaaaataacgaaaatatttttaaaaatttatttttaagatg

SEQ ID NO: 103669 - DNA, 226 bp, Heterodera glycines
  Promoter: Source sequence=SeqID_25941; Location=946..1171; Strand=+; Gene=SeqID_56702
tcgcctgttaaatttgaaatttattttgttttattttttaaataactattttttattttccctttattttcatttttgaatattcaaattcggcattaactaacactgaaggttcttttcgttatccagttggccatatattttttaagagctcagcagcaatttttcaaccattatccaaacaaaacaatttttttaaaattatttcaataatcattttaagatg

SEQ ID NO: 103670 - DNA, 298 bp, Heterodera glycines
  Promoter: Source sequence=SeqID_32524; Location=1..298; Strand=+; Gene=SeqID_62837
acgcgtcgcccgcttcagcagtgcgcgagacggcttccgcccttcctcgatgatctgaatttcgaagatttcatttgaaattttgattttaaatgttacaaaaccttaccggaacaagcgatcgtcggaatgcctggcgaatgtaccgcaacggggaggaggagaaggtggaggacgcgcagctggtcttcttcttcggcactccggtcacggtgctcgcccgctggcaatacgcgacggcgccgttcctccgcggcactgtgccgttttggccattgcacagcgactcgccgtcatg

SEQ ID NO: 103671 - DNA, 120 bp, Heterodera glycines
  Promoter: Source sequence=SeqID_38640; Location=944..1063; Strand=-; Gene=SeqID_67390
ttattcctatgttctttcgggcttttcttgccatttaatttttgtttatttttttttatctatttttgctaatttgaatattttccattcattccagtggaagcgccgaattcgccgatg

SEQ ID NO: 103672 - DNA, 583 bp, Heterodera glycines
  misc_feature (142)..(142): n is a, c, g, or t
  Promoter: Source sequence=SeqID_7792; Location=1..583; Strand=+; Gene= SeqID_65988
ggaattaaagtcactaaaaatcttcaaaaagtcgactaaaaaagtcataaaaaatcgccaaaaagtcacaaaaaagtcataaaatacgcaaaaaagtcacgaaaaatgaaaaaagtcctgaataatttatagaataacattntaatcgtaatttttaggcacataattttataaataggtacctaaaataggcatagaaaagagattcttccaacaattaagaaaaaattcatccatgtttcattgtctttttatcgatccaaattttatttttctgaattttctttgtatttttcggcattttcttcgctaaaattcaaattttgccccaaaaagtcaaaaaaaatcacgaaaaaattcgcaaaaaatcaaaaaagtcataaaatcctaaaaagtataaaaaaagtcacaaaaaatgcatgttagaggcttcagacaaagtttagaacactttttaagtcattttaaggccatttagagtcagcaaaaaaaaaagtcatttgacttaaattcccagccctatttattattattcctttttttaatttttgaatatttttcttcaaaatttatcactaaaatg

SEQ ID NO: 103673 - DNA, 193 bp, Heterodera glycines
  Promoter: Source sequence=SeqID_44338; Location=956..1148; Strand=-; Gene=SeqID_71831
cgtttaaactgactaatccggtcctggtaaggcgcccatatggattcaatttcaaaccgtttttttaattcaatttttggttacaatttttttttaattttttaccgacttcttcgaccattgaaaatttgactaacaattgaaattcttttatttttaaacaatttttagaatttattttggtaatactatg

SEQ ID NO: 103674 - DNA, 1003 bp, Heterodera glycines
  Promoter: Source sequence=SeqID_6382; Location=3832..4834; Strand=-; Gene=SeqID_61330
ataccctggctatgatgtgagaaggattgaaataattaaaaacggaatttgtgaattgacacctggtctgactcacgatgatgtgctaattaggactttaagtccatcagaatttacaccccaacatgacggaattaactgtggcgtatttgttttgctttactctgaggcctacttaaataattgttcactgaaatttccaaacctaaacattaattttgaaaggcacagaattttatggcacttggcactgctgataaatagtgataatgtggaatatgtccgtcagaacacttcaagtcttcattccttgcctttttataatgtggagtctattactgaacaaacatgcccgagagatggagctgggacctttatttgcattgaacccgatattgacagaactcctgacgttcgtttgagaccacattcagcgagtattatgagtactgcaacccgccgatcgctccgactaaaaagcataaatactgagctgtcgtctgttgataatcttaatattacttcaaaaactcctcttaatgatcttactcgtcgttgtcatataaagcaccagggaattccttgtgcggatgtgcgtgcaaagcacactactgagtattatgattctggaaatattggtgataaaatatgtgaacactgtcattctcttttattaaatagtgaagcagataaaaaacacgggaaaatttcttcgagtttttgttgtaatcacggttcggttgttttgccctcttatgaagagcacccaccaacacttaaaagatttttggcagggcaagatccggaatctaatgaatttttatcccaccaaaatgtatataactccttgctggcgtttgcatcagtttctgttggatatcatgaatcatcccttggtggtgacaaatgctatttattgaatggagaattcacacgaaaaattgggttattacctggaaaattcgctccgtcttttgcacaattgtatattcttgaccctatg

SEQ ID NO: 103675 - DNA, 171 bp, Heterodera glycines
  Promoter: Source sequence=SeqID_7852; Location=402..572; Strand=+; Gene=SeqID_66161
gtgccatttgtaattactataactaatctaataattaattgtctattccgtagatatggtgtcggggagcagcgacgattttgcacggagtgcgggcattaagtgagtgaagcatttgactgattagcaatgctaatgattgtggtactgatcaggtacacgtacacaatg

SEQ ID NO: 103676 - DNA, 121 bp, Heterodera glycines
  Promoter: Source sequence=SeqID_4614; Location=1655..1775; Strand=+; Gene=SeqID_55103
ggtttaatttgttgggccaaaaatgccaatcaaatgaaaccaaacgaccgatcagttgccaacaaatgagacgcgacttgatctgagttatgtgccgtgctttgaacgattttctgaaatg

SEQ ID NO: 103677 - DNA, 71 bp, Heterodera glycines
  Promoter: Source sequence=SeqID_5437; Location=8508..8578; Strand=-; Gene=SeqID_58038
aggaactagacattgggaaatggggagagacaattaaaaacgctaattactcaattaatgccctaatgatg

SEQ ID NO: 103678 - DNA, 238 bp, Heterodera glycines
  Promoter: Source sequence=SeqID_13078; Location=1..238; Strand=+; Gene=SeqID_76865
aacaaaagctccaaatccactcgatcaattaaaaattaaaaatgaggataaacccgcaaaatgccgttaaatatcattttaccatagaaaaatacaactttttgtttactaccgtatctcattttttcaaaaaaaaaatatatattctgtatcattgtcgtatattctccagcagcaaccctttcaaaattctcattttccacgccgtttttcaatatttttggctcatttgccaatg

SEQ ID NO: 103679 - DNA, 476 bp, Heterodera glycines
  Promoter: Source sequence=SeqID_1070; Location=3337..3812; Strand=-; Gene=SeqID_67171
tgtttctggaggtgtccaatgcatacatgaaaaaggggcgggcgtcgactccccccccccccccctcgctcgcaaagagggcagccgaggggtggggaaggttcatagcgaatttttgaaaaatatgtgtatttcttaataaaactgttatattcctggcggcgcctatcggcactgccggaccccctctccccaaaaagtttttttaagaaaaaacgcgccgcaaaaggttttgaaaaccaaaaaaaggtcatcaaaaggtgcgtttggaccccttcgcaaaattcaccgctgcccttcccacccctttatatatggcccagtggggtatccacccacagctggttaacaaatttttcttaaagaacaacattcatgaaaactatgcccattctctgcaattgctttccgcggctgttgctcaatgtaagcgctacggttgcgaaaggtttgccaatttgtcgctgtttgacatg

SEQ ID NO: 103680 - DNA, 243 bp, Heterodera glycines
  Promoter: Source sequence=SeqID_6811; Location=745..987; Strand=-; Gene=SeqID_62965
ttgatgttggcaaataaatgaagaaatcaccgaaaatggaaaaaataaaaatttatgaatgaaaaaatgaaaaaaaaaattcgtcaacaaaaaaatcagtcgatgtcttttccactctctctgtctgtttggccaacttttaatcaaatatttcgaaataaaatttggcatcggagcatataaaaagcatttgaaaatgccgaaaaatatatcatttttcatttaaattatcctcccaaaatg

SEQ ID NO: 103681 - DNA, 873 bp, Heterodera glycines
  Promoter: Source sequence=SeqID_4044; Location=378..1250; Strand=-; Gene=SeqID_52938
ttttggtcgtggcagcccctccgtccagcagcaccaccaacgggtcggtagcagttcgtacaatggcgtttcatacaacttcaaacgggaatggccataacttttttgttcgttcgttaatttcttcaaaattggtatcattcgaaaactctacgtgtttagaagatattagtaagcaaaagctaagcgattcagcatcaaaagttatgattaataagacttaaaaattcaagaaaatcctaattttttgtaaactacacttcccccccccccccccctcatcattttccattttgctttgcccccccccccccttctctctcccttcccatcacatacgcagagaatgaaacgcctttcacaacattggggggaggaccgaaatactacatatgtaaaagcaacaaaatgaaaaaaattgttttcgtttatatcaaaacccgcagggttttacagatttagatgtaagtatatacatataggcaaaagagcagaatagtggtcccgatggaaaaatagtaaaattttaaaaagcatttttctcaggggcagaaaaacactctgattacgaatcagaactcagattaaaaaaaatcatgattttgtctatgacttttttaaaaaaaccatagaaattcaaaaacccaaaaaaatcgactaaactatcaaatgcggaaaaatctggcactgacgccaaacacccagaaaatgccggggtttagcgcgttcccggctaattcatgaaatcctggcccaacacatgtaaagcattttccaaaaatgcccatccaatgaccatcgatgccaaaaaggcgcttttcggtgcaacaattgcaaaaagctgattgtgaaaacaacaattatttaaatatg

SEQ ID NO: 103682 - DNA, 256 bp, Heterodera glycines
  Promoter: Source sequence=SeqID_3296; Location=4869..5124; Strand=-; Gene=SeqID_84100
ttcttgtgcctgcgtctcttactgtcgggaaaatatagtacacagagcgggactgaaaattttggagttagagggagaaaattcagaactgaccgcagcaaatgattcaaacataaaaattgttgggaaaataaaagcgaaaattcgaattgaagactcagtgacgggtaaatttggagaatgggaagcgacactgcttgtttcacccgacaagcactgtcctggaccagtattgcttggtttaccttttcttatg

SEQ ID NO: 103683 - DNA, 977 bp, Heterodera glycines
  Promoter: Source sequence=SeqID_25275; Location=613..1589; Strand=-; Gene=SeqID_56021
taatagcgaataaatatcataaatcgaattaatcaatacatttaattggctaaattcattaaaaaataattcgttaataataagttgaatagattgacaaaaaattgttaccgattttttagccggaaatgttatttgtttataaattactcatttccggtcataattcactgtcgtcagaagcgatttgtatatatataattcaataaaattgaatgtgttaattattagtaataaatttctgttttttttatttgttgtttaaaccctaaaaaaatgtttatttttcgcagttataaatagtgcttatggttttaaattttcacctagtttttttcctgagcttcctatggcatgtaccttaaatgcatatgaaaaattctctcaaaaatctacataaatttattttcttgacaaggattttttcttttttaaattatatataaatctcaataagatttatttggcataattttgttgattttttgaatgaaattttgtttccttttacaccccaaaatttgaaactttttagcacttattttctcgtttttagaaactattttggggttttttagaacctaaaaacgaacttggttttttttttttgaatttttattttttaaatttttttcgccagtttttagcatctaaaaatataagccctagttataaatgtaataaaagtttctatttctcagttattgatccaatatatatttttaaaaatatattttaatgactcatttccgatagtaattcagtgtttcgtcataaagtgttttgtatataattttataaaattgtatgtgttaattattattaatgaatttatactttttatgagatctaaatcctacaaaattcttctttttaagcagttaaaaatcttgtaaaaatttcataactttttcaggcaccaaaataattatttatttatttttttttgtccccaaattcaatataaaaaaaagatg

SEQ ID NO: 103684 - DNA, 536 bp, Heterodera glycines
  Promoter: Source sequence=SeqID_3029; Location=1198..1733; Strand=-; Gene=SeqID_82851
actcgaacaataataaaatttaaaatatataggatgatatcctcattggcatcttacccacgagggtaaccttggtacaggaagcataaaattcgaaaattgtatggatggtatcctcatgggcatcttgccaatgagggtattattggtacaggaagcctatcaattctttgtccatgtacagctcatgtgatgaacggtagcgctgatctgagtccggattcgtgatcatcgacctcgagaacccttaacacttattttcattaatttttgaaacacatttataggcatctgaaaatgtatgtaaaaagtaccctgtaaactgtataagttcctcattggtataatagtaaaatcgatgagaatagctattgtcttggatgaggctgggttatcccatccattcattctttccacttactgggtattttaaagccatttatcatgtcttgtttatacagttatcacctgttattgccaatgataaatgagcttaaacgaaaaattaatattttttttatataaaatataaaatg

SEQ ID NO: 103685 - DNA, 293 bp, Heterodera glycines
  Promoter: Source sequence=SeqID_36635; Location=1095..1387; Strand=-; Gene=SeqID_65895
ggaattccattgccaattccgcaaaaaccgttgccattcaaatcatcggaaaacggatcaacatcttgtaagatatggccaaatgtaaaagtttttagccaacacttcccattcattttcacagatacatcgaccgaaatatcatcacttttcttcaccattttcgtcctctttttgccgcctgtcaaatcattttgtgcatcaacacggacagtgatcgcaattgcatctcggagctcattttgcgcaacatttggccaattctcgggaaaaaaatccatagcattgaaatg

SEQ ID NO: 103686 - DNA, 1003 bp, Heterodera glycines
  Promoter: Source sequence=SeqID_40603; Location=266..1268; Strand=-; Gene=SeqID_68879
aggtcaaaataatggtgacagaaaataatttcctcggtctgttttggtttctgaccacaaaatctgttttttagctgtaggcatttgtgaaaaagatattcttatgcttaggaatcattaataatgtttcaattttaaactaaaaaagtatatttttaatatacctttaaaatgaatttattaataaatttttcatttcaaataaaaatctacaaacaattttgtgggtgctatttaacgggtcagtgacagtttgtacaaatggcagttggtaatttcaggtttttctaaagaaataaaaaaatcacttttatgatcgttacgggctagggttaattgtaagctgaagaacagcagaaggaggacgtgcgcagcagggatggcacggaattccgacttccgaaaaatttttgaccctcggaattccgatttccgaaaatttttggggcctcggaattccgactggtgcgaaaaatttttggccctcggaattccatccctggtacagaccaaaaaatgagaaggaaaagggtacataaaatgtcgagaaaaatacgaaaaatgttcagggatatttcgaaggatttgtcaggtagcaaaattcgaagaaagcgacgaaaagaattggcgaatggataataatgaaaaatgacaccactcttatactaatttcaactttcgcctgtgcactttttcagtttagtgggcccgttttttcatccaaaaaatcatataaaagacaaggaaaaataacaatgactctttaaagcacacatattatttatgttttctcgtaatttgccgagcccaatattagtgcattcattcgaccaatttcaaactcggacctaacttcgaacaaaaagtcgaaactctcaaatttttcgagtttcgcattatttgtttgatgtttggtgatcccccctcatcccctgttttgtgaatgcaacaaacaaattttgaatggctactgcttgcgggggagaaaaagcattcgcatatg

SEQ ID NO: 103687 - DNA, 55 bp, Heterodera glycines
  Promoter: Source sequence=SeqID_14751; Location=1..55; Strand=+; Gene= SeqID_78876
agagctatctgacagaacagctctcctttgcttcctcgccagatcgctcgctatg

SEQ ID NO: 103688 - DNA, 505 bp, Heterodera glycines
  Promoter: Source sequence=SeqID_3614; Location=2711..3215; Strand=+; Gene=SeqID_51125
atcggctccttttctgcgcgtatatgcatttaaactacaaatggagattgatgattgcttccaagggcagggttcttaaaatgccaaaattggaaacttattcatatgtaaatccaaaagaaatctagccaaaaaagtagtgctttgttgttgtttggataagagatttagattatttatcaaaataagagacagacccaggaattttgtaaccaaaaatgggcctagccatggcacccaaccattaaattgtcggttgcttacgtagaaatgacacatgtaaattattttttgctttttactgccggatgcataaatatattgccacgagaaaaaaaaaatgtttttatttacatatttattaaggctgaagcaacaattcagcgaatgattttaataatattttaatttttgaaatataagttattattttaataattataaaaatcgtgtgtttcttttcttatttcgttttttcagatatttaagtggtaaattgataatg

SEQ ID NO: 103689 - DNA, 1003 bp, Heterodera glycines
  Promoter: Source sequence=SeqID_1710; Location=1625..2627; Strand=+; Gene=SeqID_75442
aaaaacagtgaaaagtaattatggcattttttcaacagtttaattttaatgagaatggacgaaagacaacatttttagccggaaatagattgttttgacgtttttaacgttaatatccataaatgtaaaaaatatttttttaatttcataaataaaatatttacgaatatgtttttttaactatttcaatattttgagaatatttcggcaattttaacaaaaatacaataaaacataaatttaacgaaaaccatttcccaaatcgcacccaattgtccccttttacaaatatggcctttggggttttttcgtaaatatttatttaaatgtttcggaatttttcataaatatttataaatctcagcttcagtgataagcaaataaaaattgccgaataaattaatttaagaataattacaactgaataattcatttttatttttgcgaaaaataatattcattttaatatgccataaaatcaatttttctattgattgcttttttatatatataaaaaaagttatctacgagaatgaagcgtgcaaaccaattacatgttcgctgaaaaataaggctaatatacaaggattcctttttatgtaagaaaaaaagcaaatatgtaaataaaaaatgtaaaaactatgtatgaattatgtacaaaaacccaggaatatgtacgaaacaaaattttaaaatggttattttttggaaaaaaattattcataaagggtgaaacaggcacaaaatgcataaaaatgacctaactaggcctagaacgaattaaagttcaatataaaaaatgaaaatatgtacgaaatattgcgaaagtttggatttttgtcgtgctgctgttgatgttgcggcggccgaactggcgatggcgtaccctccgatggagtgtagatgacaagatgtttacgctgctgttgttttggcgcaggagtacgatgtccttgttgcggtggccccaacgggtgctgatgcaaagttgcgtttggcgatg

SEQ ID NO: 103690 - DNA, 329 bp, Heterodera glycines
  Promoter: Source sequence=SeqID_12835; Location=2490..2818; Strand=-; Gene=SeqID_76562
ttattgtaatgcacagcctggtgcgtgagtgtttggattggggaccgaagggtgaagccgttccctgggtgtgtttgctcacttttttcaaagggaactctaagaattctgatatgccttcaaatctatcaaaagagttgcatactttctttttatcatttctctttattttctattttacacttgtatttttcatttgaatgtttattcagaaataaaattgaaaaatgtgtcattactaatattaaaaggtataaattaaccaaacaaaaaggtatttaaggagagaaatagtcagggttttgtaactcaatttggaaattagaatg

SEQ ID NO: 103691 - DNA, 57 bp, Heterodera glycines
  misc_feature (22)..(22): n is a, c, g, or t
  Promoter: Source sequence=SeqID_45477; Location=34..90; Strand=+; Gene=SeqID_72768
ggtggcacatatcgtgaacatntcataatcaattaaatttggatttcaggacaaatg

SEQ ID NO: 103692 - DNA, 437 bp, Heterodera glycines
  misc_feature (61)..(61): n is a, c, g, or t
  Promoter: Source sequence=SeqID_34701; Location=413..849; Strand=-; Gene=SeqID_64424
taaagaatccttttttcctagtgttctgatattttttattgtaaaatatgtacaaaaattntaattctaacttttcggttctaattgttatattttttataatttctgctaaatttaaagtattttctacaatggataaatttaaaaaataaattaaactgtatatatttcgaaatttataattttcatatttttttttcaattaaatttaaattaacaaatataaatctaaaatataattattttttattattaattttcaacatttaattatgaaagccgtttagtagaattttaaatgagcgatttacactttaaatctttaaatttgtttcattacagcaaatattgttttttttaaatatatttattgtgaatcttagaatattaatttatctattttgcacttgctataatggttatatttgagcataatg

SEQ ID NO: 103693 - DNA, 303 bp, Heterodera glycines
  Promoter: Source sequence=SeqID_39464; Location=1..303; Strand=+; Gene=SeqID_68029
gatatttgaaatgctaacgaaaaaaattcttgccgaaaaaatggctatctcttttttctcttggggatttgaccgcaaacttggtaccaacatttgccttctctagtctggctctaccaaacactcacacgatatttgaaatgctaacgaaaaaaattcttgccgaaaaaatggctatctcttttttctcttggggatttgaccgcaaacttggtaccaacattttccttctctagtctggctctaccaaacactcacacgatatttgaaatgctaacgaaaaaaattcttgcccaaaaaatg

SEQ ID NO: 103694 - DNA, 91 bp, Heterodera glycines
  Promoter: Source sequence=SeqID_42505; Location=1..91; Strand=+; Gene= SeqID_70375
ctgtgacaaattcccaattatcgaaggcatttcgcccctccccactggcagccccgccccgagcaatgggacgagggacgactgaagcatg

SEQ ID NO: 103695 - DNA, 183 bp, Heterodera glycines
  Promoter: Source sequence=SeqID_15028; Location=1..183; Strand=+; Gene=SeqID_79191
ggggacctctagagtcaaaatctaattcaatttgcgacttttatggaagttaatttccgcagtccactcattttttaatttaggtcattggcataacttcacttttgaaatttttcttaacaaaaagcaatttaaaccatttgaaaatgaataaaaatgttttcagctgatttggatacaatg

SEQ ID NO: 103696 - DNA, 255 bp, Heterodera glycines
  Promoter: Source sequence=SeqID_23193; Location=1124..1378; Strand=-; Gene=SeqID_53902
ggtacgccaaaaaaattttcatggaatttttaaatcttacaattaaacttttcgagatttttttaaaactcttactaaaaaatatttttttttttgggcggcgatcgaattctcgttttttttaattcaatggtttgtgttcgttttaataatgcaaaaaatgatctacaaatgcaccaccactccctttccattttttggattcaaaaattcttttacgattattttaaattttcagaattccaattggaaatg

SEQ ID NO: 103697 - DNA, 1003 bp, Heterodera glycines
  Promoter: Source sequence=SeqID_5502; Location=671..1673; Strand=+; Gene=SeqID_46056
gagatttttggctaattttttaagaaaaaataggtttttggggggccggcggtgccgataggccgcctggcgaattttgaaatttaagctcgatttctaacagatgtttacaaaaaaaaataagatttttacgataaatttttgtttttttaatatattaaattatcatgatttactcaagcaaaattggaactcagatttgtaacatattttcttgaggcacatttttccaaaaaaaaaaaaaaaacttggtgaatgtgcgagcgtagaggtccggcggtgccgataggcgccgccgggaatgttaatagattttgtccaaaaaatgataggtttttgcaatttttagagaatttttttaataagatttacgaatttttgggccctgcgatgccgataggcagcgccaggcgaattttaaaattaaaaaaataaattaaaaaagaaacggtcaacctgaatcgaactcacgacagaaagtaatgtcaaggttgattcactaaccactacaccacactacactccaatgaccaataataaaattaactttaattcataaaaaaattgtcaaaatggttaaaaaaatcaaaattgtataaattttttgccttttatcaatgaatatgtcattcttaggggtgcattttcacccccgcgcccccgcgggggtgaaggtcgtgggggcgggggatggcgggggtcagagtcgcgggggcgggggtgaggccaaaaaacctgtcccgcccccgtcgggggcgggggtgacgggggcggggtccgaaccctacaaaaaagcatttagcagtgtaaattttgaattagcgcgcaaaaaattacgccaattacatggcgaaatgtataattcctttttttcatttaaatttttaaaatgatgacaaaattactttgaaagtttagctgtttatttaaaattccctttcaattaaaattcttattctttgacaattcacaattttttgttttttcaagcttcagcaaaatg

SEQ ID NO: 103698 - DNA, 103 bp, Heterodera glycines
  Promoter: Source sequence=SeqID_39883; Location=1009..1111; Strand=-; Gene=SeqID_68352
ttttgcgctacccaatctttgaaaagttttacacaatcaatctgcaaaaattggaccattttggccacattcagaaaagagggaattttatctttggaaaatg

SEQ ID NO: 103699 - DNA, 1003 bp, Heterodera glycines
  Promoter: Source sequence=SeqID_8973; Location=636..1638; Strand=+; Gene=SeqID_69871
agtgtccaaagttatgttatagctggaatatttcagattcttcgtccgcaaaagttttcggaaattagacaaaaaaaaaaaaaatcagaattccgcgtctaaatgaaaaaaatattcccttttgctttttgtttttgtaaaatttccactttgaatttttcccccggttttacccgcatttggagcaccgccttcgctgcgctttccctccccccggcccttctccgtcgtcgttcttcaatttgagcacatagccccgctcgatgagttggaaacggcgcgacaaattcaacttcaaaacggtattaatttagaaattaaattttgaaaaaaattcggtacttctaggttttgtcaccctcccacttgaattttttttccaataattttttctaggctaatttttaattctgatcactagggatgggatttttaagcgcgaaaaagtccaaaataaggccttaaataagtacgaaaaaatcgcgaaataagtgcgaaaataagctcgaaaaaattccaaatttaggggtataattttttaaattgatatgaaaataatttcaaattaaggcaaacaattttattcattgattacagttgcaaataattaaatatattcgaaatttttgaatacacttttctagaattaataaaatttgaaaaaccaaaacttggttaaaaaaaaattacaaaaatttcggccgagataaaaacaaaatttagtggaaattttttgaaaatttttaaccaagttgccaagaaatgtgatcgcgtcaaaaaatttttttattgtatttttgttaaaaaatttgtgaattttcatgaaaaatttaaaatcgcgaaataagaacgaaaataagcataaaacgctaaaacaagtgcaaaacttattttaagggcgaacatccaaaataagcaaaacacgttatggctaaaaataaaggtcagattcgtgatcaaaattagcctagaaaaaatattagaaaaaaaatttcaggggatg

SEQ ID NO: 103700 - DNA, 476 bp, Heterodera glycines
  Promoter: Source sequence=SeqID_3417; Location=1246..1721; Strand=+; Gene=SeqID_84602
ttacgtcatcataatcatctgatgaaatttgcttgtaaattttaagcaaaatctgtggctataaaagagaacagcttggccagtgagcagcaccaattcatgcaaccatttcccattttctgttttgaataataataactgtatttatagggattggattttttaggcaaaaaaaaaggcacaaaattgaaaatcggcagaattttttcatggaataatttttttagtcaaaatgacaaagaagctgaaataaatttcgttttttttctctgaaaatgagggaagtttttttttaaatgaaaatacataagaattaattgagatgaatattttttaaaaaacttctttctattcacatgcgacaattttttttttttttgtaaatttttataggtctattttttgtaaagaaattttccaaaaatccaaaatcctaaccacaaacaccatctccatcattacaaccaccaaaaatg

SEQ ID NO: 103701 - DNA, 362 bp, Heterodera glycines
  Promoter: Source sequence=SeqID_43472; Location=827..1188; Strand=-; Gene=SeqID_71124
ggtgtgtacaaagggcagggacgtattcagagcgagttgatgactcgcccctacaaggaattcctcgttcacggacaataattgcaatgtccgatcccaatcacggcaaattttcaccggtttaccaacccctttcggggaaggacaagcacgctgattttgccagtgtagcgcgcgtgcagccccggacatctaagggcatcacagacctgttattgctcaatttcgtgcggctgaacaccgaaaatccctctaagaagttgtgcccacagaagcaatgagccaactatttagtaggctagagtctcgctcgttatcggaataaaccagacaaatcgctccacgaactaagaacggccatg

SEQ ID NO: 103702 - DNA, 767 bp, Heterodera glycines
  Promoter: Source sequence=SeqID_3245; Location=1708..2474; Strand=-; Gene=SeqID_83884
catcaacaattattttcttcaacatttaattcgcccattttctctgtttaaaagggattgatcagtttttttttgtccggcgattcaataaatttataaatttctaaaaaattataagaaaactttaattttaattttgagttaagtttgttgaaaaaattcaaagttgtactttaaaaatgataaagcaaaaatttaaatgtaaaaaagcaattttttctttcaaaattattattaattccactaattgagagattcaattaaatttttgagccaatttttcaaaaattaaggatatttaaaataatggatgcttttgtaattgattttttcagatttcgcgctgagccaaataaaatacaaatctttaaaaaaagacatattgctcccctgctggaaataaaacaaataattatgtaataaaagctattaattaatttattttattttatttatttaatcggattcaacgttcatcacatttgatgagctaatcattttaagctgtgcaaacattttgaaattgcaatttcattttacgaatgttcaaacaaaacggaaatgcgtcatttcaacggcaatttaaacttgaaaatcacatggaaaagaaaaacggaggacaaaaaaaatggaaataaaagcgcagagaattagcggacactttcatcagcttaattaagcattaattggaactcaatcagaagaaaggcaattccctcaccacattttgacatttgagaagcattgaaagtattaaaataaaaatg

SEQ ID NO: 103703 - DNA, 217 bp, Heterodera glycines
  Promoter: Source sequence=SeqID_14507; Location=363..579; Strand=-; Gene=SeqID_78557
tagaaaaataaaaaactaaaatggaaataatatttaatatgaatataattttaatattattgacgagaaacgcataatttatatttttgtattgactaaataattaatttcctgttacaacgcatcaaataatcagcagacatccgagtaaattacatatttttttcaaatatatgcaaattaatgtcagaccattgtgcgattagacctgaaaatg

SEQ ID NO: 103704 - DNA, 444 bp, Heterodera glycines
  Promoter: Source sequence=SeqID_21923; Location=1000..1443; Strand=-; Gene=SeqID_52559
gaaagaggcaaatttgtgcagtgaaaggcctctgctttcgaatcgatgaccaatgacgaccatccaatttttgtttgacattcttccattctgttagttaggtttttcttttgttgttggctttgtttgtgttcttccttttcaattcgagcataaaattcctaattttaaaaaaatactttttttactccgttacaaaaaaaactcctaatattaattgagatgttgatttatttttggaacgtgagtgaattaaaaattcttttcaacattccgatgttttggtcttccaattttgcacttctctcccgtcgtctggcaaacgttcggtccaaatttgggttttaattacatttgccttttagccgtcatgctccaatttttcgaccaatcttcgctttttcaatgttggcgcatcccttttcggtaggaaacgtgccgatg

SEQ ID NO: 103705 - DNA, 122 bp, Heterodera glycines
  Promoter: Source sequence=SeqID_1464; Location=2084..2205; Strand=-; Gene=SeqID_73688
ttttcccttcttcggttttttgcgtccctctgtatttgcacacacacacacacatatatatatataaatatgtagataaaaaatttcttcctccattctactaaacccccacccccaaaatg

SEQ ID NO: 103706 - DNA, 464 bp, Heterodera glycines
  Promoter: Source sequence=SeqID_24215; Location=1..464; Strand=+; Gene=SeqID_54931
ccgcttggatttgcctttgtctccgttcgttcgtttcttttcccctttttcctttttccccccttttttccttttttccattttcccatttgattcctttcagtgccattctcctttcgctgcccactcattgtcaaaactttctccttcatttgacggtgtacgaactttgcgaggaacaaatgccaaaaagtgcggcaaactttgggcacccccaggcgatgcttttgcattttccgcctgaattttgtgtgcgtcttctgctgttaattgaggacgacaaaatcttcagaaaaatgttgaacagactcactcaaaaaagcatcggccatttgattggccaagtgagtacggcactcgcctcagccgacgatcaccaaacggtgcctttcacaaagccttcctcgtaaatgtgctttttatcctcttaggcttcggttttgccaaggctttttgtccttatg

SEQ ID NO: 103707 - DNA, 1003 bp, Heterodera glycines
  Promoter: Source sequence=SeqID_18670; Location=436..1438; Strand=+; Gene=SeqID_83333
aaaaatcctgacgaattgtccactgactgattttccaatgacgtactgtatgtccattactgacggattgtccatttactaacggattcttcttcactgcagaattgtcattccacgaccatctcttcgtcaaatttcattcaattgcacccccccccccccccctcccttgtccatatcatttgaaaaacggcaattcgaacgatcctttgtgcaattagtgacgtcgcagtggaacaaatggctgaatttcggcttttgatcttagccaaaggcgcctggcggagaacttaggggctgattgggatcaacaaatagaacggagagaaattaagtgacaaatcacaaggaacaatgacaaatcacgagagttaatgaattggccaattcagtgatgaaaataaaagaaagttgagcaactaattttgttaattacgaggaaaatgttgcaaaataaaagtcacaatggaaaatgatgataattaattatgaagaaaaatgtgattaaaagaaatgaaaggtgttctattttatccctaggccaagtacctactgccgactggcactgatcacaattcattcgaccgttattgctctaataaattttttttttctctgcggcatacaaaatataataattgaattttattatcataaattcacatttgataattaaataactaaacgtagccaataatgataatacattacttttactaaatttaatatttttattcatagcaaattaaaaactctctctctctctctccgtgctgaaaaccgacaaaacaacgtgaattgacgtgtgcagactcaagaacgacgaaacgacgaacaaattggtggcatttgcagtgttgctgacgaagtaaatttatttgaattttgcctataaaaaatatataaaaataaaataaatagaacaaaaaataaaaaatctcttgtgactcattgggtacggtaattacagtatacaataaaagttgttttaatccgagaaatg

SEQ ID NO: 103708 - DNA, 295 bp, Heterodera glycines
  Promoter: Source sequence=SeqID_29285; Location=1369..1663; Strand=-; Gene=SeqID_59806
ttcaaaaattaaattagaaacggagaaaagtttctaaaatgaataataattaagataaattgacggacggaaaggcgataagaatcttcacaaaatgtcaattttagtgatcggtaaatgagaaaaacaaaattagggagggaggagaattggagatcaaaaaaacacgaaaagaggatcaattaagaagttgaaaaagaattgctgttctgagaaaattaaacattgccattttcaaataaattccccaaatttccaggaaattaatttgtttgccgtgacctcttccaaaatg

SEQ ID NO: 103709 - DNA, 290 bp, Heterodera glycines
  Promoter: Source sequence=SeqID_11485; Location=1..290; Strand=+; Gene=SeqID_74899
attaaatagcaagggtacgaataaatgaagtatagtcaaaaccgtgggggttgttggacaacaaaccggaacagcttacccaattttacacgcattattattcgatgttaggtgaaaaaaaatttttgtgtgtggttgggaagattcagcctttttaggccggaagcaaaaacacgcaacggaaaaaaattttttgtagtgcctgttaaggacagaatttttaaaaaaagccgtcccgggctgattattttagaagtaaaacaacatggtcgacgaatgagcgtgaaatg

SEQ ID NO: 103710 - DNA, 663 bp, Heterodera glycines
  Promoter: Source sequence=SeqID_9381; Location=1..663; Strand=+; Gene= SeqID_71186
ctcatatgaaaggccgattcataccgagaaatgcgaccatttcccccccccccttcccccccccccccccacctgatagtcctcgttccacaccggacttttggtcttgggcctcgtcaccgttttgccaacgtggtactcatcgcagtcgacattcacatacgcatccaccaattggctgtccgggtcgtccgactggttgaatctgaggggttaagggagcgatcaacggatgaagtgattgcgataaatcagagcctttggagtgggagtgatggatgtactatatccctcccccccccccttttagattttcctttttttagaaaaaaaggattggcttttaatcagaatgtttctgaacattttgttcccctttttaccttttcgaccattctgtgggctgaaggtcgcgcgcttcgaccacccgaattttggccgttccgttgaacaaaaccatcgctttttcggcctccgtttggccttttcccccgtcggtccctttgtcctttggccttttgctgttgtgaggtgatcagctgatcaatggaggctaatccccgcattcaatgagcagagaaaaggcgtaagacaacggacgaaagggcggaggaaaagcgacgaaagagcgaaaggaaaggaagcgaaggacgagaggaaatg

SEQ ID NO: 103711 - DNA, 249 bp, Heterodera glycines
  Promoter: Source sequence=SeqID_207; Location=4726..4974; Strand=-; Gene=SeqID_77583
agtcagaaaggcttgataatttaaaaatgtttaaaaatattcttgttaactgttcttttaggcatttatgtgtccatttaaaatttacttattttaaccagcgatgtgattctaatctttcatcgaattgtatttaataacgttttttcaacaaatttattcatttaacttgcttgataaaaatagaaataataataataataatactttagattatatcaatatttttgaacattatcgccaaaaatg

SEQ ID NO: 103712 - DNA, 382 bp, Heterodera glycines
  Promoter: Source sequence=SeqID_9814; Location=1924..2305; Strand=-; Gene=SeqID_72793
agaataatttcctttttcattttgacatttatccgccccccaagaaaaagtgaagctgaagtttctaagaatctaggcctaagcaagcctaagcaaaggcctatatgcctagggtctaggcctaagcttaaaggcaaaggcctaagcccgaagccagtgttaataaaatacatacgtaatttttatcaaggaaaaaaaaataaatttggcgatcaatgaaaaaatttgtcaattttcttaggggtgtatttttgaaaattttttgagccatttcttaagggtatattttttgtgttttattgcattttggataagattttttctatttattattttaaaaattttcaattacataaaaaacaaaatgcaggtgtttttgatg

SEQ ID NO: 103713 - DNA, 449 bp, Heterodera glycines
  Promoter: Source sequence=SeqID_27102; Location=1087..1535; Strand=-; Gene=SeqID_57812
tccctgaaaatcttgtgaatgagcattgggaaatatacgaaaaccaaatgaatgaaaaatatgtgcagttttggttcttcggggagagttttgaagtgttcattaataactcaagcgacaaaattattttgggaatggacatacaatttttaattggagagagatggactttaaaagtctttgatgataccgaaacgtattgggaaaaattattttgggaggaaaatcaatttgtggagattcaaagaatacctgagatttgggttacacacaaagaaaatgcagaagaaaatgaaaatgacatttttaattacagtataaatgtaataacaaaaaattttttgagtattacggatgtgaatttggcaaatgataacattcaaaacgaaataaataacagaaataacaatataaacaccaaaatggaacttaaaaacaatttagaaatg

SEQ ID NO: 103714 - DNA, 1003 bp, Heterodera glycines
  Promoter: Source sequence=SeqID_1264; Location=2153..3155; Strand=+; Gene=SeqID_71021
aaatcgaaaattgtgaaaattcgttaagtgatttgtttatttgacactgttgcagcactcttccctttcttcattgatttgtttattttttcatctttaagggctactgtaattattttggattaaaataatgatgcaaaaaattattcaaaaatcataaattacatttggataaaaaaaaaacattcaaaagccaaagggttagaaaaaataaatgtgcatcaaagtataaacattcattgagtaaataaataattttaattatttgcaaattaattagaacattttttaaaatttaataaataaatattatttaaatatacggccccccatttctttttcgctttaagtcaaaaattgggaaattccgttaattgatttgtttatttgacccccttcccttctcgccacccgaactcgcaatttcccttatccctcgctgcaacccttcctcgccactctcgctgccgagcaatttctcgccatttttctcgttgcaatgtactctcgccacactctcgcccccctgccactcgctgctgcctactctcgcccccctgccactcgctgctgcctgctctcgccccccctttccccgctgatgacgtcattttttccctttatgagagcaaattaatgtttatcatccattgccaatgtggccgagtggttagtgcgtcaggctggccgccccctctggggttcggatccgcttggtgcggggaatttttggagaattttaaatgaatttaaattcaacgtctttgacctttaagacgtttaaaataatttaaaattaaataaatttaattaaaataatttgcataaagtcgcgcagtcaaaaaagtcgcgcacccccctgcaataggtttgggtttgcaagaaaaaagtcgcgcaataggtttgggtttgcaagaaaaactcgcgcaataggtttgggtttgcaaaaaaaagtcgcgcaataggttttggcttcagtactgaaaagtctggcgctcagatg

SEQ ID NO: 103715 - DNA, 844 bp, Heterodera glycines
  misc_feature (116)..(116): n is a, c, g, or t
  Promoter: Source sequence=SeqID_11109; Location=1..844; Strand=+; Gene=SeqID_74438
cagaataaaccttttttcttattttatttattagctcaattttagacttttgctcgcaaataaaattaaaatgtatggtatatcattaacatgtgtttcgatgttatttttattgnaaaaatatgtatgacaaaaataataaacacaaataattgtaattatttcattttattaataaatcttgacaaaatgttcgaataactaaaattaaattttatgctgtgccattatgctttacatatttaatttatgtttccattattctggctgttgtaatttttttaaagtaaattattttaattttctctttactttctttaccgtgctttacttttttattgattataatccatttaaataaatattttctgacacttacggctgatggaggaagcaatgacaaatataagaatttgcgcgaaaacttaaatatgaattaaattttaaaaaaacttttctgaaaataacaatgtataatttttcgggtcactgatcacgatttatttatgccaatttctgatttataattacttgtttaatgatgccattttgactttgactaaaatttatttattttcacacataaatttaatttgtttatatatattagattattactcacaaaattaaaatttattttcaaaattttaaaaagtattattaatattattcacaaaaaatgaataagaatttatttgttggaaattatttgttaatgtttgatgaataaatctggatttttgcccaaattttcttaataaaattaatttaattttcttatataaattcatttttcagaaatttattttgttatttcgtttataaatttaaatatcaggcaatg

SEQ ID NO: 103716 - DNA, 216 bp, Heterodera glycines
  Promoter: Source sequence=SeqID_13247; Location=2002..2217; Strand=-; Gene=SeqID_77078
tttccgtagtgccaattattaacctaaaaatgaattaattctctgaggcataattatcacttcacttttacaataatgtgcttccgatcaaaagcagaaaactataattagtctcaaaaatgaaagagtacgccaatttcttataattttctggcaaaattcatttttttacaaattaatagattaaatttattctcacttttccttcgttcgatg

SEQ ID NO: 103717 - DNA, 288 bp, Heterodera glycines
  Promoter: Source sequence=SeqID_26268; Location=1..288; Strand=+; Gene=SeqID_57013
cttctattatcttagtgaaattgtttttgtttttgttaggtactttgcaaaggccctgtttttgtacaaagtcactatttggacgtgttaactgaacgcgaagaattgggtcactcccacaaatttgttcaatttacaactgttaaggtgagcaattttatgctttttcaaaaattgtgctgcgaatgatttattatttgtcttttctccaattgatttttttaaaagattttcgacctgttcaaatgctacgagtgttggaaggccacacatttggagcgaattatg

SEQ ID NO: 103718 - DNA, 408 bp, Heterodera glycines
  Promoter: Source sequence=SeqID_3172; Location=2727..3134; Strand=-; Gene=SeqID_83521
atttcccatcaaaagcgaacggaaactaagaaaattcttttgatttggcattaaaatgatgaccaaaattcaagtatttatagcataaatttctttgtttagccaagcatatattcaaatcattcccaaatatcccctcacttatttcaacacagcaatcagtgcacattttcgtggcttatgtcacactcaaaaaagactggctctagggccaccagtcaagagagggatgaagaaataaacataacaatcattgaccgaaatttttggaatggtaaaacgtcggtaaaggttcccgatttggaaagagcccacatagaagttctacgcctagaggaagctgtaaatagatcatttagaattgtaaatcgaagggcatatgcaaacacaagggccttaaataaaatg

SEQ ID NO: 103719 - DNA, 64 bp, Heterodera glycines
  Promoter: Source sequence=SeqID_11753; Location=296..359; Strand=+; Gene=SeqID_75247
ggtggggacgtaaattaaaaatatacccatggatatgtatttccagtggaaatgcgtggacatg

SEQ ID NO: 103720 - DNA, 677 bp, Heterodera glycines
  misc_feature (24)..(25): n is a, c, g, or t
  misc_feature (95)..(95): n is a, c, g, or t
  Promoter: Source sequence=SeqID_9693; Location=1..677; Strand=+; Gene= SeqID_72372
aagtacagctgcacattgtctgcnnaaggcaatgaatgcaaaaaatacatttaaaaaaacattggtccgatcgccaattggtcggcacccggggnaaattaaccaaaaaaattccgccaattttggggctttttcagtgaactttaataagcgctggaaagccgacgacaacttttgtaaatgctcgtaaaatttttagtgttaagaaaaatttcagggcattcaacttttgtgatttctcaaaaatgtaccgaacttaaaaattggacggaatcgcaaattttctcaaacaaaaaagccaaaaaaaattgatgtttatgttaaaatacatataaaaaatttaaatttcttatagaattcaataaggcaacattttgcaaaaaaattgcatttttttaaatcgaagaactccactctaatattgttctgtatagtgttcacccaactcactttgtccttggaaattgcctccttcaacacctttttggccaacttccgatcatggcgaaatcgggtgtggaaacgggccaatttcagcgcccaaaatgaagcaattttgcgcgatgtgccggccgcctcttggattagccgctcgtacttggccaccagtgcggaatagtcgggactccttttttggggaagaaaaattataaaatttgaaaatgtcataaaaaatg

SEQ ID NO: 103721 - DNA, 127 bp, Heterodera glycines
  Promoter: Source sequence=SeqID_27560; Location=1..127; Strand=+; Gene=SeqID_58259
tgaaacggaagagtgccatttgactggttttggcgagaaagaagccaaacgctacgtgagcaatgttgtccgcgtaggatttctgggagtcaacggagacccatatatatgcgcactcaatgaaatg

SEQ ID NO: 103722 - DNA, 1003 bp, Heterodera glycines
  Promoter: Source sequence=SeqID_9506; Location=2855..3857; Strand=-; Gene=SeqID_46770
taaattatgatttattatttagcaaatatttttatatcagacttactttagcttggcttgatgcttctaagatatattttatttcttattttttaggttttctatttcgatattttcacacaaccattttcattaagaaattcaaaaaacacctccaaagaccaaaaacatttaagaaataaacccctaacaataagacctaataatttttaaaaactcgaaaaattgtgcaaatatttttcaaaattcctatttaaaataaactacatttaaaaattattttttctcaatgagaaaaaattattttaatgaattaacaatttgatataacaaaaatttagggattttatataattttgattttcgagaattaaaataatttttctcgtctattcataaaaatttaatagtttaaatttttctaaaatctggactcaatttttgagaaaaaaacatgtttttgtcatttatctttatttaataaaatacataaaaaattgtttacatttcttttttcataataattttattggatttgcatgttttgaattttatttgacttttcgcctttaatttctcggcgcttctttggttcaaaaatgacaagaagcattcattcttttatgctttctcataaaaagtggaatttcaaaattttggatttttttcacattccaccaaatattattgaaatttttgtttgcacacgcataagttttttaaaaatcacagaaatttttcaatattttaacatttgttcagctcaccaattgacaattaattagcactctttgggtggtaatgagcctttaaaaggccgaaaaagcgcagtttcaatcacattaaacaataattaaaaatattattaatttattttactaaaaatgattttcattttgctgcccgtcttttccatgctaattggtaataattaataatttgaatgggaaattaatttaaaaatttagacaaaatgccaatttaccttttaggccgtaccatg

SEQ ID NO: 103723 - DNA, 118 bp, Heterodera glycines
  Promoter: Source sequence=SeqID_2976; Location=3753..3870; Strand=+; Gene=SeqID_82602
tttttaatacaaataataaaaaaaattggaaaatttttacgctttggaatccgtaaaaataatgaaatgattttgctttcacttatttggttgatggaaaacgagaaaaatcgcaatg

SEQ ID NO: 103724 - DNA, 93 bp, Heterodera glycines
  misc_feature (58)..(58): n is a, c, g, or t
  Promoter: Source sequence=SeqID_14421; Location=1..93; Strand=+; Gene= SeqID_78457
agagcatttgtatgtgtataaaattatcaaaaaaagagatatccattttctgggatancctctaaatataaaaatcctctgtgaaataaaatg

SEQ ID NO: 103725 - DNA, 311 bp, Heterodera glycines
  Promoter: Source sequence=SeqID_12915; Location=890..1200; Strand=-; Gene=SeqID_76656
ttcgagagcccttcaaatttttttataatttttcaaaattttaattacatttagccaagtttaattttctttctttttttttttgtttgtttcacataaatcctttaaatccttcattttctatactttacaaatttcgtccttatctcacctatacattgtttttttttttgtttgttttttttgctgatgagaaaatacccacaaatttccataattaatagagatgtttcttgttgttagctttaatttatttgatttactttaaatccaacaaaaaaacaacttctttttttagtcctaggaatatg

SEQ ID NO: 103726 - DNA, 78 bp, Heterodera glycines
  Promoter: Source sequence=SeqID_4907; Location=1960..2037; Strand=-; Gene=SeqID_56165
agtgatgtgtttgggttctccaaccctttttatttacatttgcaataaatatttttatttttttagaccttggggatg

SEQ ID NO: 103727 - DNA, 1001 bp, Heterodera glycines
  Promoter: Source sequence=SeqID_11150; Location=919..1919; Strand=-; Gene=SeqID_74501
atccgatccatggcttatatacattttccctttatcttttgtagttgaagagaaaagcgccggagggaattgattattgggccgagatgaagctggcgcccgaatagttttgttttgttattattattatttattgttcttttgcttcattcttttgcttcgtttttttctttggtaaatttgattgtttttttgtgtcttgaatttcgcctttttctgtcatatacgaaagagcagcccaagtttaaaaaatttgtagtgaaaaaagttgtttgactctacgcccatatccaagaatatcaaaatattaaattttccaactttttgccaatttcttcattaaaaatttgggtgaaagggactttgaaatttttgttggcctaattaataatttacttaaatttaaaacgttttgcattcgtttttctgtctgggttcattgccacctgtgtagaagaaaattcaattacctatatttatttttgcaaaaaattacaagcatttaccgtatgctccacctcatttctgccgcttctctgctgcattctttgtctgatcatggtaaaagaatgagacaagtttgggcccctccattttattcaatctgtccatcactttctttatatttagtaaattttgaaaaaaatatttattttccccgccaaatgaggtggaggaaatgtgaaggatttcgttatttcggatcacgcgcaattcaatcttttatatttgacgttcttttaccattttctgactactagtttaaaaatagttttaacaattttgaggacccataacacgcgtcggttcggcttcatccttgattttttagacttagctcgtcaggagctttcgaatgataccaaatttgttcgaaaatttttatttaaaatgtttcatggttgttggactaattttaggcggccaattctatacacagctgagaaaacaccaaattattttttaaattgattccattttagatgaatgttcaaggcatg

SEQ ID NO: 103728 - DNA, 226 bp, Heterodera glycines
  Promoter: Source sequence=SeqID_8973; Location=2087..2312; Strand=-; Gene=SeqID_69872
cctaaaataattaatttaattatgttatttttatggacagttaattgctttcaaatatttatttttccattttactcgattctttttgaacattttttatgcaaaggcacaacagtacaaatttgatggagcttttgtctcaacaatcggcaaagtcggcggcgccggtcgatggcccacaaaaactttggcaccaaatcaatgacgaaaacggcaccgaagcatg

SEQ ID NO: 103729 - DNA, 269 bp, Heterodera glycines
  Promoter: Source sequence=SeqID_8637; Location=3180..3448; Strand=-; Gene=SeqID_68741
ttccgatcggaggttccttcaaaatgcttcggatggattcctttccctctgattcagaagggagtgaaaaatcagtccgaaatgctcctccgttcgtccatttcctcaactcttccggttcgttgttaccttacgccgtcctttcgctgaacaatgaaaggcctttgctcacaaagttcgattcgttcgttttgaattttgtcgttatttccatttcaagtgttcacgcttcttattaagagcacctgaacaaattgaaatgaaaaatg

SEQ ID NO: 103730 - DNA, 543 bp, Heterodera glycines
  Promoter: Source sequence=SeqID_17217; Location=1571..2113; Strand=-; Gene=SeqID_81683
tcttccgctctctctcttggtctctctctttgtctctctctctctctccctctgtctctctctatcatcctgtgttccctttttcccaattacttcctcctcttcctcctcctcttccgaccttccctcttcctctctgtcttccacaatgcttttttgtctgaagatgctcttccgcttcttccccttctgtttttccccgtgctcttttttgtccgctttctcttctgctgcgtctgttttttccaattttctttccgttaaaatttccttttcaattttttgctgttttgaaatttgcaaaaaaaggcgttttaaattgagaaagaaaagaaattcggccgacttttccacgaaaataattgccaaaaagaaagtgacgactgccgaattgggaacaaatcgggcggagtgaaaacaatcgacggatggggcggagagagcggcggaattcggcggcgaacggaagggagggaaatccgccccgggggacgacgaattgggcaggggggcgaacagcgggggaattagcaggcaaaaatg

SEQ ID NO: 103731 - DNA, 153 bp, Heterodera glycines
  Promoter: Source sequence=SeqID_17576; Location=753..905; Strand=+; Gene=SeqID_82084
aaaaaatttattttaaatttaaaattttaaggcacaaatgaagcagacaaaaatggcaaggaaaagagaataaaacatggcaaaagtgcaagtttaatcaacttaatggccgacaaatttaaacttttccgcgctaattcaaattcaaaaatg

SEQ ID NO: 103732 - DNA, 77 bp, Heterodera glycines
  Promoter: Source sequence=SeqID_3221; Location=3552..3628; Strand=+; Gene=SeqID_83755
tggcatcggaagatgggctaatgctttaatccatcaaccccaattttaagagaccatcttcaactacgcgaagaatg

SEQ ID NO: 103733 - DNA, 391 bp, Heterodera glycines
  Promoter: Source sequence=SeqID_656; Location=1..391; Strand=+; Gene =SeqID_58302
ctctctctctctctctctctctcgctcgctcacacacactctctcacactgtccctctctctctcactctctctcactctctctcagtttcacacagatatagagacctctacatacacgtacagacacctgtatatacagattgccccacactcgcactattctcccctccctttcactctccgcaccaccgctctccatcagtgtgtatctgtctcgcactcgctcacacacactctcactctctctctctctttcacacatacactctcatttttttatgtatgtgtatatatatatatatatatatatatatatatatatatatatatatatatatatatatatataatgtttaggtttgataaatttttatttattgatagccatg

SEQ ID NO: 103734 - DNA, 98 bp, Heterodera glycines
  Promoter: Source sequence=SeqID_44754; Location=765..862; Strand=-; Gene=SeqID_72191
aagagaaaaagaaagaccaaacggaaaggaaaaggaagcctcatggaagaggaaaaggaagaggaagagaaaaaggaagattaaagaaagaggaaatg

SEQ ID NO: 103735 - DNA, 92 bp, Heterodera glycines
  Promoter: Source sequence=SeqID_14598; Location=1..92; Strand=+; Gene= SeqID_78676
atcgaggcaaggggatgataggcttggccgttcatttttctttggcaaaacacaattaaaaaaaacattttaaagtcaattgaaaattgatg

SEQ ID NO: 103736 - DNA, 608 bp, Heterodera glycines
  Promoter: Source sequence=SeqID_8892; Location=1..608; Strand=+; Gene= SeqID_69550
actgatattgttggtgccttttgcagcttttccttatggagtttcgtctactctttccccgcatttttctgctgtgtcccttcaccgccgctgggcattcccccgatcgaatttggcacaggaaaaacggcaaaaagaacgaaaaaattataggaaaacgccattaaagcagtagcagagaatgtttaaaaatttgaatcgactaaattaattttattgcatatttataaatttatttatttcaattaaattccccaataatttagttttttgcttacgtaaaaaataatgacgcaaatgacaattattaattagtagtattgttatttgtcagcaatattattatgcataaattcatatttgtataataacaatggcatattagaagtgaatatgaatttacgaaaaataatatatccatttctgggtatttcccctggtgctaaagccatcatttgtgaaggctaaaaagtctgcatttttatttgctaaataataatcaaaacttagcttaaaataatccaatttatcaacctttttagacgcactaattttgtccctaactttttttaaactcaataaatttttttttaatttaacagaatatg

SEQ ID NO: 103737 - DNA, 538 bp, Heterodera glycines
  Promoter: Source sequence=SeqID_416; Location=1664..2201; Strand=+; Gene=SeqID_51900
gtttcgcacttttggttcaaaaccgacgtaaatacatataaagaaacaaattaaaagccatcaatgatgttttttgatgaggttttacgaaatttttgcctttattccgcctagttaaatttgttatttttaaatttttcacgtaaaatttcacgtaactcacgtaaaatacgttatagctaaaaataagtgtcagattcgtgatcagcataaaaaattaggctagaaaaaatacttagaaaaaaattttcaggggggtggcaaaacccggaagtaccataagtgattgattgagtgagtaaatcatttggtttttcattttgtttctcccatcgtcgcccctttttttattaatgtattttattaaagttagggttagtaaacaacaattttccttttttaaaaaaggacaaatgaatagtaaatcgagcagagctgtcaagctgtaatttaattttacatttattgttttaaattgattcatttgttttccatcattaggcactccgttgggccgacgaaaagtgctgtcaaaatg

SEQ ID NO: 103738 - DNA, 92 bp, Heterodera glycines
  Promoter: Source sequence=SeqID_5308; Location=2097..2188; Strand=-; Gene=SeqID_57630
tgcgaaagtaaagccgctatttttcgagacaaacggatactttcaaagtgcatttatatctaaaaaagagttaggaaatattagcacgaatg

SEQ ID NO: 103739 - DNA, 374 bp, Heterodera glycines
  misc_feature (99)..(99): n is a, c, g, or t
  Promoter: Source sequence=SeqID_19242; Location=1..374; Strand=+; Gene=SeqID_83987
gatcaatgtgccacaaaatgcaccagaaatgagtaataaaactattttctttatgaatgatatgatgtttttcttctcctgaagttacaaaaataatancaaattcatttccatattatttacgcttataaacaacatatggcagattaagataaagatcttttaggccaaaccaaaaatttttgtttagtaatttattttgtttattttcatttttatttacaacagtgtccaattttgtggtgtccaatttaccgggagccaataattattgcggggaattatatggataaataaattttatggagttttaaaaaactgaatttcttattcacttcgtaatttcagaatgacttgaaattttgcaggaaatg

SEQ ID NO: 103740 - DNA, 153 bp, Heterodera glycines
  Promoter: Source sequence=SeqID_43067; Location=1..153; Strand=+; Gene=SeqID_70835
taaagttttgtgtgtttcagagcactttctgaaaaaatacttatgaattaattttgcaaaaaataaataattaatgaaaaagtcagaatttcgaaaaattttaaaaacaacaagcgttggcattttttcaggttaagttagtcctttacaatg

SEQ ID NO: 103741 - DNA, 131 bp, Heterodera glycines
  Promoter: Source sequence=SeqID_22386; Location=317..447; Strand=-; Gene=SeqID_53055
tcattaatcagtcaatgaatgtttggctatacaaaatttaaattaaaagaaacaatttaaattcttacacatttttgtgaattatttagtcggcgattaatggcaaaatcaatgggcttggtgccgccatg

SEQ ID NO: 103742 - DNA, 128 bp, Heterodera glycines
  Promoter: Source sequence=SeqID_24687; Location=1..128; Strand=+; Gene=SeqID_55431
acatattagattcccgaggttcctttacggactaataatcacaaaagtcaaatttatgaattcataaaataataattcttgtattattttgtaaaaaatgcactagaagagttaaatgaagaaagatg

SEQ ID NO: 103743 - DNA, 563 bp, Heterodera glycines
  misc_feature (34)..(34): n is a, c, g, or t
  misc_feature (77)..(77): n is a, c, g, or t
  Promoter: Source sequence=SeqID_28699; Location=1..563; Strand=+; Gene=SeqID_59280
atttttaaatctggtgaaatttaaagtgaattanatactccaaattaaataataaaattaacaaaataaattaattnatggaattttttgtaaattagtaagattttttaatataaattatcattttttatagacaaacattctgcttcccttcattgcaagaacgacaacaataattcatcacaacaaattggcacatcaacaacaacgaaaccatccacaaattatgccattcaaaaggcacaatttttttaattgtgatttttcttttcatgggctaaaaaattctaaaactaacatttttaagcagataatcattaataataactaaaattctcatttttcaaatttttctttagtaaatttctcgggcatccagaaagaaattgcttggattgaaaactctttttttattccaatgaaattataatattttgatttaacaaataacttcattggtgtttcattaatttttgactcaaaaatgtaagaaatgacaaaattattgccaaaatcttatggaattagcttaatatgctttataatattaaaatgcccaaatg

SEQ ID NO: 103744 - DNA, 118 bp, Heterodera glycines
  Promoter: Source sequence=SeqID_23797; Location=1..118; Strand=+; Gene=SeqID_54497
cttgcagcgtggaacagcaagttgtccagtgtgcggaccacatcggaccgttgccttttgccaacgaccgttcaatggcacggctgtcgacaacaaagttgtaactgacaaaccaatg

SEQ ID NO: 103745 - DNA, 114 bp, Heterodera glycines
  Promoter: Source sequence=SeqID_10196; Location=2323..2436; Strand=+; Gene=SeqID_73306
acgagatgaattggctgctgaatgcctaggcctccgccgttggcacggacttttcgcaggaacaaatcaatgccgcaaagggcggcgtaatggacatagaaagtgccaaatatg

SEQ ID NO: 103746 - DNA, 145 bp, Heterodera glycines
  misc_feature (89)..(89): n is a, c, g, or t
  Promoter: Source sequence=SeqID_3673; Location=10237..10381; Strand= -; Gene=SeqID_51390
tcttctacgttttttaaaaaataaaattgattttatatccaactttcgaaaatatttttatttaataaattaaaattacaaactctttncgtggaatatgcatttatttttgaataagttattaatcatttttcaggaccagatg

SEQ ID NO: 103747 - DNA, 1003 bp, Heterodera glycines
  Promoter: Source sequence=SeqID_5067; Location=1685..2687; Strand=+; Gene=SeqID_56781
tttggggttttaaggcagggttcggatctgtccttatttgtaagatttgcccttatttcggctattgttcttattttgttcttatttcttaaatatattcataatttggaaatttatggccaaatgttcttattttacctataaattttaaaaaatttccaggcggcgcctatcggcgccaccggacgcccctgtccaacctccaaaatttttaaaaaaatatcgcaaaaaaagccttttacatttaaaaatggtcgccaattgtctcaaaatcgcaaaaattgataatttttgatgaaaatctgttaacaaatcaaagaaataacaaaaattttttgtgtcggcgcctatcggcaccgccggacccactcccctcccccgttctccaaaatttcttagaaaaatgtgccgtaaaaaatttgttaaaaattttattttttttagataaaaattgcactaaatttgctatttttctccccaaaattgttaaaaataatcatgggaggtgaaaaatataatatttgatacatttttgatcgaataaattgtaaaaatatctgatttgaagcaattttgcgaaatgttcttatttttgaccatgaaatcttgttttttggccttaatgttcttattttgaaaaattttcgatccgaaccctggtaaattttacacccataaaaatgaagctttttaatgcctattttccatttttagttattttttcttcatcatccatacattaattactctcttttcttttgatatgaaattttccaagaaattatttagttatatttattaagcaaataatctaaaaaatcaaagaatgtcctgcatttacataacgtgtcctaattttgaaaaagccaataaacaggcgaaaatttttctaatttacgtcatcaaatttatggattatttttaataatatattcaaaacattaaacaaattctgccaaattgtgcattttatttgaaaaattagtaatattttaaaagaatg

SEQ ID NO: 103748 - DNA, 638 bp, Heterodera glycines
  Promoter: Source sequence=SeqID_5783; Location=1859..2496; Strand=-; Gene=SeqID_59208
atattttttaagaaaatcaaataattcatttttatattttatttcaaataaatattcctcgtatgataaaaaattttttataaatacgtgttaatttatttaaatagtatttgttaattaaatattttatggcttatctttggacttcctcattcaccaacagagtttccgattaaaaaatgcttttttcgtccccgccaaacgggaaatttttcttcgcgttcccgcaaagtctcgtatttccgcaaagcggaaaaattttcaaagaacaaaatttaaatattaatttatttattttaaattcagaaatttgctgcagaattgttgtcacgatgaaaataagtttaaaatttatttttgtttttttctggtgtaaaaaatatgtgaattatacgaaaaattcatcatgcttaaaaagcacacatacctcctacctatatctgcatatatgttatagagaacaagagctttcggatgagctattgatatttaatgtagttgggggcattggaattttttagagcataccacgtaacatcgtagttattactgttcgttctttgtttaatgacaaatctttttagcaaattgatcgtaaaacataagaatagacaaataatctatcatcgagaattatg

SEQ ID NO: 103749 - DNA, 225 bp, Heterodera glycines
  Promoter: Source sequence=SeqID_1889; Location=2678..2902; Strand=+; Gene=SeqID_76578
agctaatcaccatcaatcgtccgcaatgacgttaaactagcctaagccatcaacaactgtccgaaacgctaatcacccggctgccacaagtccgcaatgacgttaaactagcaaagcatcaattgtccgcaatgacgttaaactagcaaagcaccggccaccaaacaaccattgtccgaaaagacgctaaactagcaatccatccgacggtcagggtccgaaatg

SEQ ID NO: 103750 - DNA, 246 bp, Heterodera glycines
  Promoter: Source sequence=SeqID_15404; Location=1..246; Strand=+; Gene=SeqID_79668
aacaaaaaatggcagaaaggttaaaaatttatatcatcctttataatttttaaattttctataaaaaaatattttgttcatttggttagatgaaaaaaaaaatttttttttgtccaaatttttttttcgcacttcttatttaactaactaattctgattttcataaattctcgaaaaatgttaatgaaatttctcgttaatattagtaaattaaattttcatgtgtttaatttggggtaaaatatg

SEQ ID NO: 103751 - DNA, 465 bp, Heterodera glycines
  Promoter: Source sequence=SeqID_14002; Location=2937..3401; Strand=+; Gene=SeqID_77971
atcccctcccatctgttctcatttttcaatttatttttgacatacaaacatcatttcttataaaataaaaaatttccatctcttcccccctaagagcggccccctcccactgatgggaaaatcaatttgagattaaaataataaaattaaaaaatcgacgcgaaaattcaaatttgaatttagcgccaaaaattgtaacaaaagtacatgggtcactacttaaataaatcgatgaaatggtcaatgaaaataaaaataatttttaagaaaccgaaattttaaatttattttaaaaaataaaccaaattacctccgacaccatacaagaaataaagctgaacagaactcggtaaattagtcatagtaactcaaacttatcttttcgtcagttgcagcgtggaaatgttgagtcaactgaaagaaacttaataaagataaacaattaaacagatttgataaaagatg

SEQ ID NO: 103752 - DNA, 58 bp, Heterodera glycines
  misc_feature (45)..(45): n is a, c, g, or t
  Promoter: Source sequence=SeqID_10035; Location=1..58; Strand=+; Gene= SeqID_73092
aaattattattttgcgcaaaattgtccctctaaaatttatttttnagaaaaaataatg

SEQ ID NO: 103753 - DNA, 369 bp, Heterodera glycines
  Promoter: Source sequence=SeqID_22543; Location=2213..2581; Strand=-; Gene=SeqID_53212
tccgtatgggacgggcctcgtttctcctctgcccaccgagaattttttttttcaatttttcaaatttattgttagaaataaattttcatgaataaaatgttagaaattttttttataagaaaattctaagaaaaaaaaacttcaaaaaaatttgagcgattttttggaattttttttgaaaaatctataattcgtccataaaaataatttttcgaaaattttggaatggaattcacttaacttatttgctttaaggccagttcattgaatgctcgtcggcatccgccccctccgcctttatttctctcaaggccgcaaaatccgttaaatccgttggcgctgctatccaccgccaaatggaccaatatg

SEQ ID NO: 103754 - DNA, 281 bp, Heterodera glycines
  Promoter: Source sequence=SeqID_5637; Location=1566..1846; Strand=-; Gene=SeqID_58728
caaacctgctcaaattgattgccgaagtgcttcgcagttatccaaaggtggctgttcctattttcatcgagcaatccctcggcgaccaatcggttcttcgctggatcatcgaacgtttcctcctatccgctcccgtcaacgatttgtccgacaccgcccactgggccaaagccgtggtcagcgagctcgtctcaaattcgtcaggtcagcgcatcaccgatcatgtcgtgagcaacatcaaatcacttctcatcgaatgtggcgactttgactgtgcgatg

SEQ ID NO: 103755 - DNA, 516 bp, Heterodera glycines
  Promoter: Source sequence=SeqID_24965; Location=1..516; Strand=+; Gene=SeqID_55700
gcgccaccgggaaaaattggaaattttgaccattttaaaacagattttcactgaaaagtggcaatttataggtcaaattttgaaattttaggggaattttggaggccggcggatatcaatagtgccgctataaatttgaaaaattgggagtttttggtagcaattttacataaaaatggctatttttgctgattttttccaaaaatcagtaaatcatgatctcaaaaaataaatcatcattgagcagttgaatcaatttttccttgttttcgacaaatataattttaaaattatctccaaagtttttgttaccactttttatctccaatttttgggctacaaaaccttccattttaaaaatatggaaaaacaaatgtcaactctttattatttacttaaattgcttattatgaaaattttagcacattgtccgaccatcattcatcagttccagccttaaaattgatcgtcgaatggagttcgtcagttcgtcatgaatttcagcgagttccgatg

SEQ ID NO: 103756 - DNA, 240 bp, Heterodera glycines
  Promoter: Source sequence=SeqID_17272; Location=1135..1374; Strand=+; Gene=SeqID_81737
atcgtcataaagccaatatgccggagattaagagttcaagcttggaatgaaaagaagacctgatgtatctgattgtagtgtagaaacgattgatcaaatatgataatattaaggatcatgatttcagataaatataactgtaatcatcaaatttcaaccatttagggtattattaccctgttaatacttctaagaatcaactgaatccgatgttctgtaattaatatattcagcgacatg

SEQ ID NO: 103757 - DNA, 399 bp, Heterodera glycines
  Promoter: Source sequence=SeqID_3718; Location=1297..1695; Strand=-; Gene=SeqID_51604
tcttcacagcaaaataataagacaaagaggcgacaataagcaaagcaaaaggaaaattcgcattttataaaaattaattaattattttaattgctcgtttattgaaaatttctaaaaaaaataacaaagacaaattgctgattaaaaatataattttttgcgtaaaaagaagtgtgtattttcctaattgaggtttttattccattatttgtacagtttgaaacatttattctcagagttttacccaaaattggccattttgaatacgggaaaacgtgaccattgttaattaataaaaataataagtttaatgagtttgtcggcgccattttctttcaatttatagcaaattcaaagtgaccaaaacttgatttgtgtaaaacaagtaattaaaaaatg

SEQ ID NO: 103758 - DNA, 700 bp, Heterodera glycines
  Promoter: Source sequence=SeqID_28946; Location=785..1484; Strand=-; Gene=SeqID_59519
aaaaatatccagcgaatttttatcatattttttcgtcggtacaccaatttattatgattgccccctttttgatggcttttttataacgactagagctcggcctggacctggatccaggcctggatttttcctggacctgtattttcctggatttttgtacaggaaatccaggtccaggtccaggcttttttcaaaataccgagctctaataacgacatagcaccgggctgggttacctatgttcggacttgagtaaagtaagtgatttttgctgtattattttttcatgtttattaagcatttaaatgaatttcaatttagaattaattaaaattaatttttagtaaaaataagaatttaaaaaagaataattccatttatcccccggggggataaatagagacgggaggattatttttcaacctcttcagaaaggggggcataattggagacagcgggattaatggagacagggccttaattagagaatatacggtaatttaaaagttttggcttggcatatccccttttggagataacaaaaaatcagcacaaatgcacttaaatgggccaacattttttgtgggaatgatacatatagcacagggatggcattccgaggccccaaaaattttttggaagtcggaattccgtgtcatccctggtcgtaaaataatgccaatttcagtgtgatcccatg

SEQ ID NO: 103759 - DNA, 102 bp, Heterodera glycines
  Promoter: Source sequence=SeqID_1518; Location=4056..4157; Strand=-; Gene=SeqID_74151
tttattagcccctcttactgttgaattgagtttaatttttttttggaaaatgtgccaaataaattattaaaaaattctattttcccccctggcacataaatg

SEQ ID NO: 103760 - DNA, 69 bp, Heterodera glycines
  Promoter: Source sequence=SeqID_39475; Location=1..69; Strand=+; Gene= SeqID_68040
attttggctaacgagaatttggcggcggactttaactacgccgaagttgttgaagcgacgcaaaagatg

SEQ ID NO: 103761 - DNA, 78 bp, Heterodera glycines
  Promoter: Source sequence=SeqID_20775; Location=1..78; Strand=+; Gene= SeqID_51336
aaaacgctaccgaacaaaatatgagcaaaattgaagccatttcgtgtgctaattgtttaaaagaaaaggccgaaaatg

SEQ ID NO: 103762 - DNA, 147 bp, Heterodera glycines
  Promoter: Source sequence=SeqID_20098; Location=1769..1915; Strand=-; Gene=SeqID_84882
aaaatccgaaggtgtcggaacaaatgccaccattggctgtagccaatatttattacattagcattgccgaacagtttaattgaagttatcaaaaatcttaacgaaatttcgaaaagtttttggtggcaaaaaggtgaaaaagaaatg

SEQ ID NO: 103763 - DNA, 440 bp, Heterodera glycines
  Promoter: Source sequence=SeqID_8970; Location=1359..1798; Strand=+; Gene=SeqID_46681
tgaccagcagcagcggtggcggcgccggcgatggaggcacggcagcgccggtggcatcggcaaatccgcacgacccaaagcgggtgagaaaagggcaatggtagggaattgccacaagccaaatttaatgaacacattcactgaagagaaccgataaaagcctttgttgcaataaaaaaaatggcatttgatatttttaaaattaaaattgacaacatttttaatatagtgcagtattttcagttgcttctcaaatgtgcgcacttcttcaaatcgctgtcacgttttaaaccaaactcttctcaggaacaacaccaacaagtgctgcaactgttgagagtgagataatttagccttaacactgaagttattgaatcgagaaataatttgaaatattttaatttgattacttttgtcaggagggcgtcacaagtgaaatg

SEQ ID NO: 103764 - DNA, 86 bp, Heterodera glycines
  Promoter: Source sequence=SeqID_5237; Location=1123..1208; Strand=-; Gene=SeqID_57391
ttgtggtgttccgctgcttcgagggaatgtcccacgtgggggcgccgttcgcaaaatgcgaggaaagcggcaaatggagcgcaatg

SEQ ID NO: 103765 - DNA, 299 bp, Heterodera glycines
  Promoter: Source sequence=SeqID_1803; Location=1071..1369; Strand=-; Gene=SeqID_76066
tggttgttgatgatgattttgcaagaatgatttgattgtgtgagaaaatctcggcttaaatagctttcaaaagtgggcgtggcctaattttctgggagtataaaagccccagcaatttgtcagctatgtctcatttgttctgctacaatggtccttgtcatcgaattttgtgcccaaattctcggctgttccccgaaatcactccgcgacaagctcaatcatcctgaggaccgagtgaaggcactgaaggagctggtcggaaaaaggttcggacgacataccaggaccggaatggaatg

SEQ ID NO: 103766 - DNA, 354 bp, Heterodera glycines
  Promoter: Source sequence=SeqID_2419; Location=9659..10012; Strand=+; Gene=SeqID_79627
cgtaaatgaagccaaatggagtacatgcagggcacgtacagcacctaattgatcccaattaataaaattaattaattaacttatttatttatttatttgaaagaaattgcttgtaccgtgttctggtttacccgttacagtagcccaagtaatgctcaatacggtaactaattttcaacccaattacataataaatggcgcacaatacgcagatggcgattgactcgggcacaaattgccttttctccaacggaatggcgtcgatgtccaacccagtgcaattgtaaagcctttcgtactccgcgtgacggaacagaaacagttccattgggtcgctttgaaaagaaatgaatg

SEQ ID NO: 103767 - DNA, 627 bp, Heterodera glycines
  Promoter: Source sequence=SeqID_10196; Location=794..1420; Strand=+; Gene=SeqID_73307
tcatcggacattggaaatttggtcggtgccataatttgcgaaaaaaatgagaattatacaaaattttgaatatttaaatcttggaattaatggttgtcggattttctttttaattacttaattaaatacacatcaaaaaccacttacatgtatttttataattttcaaaaaaaacacaaaattttttttaataaaaaatttttttttcttattcaagacccacgccgttgccttttgtcgtattgtttctgctgcccacccgcgcaagttggttttggtcgcgtccggttgagaacagcgtgcacttctcggtaaatgagcaaataaaaacgaaaatttcattcaaaaacttgtttttgacttatcatgaaaaatgggtccaaaaaaatcaattatttaaatcttggacagaattttgagaataattaatgtcctgttttgccaagtagcgccggtgtataaaattagtttttttttttcaaaatttaattttattattttttttttgttccaatagctttgcatcggcccacccttcccgaacgtgacacttgacaaaaaacggagtatttttcggatgccaaacggatcatcgattacgtgttggtctacgaggagaaggaaatg

SEQ ID NO: 103768 - DNA, 228 bp, Heterodera glycines
  Promoter: Source sequence=SeqID_22850; Location=1492..1719; Strand=-; Gene=SeqID_53559
tgtgcgcgcccaactcactgctgtccattcgaaatattgaagttcagctttttccacgtcaactcgattttttccttgacgcctaccgcaaggcgaccgcccgcccctatggctatttgctaatcgatatgcacgcatcatctgatccatcgcttcgcctccgcaccaacatatttaaagaggagcaggaggaggacgagggaacagttgtgttcattcccaaaaatg

SEQ ID NO: 103769 - DNA, 1003 bp, Heterodera glycines
  Promoter: Source sequence=SeqID_30848; Location=6..1008; Strand=+; Gene=SeqID_61242
cgtcccccgtgaaatttgcccctcgccacttatagatagcattttactttttggtttttgttttttcaaaaaaaggcaaatttaatcccaaggaaaccaaaaatattgaagatttaataagccacattaatatatgtagatatagtttaaaaatcttttggattattttaaaatttgaacaatgccaagaatgtttaatttggttttgcctaggaaaaaaattttgataataggttgggctagtcaattaaaataagattttgaggaatttggaagcttttggcaagaacaattaccaactcatttgtcagacaaaaaatttctcgaaatcgtcaattgggttgttagagatttcataaacccgtcaaaatgaaagtttattagagaaaacaaaagtttcatacatttctaaatttttcattcttgatggtacacaattggcacaccaaaagttttaaatttaaaatattagtccgaattttgcagaaaatcttacttttttcatgataaggcctaccagtatgcaaaattttagttttcaatttttaaaattaaaaattcaaattctattcatcatctattcccttatggactcccttctgttttctcttttaccatttttgcattagcgtcaaaattattgtgcaaaaatataattattttattatatttataagacaccaaaaaacagaggtaacaaaattaattaaataatcaattgaagcaattttttttttgcaaaatttgcaagagtaagcttttttgtttgagtaaattcatctcatacatatgtaaataaacgaatctgaattaaaataattttttttttgttatttaaaacgcaccaatttgaattggtttaaaaattaaatttcataaaatgtttaaaacattccagcaatacactcaaaaacgcttttaagataccattggatttattaaagaaaaccaacaaaagcattcaacaccaaaaaaaccagttacaataacaaagcccaaaatg

SEQ ID NO: 103770 - DNA, 270 bp, Heterodera glycines
  Promoter: Source sequence=SeqID_7377; Location=3141..3410; Strand=+; Gene=SeqID_64651
aatggcacgccaggcctctcaatgatggcaaaatgacaagcctggctgaagatggcacttccatcccccgcccccccatatttattttgtcgttgaattttgaatttgccaaaggtggtgacggaggaggagcagcaacagaagccccagcggttgcaggagcagtggtttttcgtgggcagcagcgagtgcgacctgaccgacttggagcagacgcgggcgcttttccgccgcgttcggccgacgcacgtggtcaatttggcggcaatg

SEQ ID NO: 103771 - DNA, 77 bp, Heterodera glycines
  Promoter: Source sequence=SeqID_9154; Location=1068..1144; Strand=+; Gene=SeqID_70418
aacatttgctataggttcaaaatgctgtcgcccaattgttgcgccaacaatttcccaccagcgcgcctggaattatg

SEQ ID NO: 103772 - DNA, 59 bp, Heterodera glycines
  Promoter: Source sequence=SeqID_4690; Location=1..59; Strand=+; Gene =SeqID_55395
tgctttttaaagtttaaaaagtttcccatttttcttttttatatttaacccccaaaatg

SEQ ID NO: 103773 - DNA, 112 bp, Heterodera glycines
  Promoter: Source sequence=SeqID_1113; Location=4671..4782; Strand=-; Gene=SeqID_67990
tgtaaatataattttaattaaaaataaaaagtttaataaaaattaaaattcgaaataagaaataaagacctgtcgctcgtgccgtcttgacaagtgtttgttggaaggcatg

SEQ ID NO: 103774 - DNA, 458 bp, Heterodera glycines
  Promoter: Source sequence=SeqID_4074; Location=903..1360; Strand=-; Gene=SeqID_53061
aatcgcaactctatttttacatcaatcgtttcaaccttgtgttcggcagcagcagcaaagcgacggggggacgacgatatttcaattgcattgaacgcggcgggtcgaccaaatgtccctatcggatgatgtacatgttggaaaggtggaggacaaacacattcaatctttaaaccaggaaaccaagcattttttttcttggtttagacaggtactctaccaaaccggggaacataaccattcgttctcactgttacgaaggcgaaagccgaccaaaatcaacataaagggactgcttccaacacccgaaaaagtgagtcgatgacaagtaaaaacaaaaaggtttattcttcaaaagggaggtgatttcgagttgctgtctcttgccactgatgtcgcacaattggccgaagaattgggcttggaattccgcgaggaaaggtccgtcgtcaccaatg

SEQ ID NO: 103775 - DNA, 282 bp, Heterodera glycines
  Promoter: Source sequence=SeqID_13787; Location=2496..2777; Strand=+; Gene=SeqID_77712
cgtaggttatttatttttatgcaaaatcgttttaatgtttagggtggttttttactttttccgacttgtggagagtgtgcacgtaagtctaaaccggattttgttagggcagaatgtttcaagaagtgcagacactcagcagaaagacggggtttagttggggttttcacttctattgaactccgaaaagcgttagaactcggctacaaaataacgaaattttatcgagcataccattatgagaattttgacacaaatcttttcaaaaattatgtaagaatg

SEQ ID NO: 103776 - DNA, 102 bp, Heterodera glycines
  Promoter: Source sequence=SeqID_3335; Location=1..102; Strand=+; Gene= SeqID_47590
gatgccggacgtatcattccattgggaagcggcgagagcgtgccaaagaggacattgagagccaacgacaaaggcttgaggaagagcggcgaaattgtgatg

SEQ ID NO: 103777 - DNA, 800 bp, Heterodera glycines
  misc_feature (35)..(35): n is a, c, g, or t
  Promoter: Source sequence=SeqID_19146; Location=1..800; Strand=+; Gene=SeqID_83897
atcaaaaataaatacataaaatagggttgcgattntatgaaaaaatcggtaatggagcgggattgtggtgcaaaattcaattttttttcctccgttgaattacgaacaaaattgttgaaatttgtaaagtcgtttcggtttgatatgtacaatatttcaaatttctaaaagaaattttcaaacgtcgagctgaaatttcaccaataatctattcgataaaacaaattttctctaagttttaccattgaattgggcaaaaatttttccgtgtcaaaggatgaaaaatgggaaaaaatacggcgcgaggtatgaagaagtggacaacaaaccattctttttaattacaaaattaccatatttggggaggttgccctcaaaattctcaaactaaaagttttgaaagttaaccgaaacccgaatttttatttataaaaatgaaccaagatattcacaaaattgaaatttgacacaaatctgttacgaaatccgccaaaaattcataatatttcctcgccatcgaccaaaaattcctttagaattttgtgttttgaaagtttaacaataatagaccgcacaaaaaatcaccgataaaatttttggaaaattcggaaattgcgctaatgtaaatgttattattttagattaaaattttcattatgaatgctaatgttgtgcaatatttttgcaagtaaaaataatttttcaacaaaaacgctaaaatcctttaattaagcagtccgctgtgcacttcccactcaattcgttacggaatttgacccgacacatccgcagccagcatg

SEQ ID NO: 103778 - DNA, 565 bp, Heterodera glycines
  Promoter: Source sequence=SeqID_31020; Location=1..565; Strand=+; Gene=SeqID_61376
ctgattttggacataggcgtaatgtctgaacacttgccaatatttggcacacaaaaataaggtgtttgattttaaaaataatttaaaaaaattaggggggggggtataaaaaatagaaatattcatttcaacattttagatatcatagtgataattaaaaaataaattggttctaaagactcaaaatatcatctattacctatcttaaagctatggaatctgaaattgtaagaaattacaaaattttgataagaattcactgaaaaatcataatgaaaatactgagagaattaattattttaaaattactaaaagctcggccttaatcaaaatcccatttctcaatcccgactatttctaaatattggtctaccagtgacagaacaaaataggtgctcgatcgtttcgtaaaagtgccgctagacatttcatcaaaatgccaattttgtgatatctttgcaaaaaagcatactaattaaataatttattttatcgacagaaaataagatttaattttcaaaaaattcgaattgaacccgcatgcaaatactattggttactcatg

SEQ ID NO: 103779 - DNA, 165 bp, Heterodera glycines
  Promoter: Source sequence=SeqID_8151; Location=2084..2248; Strand=-; Gene=SeqID_67144
aaccatttatttatttgttttgcgagtttacaattagatacatttttaaaaactttttttgtcatttaatttgtttgttatggtcaatcaaagcccatgttcaacttcgacacgattctctaatcatttttattataaatatttttaattgataaataagaaatg

SEQ ID NO: 103780 - DNA, 67 bp, Heterodera glycines
  Promoter: Source sequence=SeqID_14769; Location=787..853; Strand=-; Gene=SeqID_78903
ttaattaattattctctcactttgtcttccactttaatactttcggcttctccccttccctcgcatg

SEQ ID NO: 103781 - DNA, 501 bp, Heterodera glycines
  Promoter: Source sequence=SeqID_29261; Location=1..501; Strand=+; Gene=SeqID_59788
caataataatcaaagttaaagatttaatcagtaaaaaaagtttttaaaaagtcatccataggcttattgttaaaaaaatactcgacctaagacgataatattaaaattatgtagatttaattgctaaaccatttgatccttaaatatcaaatgcacgaaaaaagtcccctaaaaatagctataataaataaactgcagaaaatctgagactaacattaaatatacaacaaaaattgattacaatttgaatatgaaaatatcgtttattattgacaaattaaaatcttaaaaaatggatattaatttgagcttatatatatatatatatatatatatatttctacaaattttagtttgcaatatcaatattgaaataagacaagaagataatcaatccttcagcttaagtaaaaatcttttaataaaaagaaaatataaacaaaaaaattcacttggatttgtaaaataaaaagaaaattatttattcagcaaaactgaatg

SEQ ID NO: 103782 - DNA, 244 bp, Heterodera glycines
  Promoter: Source sequence=SeqID_11188; Location=3060..3303; Strand=+; Gene=SeqID_74541
tttcctacaatttaaaaggtattatcaaaggaaaattgtgaataaacagaaaacaacgaaagtaatacgatgaaacgaatgacaaaaaaggggaaaaagaaattctgtaggatatttctgtgacaacaaaatacacaacaataattttgtcaggactaaacgaaagttcatcacaacgaaaagccaaatttgaaaaagcgttgccttattaatatgccctcaaattttctttgtccgacaaatg

SEQ ID NO: 103783 - DNA, 88 bp, Heterodera glycines
  Promoter: Source sequence=SeqID_39790; Location=1..88; Strand=+; Gene= SeqID_68276
ctatcatcagagtcataataataacaataataattataattatcatctgctaattgggaatcgatcatccaccgccaccatcaaaatg

SEQ ID NO: 103784 - DNA, 521 bp, Heterodera glycines
  Promoter: Source sequence=SeqID_6036; Location=1..521; Strand=+; Gene= SeqID_60098
cccttatttaaggccttagtttggactttttcgcgcttaaaaatccgttccctagtcatcattttgcaaaatattctcctctgttgcggttccctttttcttccaatccgtcgtcattttatgccaaaatgtttccgcgccttccgtttttgtcaatgggttttcgcctcccattggcaacaatttaagacgaacaaaattcaaaaattttttggataaaatgtggttttctgtttctttcatccaaagtacaatccgtaaaaaataggaaaccctaaaaatccaggctttatccaacgcaattaattcttctgctatttgtgtgacatcattcggaactcggccaaaattgtgctaattgccacaaaaatgaacagacggtaaaaggattttaaaagccaaacaaattagtcatttatttaactaacaataaactgttttcccacttcagttggatttgcaacgacgtttggatggacattttcccctcttttgaccgtcctcaactcggcctcaaaatg

SEQ ID NO: 103785 - DNA, 93 bp, Heterodera glycines
  Promoter: Source sequence=SeqID_34959; Location=1..93; Strand=+; Gene= SeqID_64639
tttttgcagcactgctcactccaattttgatcgatttggcacgctcagctataaattcgggcttcaaatctgaaaattaatcattttatcatg

SEQ ID NO: 103786 - DNA, 132 bp, Heterodera glycines
  Promoter: Source sequence=SeqID_45488; Location=1..132; Strand=+; Gene=SeqID_72778
attaataatcaaaattctcttaaaattttttgacccaaattcaaaaaaggaaaaaaatttgcagtcaaaaaattattcgaatttctccaattttgtttccataatttccgaaagttattcggtatcataatg

SEQ ID NO: 103787 - DNA, 1003 bp, Heterodera glycines
  Promoter: Source sequence=SeqID_17614; Location=575..1577; Strand=+; Gene=SeqID_82124
tgcacaaatccgaccaatttcagtcctgaacagctactcacgcgaaaacggccccgaccgattcttagggggtctaaaaattttagctctatttgtaataaattgtttgaaatttgccggaaattccctgagaaatttaatgatttttttaaaatcgttaatgggatttggggaacaagctgtgctcctgcaaaacccacgccacaacataaattttttgcctatgtaatcgaatgaatgcatttttctttcgaaaattgtgtagttttcaggattttgacggggatttacgacatccattagcaatattagcaccggcaaaatcaaaaagtgccgatttgctgctgttcctccctcttttctgcttcattctctcctcctttttgcgccgaatttttccttttcctctctttctcttccgtctctcctccttccccactgctattttcatccttttcctcctcttccctcgtttctccatttttgctaccaacaaatgttggatttggttgacaaagaaaatttctaaccttttacttaaaagcaatcaaatttttaattccttatatcattcgatagttctagatgttttctattagcctacagaatttcaaaaagtttcgttaagtttcaagaaagttatgagctaaaatgttgtaaaaaacttgggtttttgagcttctcaagttataacttttttgaaacttaacgaaactttttgaaattttataggctaataaaaaacggtttggcctttttatgtcaaaatgtttccgcgccttccgtttttgtcaatgatttttcgcctcccattggccattggcaacaatttaagacgaacaaaattcaaaaattgttggataaaatgtgattttcgttagaatttttggttttccgcttttctcattatataaaaataaagtttccaacgcaattaattcttctgctatttgtgtgacatcattcggaactcgtccaaattgtgctaattgccacaaaaatg

SEQ ID NO: 103788 - DNA, 142 bp, Heterodera glycines
  Promoter: Source sequence=SeqID_26280; Location=773..914; Strand=-; Gene=SeqID_57026
tgtacggatgtccccgcctcggctgacaaaatcacattgggttaacaaataactattttggatttcatttataatttgtttttagctgcttttaaatcggtgctgaatcgaacaaatttcaaattttattgcaaagcgaatg

SEQ ID NO: 103789 - DNA, 425 bp, Heterodera glycines
  Promoter: Source sequence=SeqID_12165; Location=1029..1453; Strand=-; Gene=SeqID_75738
tctgagaacaaattcaatggatgtagtacgtgcaaatgctatcacagcaaacagaagaactgtttttaagtgcaacatcctatgctctttgccatattagcatttagttcatgccaattattttgtagaattgtaaaaataggctgttgttggggccttcagcaagcctaataaaaaatttaaataattacgaattaatttgttttggcttttaaaaaaatattttggcttgtattttttaatttgttgatgtgtgcttctttagttttgtgtgtctgcggtagggccgaaacacactttttttcttattttttgttttcttttggaagagcaccgcactgacgaggcccactcttccattagaaatttttataacaaaaaaaatttttttcatttaattttttctcaggaattgtccgcaaatg

SEQ ID NO: 103790 - DNA, 70 bp, Heterodera glycines
  Promoter: Source sequence=SeqID_16278; Location=1328..1397; Strand=-; Gene=SeqID_80671
agtcagtggacatgatccgtgctttgagcacatattcaaacgtgtcggctacgtgccatggaagctgatg

SEQ ID NO: 103791 - DNA, 233 bp, Heterodera glycines
  Promoter: Source sequence=SeqID_864; Location=3521..3753; Strand=-; Gene=SeqID_46312
aaggcgccgaaaaaattaaggaatttttcaagcgttttgacgctaataccgctgaatggtccaatgcaaaacgcattacctcattagaatcaaaactctttggtcgggctgagagagcttttaagtctgcgtgttccaccgaaccgtaccgatatgagtccataaaaagagaaatgttttggcagttggaagaaacggatgcccgtgaatggagtgcttttgatcagataatg

SEQ ID NO: 103792 - DNA, 165 bp, Heterodera glycines
  Promoter: Source sequence=SeqID_7464; Location=2917..3081; Strand=+; Gene=SeqID_64903
ttccttgtttatactatggattcgcacggaattccgagttgctacatttttgtgaccggaattccgactttcagaaaatttttaggactcggaattctgatttcccttttcagaaaaatttttgtgccactgagtgcttgcaatccctggtttgtaccaaaaatg

SEQ ID NO: 103793 - DNA, 484 bp, Heterodera glycines
  Promoter: Source sequence=SeqID_5528; Location=1002..1485; Strand=-; Gene=SeqID_58352
ttgtgcacgacaaaagacaaagaaaataattgtgtggtgaatgatatgaaaacaaaaattttgccctttatatacacctcatattttcaattcactcaacagttcgaccgaccgcctttttgttagtttgagcactgctatttaagcggcaaaattttggaaagtttcctactaatttttaaataatcaaaaatcaaagtttgaaaatcaaggattttatgcataaaatttttgtcacttttgtggcactttttcgacactattttagttaactatttcgggatttttcgtcactaaaagtcgcggccctagtaataattggcattttgtttttatgccaaaaatttattggcgattttttctcgttttttactgtccatgatccgttggatccaggtgcagaccgagctgtagtgattttgaacctgacggacggctctttgttaaatctgttttatttagaattatataatccgtgcacatg

SEQ ID NO: 103794 - DNA, 337 bp, Heterodera glycines
  Promoter: Source sequence=SeqID_30228; Location=1..337; Strand=+; Gene=SeqID_60660
aaaataaaaataataaaaagcagctaattatgacatatttaataaaaatcattttataaaatatatacattagatttaaagagccgttaattattgacatttttttatttatactatttcttctttgcttttatccaagtaaattctaaatttttatgatcaatatattaaaaatttacatccaatacaaaagtaactggcacaaaaaaatcatccacaacccaaaaagaatttagaaggcttatataatgggatttgttaaatgatgaattatacctaacaaaaaaaaagtaatttacaaattatttttagcatttttaaatatttcgatataatg

SEQ ID NO: 103795 - DNA, 541 bp, Heterodera glycines
  Promoter: Source sequence=SeqID_8411; Location=3661..4201; Strand=-; Gene=SeqID_67974
aagctcacagttgacccactcgcgcacccattcagatttggatttaattttaggcaatcaatttttttccgaagggatattcaaatcggaaaatatttgacgaaaaatggcaaaatatgcaaaaaatctgaaaatatgcacaaaaaatggcaaaatatgcaaaaaattctaaaaatatgcacaaaaaatggcaaaataagcaaaaaatctgaaaatatgcacaaaaaatggcaaaatatgcagaaaaacccaaatatgcaaataaaagtccagacttttatacgcaaacacaaaaaagaaagtgtttttcctactatttagagcatggaaaagccaggaaaaaaatatgcatttgcatatttttggcagccctgctcattggaaagaaaatacttaaagaattaaaaattttggaaaaaatcaagtacttgatgaaagtcatatataaaatttttggttactttacggtaaagtattaccccgcgcctgttcttaatttaattgtaatatgtacacaaataatggcttattgtgcacaatg

SEQ ID NO: 103796 - DNA, 626 bp, Heterodera glycines
  Promoter: Source sequence=SeqID_3564; Location=3648..4273; Strand=-; Gene=SeqID_50878
tttgtcgattaagagcaattagtaattcgggaacggtgttcttcgccgagaacctaccaaaatatgttaatgatgcggagaaaaatttttctattttttttataattcgcaaaatttatttaaacttcaaatatttaaattttaaacccacttttgatttttaaattttcccagcaaaaaatgaattttttgaaatagtttacccttaattgactgtcggtcgagagcagagagattatctaataacaaccaaaaattcagaattatttactccgagaggataaaacaactaaaattaaaaatcatgccccatccaatataggacggacagctcgctctctccgatagacattaaaagaatttttttatttattaaatttcttacccaaaaattaataaatttattacaaaaattttgaattttttttcaaaaattttattttccataatccaagaaaaggctctcaaaaaattaattttctttgtaattatgtattctatttttgttttataaaaatatattcgaaaattcatttcaaacaaatttaaaaaataaaatatttcatttgccagaaaattcctggcaagtcttttaataattaaaactcttcgaaattcatgacatg

SEQ ID NO: 103797 - DNA, 184 bp, Heterodera glycines
  Promoter: Source sequence=SeqID_18936; Location=1353..1536; Strand=-; Gene=SeqID_83662
aaatcacacaaaaacaatcattgtaccatcaaactcaattttctgatcaagcttaggctaacataattctttaacacataagagtggagctacagtatcgacccttttctcaacgttatagggtcgttacggtaacagcggtgctctgctgtccctccggccacagccgttggcccacggaatg

SEQ ID NO: 103798 - DNA, 147 bp, Heterodera glycines
  Promoter: Source sequence=SeqID_27256; Location=1..147; Strand=+; Gene=SeqID_57945
cgcgtttaatcgatcaaattcagttttgagggggtcttatttgtggctaatttgctttgcaatttgtgcccaaccacaaaaaacacctgttgctgctgttgttgttgctgcgcaactgatgccgtcccgggcgataaatatgccatg

SEQ ID NO: 103799 - DNA, 716 bp, Heterodera glycines
  Promoter: Source sequence=SeqID_759; Location=1..716; Strand=+; Gene =SeqID_60562
gggccaattggggcccggtttcacatttgaaaaaaggcagaccaaaggccgggaaaatgaaacaattcgccaattaaattcagccgggagcgttggacgaagcttggggtttttttccattcaatgggaagagcattgttgaaattggggcgttttctttttccaaaattgaataaagaatgatttcgatttcttgctgggaataattttggtgcgcaagtgggcgtggccaaagtgcactcattgtacacacggtcattttaccgattcattttaaaaattttcacttttcttgcacatgtgctgttttcctctcctcttcctcacttgtcttgtgctttatggggaccatattatttaattgggaattttggggaccgtctaataaaattaatatttttgctgttaaccagggcggtagctataattacaaaaagcaccgtttatcctggcagcaatttgccttttagggcttgaggtcgttcgcgtgacttgactaatttcccgagtcgtttaggtgccctgtcgtcttgtgcttcatgggtggcggtgtgctgctcttcaggccatagttggtttatattttttgactattttccatgcccaaatatttattattcattcaccattttacgtcattttccatgccggcgctcgcatataaataccgagattttactcattcctcctcactccattctcagattaaaaaaatg

SEQ ID NO: 103800 - DNA, 315 bp, Heterodera glycines
  Promoter: Source sequence=SeqID_1961; Location=5791..6105; Strand=-; Gene=SeqID_77036
gaaatcacgccgctagaaattttttttaatttcaaaaaattaagtaatttatcatagaatgccaaaaaaaaattgctgaaaatttttctaaattttttttcttctaattgtagtttattactatcttaaggaggggggcggctgtaattgatgcgctgaaggcgcgaggagttcacacttggaccgtaatttttaaatattttgctagacacttttttgctatgctccccaaacaattgccacaaaaaatcacaaaaaaggaaacttttttgaaaacttttgtactcaattttcagaaaaacattttgaaaaatg

SEQ ID NO: 103801 - DNA, 87 bp, Heterodera glycines
  Promoter: Source sequence=SeqID_4026; Location=1..87; Strand=+; Gene =SeqID_52873
actttttcgttcggagaccgctcatgctatggacatttccttgtttccaaagacggatccaagaatttgctcggattggacatgatg

SEQ ID NO: 103802 - DNA, 118 bp, Heterodera glycines
  Promoter: Source sequence=SeqID_7377; Location=1105..1222; Strand=+; Gene=SeqID_46409
atagatttttgaagggtttttcttcaaataaagttgacgtggtcaagcggaatggataaaagtcatcccataaaaagtcactgttttattttctctgaagcattccaccgaaacgatg

SEQ ID NO: 103803 - DNA, 460 bp, Heterodera glycines
  misc_feature (34)..(34): n is a, c, g, or t
  misc_feature (50)..(50): n is a, c, g, or t
  misc_feature (88)..(88): n is a, c, g, or t
  Promoter: Source sequence=SeqID_14527; Location=1414..1873; Strand=-; Gene=SeqID_78581
cagaatttgcatattttaatttatactttttacnatgtcggtaaatcttnatgtttttggaaagccgatagagcttgttaagagcttncgaatgataccaactttattggatttggtcaacaaaaaaaaaagttataattgcgatattagagacgaaaaatttcgaaaatatgtagttaatcttgaaaatcggcaaattttaaattttcttgcatgagggtcgatttcgagtacataggtaggtgccaataagtactaatccaagacccgggactggtcccggtcccggtcaaaaccgggacctcggtactcagtttaatgaaaatacatcaaatcggattattgttcgggcatttttctccccccatccgttcatccgttttcaaatctctcacttttattttagtaggtatataaaaaggtcgaaaagacatttttgatgcagaatagcgaaaaaatg

SEQ ID NO: 103804 - DNA, 109 bp, Heterodera glycines
  Promoter: Source sequence=SeqID_34813; Location=821..929; Strand=-; Gene=SeqID_64503
ttttttttttaaaaaaaggggaagaaaaaatatttttaaaaatttttaaattccctttttaaacaggcccaaaaagttttgggtttaacttttttttttcagaaaaatg

SEQ ID NO: 103805 - DNA, 104 bp, Heterodera glycines
  Promoter: Source sequence=SeqID_5728; Location=356..459; Strand=+; Gene=SeqID_59048
tttcgccgctctgaacggcatcatttacgtggccgagttgattttgtcccaccaattggccgacattgtccgtccttgatcaattaatattgtaatataaaatg

SEQ ID NO: 103806 - DNA, 95 bp, Heterodera glycines
  Promoter: Source sequence=SeqID_18686; Location=1..95; Strand=+; Gene= SeqID_83351
tgatttgctcacagatttcccaagcaaattttgactacgaatctgcgtcagtgaatgcattttgcgatgtttttccaactgtcaaaccaaaaatg

SEQ ID NO: 103807 - DNA, 712 bp, Heterodera glycines
  misc_feature (47)..(47): n is a, c, g, or t
  Promoter: Source sequence=SeqID_17362; Location=1..712; Strand=+; Gene=SeqID_81845
agtgtccataaatttctataaaattggctgaagaaactcctcgaggngtgataatttaaaaaattatcacgtcatttacctttaaattttttatcaatttcaaaacatatgagaaaaatttttgaaccctttgttaccaagaaaaaccattttatagaacagtcgaaatcattaatttatatgattttttttattatcactaaaagtctcaaaaacaacaaattaaactaaggatttatggacattgataaaaacggcacacgaaaaactcattcttcattgtcaggctaattgtagactaaaagcaaaaagtaaaagtttgaattctaaattttttgttcaaattcaaagcccgtaaagaatcgcaaaaatttggcagtttttaatgaaaatatgttaacaaattgcactgaattttcaaaaaaaatttctggcgacacctagcggcaccaccggacgccgcaaaaaaaaaaggtcgtcaatttcatggctggaccatttcgcaaaaattttggttgacccccccccctttttttcatgtatgttggtggaattgtcatgtaactttgtgtttcccctttaatagttgttgcttggtgagctcaaaacagaattggatgcgttcaacagcagaaccaccggcagaacggagaatggcactgttaagccatcgctgatttgcgggaaggaggaggaagagacggagcaaatg

SEQ ID NO: 103808 - DNA, 674 bp, Heterodera glycines
  Promoter: Source sequence=SeqID_20217; Location=1467..2140; Strand=-; Gene=SeqID_85017
gataatcatcgatggcacgactttcctattttgttaaacactgcggagttcgcttttcgcctctggcgccaaattcgctcaatggcattcgaattcagcagaacgacaattggcatttgctctgatcagtcaaatgttcccaacgagtgatcactcgtcgcttcgcctttttcgataattaatcacttcaaattcacttcatcattttatcaaattctctcattttttgtccattggtcaattaaaatcaaattttataaaagaaaagttcgttttttaatgtctttttttctttttggaaagtcactttttcaggtcgccctttcctcctaagtgtgcgccttttgccttttatttgctcacttttaagtgaattctaagcccaaaaaagaagtgtttaaattgtcattttaatttgtgaatttccatttttgaattattttcttttaatttttatttttttttctcatttttaagttttcggcattctgctggaattccgaaaatgttatgagtatcccccctccctcttccccattcccttttatttgtttatattttcgtccgttttttctccgttcatttccccccccccatttttaattcgtttattttgctaattattttatttttattcgctaatattctaaattgtgcctatttttcgtcaaatg

SEQ ID NO: 103809 - DNA, 1003 bp, Heterodera glycines
  Promoter: Source sequence=SeqID_17970; Location=308..1310; Strand=+; Gene=SeqID_82538
caaaaagcagaaattttttgggatacattttcaaacaaaaataaattctcaaaaatcctctaaatatgtaaaaaaaatgaaaatatgtacgaaaaatgcgaaatatgtataaaaatatatacatatgtaatatgtataaaaaccccgaaatatgtaaaatacgtaaataaaagtcccaacgtttgttcacaaacacacaaaaaaaattctttttcctactattcagagcatggagaagccaggaaaaagaaaaacatgtatttacataaaaaaggaagcccgatcagacaaattttagggcattttaatatttctaaaaaattgatcaatgcgcgtaaaaattggacaaagttccttaggggcatggtgatgtaatgacttttgcttgagagcacattcttcccttctgcagctgattgtgagaccgttccatcacattaatttaattactttcgttgattgatcactctgtcattcgttgtcccccggcgggcgatggcgagaagcccacacggaaaatacggcgctgaaaaattgggtgctaatcattcattcattcattgatcatgttatgctaattatcataattttgttgcaaaattttattgtaatttttgcgtattttaatcaatgccttttgtggtgatcaaaagctgatcaaattcttgcactgattctaatatttcgcgatgaggaactatgctaatcataatacctttttgctgataaaattatcgtaaaatggtcaaaaaaactgatcaaataatttcaattatcgtataattcacaaatgatcaatagtaaactcaatagtacacatttttgtgaaagccgaacaattcaggattaaaaaataacatcactttcttttgatttccattttcaattaaggaattgcgggcattttgcatttttatttaccgatttcctgttttcaaaataatctgactgatcagtttgcaatttttagcatttttcgggcatagagaaggccgccaaaatg

SEQ ID NO: 103810 - DNA, 293 bp, Heterodera glycines
  Promoter: Source sequence=SeqID_7486; Location=1..293; Strand=+; Gene= SeqID_64966
aaaaaaagttttgacctgagaaggtttaaaaacccaatttttttttaccatttttagtcatagcttttttgaatcttatgggaaatttttgaaaattttgtagggtaatagaaaacccttaggcctatcgaatgatatcaagaattaaaaatttagatgcttttgagcaaaattatatcaaaaaatattttcatttgatggttttttgactaacgtcatagcaccgtttaatttcatttttaatttacatttttcatcataatttttttttcttcagcaatatattgtaaatg

SEQ ID NO: 103811 - DNA, 1003 bp, Heterodera glycines
  Promoter: Source sequence=SeqID_5045; Location=999..2001; Strand=-; Gene=SeqID_56700
aatgcaataaataatggacgttttctttttattgtgatcactgtaaattttgaaattgtttcactttctcctacgacaaattttgcaattaaaactttcagcaataatttaaagcaaaaaataaaaaacaaattttgggatagaaaaagaaatattaaaattgatataaattattatgagaaaaaaggcccataaaacacagctcgttcatgcctcctcggttgtcaagcggcgaagacaatgtatgatcaactgttttgaataataaatatcttcgaataaaatatctatcggttttttgaattgtccttggttggagatagacaatccgaacattaaaattgttgtagaattttaattataatgactcattagtgttaattaaatttggcataatgtcttgtttcgcgttttttctcacttaaaattgtattctttgttttttttcttctatctttcataccaattttattatctggtaatttttattgttttgtgccgtccaatttcttttgactttaaaattgatattcgtcaaattgtttctcatcgatatttgtcttttggaattaaagtgtttggatttgacagtggcctactctgtgtttggtataattgcgtccctgtcttaagtcagtagcaaaagtacaatttggcgctcccgaggaaacaggtacaaaagcggcgatttttaaagagtttgagggtgagatcgggaataaaaaattttttcggacgggttttaatttggagtgtattaagtatcagtccggaccggacgatatttaagttgtgaagtggaaattgactattccggatcggaaagttaaaaaaagcgacaaaaaactccagcgcaccgaaaaatttattgtttatcagaaaatttgagttcgggccgaacctttttttctgtctacatcgccgtataaactattgacaccgggtcggtgcttagtttttctccgtcttctcgccgaatttttacatttgacttcgctggatg

SEQ ID NO: 103812 - DNA, 1003 bp, Heterodera glycines
  Promoter: Source sequence=SeqID_661; Location=4677..5679; Strand=-; Gene=SeqID_58494
tatttttattcttattttttgtttttaaatatacgctctctcccgacattcgtgcgacgcgaaattgagtgatatgagcatgcttatcaaaataaagaaaatttttaacttttggtataataaaattttaatttaaaaatgaatttacgaaaaatcattttagaacatatttatttatttgttctttaataataatctatagtatccaatatgattgatgtccaattttactttaatattggatttatttaatatgaattgattatttatattttacatttttgtaattcaaattgagctcgttcttttcccatttaagacaattgctattcaaatttaagtcccctaaaattagattggtcaattattttcatacttttgataatatataaagtgcgattgggaggtctataggtttaatgtgagaatcctttagatatttctgaatatttgataattttctggtaatataaatttaacattgaaaaattattatttaaacgtgatcggtcaaagtttggttttaggtattggtaaaattacatgttttcaaatattaatgaaaatattaaacattgagtagcatcttttaatattttatttatttaatttttgatttcaaataatttaggcaaacatgatattaaatttatacaaacttccacagattagattttatattgctccacgacagcagattaattaatcgttttatttatagctatgtgcttgccaatattattttaaatgtccacaaatctctccctcgtgatgaaatatcactctctctagataaatatctctctctctatcgctgcgatttgttttccttttggtatttttaattttttaggcttattttatgcattggttttaagtagattttatcaactaattaataaaactgaggaggaaacaatttcaatgaatcaatttcgaaaaataattgcgaattagatttgatgaagtaacaaaattaatgctggacgcaaaaattaatatg

SEQ ID NO: 103813 - DNA, 591 bp, Heterodera glycines
  Promoter: Source sequence=SeqID_1535; Location=5893..6483; Strand=+; Gene=SeqID_74314
tttcgctctgtccgttccagctgtcactttccctctatcctttctcacattatcgtttctctatccttttgcgcactgtatcttttcccagtgcccttcctgttgtctatttcctctctaaccctttccgctctcccattttgtcctatctcttttacagtcatttattatacttttactctcctcatcatcgaatattattaatgttcgcaaaacaattaaaaaattgttattaaacaaataaaaaataaaaataaaattcaaaataaaattcaaaataaaaataaaattaattaaagagattaaaatcataataaaattaattaaagtaaattaaattaaaaataaattaatattaaagttaaattaaataaaaataaattataaaattaaataaattataactaaattcaatttgttcgactataaataggaaaaattttctcccattattcatttaaaatgttttttccaacaatcaaaaattgcgttgctgttgtagacaccaaaacaactctcgatattgaaaaaatttatttaatatcaccctccactaaatataatccacgtaaaattcatgctgtaattatg

SEQ ID NO: 103814 - DNA, 55 bp, Heterodera glycines
  Promoter: Source sequence=SeqID_16773; Location=1..55; Strand=+; Gene= SeqID_81180
ctgcctccctccccaaaatattttaaaaaatcacagatattttgtccagtctatg

SEQ ID NO: 103815 - DNA, 250 bp, Heterodera glycines
  Promoter: Source sequence=SeqID_70; Location=1063..1312; Strand=-; Gene=SeqID_61212
tggcgcagagcggtttcaccactctctccgctccaaccaaacgaacgtttccgcgctgaccaattcgacgatggacagtttggcccagtccaaaaacttctctctgtatacttacaacggggacaagtgcattgtttgcacgtttgggtcaacgacagccgccgcgccattgtctgtcgcagaaatggccgagtgccgagcggtgaattggcggaggggggggggataccgaatccccaacttttgcatg

SEQ ID NO: 103816 - DNA, 487 bp, Heterodera glycines
  misc_feature (27)..(27): n is a, c, g, or t
  Promoter: Source sequence=SeqID_11319; Location=1923..2409; Strand=-; Gene=SeqID_46948
acacaccttaccattttaaaatacacntcgagccaaaactacattgacctgtcaaagtgttaccttttgaccgaatttcgaatgcgaaaattgacaccaccaaatggtgaatggggacatttggatgctaatgatcaggttgtaccgatacaactgattggacacacgttcatacgagacatgaaaattgcaataaacggtcgtgaaattttcaattcaaattcactgatggcatacaaaacttatctttctcatgaactttcgcaatcacttgaagctaagtttcgcatttaactgctgccggatacgaccgtgaggatgttagcaatctacaaaacacaaattccgaagggttcaaaagtagaagacaacgctatttgggaggtcgaacagcacaatacattgcaaaaattgatgccgatcttttcaatgtacctcaagtcttatggacggcttggctcttgacttggcgaaaaaattggaaatg

SEQ ID NO: 103817 - DNA, 182 bp, Heterodera glycines
  Promoter: Source sequence=SeqID_9716; Location=202..383; Strand=+; Gene=SeqID_72463
atcactggaactcggactgcagtttccaaagggaagtgatttgcaataaatgcgggagaaaagggcatattgcgaaaatttgccgtaatcagaacaacactccccaacattcaggctttaaatattcccgcacaggctcaaataagcaaaatgccaacatcgtcgactgcctgcacatcatg

SEQ ID NO: 103818 - DNA, 1003 bp, Heterodera glycines
  Promoter: Source sequence=SeqID_4252; Location=1451..2453; Strand=+; Gene=SeqID_53766
gcaccggcaccccaggaagaagcacaaacggccgagcctttgactgtcagttcggataaacctgctcagatcccatccaacgacactcctgagttgccccagccgattaaggtcatgatcggaaacaggggaaaagggggtgggccggtcaaaaccatttacattcgcaatgacgacatttggcgttcttcggcccccgggtcccatccccctattttccaacagccgcgccgtctgacgaaacgctccttttactcacgcacattccacgtacctcacacaccacacaaacgaaaacgctatggagtcagcccgatcaagcactatcagaatggtcctcgggtggtacgcaaattcaaccccgaacgtgtgactttcgtggaaaaagaaggaatgaagcggtccaccgcagtgccgattccgttaaatcagatcaagtttccaaatggccctccctgttccccaattttccccaaatcacctttcgcacatgtgccattttttatggcggcgggagtgtcgcgttttacgaaataattaagccttctttccacccctccccccccctacactttacaacgcctcctcgcccggtcaatgatgcctttgcttatccaccctctcccccttcccccacataaagcctttaaaagggattgttccctgctcctttttacttattccctttctgttccctattcgtgcaatttccgctttttccattgcgtcccatcgcttttcaccgttgcatttcttagccaatttaaagagtgatcgagaaatagtgatttgttgaattttcgtgtgaacaatttttgagtcctattcaagagtctggaaaggttaaaatcgcattgggcaaatccccgccaatcgcgacacaacggccgggaaaatacccctaattcccactattttccccttcctttttttgtctattttccgtaaatttgttttcccctaatttgtcttttttttattttgtttttcacgttttccaatg

SEQ ID NO: 103819 - DNA, 1003 bp, Heterodera glycines
  Promoter: Source sequence=SeqID_10484; Location=817..1819; Strand=+; Gene=SeqID_73696
aaatgaaataaaattgcgcccaaggcaaaaataagcaaattttctttaaaaatttttgtctttgttttaaagaatttttttataaaactgttttaatcttttatttgggggccctcttttgaccaaattttcttcaaaaaattacattaaccatacttatttctttgaagtatttgagataagctaatcacgaatttaaaaccgagaatgattgtgacagcttcggtgtgtgttggcttaagcctgttttttgcaccataggagggcttttttttaaattttaaaaaattgttaaactccgctctgattcatgccccaagctgcgcataaaaatttatctttacttgaaactttaatatggaagcctgtcaatcttattattaatcatttctgacagcagttttagataaattttaagcgcagcttgggtcgtttatttaaggatgaaatcacagcctaatttaagaataattttagtttttttttaataattaaagtgcaaaactttccgatgcccaatctttccactgtgaatccttaaatgtcgcccattgtcttgcaccaatttttttgtaaatatttttggtcccactgatttaaatttatataatttagagcacatttaattctctataacgaacctaattattaacttttaatggagcatggatatttcggcacgttgttcttaataccaatataatgcctgtttttagttaaactcatgaaatcaaattacattaaaggatttttttcttaatttaaatttgtttaaaacgattttctatatcttgcttttacatttttaatttacaaaatttttgcatacatggattataattttatataaattaataaagccttcattttttgctgacgtaagttgcttttgccacttttgcaaatgtcacatgatgttccatgcaaaattggcagttctttctttttacaaatatcattttgaaaataaaattattatttttattatttttctttaaaaatg

SEQ ID NO: 103820 - DNA, 231 bp, Heterodera glycines
  Promoter: Source sequence=SeqID_3874; Location=1..231; Strand=+; Gene= SeqID_52240
agttatataaatggattcgtttaaaagcattctaatccttaattccttcagtggttggaggagacaattttttctcgcgtcgaaaatcggaaccaccaagtgtactcaacgtgcaaccaggagccgaacttcttggtggaaaattggctgctaatccccgccatcgaacgaggcgaagcgttacgactgtatttggacttcaacttcaccatcgtcagatgtgcggcaatg

SEQ ID NO: 103821 - DNA, 92 bp, Heterodera glycines
  misc_feature (62)..(62): n is a, c, g, or t
  Promoter: Source sequence=SeqID_8669; Location=2829..2920; Strand=-; Gene=SeqID_68814
taattttttaatataattttttttttattaattttaccattaataataaataaatggctggngttgaattggaatcttcttttgccacaatg

SEQ ID NO: 103822 - DNA, 231 bp, Heterodera glycines
  misc_feature (47)..(48): n is a, c, g, or t
  misc_feature (50)..(50): n is a, c, g, or t
  misc_feature (58)..(58): n is a, c, g, or t
  misc_feature (60)..(61): n is a, c, g, or t
  misc_feature (108)..(108): n is a, c, g, or t
  misc_feature (110)..(110): n is a, c, g, or t
  misc_feature (116)..(116): n is a, c, g, or t
  misc_feature (127)..(127): n is a, c, g, or t
  misc_feature (138)..(138): n is a, c, g, or t
  misc_feature (143)..(143): n is a, c, g, or t
  Promoter: Source sequence=SeqID_212; Location=2978..3208; Strand=-; Gene=SeqID_77795
ggacaagtaatttaggcgaagaattcagcgatctctactgggggtcnngngatattgngnngatgggggggtcacctatccttgcggcctctacaagcgcaggctaangnccccgncgacggcgccnacaacaaaggnggcancgccttttcaaggcttgagccgactcctgagcttcaagagctgatcatctatttcattaacacgtggatcgggcctcgccgaatcatg

SEQ ID NO: 103823 - DNA, 471 bp, Heterodera glycines
  Promoter: Source sequence=SeqID_13522; Location=1..471; Strand=+; Gene=SeqID_77422
ggaggaggacaaagttgggaagggaaagcaaaacgaaaagtgaaattataccccggcgggggaggagaagcaaattgggattgaaaatggagaaagtgccgaaaggcattggcaacacattatgtaattaccaagaaaggaaatgcaattggcaaatttgaatggcatttaatagggcgcaaatgacaggtaaaattcacaaaacaattttaattaccaattatttcaaatgaaaaatcgcaacattttccaaaacgatgcgattttcgtttttgatctgctgatgaaaattgcgcatataaaatacccttgtcgattgctgataatcgcgcaaaaaagtcttgcgaaaagcgagacgatattcggtgctaaaaagagatgatgaaaccaagaatgcctaattagcattggcattggcacctgcaggcacaaagcaccggcgcactgcttgtgtaagcgaacacaaaaatg

SEQ ID NO: 103824 - DNA, 1003 bp, Heterodera glycines
  Promoter: Source sequence=SeqID_19533; Location=1318..2320; Strand=-; Gene=SeqID_84265
ggaaaaatttgaaattttgacattttttattcactgaaaatttgccattttaaaaatgccttatgcgtttttaattaattctatactaaaataattaagaaataaaaaagcacataaattattaatgaataaaaaaataatataaagttttttgactatatggtataaggcaaaaattgaaaaaccccgaaccccgaccccgaaccccgaacgcgacccccgacgcttccaaccccgacaaccccgaaccccgaattttccaaccccgacgtcgggggcccaaccctattataaatccaccggaaaggaaaaaattagtctagtgtagggttgcacgggaccgggaattttgacaaaaaccgggaaagggacttatcgggaccagaaaagtcgggaccgggaccaaccggaattttcaaaaagaaaattttttttgaaaaaaaattgaaaaattctaaaaattttaatctcaaattcataaaagttcgaagtcttttattatatgcaaaatacaacgattaacattttattatttaatatttataggcatactcagaaacacaacatcaaatgttatgggtgggtgccgggctgaacctaaacctattaaagggtttctaaacctattgattaataaaaataaataaaaattattaataaattaaataaaaataaatcaaaagcttgtttgaagaaagcatttacaaatatttatgaagaaagtcaattagagaaaattcaacaaaatgcagcaaaattcattgatttggcctttcttattattcaaatagcttctctaatatttcatattcattgacatatattattatttttctcccactttttaatattttttaaagttttacatccataattcgcataaaaagcaaataattttgaaaagcgtaaaattgaactttcctagcaaattcaattgaatctttttttgccaattaaaatttatttttcatcagagatatcactttgtaatttcaacaaaatg

SEQ ID NO: 103825 - DNA, 443 bp, Heterodera glycines
  Promoter: Source sequence=SeqID_6851; Location=3296..3738; Strand=+; Gene=SeqID_63101
ggtattttcctgcaaaatttcaaattctgacactacgaaatgaacaggataatcaacgtttttaattcgtgaaagttatattatataaatccgagctctactaattatgcgctattgccaattaaattaataattcacaaaaattgcggtctgccgaaagctgcaaatttcataatttagttgtacggtgccaaaaagttttccttttttacatttatgttttccaatattttcctattcatttaatttacatatttttgctcaatttcctttcattgctctccgtaatttgctcttcccaaaaacaattttctcatcactggtgattcattttcattcattcatcggccaaaatgtccttttccaaatttggtagccctcttccccccaattattcaatcactttttgactttcatttagaattcagtatttttgttgaatg

SEQ ID NO: 103826 - DNA, 236 bp, Heterodera glycines
  misc_feature (93)..(93): n is a, c, g, or t
  Promoter: Source sequence=SeqID_28538; Location=699..934; Strand=-; Gene=SeqID_59143
agaatttttttataaaaaatttcttaggtttgcacctttttttaaaaaaatttttacggggggggggaatgaagtgcacccggctggggttcncctcaaaaattttttggttacgagcctggccttggcttatcagtcggtcattcattcgtctttgatcagttgcgattcggctttggccctgctgtgtgtgtctctttgttttcaacgcattattttcccattttaagcgcatg

SEQ ID NO: 103827 - DNA, 122 bp, Heterodera glycines
  Promoter: Source sequence=SeqID_22481; Location=1381..1502; Strand=+; Gene=SeqID_53153
cgtaattccatgatactgtatttattctactataacccctgaggggttgaaaatataattttaatttttttgtaaattttgacttctcaatttcccaacttttagccaaaaatgtgctgatg

SEQ ID NO: 103828 - DNA, 673 bp, Heterodera glycines
  Promoter: Source sequence=SeqID_7792; Location=1843..2515; Strand=+; Gene=SeqID_65989
agaagcagctaatggaattggggcaccaggaggagtggcgactgaagcaggaatttctgttggggcgacagacggcggcgatggaaaacattgtcatccaactgagacagataaaggagaagctcaaatgattaactgaccttcgggctccgaattggcatttcgccgtgccacaaatccacgaaattcgcttaaatgtcaaattgccactaataatttatcacaacaaatttgccttatgccagtcacttcattagcatcagatgcattcagcttgtttaattgaatgactcactgacaattagtaaggcgtttgtccctccctcgtgccatcttttccctcgagtgcttttgctaatcatcccgacttttcgcttgctcctctgctggtgattgttgtgctgataatatggcgatgctgctcccttccgcatcattaatcacttctgatttgacatcctttcatttgctaattactccccccccccattcgttacgcctcaattccttctttggcgtgtccccccttagaccctttcattaagatcattatcccaggctaattgacgacgcattgattatatctgaagaagcgtcccccacccctctataaaagaaagcgagtaaagtatgaaaattgatatttgaaaacattcccgaagtgtgaaaaatg

SEQ ID NO: 103829 - DNA, 763 bp, Heterodera glycines
  Promoter: Source sequence=SeqID_32130; Location=455..1217; Strand=-; Gene=SeqID_62458
tacgttaggtgcctatttgaaaattttggtgcctaaaaattcaggccctaatcatcactattagtgtcaattttctagcacgtccaccatactacaaataactgttatgtgtataacaatgaacggattttttttgagcaaagaatcattcaatcattgtgcatactaatcgatttaattatgattgatccgtttcttgcacaccgtctatgttttagggggtccatatcgttttggcgccgacgttttggcgccaagctataataaaaaaagaaaaacacccaaatttaaaaattttgtaaaacaacaaaaaaaacgtatttttcgcgaaggtaatactgccgatggttggttgccccccttttttgaagaaaatttttttgttttcaaaagtcatgaaaacatgcttccaatggttttcagggtcgctgctcacgaatcagtcatccatttcgaccaattcggaacccggagccgaaattcgaacaaaaaatcgaaaataaaaaatttcaaaattctctttttgtttctaaaatagattaaaacaaccaaaacgttttggcgccgatgttttgacgccatgtagggggggggggggtagaaatgatgaaatcgttataatttttctgacgaagtctattaaagagccggatttaattcttcatttactctttttcgctttggcttatgttctcttaattttgtatttaggtaatgaatcgtcaaattgatacgaagaaacaaaagcctaaaataacgcatg

SEQ ID NO: 103830 - DNA, 52 bp, Heterodera glycines
  Promoter: Source sequence=SeqID_42659; Location=869..920; Strand=-; Gene=SeqID_70497
gaaggtaaaagcgtgagcttaatttaaagaaaataattaaaattaaaaaatg

SEQ ID NO: 103831 - DNA, 139 bp, Heterodera glycines
  misc_feature (21)..(21): n is a, c, g, or t
  Promoter: Source sequence=SeqID_38204; Location=661..799; Strand=-; Gene=SeqID_67094
ttcgggaatgaaattacatanttaattagctaagggtcgaagaataaatgcatttaaaattaaattttcacttttttcgatttttaaaaaatttcatctctaacatttaaaaatttttcagcatcttagataaaatatg

SEQ ID NO: 103832 - DNA, 188 bp, Heterodera glycines
  Promoter: Source sequence=SeqID_7442; Location=1..188; Strand=+; Gene= SeqID_64838
tctccaatatagaggacgcgagacgactgacaaagtggcgttttgggggaccaaatgaaattttgtaaggggcccagccatgtaaatagttgggggggggtattgaggaaggcataaataaatggtatttggacatttacccatcgattaattaaattaattattttttatatcatcaggagccaatg

SEQ ID NO: 103833 - DNA, 248 bp, Heterodera glycines
  Promoter: Source sequence=SeqID_10782; Location=758..1005; Strand=-; Gene=SeqID_74038
tttggaccaatcagcagccgcggaagaagtgggacctcccccctttatcatatgaaaaaataacaatgcggaatatggattcggttctttcaattttgccataaaattttaaaaaaatcctctaaatttttattaaattaattttctttacaattgattttttgaattactttcgtttaatttttataattttttggggcagaaaaatgtgcggaaaaaaagggatgggggagaacatagtaaaaatg

SEQ ID NO: 103834 - DNA, 251 bp, Heterodera glycines
  Promoter: Source sequence=SeqID_457; Location=5464..5714; Strand=-; Gene=SeqID_53205
cgtgtcgttgtcgatggagtcggtgagcagcagcaatcagatgtaatagtgcagagaatagaattaagaatgtgacgagaatgaaatttctctcaatttcacgcctttttatattcaaatttcccactgaaaaaaagtgcaacagaaaatgaatataaaagggggaattttcgtccatttgcacacttgctgctgacacaacacccaatcaacgaacgaacgacttcagtgcgcccaacaacaacacaatg

SEQ ID NO: 103835 - DNA, 110 bp, Heterodera glycines; identical to SEQ ID NO: 98226
  Promoter: Source sequence=SeqID_16829; Location=428..537; Strand=-; Gene=SeqID_81246

SEQ ID NO: 103836 - DNA, 120 bp, Heterodera glycines
  Promoter: Source sequence=SeqID_5341; Location=3428..3547; Strand=-; Gene=SeqID_57731
gtttagggggagtggttcagggtggcaaaacccgattcgtgtggcatcagttaaatatttgatcgtttattttttataggagcttaaagacgcatattcaacttcaatttagttcctatg

SEQ ID NO: 103837 - DNA, 1003 bp, Heterodera glycines
  Promoter: Source sequence=SeqID_1930; Location=541..1543; Strand=-; Gene=SeqID_76866
atgttaaaacatatgcttttatttgctgaacgaattatacaattaaatcgtttacattctttttttcgacaaaattgtcttaaatcaattggaactataactattccgctgacaatcgcgatattcgtgattctgcttttcattgaagtcagcagggattccttttttatgtaaatacatatttttcctggattctccatagcctaattagtaggaaaaacactttcttttttgtgtttgcgaacaaaaatcgggacttttatttacatattttgggatttttctacatattacatatgtacatatttttatacatattttggacttttcgccattttttcgtacatattttgcaatttttgaagattttttaaggaaatttttattaaatgccccaaaaaatccaaaatttagcaatttttcgtacattttttcatattttgagaatttatagaaatttagattttttttgagaaatatacctctaaaaaatcaattttttcaaaaacagataccaaaaattaatttttaaagtactaaaatgtgattctaggcctatttgggtcatttttattgcattttatgcctatttcaccctttacgaagaatttttccaaaaaaagtaaccgttaaaaaaaaatttatttacatattttcgtacatatttgggagtttttgtacatatttcacacatattttaacattttttatacatattttatttacatatttcgcgatttttcttacataaaaaaggaatccctggaagtcagacatctaattcgtaattggcaattttgttatgttgcgttacgattcgccaaataaacttttgaattttgttttgttgggttcgtccgtgttctgtgccgttctccactttccctttcttgccgcccccattctattcatttgttgttttttttctcccatttcttatgttttctgttttaagtgtttttttctttttgccatgatcattgtttgttttttgcagagaatg

SEQ ID NO: 103838 - DNA, 250 bp, Heterodera glycines
  misc_feature (38)..(39): n is a, c, g, or t
  misc_feature (46)..(47): n is a, c, g, or t
  misc_feature (87)..(87): n is a, c, g, or t
  misc_feature (145)..(145): n is a, c, g, or t
  Promoter: Source sequence=SeqID_28710; Location=1149..1398; Strand=-; Gene=SeqID_59286
ttttttcaaaaatatataaaaaagataaatatgtttgnnaaggatnntagaaaaaataaataagtcttactttacacttgttttttntagattttcaaatttatctaaaatttttattattttctaaaaaataattcaaagattntaagaaaagttattggcaccaatttaaaaatctgaaacaaaattaaatcattaaaaattttttgcttaacaggtcaaatcgttccgcacttcgctcaccgaaatg

SEQ ID NO: 103839 - DNA, 413 bp, Heterodera glycines
  Promoter: Source sequence=SeqID_43626; Location=1..413; Strand=+; Gene=SeqID_71252
aaaaaaattcttgccgaaaaaatggctatctctttttctcctggggatttgaccgcaaacttggtaccaacatttgccttctctagtctggctctaccaaacactcacacgatatttgaaatgctaacgaaaaaaattcttgccgaaaaaatggctatctcttttttctcctggggatttgaccgcaaacttggtaccaacatttgccttctctagtctggctctaccaaacactcacacgatatttgaaatgctaacgaaaaaaattcttgccgaaaaaatggctatctcttttttctcttggggatttgaccgcaaacttggtaccaacatttgccttctctagtctggctctaccaaacactcacacgatatttgaaatgctaacgaaaaaaattcttgccgaaaaaatg

SEQ ID NO: 103840 - DNA, 241 bp, Heterodera glycines
  Promoter: Source sequence=SeqID_482; Location=1..241; Strand=+; Gene =SeqID_53923
ccgttgcactgcttgaactttgggcccagtttctcccacgcgtgcagcccttttatgcgctcaattgcaacgctgacccaatgctgcttcgcttgatggcctctcatcagtctgttgggttcagctgctcatccggcgcagaaatgctcaatgtgaaattcaattagttttcatttataatgctgagaaataacccaaatcgaaaattttttataaattttttgccaggctctccattatg

SEQ ID NO: 103841 - DNA, 315 bp, Heterodera glycines
  Promoter: Source sequence=SeqID_19728; Location=1..315; Strand=+; Gene=SeqID_84471
tcgatgttgtacgtaaccaacgctttttgaatatgattttttattgccatgaaaacttttattaatgaaaaaataattctgccttcttctttaaaagaagaaattgaaattaacacacaacatagggaggacttgaacctgggacccctcttttggtgactaactcacagaccactaagacgaaaaatccagcataattgtacttggagcccaaaattgggccgctgtgttaaaaacccaaattcaaattaaatgattgtcaaatcctcattttccaaaaaaatcctcattgacctatcaaaaagccacaaaatg

SEQ ID NO: 103842 - DNA, 705 bp, Heterodera glycines
  misc_feature (11)..(11): n is a, c, g, or t
  Promoter: Source sequence=SeqID_12622; Location=1..705; Strand=+; Gene=SeqID_76291
catcaaaaatntcggaagtcggaattccgaccccaaaaatgtcggaaaccggaagtctttccgtgccatacctggtgcctatcgacatctgcgagaaattttatgaaatttaatgcgatttgttaacagattttgtctaaaattgaccaaatgacgcagtttttgactcaatttctacaggattattaagtaaaagcctatccggcggtgccgataggcgccgccgggaaaatttcacaaattttgaatgaaatttgcgatgaaaaatgagtcaactttaattaaatttattatttaatttatttaaaaatatttggcattctcttagaaaaattttcaaaaaaatcaataaaatcccgcataatcccgcacaaaaaatcaaatttgcggatcccgctgcgggattggaactcaaaattctttgcggggcgggatcccgcaggattaatcccttgcggactgggatcccgcaaaatcccgcgcgggatcccgtcccgcgccggtctctagcagcgaccgctgcctgtgcaggaaattggctttttccgaaaatgtcggactcgcaagaccggtgccgttcttacaattagccccttaaaatgtaaaaatgtatatccaattagtgattaatttttttcatggacacggctactttcgaaaggacatccagaaaatttcatgaataaagatctcacttttcagatg

SEQ ID NO: 103843 - DNA, 138 bp, Heterodera glycines
  Promoter: Source sequence=SeqID_18819; Location=1449..1586; Strand=-; Gene=SeqID_83506
taattttttatttaatattaatatattaaagtttaaaaaaaattaataatataaataaattaaaactaatttttgtcaaaagatggatatctaaaaatatttttattaaattatatataaaattcagtttcaataatg

SEQ ID NO: 103844 - DNA, 78 bp, Heterodera glycines
  Promoter: Source sequence=SeqID_15418; Location=506..583; Strand=-; Gene=SeqID_79686
atttgcaaataattttggtgataattaattaattttcccgcattaattagtctgctgatttgctacaagagcaaaatg

SEQ ID NO: 103845 - DNA, 1003 bp, Heterodera glycines
  Promoter: Source sequence=SeqID_6163; Location=731..1733; Strand=-; Gene=SeqID_60565
ataaaaaaaatctggacaaatccttgaaattaagacaaaaacggtccaagcaattccagcaatatatattgaaaaagcgcgtcagtttggacccttctgtgtaaggccagcgccaatggtcatggatttgttatgtgtattcgaaattggcaaaagtttttcattctttgggcagcttgacaacaatgacaaggtaaagtaaaattttaaaaaatttataataccgtatttcttgaaatagagccccagggggttttatctttaactcaactcaaaaaaggggggggggggtatttcaggggaggctttattcacgggagctctaattcatggcgagaggtggggaggggctttatttcgcaatccctcccaaaaaagagagtctttatttcatggggtgtctgattcagggaggggggctctatttctaaacccttcaaaagggtttgttattagtagttgaaattggcaaaatttttccattctttgatcagtttgacatcaatgacaaggtacagcaaaataaaaaaaaaataattttcaaccacctcaaaaggggggctttatttcatgggctgtctgattcagggaggggtgcactatttctagacccttcaaagggagtctttatttcaggggggtctaattcggggagggctctatttctcaacccccctcaaagggaggggggctttattttaggggggactaattcggggagggctctattcctcaacctccctcaaagggagggggctttattttaggggggactaattcggggagggatatattcctcaacctccctcaaagggagggggggggctttatttcagggggctctaataggggagggctctatttctcaacccccctcaatgggagggggggggctttattttaggggcgggctatattataggaaatataatatttatttaattaattttcattgttattaattcacattgaaaagattgccctgtgcagtaatattgcgatg

SEQ ID NO: 103846 - DNA, 901 bp, Heterodera glycines
  Promoter: Source sequence=SeqID_12933; Location=1..901; Strand=+; Gene=SeqID_76681
aaattcatattaaatgccaaaaaccaaaaatctttctctttttattttttcccatgcctgcgggccggacaaaagaattgcttgcaagaaattgctaatgacctttctgctattgagtttgaacgttcaaatcgtagagtcccctcaagaaaatcaaattaaaggaatttcagtggacaaagaaatttgtgaccatttttgtgcccatccatgccagccgactaatttaatttttccaaccgaagagagaaatgcaactttgggttggacttgtgtacacctaaagccaaaaattgtccctcaaagttggtcctcatttttctcgaaaaatgcttggacaattggcggcatcatttttactattgccggcatttccttttgtgtaattcgcgcatatttgtggtcaattgaacccgattcaattgaaattaatgtttgaaatttcttttcaaaatttgcaatttccccgcttttgactgcgtttttaattaattccatatgaccaaagttttgcagtgcccccccccattttttttctctccgtgccaaatatggcagccgacggaaagcaattcatctcccgtcccctctcccgttttttgctcttccccgtcgcgacattagctttttgcggcgatgaatctcccctgccgctcgggagaaaaacgttttttgcctttttttttcccattagctcgccgctgttgtaacatttgaaaaaataaattgcattttttgctgtaacgcccatcgtccactcggacccgtcgttatttaaggccggctcatccttcagaaaagccatttcttgtcttcattctcatttttcctccgctccttcatttttttcatttttccatttcctttttcaattttcaatttttctttttttttttagatg

SEQ ID NO: 103847 - DNA, 63 bp, Heterodera glycines
  Promoter: Source sequence=SeqID_14021; Location=5218..5280; Strand=-; Gene=SeqID_77989
aaaagctacaaatcaaaaactgatgaacaaaaacgcgaaattgtacaaaaattcattgaaatg

SEQ ID NO: 103848 - DNA, 396 bp, Heterodera glycines
  Promoter: Source sequence=SeqID_41073; Location=531..926; Strand=-; Gene=SeqID_69280
aaatgccaaacattatgctaatttatcaaaattaaaaagattctgaggatttccccaaaagcctcaaaaatcctcaaatttctcaaaaagccacaaaaatcctcatttccaaaaaatcctcattgacctatcaaaaagccacaaaatgaggataaatcctcagatctggcaaccctgttcatagctgttctaaataaattaatttgctataggccgtaaatgtcctgcaaaattcgaaaattttggttatgattcaaaaaataaaagccaaaaaactttggattttagccttaattttttgaaatttttcgaaattctgcaatgccgggctaaaatgcgtgcattttcattcagttggccggcaaatttcttctgctacaccagccatttgtgatg

SEQ ID NO: 103849 - DNA, 442 bp, Heterodera glycines
  Promoter: Source sequence=SeqID_22556; Location=550..991; Strand=-; Gene=SeqID_53225
tcattctaaaaaattatttgcataaagccaaatacatttcttaagcaattcttaaaatgtatgtagcatagaacctattcaaaatcaagctaataacttagaaattttttaagaggtgcagctaaaagtttcaaatgtaatcaggagaagtctttaaagcttttaaatttttttgcagatttttcaagcaaaaacaattttttttgatgtttttgaagatttttagcgcatatttttagggttttggctatattttgtgtaaaatttttttctttttttgtttagtgcttaattttggaatttttgatatagataattaagtgcttaattcacctttttggtgcttaaaaatcctgtcccaacatatgtagattattaataaaagaatttagaaaaaaaacgcaagcaaaatatcattttttaattaaaatttagaaaaatg

SEQ ID NO: 103850 - DNA, 736 bp, Heterodera glycines
  Promoter: Source sequence=SeqID_14071; Location=1..736; Strand=+; Gene=SeqID_78044
cattttgtaaatttctgtcattggatacgctcacaatcaggtaagcacaaaaaataaacaaagttttttagtttgctaataaaagttaaaatttatttgcctttttatacctgcatgttcgagaaatttagtgtctttttaatgcctattttgcgattattattattattatttttttgccttttacctaagtgcgtgttttgtaattttcgtgcttaaaaatgccatccctaatacaaattggttaattcgataatttatgttttgagttgggtaaactaggaaaaaaattttaagacgaataaaatatatttaaaaattatagaaaaaaattcttggtatcattcaatggcccttcaggttttctatctacataaaatgtttcaaaaaagatatgagcaaatattgtaaaaaaaaaatattcgtccaaaactttttttttaatacatgaccaaattttttggaattttgcaagaaaatagagaagcttaagggctatcgaatgttattaaaatgtttaatttggctgaaaggacaaaagttgatacgattttttgtcgaaatgcgagtcggggcattacaaattggccttgtacgagttgggtttttacccaatttgtaaacctcaaaaagaaaaatagggcctagatatggttatatattatggaaagagtttttcttttacatataacctcaaaaataatggaatattttcagcttccggcgacacatgatg

SEQ ID NO: 103851 - DNA, 333 bp, Heterodera glycines
  Promoter: Source sequence=SeqID_40387; Location=490..822; Strand=-; Gene=SeqID_68740
agaaagtgaaagagaaagtggaaaaggaatagaaagttttaagagaaagtggaaaaggaatagaaaatttaagagaaagtggagaatagaaagtttaagagaaagtggaaaaggaatagaaagtttaagagaaagtggaaaaggaacaggaagtggaaaaggaatagaaagtttaagagaaagtggaaaaggaatagaaagtttaagagaaagtggaaaaggaatagaaagtttaagagaaagtggaaaaggaatagaaagtttaagagaaagtggaaaaggaacaggaagtggaagagaaaatggaagagacagaaagtggaagagaaaatg

SEQ ID NO: 103852 - DNA, 207 bp, Heterodera glycines
  Promoter: Source sequence=SeqID_21598; Location=974..1180; Strand=-; Gene=SeqID_52197
agggttgatttgctgaaaagttagatcatatgcgatgctcggcgttgtccactcaccaaggtacaaaatctatgaattttgtaccatgtcatttaaaaaaaaatacaaaaattcgttttttctcccgtattttaggttggctgtgtgtccggttgtgtcaacgagaagcagttgaacaagctgaagaggccgtccaccagttccatg

SEQ ID NO: 103853 - DNA, 63 bp, Heterodera glycines
  Promoter: Source sequence=SeqID_32403; Location=1219..1281; Strand=-; Gene=SeqID_62711
tcttggtaagctttccatccacaaaaacacgtttaaactttttgatattcagaagagtgcatg

SEQ ID NO: 103854 - DNA, 613 bp, Heterodera glycines
  Promoter: Source sequence=SeqID_15129; Location=1..613; Strand=+; Gene=SeqID_79310
cgtataaatataaaatctctacaaaaatatttatttaatcttgttcaataattttaataataacttttaacgaaggctttgaacggagcaaactacagaatttagtcgcagattaatgcttcttcaacaaaatgggcacccaaattcattttaaagtttttttaaaggcataatgccaaaattaatcatttatgaacttcaaattttttaaaccaaatttcccgtgggtcaattgagctaaaaattttgcttaacgaaatttttggaaattactcattcaggctaatagagaacacataatgctgtcgacagattcattcagtttgaatattatgaaaagagataatcagaaaatacggccgtcacccagcatttccaccgacaaaaattcatctttgtttaacttcatatttataatgcgtaaaacaaaatataagaccaaaatgaatggtcaagatcgagtccgttatccaaaaaatacggctgttaattcgcctttttgactttaagcatttgacatgagtttctctgtttggttgtatttgcttttgtttgatcattatggcaattttaaccatttatttgtcttttcagcatatcaaatattataatg

SEQ ID NO: 103855 - DNA, 566 bp, Heterodera glycines
  Promoter: Source sequence=SeqID_4308; Location=5910..6475; Strand=-; Gene=SeqID_53986
ggaaaaaaggccaaaaaaggtacaaaatgccaaaaaaggcattataggcacaatataattcaacgcataagcctcaaacaaagcggaaaatgtgttttttatgcttaataaatctggaactagtgcgcagaaaaaaaggcatatgcctcaaaatgcggtctctatctataagttaacttaaaagcagaataattttataccttcatatctttcaacatgtatttttgttaaatttttatttttgtcaaatttttgataattttaaggatttataaaacacatcttcacatggtccaagccgaatggcgtggtgaacatgttgattttataaaaccgttcatacaagagcaaaattcctgaaattttatgtgattatgctttaaagcatgaaaatttagtggaaattttaaacaatttagaatgttgcactgaaaaacaatgataatatacttaaaatccctaagttttagaagtcccggtcggttgcggctctaattgctatgaagctaaaaaaatggataagtcctaaaatttgtatccccaaaaaataatttcaggaaaaaatg

SEQ ID NO: 103856 - DNA, 1003 bp, Heterodera glycines
  Promoter: Source sequence=SeqID_8176; Location=43..1045; Strand=+; Gene=SeqID_67217
actgatcggaaatgctcaatatgtgttgttggatcgatgcggttggttggcaacgaaagtgcgatggccgaagacgacaaaacattcgaattgatcgctccaattcattgactttgccgacatatggtgcccctgctgctggcctcaatgttctccatctgttaagattgaaaaatagaaaaatttgaaattatgaccaaattcgttaattatttttaaatatttgaaaattttgaattttattttttctataaactttgtcaatttcggacaatcaataaactttcattttcaatattttgaaaaaattataattaatcactttattaagcagtaagaattacaacattaagcacgtaataaatagggcttcgatttttaggtttttacatatttttttcctgagctccccgtggcctgaaacgcacgaaaaacatgtttttttgggctgttgttaagctacttttcgagttattagcacctattttctaggtttttatttttagcacctaaaaaacctaaaaaaaattttaaaaacttattttcacctattttggcattttgcccaaaatttgttaacaaaaatgaaataaaaaggaaaaacagacccctaagaatcgaccgaaaatttttttcaaaaaatatacccctaagaatcgactcgaaaattttcaaaaatatacctatgaaaaaagaaaaatttctcaaaaatcatctccaaaatttatttgtttattttcttggcgagaattttttattttgaaaattatctatctcattaatgatttggcataatatttttgctttttgaagaaaattttcgattttacaccccaaattcggaactttttggcacctattttcccatttttagcacctattttgggggttttttagaacctaaaacctacttattttggcagtttttagcacctaaaaatcgaagccctaattataaaggaggaaaaacttataatatctatgtttagctacaattcaaatg

SEQ ID NO: 103857 - DNA, 1003 bp, Heterodera glycines
  Promoter: Source sequence=SeqID_22206; Location=540..1542; Strand=-; Gene=SeqID_52878
tcgcatccccgtcttaataatgggcccattgatcagcagaaaagaaatgattatttgtgtctgatcattttgaatcacactattgatggatgtgaattgattagttgctcattttctctttgaaatgattacttttaccgttatttaaatgattattttgtcgatttttcctttgatttttgaccaaaaatcgcaaaatattgacataaaatggcaaaaatatggataaaatttttccaattgaggtgtaatttctcaatttttctttagtttcgctaaatgtaatgtaaaactttaaaaaatggctaaatgatattaaaaatatacttttaatatgacttataattagggcgtgtaattatatggaaatccatttttttcctggattattggaggcctgaaacgcacgaaaaacatgtttttagcttggtttgaagcttctaggatggatttctatatccattttttccatatttcgggatttatgtccatattttgggatttttccaaaaaacctctattagaacggcccccagcagctaaatttgcctttttgagcctaaaaaccggaaaattttacaaaaaattattttttcgctaaattttctcgagaatattgaataaattcaaattttcttagaaattaataaatttatgtcaatataagcaaaaaaaccaaaatttcgctttcaggttgatttttcgctaaaaataagtaaattttagcttatcgtgttttttttcttctaaaatgatttttaataccatatttagccatttttgaaggttttactttatatttaacaaatttaaagaacttttgggaaattataccctcaattggaaaaatttatgtccatatttttgccattttatgtccatatttcgcgatttttggtccatattttatggccatatttcgcaattttatattcatataattacacgccctatttataattagcctaattcatacatttttaagccaaattaattttcaatg

SEQ ID NO: 103858 - DNA, 173 bp, Heterodera glycines
  Promoter: Source sequence=SeqID_2061; Location=2732..2904; Strand=-; Gene=SeqID_77606
cgccaagcatttcgctttggcaaagctgatcattttggatcggcaccaaaaaaggcatcaccttggagtggacaccactctgacagaattcttgagtgaattctggatgccaagtgcccgtttaaatgttaaacggactcttcgggactgtctccattgtcgccgaatgaatg

SEQ ID NO: 103859 - DNA, 264 bp, Heterodera glycines
  Promoter: Source sequence=SeqID_15986; Location=1418..1681; Strand=-; Gene=SeqID_80344
ttactacttcaacgccttctgctacaaaatcaaccacaattttgacgacttttccaaagaatgaaaaattgttgagcgaaaacacgccagtctcctctcttctacctcctctgattcagctttgcaaagaccgtgcggaaggggataatttttatcaacaagcaatctgttggggtcttctcgttctctatttaatgctgattgttagcttactgttacaacaattttgctcatttctttggataaagacaaggcattgaaatg

SEQ ID NO: 103860 - DNA, 1003 bp, Heterodera glycines
  Promoter: Source sequence=SeqID_12436; Location=1527..2529; Strand=+; Gene=SeqID_76047
gctcataattgaacaaaaaaaaaaatcggatttgggcggaaaacacgaaaaattttagtcttggccataaaatttgttttagccagtgtgatgctttgaaaatcaggtggctcgggtgaaaaaccaaggcattttagctgatttatggacaaaagatttggccaaaaatgatatgtgacaacaatttggaagcattttaagggtttcattttgaaagtttgtagtccatgcttggcattttttaaaaaattcaaacgaaatttgtcaaaaaaaaagtttaaaaaatgtagagattttttaattcaatcgaaacccccaacgaattgaaattttctcgcgttttttttctcagggtttttggttaaatttaaccgttaaaaaaaatgtgcaaaccgaaaacatcagtgcgacagttggcgattgttgttgttgttgatatttttggcggcgtcgacctgggctcttaaactgaggaaaaattgacggtgtgtaaaaaagcaaagctgattttaagaaaaatggagcatatattgggggtattgaactaacacatgatctatggaaatctattgaattctaaagaaaaagaaagtatgtgatatattgcgtttatatagcatcggaagacatattttgtgctagaaaaagcagagcgtcgcggtggaaacgtcgccgggacataatgacgtcgcaaaaataaattaaaaaatttcaagaaaactcaaaagtattttagctttttgaaaatctaagtgttaataaaaaataaatttgctgaatttccggaaaaaacccaaaacttgaaaatttttttttaatttccttgataatttttttttcattttttctaaaattaaaaaaaaaattttgcggcgacgttttgtcctgctccggtttttgggccatttaacaaagaaaatggcaaaaaaaaagttttttgtacctccgggagagtgaattcgaatgtgcgcactgtgccacacttttgtcggtcctcacaatg

SEQ ID NO: 103861 - DNA, 881 bp, Heterodera glycines
  Promoter: Source sequence=SeqID_619; Location=697..1577; Strand=+; Gene=SeqID_57577
atttttgaacaaatttgcatttaattatttattaatttaaatttcatttcatttctctattttattattcatccatatctttcatcctttgcttttgcgatcactttataagtcgttggagacaagaagaaaataagcgatagggaatttcacagtttaacaaaaagcggaaaatgtccgtgagcggaaaaaagggggaaagatggaaaaattaaaaatctgttctcattcgcttaactttttaatccgttcaacatcttctctctccgattaaaaattatttattaatttcgaattttcgcaccgtaataaatatttgtcaccgggacattatttgaaggttacggtaggggaaaatttggtgctaaaatttgtttcaccgggaaacgggagattggtccaccggggactttttgaaaacaaaatctgaaaaatcaaggggctcaccaggaattaagaagtgattggcaaactctaatttgttccaccaaacaaaggctgattgattgattcattgtttgattcttctactgtcattggacgaactgacaaaagagaacagcggacgaagagcggacttcgacacgtggcgacccattggccattgcgaaccgaattgtcaaaggtggacagattcaaatttttgttaaaatttgaaaaagctagttggctagcaaaaattttaaaatgagttcgccaatattggatataattcaagggctagtcaatcgattagaggttgagttaaccaaagaaattccgataaatcctggtcaaaatgccaccccaaatacaatccaaagacatttgtacagagcaaaaaatgcttgtgatgagttaagcgaaattttggaagaaattcagagaaagcgcgtaaaatg

SEQ ID NO: 103862 - DNA, 129 bp, Heterodera glycines
  Promoter: Source sequence=SeqID_4172; Location=557..685; Strand=-; Gene=SeqID_53459
attttttattttgaataaatattttaaatgttgtcttttatttattgttggtattttttgctcttaatattttttcatttatgaaatgtataaaagaaattaaaagaataaaaaataaaataaaacatg

SEQ ID NO: 103863 - DNA, 103 bp, Heterodera glycines
  misc_feature (47)..(47): n is a, c, g, or t
  Promoter: Source sequence=SeqID_6470; Location=1232..1334; Strand=-; Gene=SeqID_61704
aaaagggagggaggggacagtttagaaaacggataaataaaacaacnaaattgataattgttcagattccgaaacagtttttcacatttcaacggacgggatg

SEQ ID NO: 103864 - DNA, 238 bp, Heterodera glycines
  Promoter: Source sequence=SeqID_22398; Location=1..238; Strand=+; Gene=SeqID_53064
ttatttatttgatctatttatatgttcatagggaacatgtttcgcgcatttggggcatagccagaaatcatcaaaaaatgatgtaccgaaatgcaaaagactgtggcttttacatctcttacaaatctcgtaatgacaaggacagtaatgacaacatttaattttatgcgggcagttcatttttcaattttgttttatttttgtttgctatttatagaaggggtatataaaggggatg

SEQ ID NO: 103865 - DNA, 303 bp, Heterodera glycines
  Promoter: Source sequence=SeqID_17181; Location=2021..2323; Strand=-; Gene=SeqID_81627
tacgttaaagggggtttgtcggaaaaaaaatttttgcgaaggggggtctgccgccgcgatgaccttttttttacttttcaaaccgttttaggcgcgctttttgcaaaaataaaattcaggaacaggggggggggtcggcggtgccgataggctccggcaggaaaatttttatgacattttgggtgttatttgataacagattttcaccaaaaatagtctaaaaattttttgaatttttaatggtgttaataaatttttaactgtgttttttgatgtaatttagctctttcattgtttcagatg

SEQ ID NO: 103866 - DNA, 610 bp, Heterodera glycines
  Promoter: Source sequence=SeqID_33981; Location=284..893; Strand=-; Gene=SeqID_63892
acacctctctcctccctcttctcttcctctcaccccctctcttccctcttctcttcctctcaccccctctcttccctctctctctctttccctcccccctcctcctccctcttctcttcccctcacacctctctcctccctcttctcttcctctcacccactctcttccctctctctcttcccctcaccccctctcttccaaattctcccaatgttccaacttactttgtcagggaaatttcccgtttctgtgcaaatccgccaattttgcgcaactcactgaaaagagacgaaaggggcgggcaaaggcaaccgatcgaccaaaacattgagggaattcaatgcagttttaggggaggagaggggagagactgctgctaaaaagacggagacgaaaggacacaaaaagggagagagaaaggcgatggaccattcattctaaggaaggaaagtgagagggggagagaatcgatgcgatttaaatgaatttcaatttgatccattattttaattcaacccttcttccccttttatgttttcttctcgttttcttggcatttgtccttttgtcttttcctccgcctccgtcttcttctgctgatttttgatg

SEQ ID NO: 103867 - DNA, 742 bp, Heterodera glycines
  Promoter: Source sequence=SeqID_25967; Location=1241..1982; Strand=+; Gene=SeqID_56725
atctctgctcatccgccacccaaagcctttttgactctgccgaattgcctatttttgatttattttgatctcttgacttttcattctcaacagggacgttgatatttcaaaggggggggtgtgatatttggataattatttaaattagtgctatattgtgtggcattttgtctcttttaatttagttattttcttttctcagtttttggaccattatgttttatgtttttggttgtcttctcatcttctcattaattttattgttttgtgctaaatataatttggattctatttttggccaccaattgactgagtttggaattttggaaagtcgaaccaaaagtgaattgttttcaaaaggagtcgaattatccctaattgctttccattgacattgccgcaccgacatctcatttcgcaccagaaaagtacgacatggcgctcctggacaagggtgagcagagtttgttcgattaatttctattaatttggtggtgcaacaacaattcggggactattagcaattgtccacaccacaaattcgacagagaaataaaggagtcatcaattgacgcgcctgttactcattcttgtagaagagtaacaaaccatcaaaaaaactacaaaatcgccatcgtcccatcgcccaacatttgtgcactttcttgtagaagtgtacaagaaaaagcagcagcaagcattcttgtagaaacttgcaaattcttctcttctcttcacaatg

SEQ ID NO: 103868 - DNA, 769 bp, Heterodera glycines
  Promoter: Source sequence=SeqID_694; Location=885..1653; Strand=+; Gene=SeqID_59128
tttaataaagcggcaatgataaaactaagaaaaagtgcttaaacagattttttattaaaaaatattaaaaagttattttgcagtttttaagaggcattgtgttgagtaaaattcaaatattgactatgtccagagaatctgtttttttcgttattaaaaaaattagttaaatcatttcctttagcctaaatgttttccaatttatcttttttttaatgacggaagcaacaaaaatttacaacagactcagtgcttttcaaaagtttcgcatcaatttgaactgccatttgcgtcgcgtccggtcgaattggttgtatcagctttcgacggcgctggtcttcgttaccgccttaaaccatgccagcatttacctcacttacgggcccgaccacccgcgatgcatgcaacagtaaattgaccaattttttgcatcggaattctgtcttatggcatcgttatgcttttctttgcaaatgatgcttttaagcaactacgatgagattaaaaaatggatgtcctgttaaaattctacaaatttttgaaaaagaatgagcattttaattggtttaattcgaaaatgatttttagagaatcagtttgttcaaacccggtgcatattcatggtaggcccgacaccagaaaaaaagcgggaaactcgatgattttttttaaacttttctggccaacaattccaaaagctttttgttttgctatttcaaaatttgccctgctccagtgccctccctgatcaaatatttcccttcagatg

SEQ ID NO: 103869 - DNA, 416 bp, Heterodera glycines
  Promoter: Source sequence=SeqID_32546; Location=1..416; Strand=+; Gene=SeqID_62856
ttattcgtcacactttttcagaatatgtataagcattagagtacaaaaatattccaaaaaatatatataggtattgccgtttctgcaatttgttatctaacggcaaatcttaattggcattaaaacggccacaaaaaaggaaaggaaagaaacaaatttaaaaaggttatcttccgctattgcggaagaagcccttccacacgtaaattactcgcgaaatttgccaataaaatcgaccgagcaccgtttttttggggtgaatttatttaccgtatttcctaaaatacaaccccccccccctaaattaaccccctgaaacaaagccccctcccttgagggaaaaataaagcccctgggggggtactattttaggaaatacggtatttactgtggtggcactcattcattttaaaatg

SEQ ID NO: 103870 - DNA, 161 bp, Heterodera glycines
  Promoter: Source sequence=SeqID_36514; Location=1..161; Strand=+; Gene=SeqID_65804
ttcatcatgcttttcctctccctacagtttacagggatggctatgtgtgcatcagtattctccacccgccgggcgacggaccgtttggcattgagagagcggcagaacgttggcagcctgtgcacacggtggagtccatcgtcatctcagtccaatcaatg

SEQ ID NO: 103871 - DNA, 587 bp, Heterodera glycines
  Promoter: Source sequence=SeqID_11594; Location=1158..1744; Strand=-; Gene=SeqID_75043
ggtgtgaaatggaaaatggactataaaaaataaataataattaattgataaaatgatagcacgacaaataacaaataaacaattcgataggcaccgtaaaaagccaaattccgaaaaatcactcattttttgtaaaaatggcttaatgctaatttgcaggaaaggcaattggatttacgctatcaatttgagaagtttaaaaaacaatcaatacttattttaaataatttaacggtcatatgcccaaaaccaaaaatgctcaaaaaatggcggaattggtttaaaacagctcaaatgaaaaaattgcgcattttccatttttccatggaataaaaattgtttgaaagtggacacttcagtacctctttttttaaacattaaacatgccaatcggtccctaatttgcatttaaacatctttatgggcagccattacttttgagtttgggccctatgaccgatattttccaatttttgtaaaaatcggcaagcaaatttaatttaattgtctcgtctgtttttgtttttaattttaaaattgaacagaattcacttcaaactcaaaatggaattatgcagcacacaatg

SEQ ID NO: 103872 - DNA, 58 bp, Heterodera glycines
  Promoter: Source sequence=SeqID_6434; Location=2243..2300; Strand=-; Gene=SeqID_61565
ttttaaaatacatttttttgtaaaatttcaccattttttgcaatttcagctgagaatg

SEQ ID NO: 103873 - DNA, 1003 bp, Heterodera glycines
  Promoter: Source sequence=SeqID_15924; Location=1190..2192; Strand=+; Gene=SeqID_80272
tgagtagagagagtggcaaatgggagaaggaggtgagaagaggaaaggagagagactgcaaaaagggggagggaaacgtgatggaaagtgtgaagaagagagaagtggcaaatggaagagggattgaagagaggaaaggagaacgacggcaaaggggggagggaaaagtgataggaagaggaagaaaaagcgtgtcatggcacttcttacaaaggcagttcgtacaataaagttcctacaaatttcttttcagttttcaattaaaactgtattttttcaaaaaaacatgaaatttttacatattgatttcaaattttttaaaaaaataacattttttattgaaaaagaaattcattctgattttaatttaaaaaatctgtctttattgaaaaatatttaaaaaaatttgtaagaaatgctattgtatgaactgccatgaccctgtcaaattggggggggggtgaaagaggggagtaaaatgatggcaaatgtgagggaaagggaagagtggcaaatgggagagggaggtgaagagaggaagggagaaagacggcaaaaaggggagggaaaatgatggaaagagtgaggaagagtgaagtggcaaatgggagaaggaggaaatggcaaatgggaaaaggaggtgaggagaggaaaggagaaagtcgacaaaagggggaggagaacgtcgtaggaagaggaagaagatgtgtgtcatggcacttcgtacaaaggcacttcgtgcatagagttcctacaaatttcttttcagttttcaattaaaactgtattttttcaaaaaaaacatgaaatttttccatattgatttcaaattttgaaaaaaaataacatttttttattaaaaaagaaattcagtctgattttaatttaaaaaatctgtctttattgaaaaatatttaaaaaaatttgtaagaaatgctattgtacgaactgccatgaccccgtcaaattggggggggggggagtgaaagaggggaggaaaatg

SEQ ID NO: 103874 - DNA, 348 bp, Heterodera glycines
  Promoter: Source sequence=SeqID_9332; Location=564..911; Strand=+; Gene=SeqID_71025
aataaatttactaataaaaattttaataaatcaattatcatttaatttgtaagcgtttcatttccctttaatcacagtgaactgttaaaatcgctgaacaaaaatttggcgcatcgtctgaactttgagaaaatcacaagcagaaaggaaaaggaacgctggataatgctgcaccaaaaattggagaatttacggctcgaaaacattgacaaccgatggatgcacagaacgggcacaaaactgtcgcacagttaccaaaactttgtgcgcgactttcgcaaatggaaagccaaaggcacactttaccatccgataagggacggaattcgaaaggttcggcacgacatg

SEQ ID NO: 103875 - DNA, 62 bp, Heterodera glycines
  Promoter: Source sequence=SeqID_35690; Location=681..742; Strand=-; Gene=SeqID_65182
aataatgcaaaaataataataaaaatatttactttttaccattttattttcaggaaaaaatg

SEQ ID NO: 103876 - DNA, 172 bp, Heterodera glycines
  Promoter: Source sequence=SeqID_16196; Location=1819..1990; Strand=-; Gene=SeqID_80563
tgatttttaaatggccggacattttaaaaattcaaccaaatgaattgaggagctgaaaggattttgtgaggaattggaggtgcggaattaagtaatgaaaaattctaagctgttaatttaggttgaatttgaacgcttgaatcgacatgggccgacaagatggacatcaatg

SEQ ID NO: 103877 - DNA, 270 bp, Heterodera glycines
  Promoter: Source sequence=SeqID_1085; Location=1216..1485; Strand=-; Gene=SeqID_67534
ccttaacaaatgcctttgcccatgccatgccaatggccaaacgaagtaagccatgggagaaagagagagagagagagagaggaaatgtgccaagaatggccaattgaatttggtggtgccgtttctttccccacttccaagtgaccttctgctggtcgggccactgaacacttactgacccgcgtcatatggcagacccaaagtttgcgcttggtcgtcgccaattggttggaaattgttccatcggatggccgggatattgctgtaatg

SEQ ID NO: 103878 - DNA, 534 bp, Heterodera glycines
  Promoter: Source sequence=SeqID_21946; Location=708..1241; Strand=-; Gene=SeqID_52583
tgttcgaacaaaccctatctttttggtatcattcgaaagcacaaattctaacgaagctaaaatatataaaatcgcagcgttcaggcaattaccaaaaaagatttgattaatttaattaattgttgtttatttttgtttataactttctttaaatgttagatttctcttggtttctcttactgttacattattcagtttatactttcgaatgataccaaaaagatagggtttgttcgaacatgaacaaagttattgtataaaaacccgggattgtcaattgattggactcataaaagtcgattggactcataaactgcaatagagccaaaatccgttccctaatcatgacacataaacaaaaagatacaaaaacattcatcaatcccttttcatggctataaaaatgtttgttttttcgctttgtcttgcatttgaaaaaaaaataaaaatttctaacgcaattaattattctgctctttgttgtgtgatatcattcggaactcggccaaaattgtgctaattgccacaaaaatg

SEQ ID NO: 103879 - DNA, 373 bp, Heterodera glycines
  Promoter: Source sequence=SeqID_29677; Location=853..1225; Strand=-; Gene=SeqID_60144
cccccccccccccccccccccccccccccggggggggggtggttttttttttcgcggggggggggaaggggcgcccccccttttttggaaaacccctttttctttttttcgttttcacaaaaaaaagggggaacaaaaaaggggggtcccggccccccttttttttttttttttttccggggattttttttccccaagaaaagaaatactctttttcttaaataatgatgatgatgctgctcactttccctccccgcctccctttgtccctccctttcccctcattttcttaccgcccataatttgttttggcatttaattgcgccacaaaagcattaccaaatcaatcgccagccaaagtatcggccgaatg

SEQ ID NO: 103880 - DNA, 91 bp, Heterodera glycines
  Promoter: Source sequence=SeqID_166; Location=2050..2140; Strand=+; Gene=SeqID_75598
agttggtaaattagtgggttccttttcgggccacaaattgaagttgttgggaagtttcaagtgtgacgttctgttcagaggagtcacaatg

SEQ ID NO: 103881 - DNA, 908 bp, Heterodera glycines
  Promoter: Source sequence=SeqID_3095; Location=1186..2093; Strand=+; Gene=SeqID_83177
aggcatgggtaaagggaaagagaaaggaagagagagagtgtgagagcgggcaaagggataggcattgattgcccgtaaaagcgaagtgaatgtgaattgggagtgatttgggggccatttaaatatggaatagggaaagagataaaaaattggggcaaaaagtgaatattgttaatttacaattaatatgggctgatcactacaaattgggggagcaacgtactttggagggaaaatttggcgaacaaacgtgttcggtctttgaaccgactcaataaaatgtttatttgtaaaacaaataaattaaacaatttaaataaaaatgggcgaagtcggtggcgcgaataaataatggaggagaacaaatatttaggcgaagtgaaataagtgcataaaaagcaactgaatgaatgaggggaaaggacatgagacataataaatcaatagtgtcttacattaataaaggaagacacaacaattagagagtggggaaaataagaggaaaagaaagagacaaatgcaaagggaaaataaatgcaattgtgaactcactgctcctttttaatcgttttaattgatggaactgatgaagatttttttgattatttgtggaaaaacctgaaaccatatatttttaaaaaatcgctaaattctcagatttttttcttaaaaatgaattatttcaatagaatatagaagaaataaatgaaatcgaaattttaaataaatttaatttgatgaaaaaggaattgcgcaaagaaattttttattaaaatttaacaatgtttcaatttgaaagtgaaattgcaaaaaaattgggcacaagtcgctggaaaatttataaattgaaaaaaaaattggaaaaaaaaagagagaagagaacggaggaaagtgaagaaacaaaaatg

SEQ ID NO: 103882 - DNA, 174 bp, Heterodera glycines
  Promoter: Source sequence=SeqID_36657; Location=771..944; Strand=-; Gene=SeqID_65915
tttttttctgctctaaaattgcccttttccgacccaaaaaatttccggttcggccaaaatttttgtggggtgaaattgtgccaaatttttttggcatttttgcgatggtcagaatggcatttgggacacgagaaaaaatgaaccgctgctgaactttgctggcccgaaaaaatg

SEQ ID NO: 103883 - DNA, 65 bp, Heterodera glycines
  Promoter: Source sequence=SeqID_30096; Location=1..65; Strand=+; Gene= SeqID_60538
ctccatttatcccagtctataattatcccccagtctttgagggggttgaaaaataatcccccatg

SEQ ID NO: 103884 - DNA, 233 bp, Heterodera glycines
  Promoter: Source sequence=SeqID_31826; Location=1..233; Strand=+; Gene=SeqID_62131
tcataccttttaattatacgccatttaagaaccattaaacgtatttttggtttaccccttgaacccagctctagccttcgaaaaaaatattctataaaattcgaaaaaatgaggcccaaaatttcggaaattggaattccgaccccactcaaattgtttagcattttcttcgtgccaatgccatttcttccgtcagttacgaaattcatttttatgttcgcgtgccgtcaatg

SEQ ID NO: 103885 - DNA, 114 bp, Heterodera glycines
  Promoter: Source sequence=SeqID_6718; Location=2781..2894; Strand=-; Gene=SeqID_62615
agagaaagagattgagattaagcccggggtatcgagcaccatggaattgacgacgacggagtcgagaatagagaccgagaattgaccttagactcggtcgaacatcgagaaatg

SEQ ID NO: 103886 - DNA, 349 bp, Heterodera glycines
  Promoter: Source sequence=SeqID_12549; Location=2840..3188; Strand=-; Gene=SeqID_76200
tttaatcattgttttgatgaagaaaatgaataaattccaaattttcattttgatcatttagtttaatttttatcacaatttcattattttcttttttgtcccatccgtcaccaaatatatcatcaaaatttggtcgaattttgcaggaataaattttataaataaagaaaattataataaatattaaataccataaaaacattttcaatttgaaaatttgtataaagacttccaataatattataaagcttatttttttcattttgttggcatcaatgtaaaatcgaaggtgtcctgatttttcagatacctatgccctgaattagaagtcaacaactttcaaaaaatg

SEQ ID NO: 103887 - DNA, 94 bp, Heterodera glycines
  Promoter: Source sequence=SeqID_23028; Location=661..754; Strand=-; Gene=SeqID_53730
cctctaatattttttgaattagtcattaaaaattatatttttaaagtcgtccctttgctataaatagggcaacgactacaaattcagaaaaatg

SEQ ID NO: 103888 - DNA, 1003 bp, Heterodera glycines
  Promoter: Source sequence=SeqID_6066; Location=891..1893; Strand=-; Gene=SeqID_60200
tatgaaattgaaaaaattaataaatttgattctatttattactttttggcactgatataattaaaggtcttaaaatccaaatttaagtttttaattggtattcccgataaaatgtgaaaacattcttcgtttggcaataaatttaattggaattcacaattaatttgaataaagataattagttaggttgagtgtcaacaattgaactccaatcgaaattatgtcccatttttattttagtttgataattgttaatttaccttttaaactttcagtaaaatactaaattaagtgccaatttttccatttctcggcttgcatttttgttgttgttgtaaaattcccaaaatattatgccaaaaaaatgactcatacatatcattttcataaaatctggcaaataatgcttaaatctttagtcaattatcttaacaaagtttaataaatattaaattttctttttacatttgcttcctccagtattattactattattattattattttttaaataacattcaatttttcataatttagatatgatcgcactaatattattttttctgtacactctttattcattgatgaatgattcacactcattttttttgttcaaagcgattttcattagctaaaaaggagcaaatgtataatctttcgcttttgaattgtaataacgtaataacacatcaatgctttttcttcatattatttttatgtgctttcttcctcgtttcgctgtttcaaacagaacaatgtattaaataaaataattcgttacttaattataattatttcattattcaaaaagaatttaggaaagtgccgttggagttgacgaaatttggtcctatcaaagttaaatatgaacttcatgggaattgttcaaggtttttaattggagcaatttaagaacaaattaaacgatttagtcagatataattgttaattccataattaagtttttcattgtgctacagaagcacattgtttggcaagaatg

SEQ ID NO: 103889 - DNA, 1003 bp, Heterodera glycines
  Promoter: Source sequence=SeqID_1599; Location=553..1555; Strand=-; Gene=SeqID_74745
attattaatttttaatcgctaaaggaaatggaacaattacgcgtcgaaagcacaatttcattaggaaatgggtctgtctggaaagttttccatgaatgaatatcattgtttggaaattttcagcttctgaaattttacaatatatgtgccaaaattgttgtatgattaaatatattattttaaatatttttttaggttgctaaaattcaattagaatttaaattgatattaagtcaaactaaaacctaacaaatagaaacaaataaaaagaaatttgatcattaaaataagatttttaaaatcatatgaacgacacataaacaaaaaaacaaaaacggacaattggaggcaattattgaaaattcgttatcttcagttaattaaaaaaaatttaagtcgttttgttgaaaaaattattaacccatccaaaaaaatgtctttcttaggaaccttaaaattattactttttcatacaattttattttttttctattcttttcttatgaattatttcaaataattctcagaatcgattaaaattataaaaattataatgataaccttcatcatgggactaagtgcattcataaaataaatgtaaaaatggatgctcactcttttgatatgaatattaataaaagacatttttcattttattaaattattatgccttttttaatattactaaaaatttataaatccttaatttatgaaagttttgcgccatgtattagtgcattaattatatatttggattctttatgattaaagaggccatggttttttgaactttttcattattacattcttataagttaaccaaagatataaatgaatgaatttatttgctaagtaaaactaaattattccggcagactgtagggcaaaattttgtgtaggcaaaaactggcactccttattttaatcgtttttccaaaaacaataattaaaatttgacttcaactttaagttatttataatattagttgctttaatcaaaatg

SEQ ID NO: 103890 - DNA, 426 bp, Heterodera glycines
  Promoter: Source sequence=SeqID_41531; Location=1..426; Strand=+; Gene=SeqID_69624
tttcacatacattttcagatgcctataaatgtgttccctcacttagtgaaaataagttttaaggggtattgggggtccctgatcacgaatacagcacccatttttgttaatttcgaacccctgatccgaactcgaacaaaaataaaattagaaaatttgtatggataatatcctcatgggcatcttgccaatgaggatattattggtacaggaagcctataaattctttgtccttgtacagctcatgtagtgaacggtagcgctgaactgagcacgtattcgtgatcagctaccctaaaaaccccttaaaacttattttcattgatttcaaaaacacatttataggcatttgaaaagtatgttaaaagtacgccctgaactagaaaagtactcttttcatatttattttaggtgcctattcaaatg

SEQ ID NO: 103891 - DNA, 215 bp, Heterodera glycines
  Promoter: Source sequence=SeqID_15395; Location=408..622; Strand=+; Gene=SeqID_79657
ttgtgaccacctgtcacagctgcacaattgcatcgcgcaaatgtcaaattcttcatcccaaacacattgcggcacgcctttgacagtttcctccgattggtccttcttctttctgtgcttttccgaggaatgcttcttcaaagttactaaacatttaaaaaccaattagtccgttaattgataggcaattataatcattattaaacagaataatg

SEQ ID NO: 103892 - DNA, 104 bp, Heterodera glycines
  Promoter: Source sequence=SeqID_6517; Location=2920..3023; Strand=-; Gene=SeqID_61875
gacaatacgggtaaatattatattccctttgaaagactcttgagctgttgaggttccaacgtgggctgttgcgtcacattggcagaaagggaatcctgcaaatg

SEQ ID NO: 103893 - DNA, 116 bp, Heterodera glycines
  Promoter: Source sequence=SeqID_105; Location=1..116; Strand=+; Gene =SeqID_69857
tggccgcacacgacggcacaattccaaagctggaactccaagcactgactctcggagtcaaggcagtcaaattcatccaagcgcaaatcaaatttgccgatcatcaagtcatcatg

SEQ ID NO: 103894 - DNA, 1003 bp, Heterodera glycines
  Promoter: Source sequence=SeqID_5918; Location=3192..4194; Strand=-; Gene=SeqID_59681
atcgggaaattttaattaggggacactaaaattaaaaaatctcatttttgaaggattaaattaaaaatttacgaaattgccccgaggcgtagggatggggcagaggactgggtgatttgtaaggtatgctttggcatggcaatggtagggtgcgtttttggtggaatacggtagtgccgccattcatttcggctttactatacggtattgttttttggtgaccgcgctcatttggccttctccacggtggtggtgcggaacacataagtggtggaggggtggcgggcgttcgtttgctgctgcaggggactcaaaatgtcggcgcccgcttcgtcccgcgcttcaatggcctcctcgcgcacgcgttgccaaatgacgaacggaaatggggagaattaaaatttgcaaatttaaaaatggggttggggttagcagaaagcgacaactggaccatggcccctagggcccggaatttcgaaaaactcggaccatgacccggattttcgagtcggacatggacagtatttcggacagaaagtcctgtaggactctaaaatgataaccaaattccttcaattcaacaaaaaccaggcaggcagtcgtccagaaagttgtccccaactaaagtatccgataaaatcatttacagtatccggtatataaaaatcattttttgatgcctaattagtccagaatcgccaaaaatttccttattttttaacttattttaattaaaaaaagtggcaccaaaagggcacagtggaaaaatgaaagcacaaaagggacggtgtgatttgaggagaacaatccgatgccaaaatgggcccaactgttcagcgcacaaatgaccacttggcactgaaaggcgtgaagcaattagtcagccaaattacgctcgatattgaacaaattttagcatttttaggaatccgcgagtccaaagactctcgtgaaaaattaaccgaccatcgatcagtggtcgaaagtcgaaattttcaatatg

SEQ ID NO: 103895 - DNA, 614 bp, Heterodera glycines
  Promoter: Source sequence=SeqID_12187; Location=793..1406; Strand=-; Gene=SeqID_75760
gtgatatacttaatttcttatttctctttttctctctctcatcctctgatcattgttcgtccatcaatgtcatcccgggggcggtccttcttttcactaatcgagactctttataagtgttcatccgcctcttgtctctctctcagtcttgcccggggctcccgctcatcagtctctgttcccgagaccgaatcgggttggggggtcgcccattgtatcctgaacattggacaccagaataaagactgtgctgttggtcattggaagagtaagacattggcacttagaccttttgggcacccccttgtccccatctccattcagcagaaaaaagacaaatggcaacaagcggaagggacaaagtgccgaaaacacacattagcaaaaaaaaaaaattggacaatgaaaatttgaataattctctgtaatttcaaatttatcttttatttctaatttttcacccataaaatctgttcaaacatttggaaactttctgccattaattcatttgcttgcgtaataattgatgggatttttgtcgaattgttcagcttttaaccgttaattttatttccaatttttctcttcaatttatttcaattactttgaaaatg

SEQ ID NO: 103896 - DNA, 953 bp, Heterodera glycines
  Promoter: Source sequence=SeqID_22953; Location=858..1810; Strand=+; Gene=SeqID_53650
tgcacaaatctatgtagctgaaaatttgaaacaatatttgtatagttaataaattgatgaacttctgaaagaaagcaccaacccatggtagggggccggaatattggacgggtgcacttcattcccccccccgtcgtttcccccccgcccccgaaaaattttttttttttaattttcaaacctagaaatttttcataaaaaaattcttaggaaattttttagtcagaaaatttcaagaaaaaaagttttataaaaaaatttcagcgattttttggaaaatttttgaaaaaacttagtagttcatcatgaaatttcgaaaaaatcgctgaaaagccttttaaaaaatttgtttttcttgaaattttcttaataagaaatttcctaagaagttttttatgaggaatgaaaatataaattgggcaacaacaatgggtttatttaaaattacacaacacacaccctcccctccccgggggcgtgccgaaaaaatgacttcattcatcccttctataacaagcaaaacgatgttcatgctcaaatgaaaagctaaattatcatcaccatcaccatcatttagtgttttccacccccgggcacactgtttgtgtgtatgggagggggaggggggggggggggtgggttgacttgaagtcggctggtggcacgtctcaatctgcaaatttgttggatttagaggacgaatgcaccagtccattggaagagccgatgtgtaaggtggcgataattcaccattttcggaaaccagctagagcccagactggatcccgaccctaaaatatgaaccaagagaccaagacttccaaaaaattggaatttgaatcccggtaattatatcccagcctaattcccagtcccggcatttttaaaagtctgggttctaaaacaaacatggattttttttgggtatgaaaacccatcaatttttagaaatg

SEQ ID NO: 103897 - DNA, 75 bp, Heterodera glycines
  Promoter: Source sequence=SeqID_16624; Location=1..75; Strand=+; Gene= SeqID_81034
caatcatatcttagtaaagaacaaataaaaaacgctcatgtgaccaaattgtctcaatttccgggccaagcgatg

SEQ ID NO: 103898 - DNA, 543 bp, Heterodera glycines
  Promoter: Source sequence=SeqID_43322; Location=1..543; Strand=+; Gene=SeqID_71027
tttttacacaccgagtcaattttgagcccctagttcaaaaagtaaatgcatatgtggcgaaatggtttttgtaagatagtaaagggacaaagggtggtggttcgagtccgttgtgcaacacgaatatttttatttatttttgtccaaaatattaaaaaatgacgaattttgggaattatttttgaagctttttcccaaccaaattggacaatcttagtatcattcgaaagctctttatgaggagaagctttttctaagcaactgctaagcaattggattgattaggaaaaagatatgagggttcgaaattttattttttgaataactttttagaacaacatttaagctataaaaacaaacagagaaaacgatgcagaatttttttctctgtcgctatgcaaaatttgaagcgcatttaacataggacaaaaaaactaaacatagaaatgtaaattccgtttttctctattaacacagataaagaaatagtacgccaaaaagagatatgtttttttctctgcactctctctttattgacacatg

SEQ ID NO: 103899 - DNA, 654 bp, Heterodera glycines
  Promoter: Source sequence=SeqID_779; Location=1399..2052; Strand=+; Gene=SeqID_61023
aagaaaacaatcccaaaactagtgacaaaataattgccaataaattgacaattggcttttcaactttgcaacaatggaaaaaggcttcattttcgaattgaatgatttggtaaaatatgtttacaattgaatttatttctttttatttttcattccgtcacttttattataaataaattcgctgattccaattttcagtgccgttttttttttggttattattctatggtttcacaaatttttagattattttgagtattttaaaattggtttttgaaaaaaataaatgataattgcatttaaaaaatttcacttcacttttttatttttattattataataaatttttatcgaaagaattgatttttatttgaaattaaatgaagaaattaatgataatgtgaggtataattgagaattttcaaacacaactaatcaaacaaatttatgaatgtcatttatgctggattttaatagaagttttggaggaaaatcatttcgggggattccgaatgtcccatggattcctaagaaaaatggtttcctttttacaaaataagcccggtgccgagttatgacgtgccaaattttatagttttttatgtataaaaaaaaatttgcatgtattttatctatttcaaagcttttaaaatg

SEQ ID NO: 103900 - DNA, 221 bp, Heterodera glycines
  Promoter: Source sequence=SeqID_908; Location=2057..2277; Strand=-; Gene=SeqID_63694
gctaaatattgtgggttgggtcgtctggttggctcgcgctaaatatcgtaattaaaaagtataattggctaaatcgaatttgacctttgactcagtgaaattgaaatgatggtgtgggttgggtcctccgggtgactcgcgctaaatatcgtaaataaaaagtataattggctaaatcgaatttgtacctttgactcagtgaaattaatttttttagcatg

SEQ ID NO: 103901 - DNA, 125 bp, Heterodera glycines
  Promoter: Source sequence=SeqID_24060; Location=484..608; Strand=+; Gene=SeqID_54757
attcaaccaggtgccaagtcatatctacctatctcaatgaaatccatttttcttccctaggctcccgatgtctcgtgaaataagccgttcaaggagcgaattcgacacttctacaatatttgatg

SEQ ID NO: 103902 - DNA, 340 bp, Heterodera glycines
  Promoter: Source sequence=SeqID_3598; Location=990..1329; Strand=-; Gene=SeqID_51027
actcattttcctggctaattgccccacaaatttaggccatcaaaaatttgattgatgtcagccaaaagaaagcttctgacctcaatgcaactgatgtgcagaaggccgaggcgggaatttccattgaagtggccgaagccgcgctcagagccatcagcgaaaaataaagacaattgttgacgtatgaaaaatagatggtattgctgtttattgtcgtaatagttttataaatctaatggaaattcccttttctttcatttctcatttgttttttttttcaacaaattatttttgcttgaaatatttgaactttttttcacaaattaatttcgtagcaatg

SEQ ID NO: 103903 - DNA, 326 bp, Heterodera glycines
  Promoter: Source sequence=SeqID_11194; Location=703..1028; Strand=-; Gene=SeqID_74545
ggtgcttaccattaacaaattaatattcttttccctattttatcgacacgtattttgaaaaaaaagtcaaaaactcgacaaaattttgttaatttttcgttcataaattctgtgcttactaattaatatttttaaagttttcccctcttaggcttttgtctcggcttcatcttctgcaaatttcattgctgtcatttggtcgtcttctgctgactccgttttgccatttgatcagaccaacgaattgactcgtgaacaattggcattgaaaaggatcaagaaaagcgatcgttttctgctgatccgttgcccaattgtgcgagatg

SEQ ID NO: 103904 - DNA, 119 bp, Heterodera glycines
  Promoter: Source sequence=SeqID_9029; Location=2143..2261; Strand=-; Gene=SeqID_70045
atgttagcgttccccgaaatctccatcccctctgctgaagtggtgtaaattggcaaatgggcaccatcgtagtcaatacttaagaatcatttttcttattcgatattcagagagagatg

SEQ ID NO: 103905 - DNA, 1003 bp, Heterodera glycines
  Promoter: Source sequence=SeqID_25; Location=561..1563; Strand=+; Gene=SeqID_82130
aaataggagcgaaaatgttggactaaaaatgttaggtgtaaaataaaaaaaaaccatgtttttatgaaaataaattgaaaagtgcttgctattgatttttatagaagtagaaaatcagaattattacaaaaatcaaaaataacaacaaaaaaattgtatgcagatatcttaatgaaaaatggtccgcgatacagtttcttattgaatatggcatatgatataatgaggaataattcaatagacatgtttaaattcatcgccctcccctttcctcattagggatgtgtcaaaactttccaggaagtcgagtccgagaaaaagaattcgaattctgtatccaacccaggcttcaattaacgaatcctaaccatgtaattttataaaaaagcaaattgattattcaatgagtgccatgtcaactactattagcacaaggaaaaaattaattttataattaattttattattaatttaattggattcaatgaaaaaaacattggaacaaattccatggatttcatatttaatttaatctgaaaatttgctatattcgaatagatatttttatttggttacctttttaattgatattgaaaatagtaataaggaaaatagaaaacaaaaataaataaatttagcgacaaaaaatatttaaaaatatgacaatttgaatcgagatttaaattaatattacgatagtgaagctaaattattatttatttttaatattgctatctattttttaaaataatctcaaatataattaacctaaatcaattttcatttttattagtcattaaaattgttgtcgttgataaagattagagacaccattttttgcctatttcggggtttttgtgcttaatgcctatttgcctatttttgtgcctatttcgccatttttggcgcctttttcaggattttcggaaaaaactttaacaaaaatgcaataaaaacgaaaaatacactactaagaatagacccgaaatattttcagaaaatg

SEQ ID NO: 103906 - DNA, 157 bp, Heterodera glycines
  Promoter: Source sequence=SeqID_39081; Location=940..1096; Strand=-; Gene=SeqID_67733
atttatacactattttctttcttcttttcagtttctctgtttattattgtgtttttaacgaaaatttctattgctccccatatattttcattataaaaatatataaaatccatccatcacaccatagcaatttttaaaatataattcgatatcaatg

SEQ ID NO: 103907 - DNA, 63 bp, Heterodera glycines
  Promoter: Source sequence=SeqID_4057; Location=1669..1731; Strand=-; Gene=SeqID_53003
ggtttttaacaaaattttgttaaaaattagcaaaatgtttagtatggtgtgttcacgttcatg

SEQ ID NO: 103908 - DNA, 781 bp, Heterodera glycines
  Promoter: Source sequence=SeqID_24239; Location=1..781; Strand=+; Gene=SeqID_54956
aaatttctttaacatattcataacaacaatttcaacggcgtaaatcattttcaaaatggagagaataaatttgatcactttaacttgtcaaaagcaaaacatgcaatgatcaaaaacatttatatattcaatgttttatcaaatttgacttccattttcatttttgcttattcataaatattttaaataaaaataataatcatttatttttggtaaatgctttacaaatattttttgttggcattttgtttgctgcttgtgcaacgaataaatgcttaccaatgcggcacatttcaagaaaagatcaaatattatcataaatcagcacatttgcccaaacaagaccttcaacctcaagtaaaattgtttattcgttaatatcagcaatcatcacaaatcctaaatttgaaaatattaatatttttattagaagaggagaaaaatatttcacatttgccatgttttgagaaaaatggcttaattggtgggcaatttttttttgaaattgcctattaaacatttatcagtcgcctcttttaaactacttttagaattttgaaaatttaagaaaataaaaagattctggcatttttgagaattttattacatataaaaacgcttcataatatacgaaagcataagaaagcataataatttgattaagcagactccgatcgaaaaattactatatttttaccatagttgaattaactctgtcccacccttatttttctcccattaagatcagccacggtaatccggtaaagtcaaacaacaaatg

SEQ ID NO: 103909 - DNA, 132 bp, Heterodera glycines
  Promoter: Source sequence=SeqID_8748; Location=894..1025; Strand=-; Gene=SeqID_69102
tttctacaatgaaaagacgacaaattgacaaaagaaacaaatttttggagaactaaagtggatggggaaggggggggggtttagcgatcgggccatactccgctggttatttctccgaatattcgcgccatg

SEQ ID NO: 103910 - DNA, 138 bp, Heterodera glycines
  Promoter: Source sequence=SeqID_188; Location=9379..9516; Strand=+; Gene=SeqID_76957
attagtgaaaaataaaatcaatttaaattgtccatatttaaattttgtgaattatctcgttctaatttcaaattaatttaaaaaggtaacaaaacttggtggttatgtgcggtgccaatattttattccattgcaatg

SEQ ID NO: 103911 - DNA, 246 bp, Heterodera glycines
  Promoter: Source sequence=SeqID_26084; Location=917..1162; Strand=+; Gene=SeqID_56833
attacatgctgtagaatggattcgcgctgccagcgccttcacaatactatggtgacgtgcctgtgctacaagacaatgcggatgaaattgaggaaatggacactgttcaacaacgattggctagcaggaggaaactaaaaaagcacgatgatgatgatgattggcaagacaaaaaatacaaaaatttactataaacctccccctgctcgccggcccccgtctcgtccagcaaaaattgaaccaatg

SEQ ID NO: 103912 - DNA, 55 bp, Heterodera glycines
  Promoter: Source sequence=SeqID_14039; Location=648..702; Strand=+; Gene=SeqID_78016
ttgccttttaagcgccccctcgggatgggaggagccctatcggagagataaaatg

SEQ ID NO: 103913 - DNA, 293 bp, Heterodera glycines
  Promoter: Source sequence=SeqID_578; Location=557..849; Strand=-; Gene=SeqID_45957
actgaccaaagagtgacggatgataaatgacacagtgaccgatggatggtcgattggggcggacccgtggcgattaaaggagattttttttgtttctttgttatcgttaccagcacaaccatttttgtttgagactttctcgatttgtttgtttgctgaaaatttttgcgtttgcattttctttaattatccattcgttttaatcgttcattattttcaatatgcattcattctttttcctattaattttttttataacgcttgtcaattaattgcttacaattttgccgatg

SEQ ID NO: 103914 - DNA, 339 bp, Heterodera glycines
  Promoter: Source sequence=SeqID_17985; Location=748..1086; Strand=-; Gene=SeqID_82552
aatttctatagttaagaagtaattatcctcagtaatcgttggttaaattccgttggatttgcttcaactttttttttcattttagtacaattttctccgcgagaagttcgaattttttcgaggtccctacgacggctggaaaaattctgtgcgtcacaatttgtccatgcaagattatttctacaaattgccaaaggatgagcatggcaaagttggaaagggttggtccgcctaacgaattaaattaattagttccaattaattagcgtaataatttcaataaaactttttcaaatttttggccaccattggacatatggcaaagattggtttcaaatg

SEQ ID NO: 103915 - DNA, 61 bp, Heterodera glycines
  Promoter: Source sequence=SeqID_5075; Location=1..61; Strand=+; Gene =SeqID_56807
aatgagagtgccaaggtccaatgcgctgtacatctttctgatgcgtgcgcccagcgatatg

SEQ ID NO: 103916 - DNA, 115 bp, Heterodera glycines
  Promoter: Source sequence=SeqID_10164; Location=1734..1848; Strand=-; Gene=SeqID_73270
tttctccaaccgatggccgatttttcagtggccaaagtaattgttaattaattgccgcaaattataacaaacgaaccaaaatgccgataatttttagtcgcaccaaagacaaatg

SEQ ID NO: 103917 - DNA, 324 bp, Heterodera glycines
  Promoter: Source sequence=SeqID_37076; Location=1..324; Strand=+; Gene=SeqID_66245
attttcaatgaaaaccaatcaaattgatatttttaacttttttaattgaatgatataaattgatttaaaaaaatatatacaattgttgcgatttgaaatcaatttatttgcacacagaggtggagccgtcccgggtggagcagttggtcaagggagacaaggcggacatgttgctgtaccaaccgcagtttgcggagcgtggcgtcagttttgggagcagtggtggctcaacagtcggtgctagcgttacggcaattgtcaaattggtgccccatttttttgggatttttgttaggcaaattaaaattttttttgtaggaaatg

SEQ ID NO: 103918 - DNA, 126 bp, Heterodera glycines
  Promoter: Source sequence=SeqID_43637; Location=779..904; Strand=-; Gene=SeqID_71268
tctgaaaaaatacttatgaattaattttgcaaaaaataaataattaatgaaaaagtcagaatttcgaaaaattttaaaaacaacaagcgttggcattttttcaggttaagttagtcctttacaatg

SEQ ID NO: 103919 - DNA, 52 bp, Heterodera glycines
  Promoter: Source sequence=SeqID_26291; Location=66..117; Strand=+; Gene=SeqID_57037
tgtaagtgaccccgaggaattcactgaataaaaataaggcaaaattcagatg

SEQ ID NO: 103920 - DNA, 126 bp, Heterodera glycines
  Promoter: Source sequence=SeqID_24387; Location=1154..1279; Strand=+; Gene=SeqID_55117
tgccgcctttcgctcccacgcgcaccacaaaaagaccctttttcatttcggacccttccggcactttggaacaacttcggcccggcattttcgcctgttcgttttccccggttaattctcaaaatg

SEQ ID NO: 103921 - DNA, 109 bp, Heterodera glycines
  Promoter: Source sequence=SeqID_11425; Location=888..996; Strand=+; Gene=SeqID_74817
agattttcactggtaccccctccaagacctacctcactaaataaaattcatcgcgaaatttttctgaaaatccacaaaattttacaattttttgtggaaaacaaaaatg

SEQ ID NO: 103922 - DNA, 190 bp, Heterodera glycines
  Promoter: Source sequence=SeqID_8291; Location=310..499; Strand=-; Gene=SeqID_67591
tttttaatttgcctatgcttttggtttccgattaaaattatttggattaattgccatttaatttcggtttccaattgtttagccatttctccgtgccaccacttctgcctgcttcaaaattcgacttaaactttttgaatcaaccgaaattggggcatttgaattggtgaacgagcggaccaacgaaatg

SEQ ID NO: 103923 - DNA, 247 bp, Heterodera glycines
  Promoter: Source sequence=SeqID_2233; Location=747..993; Strand=+; Gene=SeqID_78626
aaaaggcgtgtttcattttttattcattaagaatttaatctaatatataatatatatttatacaaggaaattaaaacaaaaagaaatatttggataaatatttgtaaaatgcacttaattaagttttaccaaattctatttcatcgaatacaaaatcaaaattgcacaacaatctgttaagattaatttgccaaattggaatttgccttataatgtttatatgaaaaatgaaaaggaattaaaaatg

SEQ ID NO: 103924 - DNA, 237 bp, Heterodera glycines
  Promoter: Source sequence=SeqID_16296; Location=696..932; Strand=-; Gene=SeqID_80685
ttggtttgtggtaaaaggcaaaaaccctatgggaggaaaatataaattaaattatttttagaatcctttgactgtcgctcggggcgatgacgaatttccaggaaatgaaatagaagaaaaggcgcttttcgaagaggacgaagcagccaaaattgaactggcgaaatgcgaagaagcaaacaaaaggccgcgcaaaaactttgacactaacttttaaatttcacaatttttaggatg

SEQ ID NO: 103925 - DNA, 387 bp, Heterodera glycines
  Promoter: Source sequence=SeqID_12953; Location=1009..1395; Strand=-; Gene=SeqID_76707
accagaaaaacgaatacaatccatttatttaaactgaaattttatgggtttctattttaaacatgcatttgcgcttttaaaaatgacagaatatcgcatgaaaatgaattattttgttttgtccattgtcaggttgtggtcggagtccgttctttgcctcaaattcgcttcaaacgcaacactttgcttcttccggatgcgataaaagttttaagatttattgttaacacataatgaaatcatttatttgttcccaagggcgagtggcgtcgagacgcgagccgagctgaatatttggctgcggaggagttggacaattggcttgtgctctgtgctcgtcagaatacgaatctcgtcaaagattttgtgcggcgtatgtgcgaaatg

SEQ ID NO: 103926 - DNA, 162 bp, Heterodera glycines
  Promoter: Source sequence=SeqID_1480; Location=2865..3026; Strand=-; Gene=SeqID_46886
ggttttgattttaagcgatacaaaaaagactcggctcccaaaattggaaaaataaggcgaaaaaatataaataaacttcaatcgtcagtcgggccaccaatggttgtaaagaccaaaaataaacgtctgcgtgttgactcattaggaacctattaaaaaatg

SEQ ID NO: 103927 - DNA, 642 bp, Heterodera glycines
  Promoter: Source sequence=SeqID_29373; Location=1..642; Strand=+; Gene=SeqID_59877
aaaagataaaatatgcgaaaatgcgaaagcgaaattttttctacaactttttaatagttaaaagcataaagcaaaaatcattttttaaattttattccaaatttaaaaatcaataaaaattagggggtgtgtattttacaaaatttttagccgttttcgccaaaaaattactatttttgttattttgttctctatttttcaaaatatggtaaaataggggtccggcggtgccggcaggcgccgccgggaaaatttttgaaaatttgattaaaatttgttgacagattttcactaaaaaatgatcaaattttgtgatttttatcatttttctaatgagaaataagagttttggggcgccgctgaaaacagtttttcatcaaattaccaaattttgcgattttgggccattttctaagaaaaaataggagttttgggggcgcggcggtgccgataggcgccgccggggaaaaaaattggaaattttgatcatttataaacagtttttcactgaaaattagccaatttataggtaaaattttgaaaaattttatgggaatttaatccaattcttaggggtgtaaaagtcgcatttcgcgccaaaaagcgaaatgcgaaaagcgaaatgcgaaacgccaaaaaatg

SEQ ID NO: 103928 - DNA, 778 bp, Heterodera glycines
  Promoter: Source sequence=SeqID_15337; Location=1066..1843; Strand=+; Gene=SeqID_79581
tttttgcttaattacaaaaatttattattttttaactaataaaaatttttcctttttttcattggaataatacgataaaatcatttgatggacatatttatgatttgctgaataaatgattgaaaatgagaatgggatgggatgcatttttgtgatgattcaatgcgaaaacggattaattaatgcataaatattccaataaatagaaaataatatgttaatttaacaactaaataaatgaacaattttattataaatttatatgattttaaatatttttaaatcagttttaaaaaatggaagtcccggtcccgatcaaaaccgggacttaggtactcagttgtcccatttttttcagtaccaggtcccagtcccgttctactcttaaaactttgttcataaacaaccaaattttaattttttgcttctcaatttggctttaaaaatctaaattttatagcggttaaattgtcggaatttgcttaaattaaattgttttttagttgtatttggatttaaataatatccgtcctagctggtcactaattggatgcgcattttcttatggaatcatcgctacacagctgtaaatcaactcgtactacagcacatcaaaatcaaccgcctggaatacgctgatcaccacatgaaagctaagtgattgttaaatgtttaaaaaccgaatcattgtaaatatttgtatgaatttattgatttaattatgaagataatattttgtttgaaaaattactatattttttaatcaaattttagcatg

SEQ ID NO: 103929 - DNA, 1003 bp, Heterodera glycines
  Promoter: Source sequence=SeqID_19213; Location=184..1186; Strand=+; Gene=SeqID_83957
tagaaatgtttagaaaaattgaatttttagaattaaaattgtcggtgatttttatttgttaaaaatattgaaaaaataaaacgcaattctttgaacaataaaaaaaattgctttatatttatcatgggattaattatcaataaatattaaattttaaacaaacttcatttttacacgaaaatatatattaaacacaccgtttcagttttggcctcccagttccaaaaagatttgcatgtgtggctcagtggtttttgtaagatagtaaagggacaaagggtggtggttcgagtccgttgtgcaacatgaatatttttatttatttttgtccaaaatattaaaaaatgacgaattttgggaattatttttgaagggttttcccaaccaaattggacaatcatggtatcattcgaaagctcttgatgaggagaagctttttctaagcaaatgttaagcgatttaacgatttagaaaaaagataagagcgttcgaaaatttgttttttggataactttttagtaagccttatttttgcaaaaatctcctatattattcgatgcagaaaatttttctctatcggtatgcaaaatttaaagaacatctgtaagggagaaaaaaaagttctatagagcgaagtaaattcggttttctctattaacagagataaagaaatagtacgccaaaaaaaagagatgtttttttctctgcactctctatttattggttcatgtctcgttttttgaaacggtgtgtaaagtaatcaaaaaaaaatcatgatttttgatgattttaagccgaatattgcagccttgtgaaattaagatttttaacaaaagtttcaaaaaatttgtaagaaatacagtaattggggctgtacagtaatttaacggaatttcttatcctgtattaccattattggaagattaatataatcagaattttccgagaccaaaagcatttttatccctcccccctgtttaggccaattcttcctgacccaatg

SEQ ID NO: 103930 - DNA, 845 bp, Heterodera glycines
  Promoter: Source sequence=SeqID_1549; Location=1794..2638; Strand=-; Gene=SeqID_74387
taatgatagcttctaaacacgttgagctttcgttgaaacaaattttgaagaaactaaatgacgaacaaaaaaattatggccattcccatttgaaattgtacgaactgccttgacaccgaaaatcccggtcccgtggcttttgaaaaatcattgattttatctaggatttttcgttaagtaattgatttttcaaacaaaaattaaagaaaattattcagacttctcgaggttttttgggtcgtttatcacgaatatggcatttattttggcttatttagaaccacggacccgaattcgaacaaaatatcggaaattaattaaaaaattcattttaacttctaaaatagattaaaacaagccaaaattaatcagaaaaccatcacctaaaaataatcattctgctcagattcgaacccgcccccgcggggacgggggcgggggtttgctttgaattaggtccaaaaatctcacaaaaaaatattttttaagaatgatttctttggctccacttcctttatttgttgatcgcctcgatactatttcttttgacataaattgcacagatttcgactaaaaagtaaccaaaatttaggggttggggtcatttccctaccgccaattccctaccagccatttccctaccgccatttccctactaaggcatttgggccatttccctaccaaaaatttggcgctatattaaaagtgggtctttatgaaacaaaaggggggacccttttgttttgcaaaatttttttaagataaaaaaccatgataattttttatccggagttttaaaggtcgctaatcacgaatctgacatgtattttattaggttcatcatg

SEQ ID NO: 103931 - DNA, 310 bp, Heterodera glycines
  Promoter: Source sequence=SeqID_9478; Location=3368..3677; Strand=-; Gene=SeqID_71564
accaagcctaaggaggcctctaaaaattttttgaaatttcaattaatcactatttgggtattagaatttttcagttttgacatttttaggcccgctggtccatcattcattatattttcaaacttggaaaatttttggcttttttgtcagtctaatgaaattttttgaaaattttcatctgctgggagccctggcctaatgccaaatttgtaccattagtgaatatttaagcctcgtagcctcgctttggcataatttgcacaaaattgacccttacaaattagggcctacccctctctcattatcaatg

SEQ ID NO: 103932 - DNA, 195 bp, Heterodera glycines
  misc_feature (40)..(40): n is a, c, g, or t
  misc_feature (59)..(60): n is a, c, g, or t
  Promoter: Source sequence=SeqID_19551; Location=1861..2055; Strand=-; Gene=SeqID_84283
tatgaccaaagaaagtggcgatggacgcttaatgtgcatnagtgccaaaagcatccctnntagtacatcgaccacagtgtcgtcgcatttctccgttccaataagcaagcttttgaccgaggcaccaacttggatttgtcaataatacattccatcgacgaaactgctaaacacaagcagatttgggatgttatg

SEQ ID NO: 103933 - DNA, 617 bp, Heterodera glycines
  Promoter: Source sequence=SeqID_6876; Location=2045..2661; Strand=+; Gene=SeqID_63179
tccttttattgactccctttccctcaccaaatcactcacccggcttcagaaaggcgaacaaacacccgccaccgccggcaccggcgggaaaagtttccggcggtacagtcggtccatcctccaccaaaaaattttggaaaaatatgtaatgcggtaaaaaaaattgaaaatttgttagtagatctcacaaattaaggagttttagaaaattttaaatttagaatttttgatagttttaaaaaaaaggttgattggttaaattttgagatgatttttgttttctaaattgaaggcaaacaattttattcccgccccgttttattccggcagtttgaaatacaaattccgcccggcccgattatgttccgtaaaaatacgaaccaaaaatttctgattaattaataattaggtgttcgttaaaagagaattctcgtctcttttcttgacttttagcgcgtctcgttctcgtttttttctacattttctcttgtcttgtattttctttttcttttctcaatatccctgttgttagttttctcatatttatttttcattgaaaccaaagcattgtctaaaattggcttgtataataatccttttatttagcggcaataatg

SEQ ID NO: 103934 - DNA, 334 bp, Heterodera glycines
  Promoter: Source sequence=SeqID_28549; Location=779..1112; Strand=-; Gene=SeqID_59153
ttattttgattaaaattttttcgacaaatgctcctcccactccacgacaacaaatatcttaattaatatattaaaataatttaataaaagtattgactaggaatcaaccatctttgaaaaagcttgctggacttgaccttttcatgcttgacttggtcctgcaggaaaacctaggcttaagaaaaacgagagaaaccaacagggcctgggccaggcttgccaaagcctctatcctaacatttagcttgcttttcttggaatacggtttaaaactgacataaaaaagtcttttttttcgaaattttaaaaaatatgtccataatctttcgttatg

SEQ ID NO: 103935 - DNA, 229 bp, Heterodera glycines
  Promoter: Source sequence=SeqID_9435; Location=1157..1385; Strand=-; Gene=SeqID_71411
ttaaggggttaatgagggataatgaggggagggagaggcgggacaaaaccaataaaaatgatagagacgataagtattatggaatggaaaataaaacagaatcaaagacaagaacggcggaccatttgcacttcttaaggagcgaagaaattccgtgctaatgattgggttaactttgtttaatggcaccgatggaaaagtgatttggtaagtgatttgtgggcaaatg

SEQ ID NO: 103936 - DNA, 164 bp, Heterodera glycines
  Promoter: Source sequence=SeqID_10325; Location=1620..1783; Strand=-; Gene=SeqID_73504
ttttggaaaaaattggtgaaatgaatttgagttttggccagatgaaatatgttggttgggagtgggtgtgcctcctcggcaaagtttggagtaggcgtggcatcccttttccggatataaaagtgaaacccatccacatctgactttcattttctcctgcaatg

SEQ ID NO: 103937 - DNA, 590 bp, Heterodera glycines
  Promoter: Source sequence=SeqID_24177; Location=555..1144; Strand=+; Gene=SeqID_54889
ggaggacaacggacagtagcagaagagccacccggaagcggattcgtgttgagtatcctattgtatatatgcatatgtatttttgtatcatgttttgtgccgcatttatgatcatctccacacatttgatgtacctattgatgtatttgtatgtgctatgtatatttcgttcacatatgtctgaatgaattgtgtttaaagaatgaaagtgttcttgtgactataaataagacgaattttgagtaaaaattgagttaaattattttctatatacagtgtgtaaatttagaatagggacgactgttttttcgggagtttgacttgtcggaaaaccgatttcgaggcccccacaaaaaagaaatgtgaaaaatgaattttcataaaaattcttcagtttttcaactttgtctgcggcgattgttggcttttggtgttcgattttcttgcgcctgctcagctcggcctcgaaattgcactgatcaaccgccgtttttgacttttacgtggacgaacacttcaaaacgcgcaaatggaaattgggcggaatacgaatttggcacaaaattggagagaatggcaccaaacaaatg

SEQ ID NO: 103938 - DNA, 440 bp, Heterodera glycines
  Promoter: Source sequence=SeqID_41566; Location=162..601; Strand=+; Gene=SeqID_69648
ttgttgggatgctatcgtggccgagctttcgacatattgaaacttttaccccctggaggtgtcgggttttcggtgaaattcggcaacactagttaccgggtttccgtttacgttttgtcggaaaatcgcttttttcatcatatttatgccggaatgttcagcttagtgggcgaggctctccagctgggcccctaccatgaccaacgggtggtggacgtggcacgacgcgagttggccgaggcgtaccaattggacgagcgcagcgtaagccgatggcattgaaattttcctagggctcactcaagttacgagacattgagaattgatcccccgagacttgagaaaacccgaaactttctcatcgatattcgtgttcgagaacagaacacaatcatttttatttgccgcaacaaaatgaatgatttttgtcgcgtcagatg

SEQ ID NO: 103939 - DNA, 148 bp, Heterodera glycines
  Promoter: Source sequence=SeqID_9424; Location=1..148; Strand=+; Gene= SeqID_71360
atgtttatgtaaatcccataagttgtcctatatgtaaacgagttgagtttaagggttaattctgtctccaacagcgcaatccaaggcaattaccttgacgagggagtcctcggagtgaaaggtaatgtttattatccaaataattatg

SEQ ID NO: 103940 - DNA, 966 bp, Heterodera glycines
  Promoter: Source sequence=SeqID_18431; Location=1..966; Strand=+; Gene=SeqID_83027
atggtgtaaattattagaagagatgatgtaaccgtaccacttgattggttggctcattcacatacataactaataattatatttactttcaaaatgtaatttttattatattatcttacattaaaaatatctatttttatttatgataatggttcttttgtatattataaataagaatatacatatataaatttatttcataaaggtatttgtctattttagagctaatatcattctgcatatctttttttaaacaattttacaatctcatgagttgtcttttttattctttttttgcttttttatttatattttttaaagaaatataactgcttaaaataaatcatttaaaaattaggatagtattgcttttaaatgaggacattctgttgcaaatttttattttatacattaatcctttttgaaggagtattttattaatattttttaaatttaaattaaactattttaatatctttcaaaaaactcttattattcatttaaattgataataattttttggttgtttataattatatgtaattttttatatattaaaatttaaataaaccattattttatggcctctttttattttggcattttttttcttgtattgagagggtccaaagatttattaaatttcttccatattttatttaatctgttttttttcaaaataacttaatattttattaaagtgtcgaatatagttttgtcattgtggaccacgagtgctgcgaggctaaagctgtacgagtacatggagcaggtctacaagaaggaggggtgtaaactgctctattgtgacacaggtgaaaaggaataaaaagaaaataaacaccaaaattttagattctctagcttttgctcatcggaaggggcgctgtccgttggtggaggggaaatttttggggtaaaacataatttttgaaaattttctataaacatttgtttagtgagatg

SEQ ID NO: 103941 - DNA, 344 bp, Heterodera glycines
  Promoter: Source sequence=SeqID_10805; Location=484..827; Strand=-; Gene=SeqID_74069
aacactgtgctaatttgtgagtttaaatgaataaatttaaatatggtacagaaatattatgccatagggacggacatttcgcaaaattcaaaaaaaaatttctgcattaaattttcgaaaatctgcctgtttataaaagttgacgaccatcaaatgggtggctttcaggctggaaaaaaggagatattaaaaaagaaatgtaaatatttgtaaatttcttaaaatttcgcaaattatgcctaattttgctgcagaacattgtgaaaataatgccccgagttaggcaaatacgattggcgattcatgcatgtttttaatccatacaggcacagtctctagcaatg

SEQ ID NO: 103942 - DNA, 92 bp, Heterodera glycines
  Promoter: Source sequence=SeqID_31275; Location=1..92; Strand=+; Gene= SeqID_61644
cagtacggtatcattgccatgaaggtcaaattaaaattagaaaattaatacatttttaaaatttatttcagagaaaaattcttagccaaatg

SEQ ID NO: 103943 - DNA, 316 bp, Heterodera glycines
  Promoter: Source sequence=SeqID_2162; Location=3298..3613; Strand=-; Gene=SeqID_78187
ataaatattctaaatatgaaaaccaaaataagactaaaactgattatttaaaaaaaatagtaaaaaataaagggattaaaagtagagtgccacgggaccgggacctggtagcggacaactgagtaccaaggtctcggttttgaccgggaccgggactagtcccggttttcccagccaaaaattcccggtttttcaacccgaaaaggtcacggtcccgggtttgcccaaaattcccggtcccgtggcactctaattaaaagggattttttggaaaaatgtccaaataagcacaaaaaagcataaatcgcgaaatatg

SEQ ID NO: 103944 - DNA, 1003 bp, Heterodera glycines
  Promoter: Source sequence=SeqID_5376; Location=2088..3090; Strand=-; Gene=SeqID_57815
caatagaataaaatacataaataaaataaaaatgcaaattaatataatttaattgctaaaaaatgctagaaaatcgaaaaactgaactgacaaaaaaatcggacccaaaaatggtcgtagtttaaaaaaaaaatttaatatccacaaaatttacaaaaatgattagtggtactgtatttaaaaaaacagattctacggaaaatttaaatatgctgtatcgggaacactaaatttcagtaactaccgtttaagcctaaacaatcaaattatcacactaccgtatatctctcattttgaaaaatactatctttagcattacaatatgttgcgatcaaatcttctatcgcccatgatgacatcacaaattccatttttagtagcgccgattttccgttattttcccttcgacgcacacattttgttattttgtatatttatttttgcatttttttttgcgtcatcacaacgccacactttcgttgttcccactccgcccgcgcggggactcgtttttctgatcggaaaaatgagacaattcctgcgactctgatcggacacaattaaaaatttgttcttcatccgtctgattggccgacgaatttttcattgtgtccactcactgtccgtcctccatcagttactctaccagcgaaccacacactttccatggacgaacaataacaaattaattggccataattaggtggacgtcactggacaaaaaattgggagtgtgtcccgatcggtataaattgggacgaaatgtgacgatagaacagaaccacaaacccacaaaaatttggaatattaaataaatttaaatatatttatttacccccccccctcaaaaataataataaataaaaatatattttaaataattttaaatttagaaaattaaaaaaacaaaatttaaaaaataaaatgcaattgctcttcacattcccaattctgttggtcattctgtttgcaaacattgaccagaaccaacattttgctgatg

SEQ ID NO: 103945 - DNA, 191 bp, Heterodera glycines
  Promoter: Source sequence=SeqID_1968; Location=2327..2517; Strand=-; Gene=SeqID_77093
attataattaaatttataccattatatttcaagataaatttaaaaagaacaaataaaaatttgtcatttttgttctaattttttgcataaatatcttttgtcatttatggcaaaaaatgcaaaaaaaagggtaaacaaaaggaatggcatgaaatttcatactaaaattgaaaaaagaataaaataaaatg

SEQ ID NO: 103946 - DNA, 55 bp, Heterodera glycines
  Promoter: Source sequence=SeqID_23821; Location=1449..1503; Strand=-; Gene=SeqID_45814
ggtgattaatttttattattttaaataattttattttttacaatattttaaaatg

SEQ ID NO: 103947 - DNA, 872 bp, Heterodera glycines
  Promoter: Source sequence=SeqID_14053; Location=1315..2186; Strand=-; Gene=SeqID_78027
ccattttgtacgatgcttttttagtcaacctcccccccccccccaccccctccccattcggattcttatacatatataaacacaaacacacacataatacaccctacacccccacccccactgactcatcctctaatgttactttgaaaaaaggggagaaaaaagagtgggggggggaatgagtgaggttgaggttgaatggcgaattttttttttcatagatgaaacatttttttaactacatataaaattaaccgttttaaaaagaaattgctatgtaaaaaagagatgcatttggcagcaaatttgtcttcgttttatgtttgaattttttttttctaaaaataaaatttagtttttggcaaattgtggcactcaacaggggtggcgcggaatttcgattcccaacaagttttgggcattggatcagagatttccgagaaattttgggacctcggaattatatatgtattctccattcttcctctttatttaattatttgacagtaacacttttcgctcttccctatcaattaccaaataaacgctaatcacttttttacgtagaaccaaaatgtcccctccgttccatcaatccaagttctcgtgatcacaataattctatgtattcattcgtcatttattcgggaatgaaactgtccacttcgtccctattttctcccccgcaatattacacatttttaaatttctgaaattttgtttgtttaattcaaattttaatttcctcgtgtatttagaggccagagatacctacaattataatctaggccattctatagcatatatacatatatataattgtatatacctaattatcttcaacacgcttttgttgcccttgccagtaaatg

SEQ ID NO: 103948 - DNA, 151 bp, Heterodera glycines
  Promoter: Source sequence=SeqID_6981; Location=1202..1352; Strand=+; Gene=SeqID_63477
tgtatgttggggcgcacaaaggtagtcactgtaactgtattacagtattcttagattatattttttatttgacataaattgcgcggattttgttggagaagggagcaaaagtgcggagcaagaacaatgctggatggagcgctataaaatg

SEQ ID NO: 103949 - DNA, 862 bp, Heterodera glycines
  Promoter: Source sequence=SeqID_39182; Location=384..1245; Strand=-; Gene=SeqID_67815
tattaacttagcgccaaaatgtttgtgattttgacccataattataataattgtttacttttgttttcacatgcgacaattttcaaaaattaatctgagaatatatgcttgataataatgaaaacggattgtgattatgaaaaaactgtgtgaatttgtttaaaaaaaatttatcaggcaaattgtgttggccatcaaattttggtaagtaaagcctacaaatttaatttttttgagttattaatttcattcatattgcaaaaaaatttacctattttttcttacaaaaatggacgacctaaaaatacggtgggggtcgtttgagtgtggccattttctctcttttgtacggtgttatggcgttactcaaaaaagcatcaaacaaattttttttttttttttgcccataactttgctaaaaacaacaaatttttcaacttaatatcaattgatagcactcagtgttctctattagcctctaataaatttcaaaaaattttaatagtttcagaaagttgtgtttataattaaatattacttttagtcaaaattttccatttgatggtttttgagttacaactcaacacttttcttcccaatggttcgcttttactgtcatttacactctttccatttacctatttatctatccattggtttcctttttcaatgatttcttttgcataaaaacgttactactgaatgataatttagactctatataaatgcgaactggatttttttctggagcagcaacaacaaattatttgaaaggaaacagaacaaagcgtgaactttggctaggccgaagcttatgcttgcttaggcctgggcttacgcttaggctttatcttgcaaaatg

SEQ ID NO: 103950 - DNA, 201 bp, Heterodera glycines
  Promoter: Source sequence=SeqID_3158; Location=4225..4425; Strand=+; Gene=SeqID_83470
gcgctcaaattcatggattggtacgccaaaaagaacggggtgagcatccagacggcacactcgccaggcggagagaaaaaaattggccagtacactgtggacggatacatcgcggcgaccgacaccgtgattgaggtcaacggctgccattggcacgcgcacgacaatccacgtcaccgttttcagccccaaacaatgatg

SEQ ID NO: 103951 - DNA, 99 bp, Heterodera glycines
  Promoter: Source sequence=SeqID_4476; Location=1035..1133; Strand=-; Gene=SeqID_54586
ggtatttccttgataatatttcaccttcatattttgggtactttttgcttttaagttcgtactgtttttgcgaatgtggctacaaaatacgacctgatg

SEQ ID NO: 103952 - DNA, 571 bp, Heterodera glycines
  Promoter: Source sequence=SeqID_4013; Location=2070..2640; Strand=+; Gene=SeqID_52809
aaatgccgtgatggttggacgcataaatttaaagaagtccaaaaagcaacagtttcaattcacaagtgatttacaagggattacagctttattgtccgaatacattcatacaatatatacatatttatgtacacataatttgggtgttgcattgaaattcgttttgtgaaatttttaattcgggcggcttacaggtcggccagcgcaacatttggatggtccgacattgctcaattgtcgtcgttttcgttgtacacagagaagggatgattgatgaagatgaattgccgataattaatgaatgatgaaaataatggcaaccaaatgaattttttgtgccttttatatatgaatttatccgaaaaatttgactcttccgactaaaaaatttgctatttaaggcccacacattttgcttatccacgttcattccgttcattcattccatccacttaattattcgtcctcctccaccgccacttaaatcgtcagtttatttaggtaattaattgttttgttatgtgcattttcattgtgctaattgccccccccccccatttttcagcgaatg

SEQ ID NO: 103953 - DNA, 157 bp, Heterodera glycines
  Promoter: Source sequence=SeqID_3264; Location=972..1128; Strand=+; Gene=SeqID_83962
gttaaaaaattctttggaattactaacggaagtacaaaaatatttggtcaaaattcgggcaataaaaacataaaagtttagcctcttttataaattattattttcgatacttttttttgccatgggaattattgtaaaagattttcattaagaaatg

SEQ ID NO: 103954 - DNA, 1003 bp, Heterodera glycines
  Promoter: Source sequence=SeqID_9703; Location=1073..2075; Strand=+; Gene=SeqID_72422
ttcgcctaacaagaaaaagcattgaaacgaaaggacaattcattgtccagcagttgttttttcttttcaattcacttcatatgtttgtttgtttctcatataaaacgcaatcgaacgaagcctaatggaatcaacaatagcaaagcaatttttcaccaaattccttaaagtttcaaaaaaaagaattataattttattatatgcatttaaaaactttttccataacattctttagcgataaatattaaatatacagtgtgacaaataagtcttgcaccacctatgcttttgatgtaacttttaaaaattcaactaaaaatgaccaaaatatattcaaaatatgcacaacagattagggaatattgctacataatagtttatcccatctttcgagagtcataacatagagacaaaaatgtgccaaaaaaattttcaggtggcacgcaactcccgaatcaatattttggcataatcctagttaatttcttctatttgtctacagtgaatccatcttcattttatgcacaaaaatttccaaactaactaatttttttatcaatttcgcccgcacaattgccatcaagaaaataaataaatatattttggagacgaatttttgagaaattttcctttcttaggggtatatttttgaaaaattttggtcaattttaggaatttatttttttgaaatttttgggaccgattcttagggggtgtattttttgtttttattgcatttttgctataaatttctggaaaaaggccaaaataggtgctaaagttcgaaaaatgccaaaataggtgctaccccccgttttaggtgtttttaggtgctaaaaagttgctctaaatcaacaattgttcggagaaaagtgtttttcgtgcttctctcatcaagtactagccgtaaaaaataggtaaaaacttaaaaatccggtctctagtaatcaccatcgttttcatgcttatttttaaagaactaatgtttttttagatgaaaatg

SEQ ID NO: 103955 - DNA, 69 bp, Heterodera glycines
  Promoter: Source sequence=SeqID_21497; Location=1305..1373; Strand=-; Gene=SeqID_52106
aaggagacaacacgtcaattgagccccgtttccattttacccattcttaaagcgttgaatgccaaaatg

SEQ ID NO: 103956 - DNA, 312 bp, Heterodera glycines
  Promoter: Source sequence=SeqID_26542; Location=1..312; Strand=+; Gene=SeqID_57280
ttccgcccactgttcttcgcattggtgtcgcttgtcctttttggcctaggcatagtggcaatgctttgctctgtgtacttatataaagtgagcgagcgtaacgcgtggccacaaaaattctttcccggcaaaattgtgaccaaaaaattgcttttaaatcaaaatccgatggattttttgatcaaattgagatttggcttttgtcactgttgagtttctgtgttcgcgagtttgtcaaaatatgtttcattaacaattacgtgattatgtcatttaccttatttcgttttcagttcaccgtctattttcatg

SEQ ID NO: 103957 - DNA, 1003 bp, Heterodera glycines
  Promoter: Source sequence=SeqID_12639; Location=1339..2341; Strand=-; Gene=SeqID_76314
ggaattttcgatatcgagcatcactaaatattaaccaagctcccttatccccgtcgggtaactcttgttggtgagcggggtccgtcagaatgacaagtcggggatggttctaggtcgtttctaaaatccggtattttagcgaattttcgacaaaacatgccataactttgcttaagcgcaatcaaattttcccggcagcgccaatcggcaccgccggacgtgaaattctgttaataaaatgcatttaaattttcaaattttttcactgcggcgcctaccgacatcgccggcccgctgttcccaaaaaagcgtgccgcaaatttttattcatttttttttaattggaataaatttttgcaaaattgctgattttggattctaaatgctgatattgaagatttgcactaagtagcactgtttttaattgttttaacaatttaaaacgtcgttttttcaaaaaaaatcgtaattttggggcaaaatcttagttttaacctcgtttgtccctattttgaaaatacatttttggagccctgcgtaataaacttgctggattcgtctggacaattcactttattttaaaatcagcaacaacaacaacaaaaaaggaggagaggtcggcgcaaaaacaaaaaccaaataaaactatgaaagtgcactgacaaacgaatggaataagcctaatattttttagaaaaaaaaaattaaaaattgtcgtcgtaaaaatttttgaaaattgctgaaaattatttatataatatttgtacaatttttaagagcctgttacactttgttcgtgcaccacaaagagtctttaaaatggtttcacgcatttacattccgaaaaccacttcaaaaaactttgacaatatataaaagataataattaaagaatatttaattaattctcaaaaatgaatttaattttttttttacattaattcatttttgaacatttaatctgattttcaatgcttttattcaggattttttttcgggaatg

SEQ ID NO: 103958 - DNA, 1003 bp, Heterodera glycines
  Promoter: Source sequence=SeqID_10234; Location=5873..6875; Strand=-; Gene=SeqID_73379
tttgtttatagaaaaaaataataataaattaaaagaaatgatcttttaacgaacttttctcataatcctgggaattttcttgctacttttaatatttttaagtgactatgtgccgtgaaatttcggtgtaagaaacgaactgcacgacctggaaaataatcaacattgatcagaaattgaacaataaataatacaagtttatttaaataatttctataaaattaaactagacacattaatttattaaataattaataataaattcaaaatataatagtatatattaataggtttattttgataaatttaaagtaggatattaaaatttaaacattctcgctgatcacgtccgcagtggaataaatataaattgtgtaaagaaatcagtgtacaaaagtgtaaagaattaaacaatcattgagtaattattcactattaaaataactgttaatataattatattaatttaaaaatctacaaatatcaaaaagtaaaacaaattttatttaaaaaactagttaataaatattcataaagacattcttaagatttttacaatataaattcggattgagaaataaaaaaaaccaaaatttactttaatataatattcaaaaaccaaaaataattttaggttaaatcaatttgaacctaaaagatcaaaaaagtttctcgtaattaaactaatttctttttcctaaaataacaatgccacagatgaaaccattaattctattatacaattaaagaattaaattttgaagtttaataaatatccgttgataaatatttgccaagagattgagcatcttaattcgaccgtgaagaaaaaattaataatttaaataataaaatgaaataaaaacaaatcctctttatgtttaataaaagattatattttttatttggcaaacggtagtccaaagaaaattaaaattctttccattgcattatattttttcaagacttggcgtcgagaatttctggtcaaaaacaatgcatg

SEQ ID NO: 103959 - DNA, 56 bp, Heterodera glycines
  Promoter: Source sequence=SeqID_27829; Location=225..280; Strand=+; Gene=SeqID_58507
tcttcaaaattaacaacaacgacaactattgcctcttttatgctctggaattaatg

SEQ ID NO: 103960 - DNA, 582 bp, Heterodera glycines
  misc_feature (278)..(278): n is a, c, g, or t
  Promoter: Source sequence=SeqID_3462; Location=1..582; Strand=+; Gene= SeqID_84759
ggttatggtgtaaatatgattttataataggggccgaaatttcactttttcacccagcgacacctaaaccaacaattcatcttatgtcaaaatcgcaaattttgtcattgtgtaaatctgtaaaaaattgcactcaaatttcaaaattttcccggcggcgcctacgagcacagccggagaaaaacccgttgataaatcaacaaaaaatttacgatggtgtccagggatggcgttcctaggaccctcaaattttaggaaatcagaattccgtgccatcncaggtggtgtctatcggcatcaccttacggttccttaaaaatttttacgacgaagcgcaaaaaaaaagtaaaaagttttttggagattttttaatttctcgaaatttttcgaaatttccaaaatccctgggatgccgcagattttaaatgcgggacttgcgggattaatctcacgggatcacgtcccgctaaaaatttctgagttccaatcacgcagcgggatccgcaaacttgaatttccagtctctaatatttataatttccctcttgaaagattattttattttattatatttttaagatg

SEQ ID NO: 103961 - DNA, 538 bp, Heterodera glycines
  Promoter: Source sequence=SeqID_24815; Location=845..1382; Strand=-; Gene=SeqID_55564
acccatagtgaatatagagaccggaaatttcaaatttgcggatcctgttgcaggattggaattcaaaattttttacaggacaggatccggcaggattaatcctgcaaatcctgcatttaaaatctgcaggatcctgcgcaggattgcggattttaggaaatttaaaaaaattctgtattaataaaagtctttcaaagtataaaaaagtattcaatatatttttaaaccaaaaaatgatgaagatgaaaaataaataacgtttttttgcttacactccaagcaatcgactgaatcttctttaatgcgtttaaaaagaccgatttgccaaattgggtggctcataataatagcttaaattaaagtaaaataatttttatttaaatttctttgcaaaaaagccataatccattatgtatagggatgggatttttaggcacaaaaaatcgcgaaataggcacttaaaaaggcagtaaatcctaaaataggcacgaaaatagtaaaaaaaatttggttctagtcgggttttacgcgtcccatg

SEQ ID NO: 103962 - DNA, 1003 bp, Heterodera glycines
  Promoter: Source sequence=SeqID_9278; Location=1130..2132; Strand=-; Gene=SeqID_70843
aatttttttccgaaatcctttcgtcttgtcactgttagaatcttaatattttcagaatcgctacgtacagttaaaatttcaactcgatcggttcatgggaactaacaaaaaataaggtgtccttatattaatgtaacacattaatcacttccatttttcttttagatattctttttaaatgaaataataaaattttgaacaaataaaaaaattgatcgaaaaatttgctgaaaattaatttaaaaaaatttatggaattaattagaaaaaaatagtattaaattaatcatatttagtattatttaaattgaaataagaatccgccgctggtcgcaatgttcgaaaatggtcccttaataaactgaccgcaaatgaccgattttcatcaggcaggtcatattataatgtcacttcccccccccccctccaattatttgtcctttttttgcataaataccctttcttcccattcattttgtcttttgaccatacttttccctctccgcttctgtgacctttcggcgtaacagaagcacatctccacacattccaattcatccatcgccggagggaatcgggggcaaatcccgtgggatcatcggatgaaagggcggaggatggacgatggatgagtctccctttcatccccctcccctttccttcctttcttttagtcatacgtttcttcccctccggcgctgaccatcccccaacatattttgcttttgctttcacctccctctctctctactctctccctccctctcccttttcacactgtctctccaatgcgcaattcgtccgattcgatcctttgtcgtctttcgctcacgacgtcaccgatcgaatgaccagcaaatttccgttgatttctcgaagcatgttcaattcatgctcagataaaaaatgggaaaatgaaattggagattttcttccctttgtgttgcgcattctgtccacttattagctaaaattatcccatttagccttacatcgcaaaatg

SEQ ID NO: 103963 - DNA, 912 bp, Heterodera glycines
  Promoter: Source sequence=SeqID_4971; Location=3319..4230; Strand=-; Gene=SeqID_56404
ttgtctccaatcactgctcgtctccattgcgataattcaattagaaattgtttcggcagtttgttcgatgatcttcaaaattcttgtgaaggtttcggctcttccgtcgttcttgtcggttgtccgaaaatggagaacatctgtcattctcatcatgtttcgtttagggccattacggtttctttttggttcgtacatttcggtcagatgaaatcgacttcgccattgttatgcaaattttctttgctgacaaatcgtctcttttcgcttcaaaatctcatcaaactttttctttgaatgggacgttcgccagtgccaataaattgaaggacggagaaaaggtgggcgaaataaaaaatgagaagattagtctgtccaaatgtcaagtggaaaactagcgggcttagattagaccaataaagggtggttttgagacttggaacgtaatttgcctatttttgtttattttcagtttttttccttgaatattttttgaattagtgcaaaaatcccgactgaataacgaaatcccggttccggactcgaatctcggtagctcaatggtcacggaagcgtggagacgcgggttcgacttccatccaatgaccaacattttacccatttcttgtttgttaaaatgtaaaagcatagcttaaggtatttttacatccgctctctgaaaatgctttaaatcggtgtgaatcagttgtgattaatcctttggataacggcgactgggaaaaaattgtaagttttttggaaatttcaaaatgtttctatgaaaaggggaattatatgccttcatttgcagctatttaaaggtgtcttcaaccgaacaaatagaagaactcctcctcggacagctccgcgtaattcagacgaatatgcgaatttgtgtccattttaaaaatg

SEQ ID NO: 103964 - DNA, 97 bp, Heterodera glycines
  Promoter: Source sequence=SeqID_32176; Location=257..353; Strand=+; Gene=SeqID_62502
acttcggcacacggccgatctgttgcgacaacagtacggcgcgttggttttggtgataaccgccggcggtctcgcgacggcggaggaccgcgcaatg

SEQ ID NO: 103965 - DNA, 500 bp, Heterodera glycines
  Promoter: Source sequence=SeqID_7750; Location=952..1451; Strand=-; Gene=SeqID_65818
cgaataagaaaatcaatttcagttaaatttcatcatttgcctttacaggtttaaaaacatgtttttcgtgcgtttcaggcttcccgcattccaggaaaaaaatatgcatgtgcatatttttggcatccctagtgatcaacaacaccgaaaactcccgggaatatacctacctattcacatttttatgtaacaatttttttttgcaaaacaaacgaggaatcgttgcgttgaaatcgttgaaatttcactctctgcaaattgcatgaaaatggcatttttggtgcatatgtaggtaaatgtgtatttctacggtcctcataatcacaatgtgaattcgtcccttaaactgaatgcagcgcactaaaattgtcgcgctaaccccccccccccccccaccctaccgcatcccccactcacgctaaaatattaatcaaaaaaacgcgcacaacaaaaattgggaaacccctgcgctcaaaattcatcacatttacagatttatg

SEQ ID NO: 103966 - DNA, 132 bp, Heterodera glycines
  Promoter: Source sequence=SeqID_10131; Location=1789..1920; Strand=+; Gene=SeqID_73222
gacattttccatacatttggacctgttaaaaaaatataaatttatcacattttgcgtgaataatgcacaattatggacatgaaacttttttattggaatgtaatttcgaaattaaatgctctttgaaagatg

SEQ ID NO: 103967 - DNA, 833 bp, Heterodera glycines
  Promoter: Source sequence=SeqID_2867; Location=1638..2470; Strand=-; Gene=SeqID_82049
aaatggattggcaaatttaataatataaacactgatttgtttttcttaatttttttatctccaaaatatcaaacaaaggattatggacggtaaattactcggaaatgtgagaaaaagcactgatttttctttttgcaaaaaagaaataaaagtcgaaaaataatttatatattaaaaatagtaaaatttttgattttattttatacaaaacaaacaataattaccaatgaatgcgagctgctgaaaaaaagtgatatttattgaaaaatttgtggcgacggacaaaaagtaatttcctattttgaattgtattcttttgtacaataaaatgtattgcaaaagatttaacaaaaaaaaagtaaaaaaagagagttttctttttgaaaaatataaataattttactttatagtttttatagtaaaaaatccctttttaaaaagtataaaaaacaattaaaaatattttctcaaaaaaatatttttaaaataatttaaaatgttctaaaacagaacaataacatattattattataaaatttttggcctttttcggccgaagacatttttaacaagaaagaatacaattatacaaaaaaatatttaaagaatatttattattaaaattttttttttacaaaatagcgaagtctgtaaattcacgtgaaagcaaataagaaaatccatcaatttccgcaaaaaaagattttttgatgtttttgtctataaaagccacgtctatgaaggaaataagaaaaaaggatggatatttaagcgaacagaaaaactaacaatattatttaaaatatttttattcattaaataattttaccatg

SEQ ID NO: 103968 - DNA, 408 bp, Heterodera glycines
  Promoter: Source sequence=SeqID_3843; Location=1799..2206; Strand=-; Gene=SeqID_52098
tttttttttttgctttgcccattgaatttttgcgggggacggaatttttgacttttgctgctgaccaaaaagaaaaaatttaaaaaaaaaaattcatttttgcaaattttccaattttcattgattattccttaaaatttaatccgacaattaaccaaatttgcccgaagcaaaatagtgattgcatggcattaaatgttaaagattattccaccctttcctttctttcaattacttttgatgaaataatataactggtgaacaattggagacaattaaaaatcaattcatttgttcctaaatgacatcaattgattttctttagcattttaataaagtttaaattaaatatattaatttattttatatgaccaccataacaaaaagtgaaaagcacaaaacaaaatg

SEQ ID NO: 103969 - DNA, 287 bp, Heterodera glycines
  Promoter: Source sequence=SeqID_16947; Location=1..287; Strand=+; Gene=SeqID_81376
tcacggccattaattttgggctccaagcgcaaataagtttattatttacttagtaatcagaacgccaaaactgcaaaacttaaaatttattggggattttcccttgtaaaaatgcaagagccgatctcgagttagaaaagaaactttcaaaaaacaaaagagaattcgatagaaaagaccaaaaaattcacttaggcaaaatttcaataaaattggtcaataggaaaaaaattttttcaaggacaacaaaatcaaatttatttgcaacatttttagcataaaaaatg

SEQ ID NO: 103970 - DNA, 482 bp, Heterodera glycines
  Promoter: Source sequence=SeqID_2388; Location=441..922; Strand=-; Gene=SeqID_79481
aagagcagtttatagcaagattttggtgaaaatgcttccaaattgagtacatgcacggcacatacagaatctatggcaatttttggtattttattgttatgttaccagaaatgtgtcggaaggtcgtttccaatttctagtttcctgcatttgggtcggaaatccgatttctaattgtcgaatttatcaaggcaaagtcttcaattttcggcaatttgttggcattggcatgtttccaaaattttgggccgtctgaattccgattgccgaattttttgagaaaaattggaaattttcgacaatttattggaaattggcaaaatcacaactaaactttcaaattttttatcggcggtgcttttcggcgccatgaccaaaatgccaattttaacattgttgcagttgattactcacataataaatggcgcacagtacgcatttggcaattccgccgaccacaaattgccgtcgtcgctccaatg

SEQ ID NO: 103971 - DNA, 139 bp, Heterodera glycines
  Promoter: Source sequence=SeqID_20582; Location=1..139; Strand=+; Gene=SeqID_51135
ccattacggtggagagggtgaagattatggcaatgatttcacaagcttccgccgcctgtcgactcgaacgaaaaaggtgatcactgatcatgatcagggaagaagagatttgagaccgttggcaaaaacgatcaaaatg

SEQ ID NO: 103972 - DNA, 157 bp, Heterodera glycines
  Promoter: Source sequence=SeqID_46; Location=561..717; Strand=+; Gene= SeqID_56542
aaataataaatttgttaaagatttgacgacaatagggtagagactaatggaaattgggcattgcgccagagtttcatattttagtaaaattttaaaaacttcggtttgaataagttcggttaacaatcatttccaactgtttttgctcgtttagatg

SEQ ID NO: 103973 - DNA, 1003 bp, Heterodera glycines
  Promoter: Source sequence=SeqID_30655; Location=304..1306; Strand=+; Gene=SeqID_61065
ccccaaatgatggcatagaggggcagggcgatttctgctgttttcctcttttttcaatttgggatgccattgaaaattcaattaaattcgcttaaaaaatttaaaatagaaaatttaaaatcggaaaccggaccagtgatgccatggaatttggttcactgtttaaattcacgatttgaaaatatcttttggcgccatgaaaacattttgccaaattaggtagtggagagagagatttagatgaattctgccgatgacaaaaaatgaataaaagtgtatcttgaaaaattgggccctcctaacccattgaaacatttttattcgtttattattaatttattaaataacgcaaaatggaaaaaaatgcatttgccacattttttccattacttctttgaaatttgcccctatttggcactcgaaatcgcatctgtatgttgccagttagagcacatcttttgtatcagtcacagattaaacataaatgcataagccatttggtggtcattaaaaagacataaaagtttcgtcggatgcaagagcagaggggcagaaaactttttcacagattttgagacgatttttctataaaaaaattacccaacttcgcctagggcaaaagaaatggacaattaattggtcagtcaaatcggcaaaaattgatgaacaaagggaagggcacaaaacgttgacatttgctacctgcaaaaaataaattaaaaaatgtttatattttaaaataaaatttcagaatctcttcaaagtttatgtaatacattgttgtaatgtaattttattattctttcttaatgaagtgattattaaaattttatgttaaagttttattgctgctaatttttgccggttttcggttctgtttcgattcggttaaaccaccgtccactaccgtagttgctagtgaagtagtagacaattttatttcctttaatttcctattttttgatttaggataaggcaaattgtgctaattgcctcaaaaatg

SEQ ID NO: 103974 - DNA, 191 bp, Heterodera glycines
  Promoter: Source sequence=SeqID_25798; Location=1001..1191; Strand=-; Gene=SeqID_56562
ctttgatggccgggtggtgctctctctctaatgaattagtcttttttgctactgctcttaatgtgttcggcacttcgtttcctcctatttggcttttcgaccttttcatttgaatttcgccccccccccctcctttaaaaaatacaattagttaattacttcttagggttcgtcctacgttagctcaaatg

SEQ ID NO: 103975 - DNA, 122 bp, Heterodera glycines
  Promoter: Source sequence=SeqID_9657; Location=937..1058; Strand=-; Gene=SeqID_72219
tcaattttgacggtcatttatttgattggtcgtctcctttgtcaccaaattcaattgattttgttgaaaaggtataaaattcgataaaaattaaattaattaattaatattttttcagtatg

SEQ ID NO: 103976 - DNA, 55 bp, Heterodera glycines
  misc_feature (44)..(44): n is a, c, g, or t
  Promoter: Source sequence=SeqID_36353; Location=1279..1333; Strand=-; Gene=SeqID_65689
tatgcgtgaataagagctgtgaactaattttgggaaactgacgntttcaaagatg

SEQ ID NO: 103977 - DNA, 829 bp, Heterodera glycines
  Promoter: Source sequence=SeqID_1281; Location=322..1150; Strand=-; Gene=SeqID_71406
tctcaattcaaaagaaatccttttttgaaaaaatgataattgtttaattaaatacagttatttggattagcatttatttgtcggtatcccttttcctgggctactagtggcctaaaacgcacgaaaaacaggtttttttttgtggttgttaagctacttttcgaataattagggcctattttctaggttattatttttagagcctaaaattatacaaattttgaaaaaatatattttgacatatttggcgttttgccctgctaagaaaatgcaaatgcaataaaaacaaccgtcattttacaccccctaaatttgaggctttttagttcctattttccattttttagtgcctatttgggagtttttagagcctaaaatattagcactagcccagactactttcagccgcctgggtgttttcattataaatttttgaaattcttcaaacttctgatgaagttttgtttgtcttacatctaattaattggacgccaaagtcgataggatgtttaagggcaacccttggaagctttctttatttagcctaatttgatataacgaatatcaatggaacatggaagcttgccgcttcaactcattattttattcgttttaacgttgcaaatttcaactcagtcgccagaaatttcagtgccttctgatgttcaaattttgtcagcagtccgaaacgtagatttgaccactcaaattgtcaaggcattttgttattaaaaaatatttaaaattttatatattaattcaggttaaaactgactttgagttgaaaaatggaagaaacgaggaattgagcagttttgtacatgccatg

SEQ ID NO: 103978 - DNA, 114 bp, Heterodera glycines
  Promoter: Source sequence=SeqID_27683; Location=661..774; Strand=-; Gene=SeqID_58357
atgggaaatgaatgaatgaatttgaaaataaatgacgaggcttgcaattaatgtgccgtaccatttttggcacaataaaaacacagaactgaaggtttccggcgtgtacacatg

SEQ ID NO: 103979 - DNA, 976 bp, Heterodera glycines
  Promoter: Source sequence=SeqID_4106; Location=3490..4465; Strand=-; Gene=SeqID_53209
tttttagggatgcattttcaaattttttttttttcacaaaaaattttatgaattctcaaaatatgaaaaaaaatgaaaatgtgtacgaaaaattgcaatttttttggggaatctaaaaattttccttaaaaaatcttcaaaaattgcaaaatatgtacaaaaaatgcgaaaaagtccaaaatatgtataaaaatatgtacatatgtaatatgtagaaaaactccgaaatatgtaaaaatatgtaaataaaagtcccgatttttgttcgcaaacacaaaaaagaaagtgtttttcctactaattaggctatggagaatccaggaaaaaatatgtatttacataaaattagcagccctagttatgggtgtcgaagcgatggcatttttggcagcagtggtcccaatcggccatatacaaagccaactccgccggcaatgttatcactggcattttccactagacgtggtcagatgtggtgcttatttggagcattttcacgaagaatggacgacgaacgagcaattttttttactaaataattaactttattatttgttttcaagtgcaaaaaattatagtaaaataagggcgtttttttaaatataagataaccaaaaaaatttttaaaaattcatccatttaagcaataatcaacattaatcgaaatcacttattttcaaaatttttaaagaaaaatgagaaaaatcaattatttaatattttagtttataaaattccttacttttaatgtgagctctttttggagcattttgtcaaattcgttctttttcagaggacctgactggatttttgaaaattaagtttcttctacaattctttgtctgcgaaatctgtttccttaaagtcaagagttttcttagagaattgccgggcttaataaaattctttcttttcatttacttctaaaacaaaataaaaatattatcaaattttaggcacttttaaaaaaaccatg

SEQ ID NO: 103980 - DNA, 531 bp, Heterodera glycines
  Promoter: Source sequence=SeqID_28968; Location=1..531; Strand=+; Gene=SeqID_59541
ttattaatgattaattgtttttctcttccatcggaaattctactttttttatctacaattttccatttattattattcagaaaccaaaaattgagatttaaatttaaaatcatagacttgcaaaaatttctgaatcttcatacatcttatttttagtgaggaaatttttaagtaattaatcaaatccatttttgcaaaataatttagaaatatcattatttatttatttataaattattatttttctttcattcaaaattttttacatctttatctgtaaattccatattttcaatttttaatttattttttatctataaaccataaactgagattatataccaaaatcaaagactctcctaaatttttctaaattcttttttgtggtaggtttattttatcgggaaattttcggtgaatattcaaaacattttttaaatggcttaaaaaaaagtcatttttaatatatttttcgtattaattactgtttttaattaatttttattatttaataaccatcagtttaccatg

SEQ ID NO: 103981 - DNA, 323 bp, Heterodera glycines
  Promoter: Source sequence=SeqID_35529; Location=458..780; Strand=-; Gene=SeqID_65075
tgcttaagacattgtgtgttaaaaaaaaagattcaaaaaattcgtccgcaaatgtcgccgtttctgctgatgatgatgacgcatcgcttaaatgacctcactttattcattttaattcttttaaatttaaattccttcgggcataacatttagtttccaaatgaaaacttaaatcgaaaaatgacagtgaaaaatagcaatgagactataattcttttatgatattttatgaaaatacctattcatttttatatgaattttgaagaaaataaagcccatttaagtgccgaaaactgtcttaataatttgccaacaacaaaatg

SEQ ID NO: 103982 - DNA, 332 bp, Heterodera glycines
  Promoter: Source sequence=SeqID_24423; Location=344..675; Strand=+; Gene=SeqID_55157
ttttctgataatcttcattaatattaaccgaaatgctctgtacttttcttaccccttctaaaagtcgtccaaaccatatatttacccctgaggcttcgagatttcttatcttaactttttcagcttcttgaatggctctatgagatgagtagtaaaaatctatacattcattatgtaatgtgccggtatacgtaaacactgtgtcatttgttaataaaacagtgttcaattgctgtttttcaatcagtagaaaggcatcaacaggggggagggggtacgggcgggggcaggaaacgaactgttcccgctaaacgtgttccatttttagcatg

SEQ ID NO: 103983 - DNA, 1003 bp, Heterodera glycines
  Promoter: Source sequence=SeqID_4205; Location=318..1320; Strand=-; Gene=SeqID_53591
tgttgtgatgatttccctttcatcattttgtcccaaatttctctcctccccccgttaaattggctcaattttcttttcccgcgcgccctcgggcaattaaattttgcacaaaatccaaaaaaaaaaaattttagtggccgattttgcgggaacggacgcgctgatctttcgccggaatgtgtccgagccggtggagacgtctgaccgctcactgttgcgcacccagcgaggcaatccgctgatgctggaccggccccaatttgtgggcagtttgcagacggaccaagtcagtcccggattttttttttttgaaattatcggcaaaacttagcattttatgattggcactcgctcggattattgggaagccaattattggcatttataacaaattttagataacttaagaattggcattttgagatttcggggcattaatgggattagcataacttggcattttttagaaagtttttacatttattttggagatttaaatctgggttgccacctgttaaaaaatttcatatatatccgttcatttttatcttttgattccatcgattgaatatttcggcatcaatgaataaaaaaacaaaattttcggcatttttgctggtgtcatcgattaaacacaaaatttccggcattttcggtggtaccgtcgattaaacacaaatttttggacattttcataggtgtcatcgattaaacacaaaattttcggcactttcgctgatataatcgattgaaaaaacccaaaaatttcggcatttcgctgatgccatcgattgccttttttgtaacggtccccccccccgacccatcacatagctgtgcaacattggcacaaaaagtgctcatgtacaacattttgacttatactcattacctcctccatttgtccctccccccaaggtcttccccctccccccattttcgtcgttaatcgctgtcatttcctccgcttctcccctcggaggacgaaaggggtgacaaaatg

SEQ ID NO: 103984 - DNA, 133 bp, Heterodera glycines
  Promoter: Source sequence=SeqID_16846; Location=2301..2433; Strand=-; Gene=SeqID_81268
ggtgaaaccgacacaagatttttggtacttttcggttttggggcctagatttgattttatttttattttttttaaaacaaaagacgcacagaatttgtgcgagttcatctggcgctatgatgccaaaaaaatg

SEQ ID NO: 103985 - DNA, 63 bp, Heterodera glycines
  Promoter: Source sequence=SeqID_19792; Location=2493..2555; Strand=-; Gene=SeqID_84532
cacaaatgggtcacagtcccgcggtggacgacagatttgagactttacaatgctaagcaaatg

SEQ ID NO: 103986 - DNA, 179 bp, Heterodera glycines
  Promoter: Source sequence=SeqID_10380; Location=310..488; Strand=+; Gene=SeqID_73570
ttctcagtgtcaacattcatcctccggcattttgccatttaaaagcactttcaaacgcaagctttattttaaagtattcttaaaattccttaaatacctcaactgcaagcagtaaattgagcagcaacatacaacacacaccaatcgcaggaacattaagcagtacaataagcaccatg

SEQ ID NO: 103987 - DNA, 167 bp, Heterodera glycines
  Promoter: Source sequence=SeqID_11163; Location=2914..3080; Strand=+; Gene=SeqID_74516
aatgaccgacccgaaattttgtgtattttcgttgttttttatgaatgaatagtcactgattttacactttattcctattttcattcgggcttttcttgccatttaatttttgtttatttatatatatatatttttgctaatttgaatattttccattcattccaatg

SEQ ID NO: 103988 - DNA, 134 bp, Heterodera glycines
  Promoter: Source sequence=SeqID_18656; Location=1361..1494; Strand=-; Gene=SeqID_83315
gaaaatgaaaaaaacaaattcggcgtgacatggaaacaaattaaatacgaaattcaactattaatatataatagatagaaccaattaagcaattggtgagaaaatgttaattaattgttgttcagcatgcaatg

SEQ ID NO: 103989 - DNA, 151 bp, Heterodera glycines
  Promoter: Source sequence=SeqID_6458; Location=1..151; Strand=+; Gene= SeqID_61664
aaaactcaaaaagggtaattctttttttataaattcaaaaatcatttaagtgaaagtgtcatatttgtttttgcactactctttttaaaataatcaaaataggacggaaatttatttgtttttattttcagcatttgtatcttaacgaatg

SEQ ID NO: 103990 - DNA, 357 bp, Heterodera glycines
  Promoter: Source sequence=SeqID_9354; Location=742..1098; Strand=+; Gene=SeqID_71103
aaccaaaaaggaacggcggaaaaggaagaaaaaagtggagaattatgtaaaaaaagagaaagtgagaccaaaaaagccgaaccggaagcaaaagaccgaaaaacggatgaggaaggacttgtacaagcaaaaatggagaaagagaaaagtacggtggaggatgtgttgtctttaggagatgaagaagaagactctccttatgaagcagcgaaggtattcgagatggggacgtccttttttgagagcgcgggggtgcgagtgaattcacgtcgggaacttgaggaattgacaaaatcccgaaatgaagcaaaaataaaagccaaaaatgagttagagccgccggcgctgttagacatg

SEQ ID NO: 103991 - DNA, 363 bp, Heterodera glycines
  Promoter: Source sequence=SeqID_18250; Location=168..530; Strand=+; Gene=SeqID_82844
tttgcccgagttgaaagttggccgaccgcaacagcagcaaagcgcggccggcgcatcggccggcggcgatggtaaggggaaaaagtgggagacggacggaggaggacaaggagatgaacacatgaccaaacttggttgggcatttaggacacgaacggcacgccggggaaaaaatgccatcgctaaaaatatccaattggagaaatcttctttttattcttttttgtctactcatcagattttacggtttgtgaaaaaattcgtcaaaaatgaaaaacaaatccgagttggaaaaatgaggagataattagacaaatagacacgaattctttccttttttgttgttgttacagattgaaaatg

SEQ ID NO: 103992 - DNA, 370 bp, Heterodera glycines
  Promoter: Source sequence=SeqID_29935; Location=476..845; Strand=-; Gene=SeqID_60410
cctaaaacagtaaatatattggagaaaataaccacctcaaaaaggttgctgaataacaaacaaattaggaaaattttgcgtctctcaagagcaatcatggcccaatttgagtgaaaacacattctattgagggctcccatttgcgctatttctacgatttgtgtatttgaaaaaataaataaattttaccggcagttttcagcacagcagaaccctcaaaaaggaggaaagcaagaagcaaaattcaaatacacaaacccgaattaaagccaagcaaagaaagccaaataattatttattttcaatattaattcattgttttaagtattaaaattaatactttcttcaaatcctcgactcgtacaaaatg

SEQ ID NO: 103993 - DNA, 267 bp, Heterodera glycines
  Promoter: Source sequence=SeqID_18014; Location=1421..1687; Strand=+; Gene=SeqID_82590
ggcaacagcaaaatgtcttaaattttccataaaatgtcccgattttaaaaatagccaataacaagcgaaaaattttctaattaacgtcatcaaatttatatagttaatcattttaaaatatattcaatattaataattctgccaaattgagttgaaaaattcgtaacatttttgctattattataatataatccaaaatataaatcattttttaattgcattgaaaatattattttagatcctttcagactgtcattacagaaaatg

SEQ ID NO: 103994 - DNA, 223 bp, Heterodera glycines
  Promoter: Source sequence=SeqID_12252; Location=1..223; Strand=+; Gene=SeqID_75839
tttcagttttcgccagtggcgttgatccgctccatatccgtccatcatttaaaagatatcctttcaaataggcattaaaaatatttacatacgtacaacattttttaatgctttgcagggcaaatttaattaataactaacgtaattaattttgttaatatttcgcacaaaaattaattaatatagtgtccgggctctactgatcaaggatgaaattacgatg

SEQ ID NO: 103995 - DNA, 331 bp, Heterodera glycines
  Promoter: Source sequence=SeqID_29688; Location=309..639; Strand=-; Gene=SeqID_60157
tcttttgctttacgttgatatcactccaaattcccccctgcctttgggggaattatgccttctctgtccatgtgtatatttattgcttacaacgcaggcaatttactttaaaaataccataatgttatatttgtctatttctctcgctcctacaatattttcaccttttttctttggtgttacctttgccgtaattcagttactattgattattttttgcctataaaagccgcttcaaaaacaagaaaattattcattatcaactgcttgctgtgctttgtttaattgagcttcagcttcactcctcctctccgaattcgctgataaaatg

SEQ ID NO: 103996 - DNA, 58 bp, Heterodera glycines
  Promoter: Source sequence=SeqID_6191; Location=148..205; Strand=+; Gene=SeqID_60663
tctttttccccttacggtcggcgtccgtcggatcaatcgatggaacgacgagcgaatg

SEQ ID NO: 103997 - DNA, 292 bp, Heterodera glycines
  Promoter: Source sequence=SeqID_26722; Location=648..939; Strand=+; Gene=SeqID_57497
agaaaatcccatatgaaacatttgaaaaattgaaatccgagtctattccttatttctcttaaattaaaagcaaataatttttaagaaattgaaaacagtctcataataaaaatgatttgaaatttcgaaaattttcggcaaatcacgcgatgccgaaaactcagaaaaacgatattataattgtaatatttaaataatttccctaaaaattaaggctttaccgcaagtttttgggcaacaaaaaccggtgatcgtgttcagcatgagttctttattagaaccatccaaaatg

SEQ ID NO: 103998 - DNA, 193 bp, Heterodera glycines
  Promoter: Source sequence=SeqID_5648; Location=1..193; Strand=+; Gene= SeqID_58775
tttcggcaatgtttgtcgctttgtaaataaaaatttgatcttttttaaataatatttattatttttagtaatatatttatatgataatattcatatcatattattaatacacgggatgtctattttaacattaatcgtaccactaatttttttaatgcttttgctgattaatgacaaattatgtgccggaatg

SEQ ID NO: 103999 - DNA, 119 bp, Heterodera glycines
  misc_feature (4)..(4): n is a, c, g, or t
  Promoter: Source sequence=SeqID_45338; Location=1162..1280; Strand=-; Gene=SeqID_72651
tggngcgtttcctaaaactcgccaagtaacacatagagaatgctattgctcctgcaataggcgcccatgaaattgaaaaatggatcaataatttggatctagcagcagtcaccaaaatg

SEQ ID NO: 104000 - DNA, 90 bp, Heterodera glycines
  Promoter: Source sequence=SeqID_8775; Location=1087..1176; Strand=-; Gene=SeqID_69189
tcctgaaaagggcacaacatttagtcatttaaaaaaattatacaaaaaataaaaaactgacgggaacaattttaattgtacagcaggatg

SEQ ID NO: 104001 - DNA, 101 bp, Heterodera glycines
  Promoter: Source sequence=SeqID_32414; Location=152..252; Strand=-; Gene=SeqID_62719
ttggcggaggggagggcgaattaattgaccgaatcccgtaaatcctcccaccccattttggtcatcaccatcgggaacaccagcgcagactttccgtaatg

SEQ ID NO: 104002 - DNA, 70 bp, Heterodera glycines
  Promoter: Source sequence=SeqID_3133; Location=6386..6455; Strand=-; Gene=SeqID_83355
atacattgccaaagtcaacggccaattttacgaaattgacacaccggacatcgaaattgaaattcagatg

SEQ ID NO: 104003 - DNA, 70 bp, Heterodera glycines
  Promoter: Source sequence=SeqID_11886; Location=1..70; Strand=+; Gene= SeqID_75397
ccaatgcctgattaaaattcgtaataacgacaaccacttctgccttttctacgcactgcaggcaacaatg

SEQ ID NO: 104004 - DNA, 149 bp, Heterodera glycines
  Promoter: Source sequence=SeqID_31837; Location=297..445; Strand=+; Gene=SeqID_62145
ttgaagcagaacgaatgaagcatggctgataaattgccgggtcttttatactcccggaaaattagaccacgcccacttttgaaagctatttaagccaagattttctcgcacaatcaaatcagtcttactaaacatcatcatcaaaaatg

SEQ ID NO: 104005 - DNA, 986 bp, Heterodera glycines
  Promoter: Source sequence=SeqID_8; Location=7253..8238; Strand=+; Gene=SeqID_46232
aagatgaataccttggaaattgataaaattttatcgacaagcccactcacaaaacagacttatatcggctgttttgcggctgaccagataccaaatatggaaatggtaaaatttccaaattgtctggtaatgaatattgacccaatcacctctaaaggatcacattgggtttgtgcttacagtccttctccgtcacacattgaatactatgactcgttgggcatttggccaccacctagcatacacattgcaaattatttgtcaagattcaaacaaattcgttatagtataattctacttcaatctcccaattcaagtgtgtgtggtcgtcatgtgctcttctttttgtttaatagatgtctgggaactccctttgaaaagattgtaagatttttgcattttggaaaaacaacacctgacacacttgtcagttcttttgttacaagaataataaatataaatagttgaaaaaatatagttttttcacaaaaatgcatgtcgattttgatccccaccaagtggattggtctacattctcgcacgaatttattcaatatggaggttacaatatttttcgtggtgtaccatatcagcgcggtgctggtatcggttcagtatttagaagcttaatgagatttcttttaccgatagggaaacaaattggatcgtcaattgcacgtcaggggcttgaaagcgggaatcgagtgttaacaaatgtattagaaggtaaagatttgaaggagtctctcgtcagcgagggtaaaacaggacttaaaaaccttttggaaacggcagcaaataacattgaaaaccaaaaaggacagggatttgattttaaaaaatacaagaaagaaaccataccacggtatggaaaaattagaagaaaaaatataaataagctccaatcttcaattggaccacctatggttgttaagaccaaaaacaaacgtttacgtgttgactcattgggagcttactaaaaaatg

SEQ ID NO: 104006 - DNA, 328 bp, Heterodera glycines
  Promoter: Source sequence=SeqID_23040; Location=996..1323; Strand=-; Gene=SeqID_53744
attgtactacaatatgttgttggtcgacactcagaaatgattttatgcgttcaatgctaataaacaaatgctttgtttaattgcgtctcccttaaattgcacaatctttttaattttaattgtttagagcgttattttatgcgcttttatttttcattttaatgattttttttgcttattttataattgtttaagcctgttatttgctgccttttgccttgctttaaagagctaccaaattttattggtaagaattcatttcccaaaaagagtgtgcctatacactttaactttattacagactttgtcctcaaactgttacaaaatg

SEQ ID NO: 104007 - DNA, 241 bp, Heterodera glycines
  misc_feature (14)..(14): n is a, c, g, or t
  Promoter: Source sequence=SeqID_14402; Location=4056..4296; Strand=-; Gene=SeqID_78440
gatccataaattgngcaaatacctttttaaacaatatggaagtttcagcaaatttttggcaaacgatttttcaaaatttgaaaaggctttcaaaaaatatcaaaaattatggtaaaactaaaattcgtttttttaaatttttatttttatcccttttataaatgcgcctcatttcagagctaattaccgaagacaaaaattttgatcaaatttccgagtgcaatttttttaatataaaatg

SEQ ID NO: 104008 - DNA, 290 bp, Heterodera glycines
  Promoter: Source sequence=SeqID_34981; Location=1526..1815; Strand=-; Gene=SeqID_64654
tttttgcctgtgcttttgccgcttctccgaccaaaggtccgctgtcagtgaacgcaacgtaagatggcgtcatacgctttcctcaatttacaaaatgaaaaaatttggttaggcccttcaggggaatgggagaaactcctgaacctcccgtaatgaaaaaaagattaggaaattgggtaggccatctcccaaccctcgaaacgaaaaaaaaagaaatttattgaaagaaattttgaaaatataaagaaattaaaacatattcggcactgcctttgttttactcaaaaatg

SEQ ID NO: 104009 - DNA, 437 bp, Heterodera glycines
  Promoter: Source sequence=SeqID_16315; Location=2979..3415; Strand=-; Gene=SeqID_47355
aataggtattgaatgctttaattttagactgggtgaaatttctgaccgtaatttttaggggtttttgtctttggcaaggaatatcaatattaaaatacaatgctgaatggtctgaaaaaacaatactatcctttagttcaattgaagagactaaatcaagggttgtaaaaagacaaagatcaagaattgaatttcctcttcttggacctataatattagtgtttagtgaaaatttattaaaaaaatcaagaaaagttattcctagactggtatgaggtactggaagattgttgacccaagttatatctttgctgccaatgttaaaagtctcctatgataatagtattgtttgctatatatttttctaggagtaaaaaaaagagattttgtaagtttcaattacagatcaattttctgtttaaacataacgaaaaatg

SEQ ID NO: 104010 - DNA, 64 bp, Heterodera glycines
  Promoter: Source sequence=SeqID_4316; Location=2191..2254; Strand=-; Gene=SeqID_54014
actccaatttaaaagttttcaaaaccgaaatacttgtttgttttttaggtttctgtttagcatg

SEQ ID NO: 104011 - DNA, 480 bp, Heterodera glycines
  Promoter: Source sequence=SeqID_18967; Location=1..480; Strand=+; Gene=SeqID_83701
ttaatttcggcttttataaatgttgaaaccttgaaattgggtgaatttgtgctagggcgaacctaaaaaaatatcacaatattcatatttaaatttaattattatgacaatttatttcacaataataaaacataattttgctcaaactaatcaataaaataattttggtatttttgcgatagttgctcgtgccctctattatcttgaaaaaaatataagttaaaatttaaaaacttgttaatcaaaaactccgaaatacatatcaattatttgccctaacttttttgaaagtaaataaaaattaacagaataatagagaattcttcgagatatctattataagactttagagctattttataaaaaaaaataatttttaattcaattccttttaaaatacgcttttgtccatgtgttcagtgtgttcatttgtcagggtttccctgctgtcccggcagtcagcagctcgtttccctcatg

SEQ ID NO: 104012 - DNA, 340 bp, Heterodera glycines
  Promoter: Source sequence=SeqID_20705; Location=211..550; Strand=-; Gene=SeqID_51265
gtaatttgaataaatcgtcaagagtgaaatttttatttttgaaaatttctggccaaaaaagcggtcccaaacccaatgagtacctaattaggtagacgcatatgtaagtaaagcattatttacctaatttgtaagtaagcagtggctgtttcaaaaaagccaaattagtgaaaacctgcagagcgacaacacgccaaattatgtatttctaagaattcaaaattttgcttgttacaaaaaaaaagtacatacggaggaattttcttaaagaagcacaaatttgtattttttttttagaatctacgcatttatttctttttttgatccagataagctaatg

SEQ ID NO: 104013 - DNA, 93 bp, Heterodera glycines
  Promoter: Source sequence=SeqID_30870; Location=999..1091; Strand=-; Gene=SeqID_61258
tgtaagtgatggggcggggggggggggtgtggctgtgctaactctcacaactctcccccgcttgtaaaggtgtcgctgtacccgttcgtgatg

SEQ ID NO: 104014 - DNA, 159 bp, Heterodera glycines
  Promoter: Source sequence=SeqID_32976; Location=270..428; Strand=-; Gene=SeqID_63184
aaaattttatttatttattttttaattaatttaatttattgcgaagaaatagttgtaatatttaaaaaatatggtattttcttggcaatttcagctatttgttgtttaagtaacaattttaaaagtttgccctattttttaattgccaaattcgacatg

SEQ ID NO: 104015 - DNA, 588 bp, Heterodera glycines
  misc_feature (15)..(15): n is a, c, g, or t
  misc_feature (78)..(78): n is a, c, g, or t
  misc_feature (96)..(96): n is a, c, g, or t
  misc_feature (116)..(116): n is a, c, g, or t
  Promoter: Source sequence=SeqID_18560; Location=490..1077; Strand=-; Gene=SeqID_83196
tcaaatgtgagttgnaattttcatgtatttataagcaaaagggctgggctgctctgcttgacagtcgaattttttcgnagtctcgaaaaatttccngctcgagaccgacaatctcngagcagccggctaatacgtatggtaaactttagtcgttctctgcccatggccagttttatgatggattttttgctcaaaacttgaaaatcttttggcagagtttgtgaaattgcgaaaatttttctagcgatttttttttaattttatgatgaattaataagtttttttctaaatttttgaaaaaatcactgaaaaattttaaaaaatcttaagttttccttcaaaacattttcagatttaaaaattaatttgatgggtgcacctcaaaatattgccgccttttcaaactgagaaatttttctagaaaaaaaaattttcgaaaatttttataagaaaatttgaagaaaaaaattattgaaaattattttggaaattttttcaaaaaaaaactgtaatttatcagaaaatttatgcggcgatattttgtcccgtccccaatgtgatgggggaggggacgtgactgaatatatg

SEQ ID NO: 104016 - DNA, 960 bp, Heterodera glycines
  Promoter: Source sequence=SeqID_24250; Location=1..960; Strand=+; Gene=SeqID_54970
catttttacccaataacaattatgaagcattattttatcaaaaaataatagttgttgcatgaattagagcttttacccaaaaaaaaaaatctaatcttgaaattttttttttcaatttttgttcgaaagcgggtcaggggttcggaattgggcaaatccgagttcaaatgcgtaatcagcacccttgaaaacccctaaaaacttgttttagcccaaaattaaaaaaaaataaaaattagggacccccattcttcaggattgcccaatttgctaccattcaattaattttcgtacattatttacacttccattttctgttttttcagattccccactttgtttttacattttgtgatcagctcacatgcattttgctgacctgtccctaagtgaacgggaaaaagcgctgagtgttcgctatttgcaggagcgtgatgcgatgtttgaggtttggaatcaaatcggggcggggcattattaaccgggtcttaaagccagggctgccgaatgtgaggcttagcctcattttgtacttttttaagaggccgatgaggcaaaattaccaaaaaactttgaggcttttgtattttttttgagtttttcttaggcgcttcgtgttttttgggaaaaatccttcaaaagtgtcattatttggtcgaattccatttaacaaatcgtctaaaaacgcaaaaagaaactttttttttgcataaaaattgttacatagtcagtcaacttaatgtttagaaattcaatatttttgaaaataatttgacaaaaaaagagccaatttttttttaactatgtgttttgagtcccccccccccccgaattttgtgatgaattttttctttaaagctaacaatgcatacgtattacatcagttacctgaaaatgtgaagaaattaaaattagaaatcaatgattaggattaatgagttataatctgtgaccgaaatg

SEQ ID NO: 104017 - DNA, 231 bp, Heterodera glycines
  Promoter: Source sequence=SeqID_3049; Location=6128..6358; Strand=-; Gene=SeqID_82965
cgccagatgcccaaatagggggtcaagtaacacatttaattagttgtagatcaaaatttgactataaataaggaaattgtacgagcgagattcattcactcactcatttattaataaataaaatattattattattatttccgtttcgcaaattttcactaacgtctcaacaacgtaatttaatttaatattttttaattaatcaactaaaaatccgcccgtttagctatg

SEQ ID NO: 104018 - DNA, 496 bp, Heterodera glycines
  Promoter: Source sequence=SeqID_3910; Location=4522..5017; Strand=-; Gene=SeqID_45674
tttctctgccctattctaaacagagaagtgaaagagagagaacgcagagagtgttgccacaggagagaaaaagcgagaacagagaagcaaagacaaaagtgtgcacgttagaagtggaagcagaaaagcgagacagttctacgcaaaacccctcgggcgaggacgaaaagcgaccgaatcattgcgaaaggacgaacgcaacgcaaggcatagagaaaataaaaaggagagagagagagagaaggtgagagatagagatagagagtgaagaggaaaaggcagacaacgcagaagagataaagcaaacggaaaggagagaaaaaaaacggccattccttctgctgctgctactgttactggcgagacgaaacgggccaaaccaagttcaaagtgccaatgtgacgacggcggtttttgttcaatgctaatcagctaattgctcactaattaccccaaataacaaaactatgcttctcccaacaatggcccccaaatg

SEQ ID NO: 104019 - DNA, 99 bp, Heterodera glycines
  Promoter: Source sequence=SeqID_26127; Location=315..413; Strand=+; Gene=SeqID_56875
ggtcttttatatttagatatttacacttttgaattgcttttttgctgcttttaaaattacttttaaacatgaaaaaattgtcaggcatggaaacggatg

SEQ ID NO: 104020 - DNA, 127 bp, Heterodera glycines
  Promoter: Source sequence=SeqID_7236; Location=1821..1947; Strand=-; Gene=SeqID_64223
attactcattaggcattaattgatgagcatttaatttaaggattttatattttaaaagcattcattcatttggcaggtgcattttatgcgcaaggtttggttggatgtcgtgccgggtcaagacatg

SEQ ID NO: 104021 - DNA, 421 bp, Heterodera glycines
  Promoter: Source sequence=SeqID_22160; Location=1441..1861; Strand=+; Gene=SeqID_52819
ttggagtgccggttccgcggtcgctgcagaattttggggagtcgccgttgccaaatgccgcaggcggcaccgcgttgggcgtcggcgatacggtgaaacgcgagatggcgccagtgatggcattacccgcagaagagggagcagtgacggcagcagagcgaggcttggtgaagagatcgatgggagacgaacgagcggaaccctttgggaaaaatgggtaaagcaaatgcaaagacagaatttcggaaatttattttctgtttttggcatgcaacccaaatttgcaacataaaaaataccaaaccgtttcgaaacagaccaaaaagaaaattttttaggaaatgtcaaaaacttagcgacgaaaaatttcctgcgcaccgaaaattggatgtgtactgagtcggcggcgcggaacagaatg

SEQ ID NO: 104022 - DNA, 299 bp, Heterodera glycines
  Promoter: Source sequence=SeqID_33943; Location=486..784; Strand=-; Gene=SeqID_63865
taataggtacctcaatcgtagagaacatccgaaataagcattacagaataaggcacataaatatttatagataaataaataattcttaataaataaattttcggcctgagggcatttttgtgccgtcacatcccccccgcgtctttttttatcggcagcggcgcgattttggacagaaaattttttcttttttttcgaaaaattttacgtaaaattgatttaaatgcaaagttttcaaaaattcgtaaattttctcaacaaatttaagacaaaattgaaataatgctcgtttcaaaatg

SEQ ID NO: 104023 - DNA, 830 bp, Heterodera glycines
  misc_feature (94)..(94): n is a, c, g, or t
  Promoter: Source sequence=SeqID_16092; Location=1..830; Strand=+; Gene=SeqID_80447
aggaaacatcgtccgaatgattgataattatcttacaaagtacataaagcaacttctgaaaaattatgcacatctgaaaatttatcggcaattntcgcttctctctccagctcacagatcagagttttttgattgtttccgacttgggaattgacaatgtaaataaagcggaagaaatgtttgacaaagtgtcactgtcccttccaacaatagcaaaatcaatgcttttgacattgacaatgaaagtacattgtgggcagcgagcggtcggagctcacaaagaaacgattgcttttgtttgatgaaagaaaagtgagttgtggagaatgggaggaaaaaggccgtgatgaccaacgcccgggggatgggcgatgaaagcggcgggtgaagcagagggaaactgagagacggggaaaagggtccatagccaacaaacactcttttctcctctttttctttctcacctcctgccacattttccgctctcttttcctttctctctctcacacaaatgtaaaatgaaatcggtcgggaaatgaaagccaatttacccggtgtgatcaaacgtcgaatacgaacaattgcaaaagtttttcttcattttttgaataagattaggataggtaaaatacctatttctgctgctggtttcattttcctttttctgcgcttcactcactgtgcaggaaaagcctagttcctattacttcctttttttcttttttataattcactttggcgtactatttcttcccatttactgatgaaaagacagaatttattccgttcgaatgcataccttatataatttttacttcattttcagaatg

SEQ ID NO: 104024 - DNA, 162 bp, Heterodera glycines
  Promoter: Source sequence=SeqID_18001; Location=1679..1840; Strand=-; Gene=SeqID_82571
cgccgggaccgggactggcaaaaccgggacctgaatttcagttttttcaaaaaccgggacgggactgagaccgagaccgagacctgaaaacccggaaattcccgtcccggtcaatataagtaataattttatataattaatcctacttttttcagtgacatg

SEQ ID NO: 104025 - DNA, 182 bp, Heterodera glycines
  Promoter: Source sequence=SeqID_25237; Location=1..182; Strand=+; Gene=SeqID_55985
aaaaatttttacatttcaaaaaaagaagccaaactataggttttcggggtcgctgatcgcgaatgcggcttccatttcgaccaattccaaatcccggacgcgaatttgaacaaaaaggcatttttcaaggaatgaacggctcgtcgaggttctgagccgtgcccggacctggtcacaatatg

SEQ ID NO: 104026 - DNA, 183 bp, Heterodera glycines
  Promoter: Source sequence=SeqID_882; Location=1641..1823; Strand=-; Gene=SeqID_63275
aattttcatgtcaaatcaccaaaaaatcatataaatttttacaaaaaaagtttttgctttttccggttggtagaaaatttttataaaaaaataaacaattttaatttcttacaaacagttaaaggggatgttaattatttaaaaggtctaagctgttgtttaattaatattcgttctataatg

SEQ ID NO: 104027 - DNA, 217 bp, Heterodera glycines
  misc_feature (24)..(24): n is a, c, g, or t
  Promoter: Source sequence=SeqID_8317; Location=1..217; Strand=+; Gene= SeqID_67671
aattaaaaacgtgcataaattgtntgaaatgttctggtttttattaaactaacaataaggcttttcaaagtctaataaggctttttctttttattctttttgtaaatagaaaaaaagtttttctcatttattattactttttaaaaccaaatcacaattattaaaatttataatatttttattgtttatttatttatttaagttgagtggtaaaatg

SEQ ID NO: 104028 - DNA, 191 bp, Heterodera glycines
  Promoter: Source sequence=SeqID_28417; Location=1..191; Strand=+; Gene=SeqID_59037
ccaaaattttcattttttcaattaaaaaaaaattaattttttgcattagggcgcccgaggttaaagcttgggctcaagcggtggccgatttggggcgccaaatttgcacaatcgggacagtgactacaaagcggaacggagcgcggaacatttccgcatgcaaatcattgagccaaaagtgatttcacatg

SEQ ID NO: 104029 - DNA, 153 bp, Heterodera glycines
  Promoter: Source sequence=SeqID_6547; Location=4313..4465; Strand=+; Gene=SeqID_61968
gcaaaaagaaccggcgaaaactgaaaattacggctttccctatgattttcattcaattttgcattatgaagctgtgaaaacaagcgggtcagttattttaaaggtataaatgaaaagaaaataatttggcaatgaatcagctattacgacatg

SEQ ID NO: 104030 - DNA, 610 bp, Heterodera glycines
  Promoter: Source sequence=SeqID_32009; Location=1..610; Strand=+; Gene=SeqID_62322
ttttttttttagttaacatatttccgagatttttccgtcactaaaaaagtaggcgactctacttttgatgatgatgcagggctggatggagtcggagatgggaacgaattgttcatttattagccccttttactgttgaattgagtttcattttttttttggaaaatgtgccaaaaaaattatttaaaaaattctatttatcccccctggcacataaatggagactggtatattatttttcaacctcctcagaaagggggtatataattggaggccggcagattaatggagactggcatataaaaagagtatatacggtaacccaaaatcggtcatttcgcctactgacatttcgcctactttcatttcgcctaccaagccaaaaaccttcatttcgcctactaattagtaggcgaaatgaatgtttttggcttagtaggcgaaatgtcagtaggcgagatgtcggtaggcgaaatgtcagtacattttgcatatcgatagagaaagaaattaggaacaaaatgtaagggtttttaagagcaaaaaaagggttaactaaaaagttataacggtttctcttctaaaattcttattttttaaattttagatg

SEQ ID NO: 104031 - DNA, 101 bp, Heterodera glycines
  Promoter: Source sequence=SeqID_34115; Location=818..918; Strand=-; Gene=SeqID_63991
acaatatttttttacagagcaaaaaagccgaaagtgaacaattgcgtgccgagttggccaaaccaaagcagcgatgggacgacgacgacaacaacaacatg

SEQ ID NO: 104032 - DNA, 1003 bp, Heterodera glycines
  Promoter: Source sequence=SeqID_17909; Location=2017..3019; Strand=+; Gene=SeqID_82459
tctttttatgtccaaaaatcggaaaagaatttgtacgatttactcggagttaaatctgatgcttcacaatacgacatcaaaagtgcttacttttcaaagtgcaaaacggtattattttgggcaaagtgagttcgcatcttttgttaattggggattctctttgtgttgttgatttttagaccctttttttttgtccctgtaaattgagtttggcttctaaaaccgactttcttgaaacttttctcgtgaactcgttctgtcaattatttccttattttgtttaattttctaaaggtttaaatcttttagctccatcctgacatgaaatgtgatggtgctacaaaaaacgattttttggagctaaaacaagcttatgatgtgctgaggagacccgccgagaggcgaaggtattgtattgattggccatccatccaattcaatccttttttgccaaattgcacagatacgacaactctttgctcctccatgttaaacagatggacaattacgccaaatacaacaacggttacggaagaggacaacaccacagccaaaacggagaagcatttgacgggtgcttttttcgattcatttccttaaatcttctggctagactcatctcctttcaaaatatcaaattttgggcgacttaaaacttttaatttttcggtttactgaatttatactttggataggttcaattggtttttttgatacattttgctaaatcccgtgcatttctatggtgtgcctcactttggtgcttatttgttagtccaaatgaatccatctttcccatttaagcttttctacccacaaatggcgttctccgctggccaatgacgacattcattttgtgttcgctatttttatgtttggccttgtgttcgtttttctgttttactttgctcaatggtctctctcccctccgttttctaatttattttcaatttctctccaaaggtttgccattcgtcgtcagaacaaagagttagcagcgatg

SEQ ID NO: 104033 - DNA, 376 bp, Heterodera glycines
  Promoter: Source sequence=SeqID_5606; Location=4141..4516; Strand=-; Gene=SeqID_58622
atagatttttcaatatttttctaaaaacgtgatagggaaaaatgtcgacggcaaaaaaattatcaccgggaacaccaattctatcactcaaaaaatcacaatttaataaacgttttgaaaatttttttttgctcacatggtataccaagtaagcataatttacagctttattatttaaaaaaaaaattcggtgccaacacattcccagtttttcggtggtaagggacaaatgggcgacagcccagcggttttttgggggaataattcctttgatagttatccaattttgaatagaaaatttaaaaaaaaattaccaagagtctgagtcggtcggacaaatttatgacatacggacccattaaatcggggaaaaatg

SEQ ID NO: 104034 - DNA, 298 bp, Heterodera glycines
  Promoter: Source sequence=SeqID_29461; Location=1678..1975; Strand=-; Gene=SeqID_59958
aaaatattattttgaataaatgggatttaatgaattcattatgaataattatattcacaaaaatgtaaaaaataaatctacttttcataaattaaatttttagatatgggataatataaatttgcttttattacaaagtcccatccttggccaaatatttgagcaaaatttgtcattaattttctatttttttcacaaattgataaaattttgtcattagaattgtttctaaatttttagccaaaataaaagtattgaataataaaaatcataaatattatttattttttaagagatg

SEQ ID NO: 104035 - DNA, 178 bp, Heterodera glycines
  Promoter: Source sequence=SeqID_9037; Location=1152..1329; Strand=+; Gene=SeqID_70074
tctccctcggctggtgcgtctcacagatttggccaaggataaattcaaaatcagtccgaccgatttggaatttatcaaatcttgagagattttggcttccatttttcactcaaatgccctccctcctctgctctcagctcacccaccaaatcggcttcaccttttgttaccccaaatg

SEQ ID NO: 104036 - DNA, 117 bp, Heterodera glycines
  Promoter: Source sequence=SeqID_19320; Location=653..769; Strand=+; Gene=SeqID_84058
ggtggtccgctatattttcttaattgtgtatgttttactaattttgtttaggcatttctccgtgccaccacttctgtcagttacaaaattcgatttaatttatttttggaaccaatg

SEQ ID NO: 104037 - DNA, 72 bp, Heterodera glycines
  Promoter: Source sequence=SeqID_40779; Location=716..787; Strand=-; Gene=SeqID_69021
tttttaaataatttatttggaaaaataatttataattttgtaagatacacgagaacagcaccaccaattatg

SEQ ID NO: 104038 - DNA, 66 bp, Heterodera glycines
  Promoter: Source sequence=SeqID_12972; Location=2903..2968; Strand=-; Gene=SeqID_76728
gaggaggaagatgaaatcagcgaagatgatgatgataaagaccacaattatccattattagtcatg

SEQ ID NO: 104039 - DNA, 69 bp, Heterodera glycines
  Promoter: Source sequence=SeqID_6985; Location=4063..4131; Strand=+; Gene=SeqID_63504
ggtggcaaaaaaatagcaattataagtgaaatttgacaattataaactaaaaatctgtttaaaaaaatg

SEQ ID NO: 104040 - DNA, 1003 bp, Heterodera glycines
  misc_feature (398)..(398): n is a, c, g, or t
  Promoter: Source sequence=SeqID_24573; Location=446..1448; Strand=+; Gene=SeqID_55298
aaaatagaatttaaagttaaaataaaatacataattatttttatctttgttacaattaaccatagctaaactgtttattccaattaatattcaaatggacaaataaaattttttttaaaatgtgaaaaattattcaaaaaacgaaataaagggcataaagtgatcagattatcacttttcataattattttaaaaattttagagagatttttcagcaaccgaaaaaattttaattgcattttcaaattgatttaaataaataaatattaaatttatttttaagattcaacaaatggaggaataaataataaaacataaaaaaggaaaaagtaaagaaataaaacaaagttgttaaaggaagttttaaagttcaacattccaagaaattaaccaattanaattttataagatataataaataattgaaaatatatttaattatttacagtgaaaattatttatgcataattttaataattgacagcaatatttgtgataaaattgatttaatgcattaacttaaagcaataaagtcttaaataaatctattttttgttctattaattaaccaatggaggtaaaagttaattgaatttgtaattttaacataaagttattactttaattcttaaaactaaatccctaaaattttggacaagcttcctaatattgttatgaattaacgaaaaattttaaaaataattagttaaaacagcgtaaatgattaaaaccaaatcgaattttaatgaaataataaacaaaaaattacacatataatcgtcacagtaaattgtcactaatgcgtgagatcagacacgaattttaagaaaataagaaaattaaaataaattatagcttcattaaaaatattcatttaaaaataaaattaacaatattgtaaaataaattaatgtaaaaaggaaaataaaatttgatgaagattaatatatatttataaattgtacaaaatgatttactaaataatttatgaataaaaggaatg

SEQ ID NO: 104041 - DNA, 1003 bp, Heterodera glycines
  Promoter: Source sequence=SeqID_14969; Location=934..1936; Strand=-; Gene=SeqID_79127
aatatgcaaatgcatattttttcctggcttctccatgctctgaatagtaggaaaaacactttcttttttgtgtttgcgcactcttaggaaaaaatttttgattgcctaaaattaaatccaaatttgaatggatgcgcgagtggatcaacagtgagcttcactgtcgaaaaccttgtgaaatttttgatttgcaattgcaaaaaaaccgataaaattatgaggaataaaatttttaaattaatttgcacccctaattttcggggtccggacaatccgtcagtggtcaatccgtcagtgaaggacaattcgtcagtaatggacaatccgtcagcaaattttttttgagcaatgatcaaaaaccttgcgaaaataattgttaaatataataaatgtaaattttttatagcttcttaacatttctagttacttcatgcttcaattaattgccatatcgagaataatcaattaattctttttaaattcataatttttttaaaataacacaaattattaattcaggattttagcgacttaaattaattttcacatgattacaaacaaagctgggtgttttaaaataaatttgcttatagattagttactgacggattgtccgggagcctaattttcaagtttttttttgttcatatttggtgcattttcaggagatattttggcaacacttcgttcatattttttgcagtcctgctaataagatttagaataatgttttaagaattaaaaaaaataatttttgataattcttttttggaaaaagtcacaaaatggccaaattttgcgtcaaattttgagaattttagtgaaattttggagacccgtaaatttttttggcatttttaagggattttttaagaaaaattagcaaattacaatattttttaattaaaaattcaagatcttaattataaaatggagacttttcgaaaaattatcgtgagttcaatcccgcgggattggtaaatggtcgggagggatcccgatg

SEQ ID NO: 104042 - DNA, 356 bp, Heterodera glycines
  Promoter: Source sequence=SeqID_29384; Location=288..643; Strand=-; Gene=SeqID_59885
tttgcactgtggtgagtgttttgaaattttgataacaatttctctctcttttgtaaaattaaaaaaataagtggttctcatcgaccaaattcaatttgaaaatgtgggtaaaaccaatttcaaaacatttaaggaagaaattaacacgaaggatccgatagtggcggtagcgccgccagtttttaagaatttttgtgtaaatttttaaatggaaaaacccgacgatgcacagacggcaccttgtaaaaatttagaattatttaatagaacaccaaaaagtcaaaattttccatgaaatatataatgagcaaaattccaatttaaaatatttttaattttcaaatacagtacggatg

SEQ ID NO: 104043 - DNA, 73 bp, Heterodera glycines
  misc_feature (33)..(34): n is a, c, g, or t
  misc_feature (68)..(68): n is a, c, g, or t
  Promoter: Source sequence=SeqID_41643; Location=1144..1216; Strand=-; Gene=SeqID_69728
gcaaatttaaaatggaaataaacgatgaatgcnncaagttcggcttcagttgcacttgcgcaaattgncgatg

SEQ ID NO: 104044 - DNA, 1003 bp, Heterodera glycines
  Promoter: Source sequence=SeqID_3101; Location=1643..2645; Strand=+; Gene=SeqID_83192
ttataaaaacagactttagtgttactgtacaccatataaacaacaatttgtacgcgccgatcttgtacttgatgtaatcccaatgacaaatcacacaggagttgacatagcggaagaaattggaaatacacttcggacaaatggattaaacccagaaaaagttatttgtttggttcgcgacaacgcaaaaaacatgataagggccactgatattttgaacatgaataggttttacctaattctggttttttaattactattttttaagctttcaatgtgtgtgccattttcttcatctggttatgggagacgtattgcgactgcctgagttggctggactcattttcaaaattcggtcttgggttaccttttttcgtacaagtaaaggcctgccctgtccttgctaataggtcaaaaatcaataaatatattaattattttataatttaaggctttccggcaatactgtgcgcaaaattttgattgtgaaggccaatttggacgcacttttactggcaccaacgcatgaattagaatcagatgatgaaaatgaagaaaagacgatttttgagttcttaaaattttatttacgtgcatttaaaaagaaaaatttgattttttgttaaaaattttagttgatcactacccgatcggggtccccgacccccgacaattgagctcccccccgacccgacccccgacatgtcgtcccccgaggtccccggcccccgacattttgccccccgagggctcggggctgaaccctagttaaaagcgccgccgcaataattccaagaaaaacatattctaaaattttcagttacataggctaattcgaaaaaagtttaatgatgaaaattacaaaaaaaagagaaaaaaaaagcattttttaatgtaattgatgaaattttgtgggttttcccatagtaacttgtgaaaatttaaatttttaccaacccggactcccgggcccggcaaagtgccgaaagactctggcaaaatg

SEQ ID NO: 104045 - DNA, 570 bp, Heterodera glycines
  Promoter: Source sequence=SeqID_42928; Location=578..1147; Strand=-; Gene=SeqID_70725
aaagcggcgcttaaaaaataaagaaaaaaatgggttgaattcatttggggataaattcagaaaaaatttccaatggctgtggtcgacacaaacattaataattcagtaggagaaagtcattttataataattgggttaaaaaccaaacgagtatattcagctgtatgccgagttcaaagatgctcgtccgagtcgccttctcatcggttgtgccctccctttgagaagtgtcgccgcctgcgaaatacttttcaatttttgcgttatttttgcgacaattcgctcaaagtccgcatttatattttaaattccgtttcaattattctaatcctttttttggggctttgaatggcactgccaattttctgctggcactttgctctttcttcgaactgctccatcagcatggccattttctgtttgtgttcgtcgctttttcgggcttaaatttcatcgaatatcaaacggccgcacttttcgcggcactttccgtctttggaatgggtgggacaaatttaaaagtgaaaatcaaaaatcgtgccaattttaggtggcattgccatttcaatg

SEQ ID NO: 104046 - DNA, 441 bp, Heterodera glycines
  Promoter: Source sequence=SeqID_25560; Location=1389..1829; Strand=-; Gene=SeqID_56300
ttttatgagtctaatcaattaaccatacctttacaataattttgttcatgtcaaacaaaccctatattttttgttatcagccaaaagcactaataataagtctgaataaggtaataataccataaaacataagcatgctaacctttaaaaaggtacaaacaaaaataatcaagaattgctaattaatcatatatcgtttttgacaattgcctaaacacttagatttgtataattagcttttttttagactttgtgcgttaaactgataccaaaaatcctatgatttgttcaatatgaaacaaaaagttctgattcaagaaactcaggatgacagttgatttgactcgtaaagtgcaatagaacctaataaaatccttcgattgtaatttggcaataaattctcaatttgtcagttttaatacgtcggaattgggcgcaatg

SEQ ID NO: 104047 - DNA, 550 bp, Heterodera glycines
  Promoter: Source sequence=SeqID_1312; Location=330..879; Strand=-; Gene=SeqID_72325
attttattttaaaaaataaatgttttttcatatttaaaaaatcagtgaattatcgatttgcaaattaatgccaataaaacgaaaaaaaatgggcaataaataagtaatattattatttttttcattatttgtaaaaatgaatttgttgtatttaatatttattatatatttctttgtttttgtaattgaatccggcaaaatccgacccaaattttgatgaaatatttggcaacggatgggacaaaaaagaaagtgaacaaacagtgaaaattgaacaaaatgaacgaaatgagaactcacaatcagcagcagttgatcaaatgggtgaagaaatgggaaatgaccgaaatgatcaaatgaaaaatgatcacaaaaagagagaaataattaaaaaatttgaagcaattaaagaaaagttgaaggaaaaaataaaatacaaaaggaaagattatgacaaaattgagagaaaaattgcaaaattattaggaacaaatctgcaattaatacaaaaatggaaaaatgaattgaattaaatataattaaaaagatg

SEQ ID NO: 104048 - DNA, 176 bp, Heterodera glycines
  Promoter: Source sequence=SeqID_2732; Location=2671..2846; Strand=-; Gene=SeqID_81314
agacgcggttttcttcaatttcgacatccaatagtctctaggcgggtgaggagccactctgcgtggttaattgctgatcatcggacgagtcaaagccaatggacgccacccaactgtagcaagtgcttgacgcagtttttgcacgatttgccggaaatgcggcacctgcaaacatg

SEQ ID NO: 104049 - DNA, 468 bp, Heterodera glycines
  Promoter: Source sequence=SeqID_40059; Location=1..468; Strand=+; Gene=SeqID_68493
ccttctctagtctgggctctaccaaacactcacatcccccctgaaatgcaaacgaaaaaaattcttgccgaaaaaatgtttatctcttttttctcctggggatttgaccgcaaacttggtaccaacatttgccttctctagtctggctctaccaaacactcacacgatatttgaaatgctaacgaaaaaaattcttgccgaaaaaatggctatctcttttttctcctggggatttgaccgcaaacttggtaccaacatttgccttctctagtctggctctaccaaacactcacacgatatttgaaatgctaacgaaaaaaattcttgccgaaaaaatggctatctcttttttctcctggggatttgaccgcaaacttggtaccaacatttgccttctctagtctggctctaccaaacactcacacgatatttgaaatgctaacgaaaaaaattcttgcccaaaaaatg

SEQ ID NO: 104050 - DNA, 996 bp, Heterodera glycines
  Promoter: Source sequence=SeqID_2018; Location=1002..1997; Strand=-; Gene=SeqID_77347
ggataacagccaatgccaatcaatttaagattgtctaatgcaatagataaataaaaaattttgacagaaattgcttaatttagagttaaatttcttaaaataagatcaaccctaaaaaataggagcaaattccttatataagggcaaaaactgcttccctgcagaatttgaagatatcataaaagccatagaattgtaatatttagagtactcctcgagaagttaaagaaaaaccaaagaaaaagggaagtttgcgtcgcttaatgtcatcattaaaattgtcaaaaaataaaaaaggtactcattttaacgaatttgtccaaaggcatgagaagtcagtgccgcgtgaacacattaaacacttggttgaggttctcaactaattatcattaacaattaaataattttttacaattagcttatttaatttaatgatcaaaattattcaagcagttttcacgttaagttcacatttggtaaaccctggccctcagggagacaaaagcggtcataggaggttgggaggagggtggggaaaatctgacaaatttgtcgtggatggctggataaatttaaaaaatgactcggaacaacccctccgggaagtaaattttcatctaaaaatagaaaaaactttctaaagcaaaaaatcttagaaactcatttaaaccctctcatataatttgggacataacagactacattcgcaattgcccgcaccggttcggggcttaaccttagttcatagtactttcataaaattacgtttgatttgaattataatttcgtgatttgtattcaacgcatgaaatagcgaaaacaaaaatttagaaaatcaaaaggtgtacaataagaggagagaagactttttgcaaagatgttcgaatttttgaatttaataatttataaaccatatttaatttaaaaacaacaataaacgggattttttaatttaataaataggctcgtcgttcattggatcttcattctccaatg

SEQ ID NO: 104051 - DNA, 556 bp, Heterodera glycines
  Promoter: Source sequence=SeqID_12038; Location=953..1508; Strand=-; Gene=SeqID_75566
ttccgactaatttagaatctcggacccaaattcgaacgaaaactcgaaaattcaaatttttagtttttaagcccgctttttttgtggaatgttcgaattatatttctgaaaaagtctttcattcttatttaatttaccccaccacatcaaagcaatcttgccgatacaaaaaaaaaatcagcatcaaattctaaaggattatgtatggtacggtaccaacccgctttttttcgaaataaaaatcattatgccaaatttgtttaaaaaatattttttttataattttgtcattaaaacggcgtctaaacagcaatatgcctcaagcagttttccttcctctgttctttcttatctgctcatttattcattcattctgaggtcattcgataagattgttttgattgcagtttcttttacccaatataaaatgaaggaaaagtaatagaattttcatgaagttgtgaaatgtttttcctttacattcattcttaaaattaaaccttttctgatttcattctttttagcttatcaatttttaccctttccacttaaaatg

SEQ ID NO: 104052 - DNA, 955 bp, Heterodera glycines
  misc_feature (15)..(15): n is a, c, g, or t
  Promoter: Source sequence=SeqID_882; Location=2432..3386; Strand=-; Gene=SeqID_63276
atcccacacaaatanagggcaaaaccaaaatacacaatttttaggctaatttaaggcgcttgacaaatgaatacgagtctaagaccatttttttgcacagtttcgatacttgaaatctcccaaacatgtatatattttttaatgttttactataatttgtgaatgtatctttttgaaactctagcgaaattaatcggttttataaaatgcaattctataaattgcttagaaaaatatttatattttacttttcgctaatttttcatgactttttgtcgttttttttttgattttctaatcgaatcgtctttttggtcattttcctctaataaattcccatcctaataatgcttagccgatccttaaatttgaatctttattaatatattatttatcaactgattggttttcagcgattttttggaaaaaatagtagttaatcataaaattctgaaaaaatcgccatattaaaaaaaaattttttttttgtttggaattagcttatgaaaaaattcctacgcatttgaaaaatttgtgtgggaaattatttataaaaattttcggaggtgggggggggggaggacctgcgccgcaactgattgtgagcatgttggcaatgttcctttttgcatttaaaattaattttgtgctaattgacttggtttcaaagctctctattgagttttttagttattaaatccaaccttaaggaagcaaacaaaaaattgcaatatttggattaacagcgaattcaaattgtcattcgtttcaaattgtcattcgtttcaaattgtcattcgtttcaaattgtcattcgtttcaaattgtcattcgtttcaaattgtcattcgtttcaaattgtcattcgtttcaaattgtcattcgtttcaaattgtcatctcccaaaaatcaatcgatggcaaagagaacggcggcgaatttttcccctcccatg

SEQ ID NO: 104053 - DNA, 331 bp, Heterodera glycines
  Promoter: Source sequence=SeqID_32253; Location=1..331; Strand=+; Gene=SeqID_62576
gttcgaggtgcgaataggatcgaaatggatatcagaatcggattcatcgacccagaaaaccctagaaacgcctttttcgcaccaaaaaaaatgaatttttttttttcaaaaaggtgtgataccatctaaactattacccaaaatttgtttaaccaattgacgagtgatcactgtttgacttttccagtttttatacaaatttagtgaataaatctcattgtcagaacatgaacagatcattatacatagctattagttgcaatcgcatttttatatttgcatttttattgcatttcgctaatttataacgttcttttttattgcactaatg

SEQ ID NO: 104054 - DNA, 78 bp, Heterodera glycines
  Promoter: Source sequence=SeqID_5606; Location=3260..3337; Strand=+; Gene=SeqID_58623
actgaaaaaaattattataaaaatttatatttcgctctttttccattcacagaggctggcaatgagaaggcgccaatg

SEQ ID NO: 104055 - DNA, 849 bp, Heterodera glycines
  misc_feature (172)..(172): n is a, c, g, or t
  Promoter: Source sequence=SeqID_15455; Location=864..1712; Strand=-; Gene=SeqID_79718
aaatcgattaatgcgatctcaggtaattatgctaacaccggtaattactatcagttttactgagaatccgggaagcaaccgataaagggtttaaatttgataccacaaaattttgtggtaatgtatttaatgtttaaatttcttaaaaataccattttcggaataagtattntaaggaaataaaaaagaacgcttgtcaaaatttggcatcttttcatctgaatttaaatctgaaccaagaattctcacaaacccaaaaactcattttacaaaagtgaggttcaaaagaatccacaacagttatttttgaaatcaattattacctaaattgcctctaaatcaagcaattgccttttggggcttgttttttgaacgcactattgtaaaacaaaattgttgtttactccggactcggaatcaaagttttaattcccaacattttttgccaaaattgtgttttaacgttaaaattgataaatagatgctaattagtgcgctaaatctcttttatcttaaccgcgtggtaaattttgtggcatgatcactctgaatgattgttgaaactttgatccaccacatttgtgactttgccttggcaattttcctattttgacttttcctcactttttcccccattaattaagaggcgtcaactttcttttcgttgctggtcattatccgctttatgttaccgacggcgaccgtagctttacttgtgccgaacgcttcaatgaattgttgagtgttcacaaggtcggtgcctatttgtcgggccatgagcacaatttgaagcatttggtgaccaaatttggtgtccaagtgtttgtggcgggtgccggctcacgaatg

SEQ ID NO: 104056 - DNA, 503 bp, Heterodera glycines
  Promoter: Source sequence=SeqID_5018; Location=1203..1705; Strand=-; Gene=SeqID_56590
tattttagcctttgtctaaaagttggaataatatttttgattgatattatattaaaataatattattattaaatttcgttttttgcccatttttttgtcaatttttgcaaaaaaagaggaaataaaatttgttgtatgaacagttttttatcgttaggttaggctaggcttggtttaggcttaggcttatttattaagtttttcaaaagttctagccaaaaaatgaaaaaattgtcataacttttgaaaaacttaatataattttttgaaatttggcaggctaatagcgcaattcaagggctatcgtatgataccaagattgtgcaatttggttgcgtctgagaaaagttatgagtggatttagtcaaaaatttagcaaattttgcactttttgtccttcgaccaccacggggctacacatttatcaaagcgacaattttcactcaaaatccgaactgcttcatcggccatttctccaattcaattaattcactttcaccatg

SEQ ID NO: 104057 - DNA, 208 bp, Heterodera glycines
  Promoter: Source sequence=SeqID_29699; Location=528..735; Strand=-; Gene=SeqID_60172
tttcagcaagaatgaaagttataacgactaatttcacttttatatacgatcaaaagatggacgacgccccatcatttagttccttaatagccccgcccactctcacctaaataattcacctgactaaaaaccgcaatcctttttaatttctctcttcaaacccaaaatcatccttaacaaaaagaccaaaattattttatacaaaatg

SEQ ID NO: 104058 - DNA, 407 bp, Heterodera glycines
  Promoter: Source sequence=SeqID_6216; Location=1..407; Strand=+; Gene= SeqID_60763
gctccctaaaaacaacaaaatgattgactcattcccgcctcaatgccatttcaatgccaatagttcctccacatcattaaaaaatgatcaccttcccattgtgccattcatccaatcaccgccccttcgtctcctccgcttcttataaatgagtgccgtctctctccgtgtgccatttagcacattccgcgccctctctcactccctctctctccgccattctctctctctctctctcactctctctccctctgtccgaatgtctctttttctcttccactctgttctgctcttcatttttcttcagcttaattcttcactcatcagaggtccgtttctccattcattcttccgtcgttcatttgcttctcctccctctcccctcatcagctgattacgtgactatg

SEQ ID NO: 104059 - DNA, 242 bp, Heterodera glycines
  Promoter: Source sequence=SeqID_17620; Location=1..242; Strand=+; Gene=SeqID_82147
ttcaaaaacggtgacactgttctcgtgttgattacggaaggtctggcaagcctaattggttgaaggcaaaatagtcgatggtaaaggtctaatttggaaggtcaaaattccacttttgaatattactgtcactcgacatgtaaaccaaatgcgttcttttgtcccttaccaaacagagacaactttttcggccgatttagttgaccaggttcctcaacagaaaagtccttgccatcacaatg

SEQ ID NO: 104060 - DNA, 127 bp, Heterodera glycines
  Promoter: Source sequence=SeqID_22583; Location=2284..2410; Strand=-; Gene=SeqID_53247
aaaatatcaagatcttgatgataactgctcatttgtttcgcgctagaggccatttttcgcatagtctgggaaattatcaacaactattaatttttcttaattatacgatcatggcaagcaaagcatg

SEQ ID NO: 104061 - DNA, 296 bp, Heterodera glycines
  Promoter: Source sequence=SeqID_14969; Location=1..296; Strand=+; Gene=SeqID_79128
ggtcttgaatgatataatttttttattgaatctttattttgccataatgaagtttgccccgcccctttttttgaaaaaatttccatatgaaacaagttccctgagggtttttcaggtccctgatcacgaatccagaatcaatttcgaccaattcctaatcccggacccaaattcgaacagaaatatctaatttcgcttctttggtctaaaaaggctaataatatttatttcaaaataagtattaccatcgtttatgttatttggcgcacttttgaatctgacattccaaaacaatg

SEQ ID NO: 104062 - DNA, 329 bp, Heterodera glycines
  Promoter: Source sequence=SeqID_8228; Location=1166..1494; Strand=-; Gene=SeqID_67378
gggggggggtttacaggaagttatagtgttttcgccaaaaaaagaccttctttttttttgccttgtgacccattttttacaaatttgggtgtgatttttgaattgcttaaaatttcaagaaatttacccatttcaacccccccccccacccctggctatgcccttgggctgacttgtgcgtctgctttttatggatctttttccacatattttagccttttcccgacttcaaagcgttgtgttggcccgattgggtgccccgggaacactactgggacatcctggccatctccagcttctgccactcgttcgccccgctgctgatcatg

SEQ ID NO: 104063 - DNA, 129 bp, Heterodera glycines
  Promoter: Source sequence=SeqID_5723; Location=1164..1292; Strand=+; Gene=SeqID_59027
attgttgaatgcgcttacccaggtttgccgcccatctttatcagcgattttgcgataaagcacttaattcgtgctcttgaaaaccctgaaatttcggtgggattggaaatagctcgccgtccaggcatg

SEQ ID NO: 104064 - DNA, 266 bp, Heterodera glycines
  misc_feature (35)..(35): n is a, c, g, or t
  Promoter: Source sequence=SeqID_36364; Location=1..266; Strand=+; Gene=SeqID_65698
ttatttctgggactttttcagaaatcagaattaanttctcctatggtggcccaaattttaggcccccagccacagccccttgcttctcccagttttaagtcttggatttgtcaaataaattcaagacttcaaattaataatcaaaaattctcttaaaatttttttgaacccaattcaaaaaaggaaaaaaatttgcagtcaaaaaattattcgaatttctccaattttgtttccataatttccgaaagttattcggtatcataatg

SEQ ID NO: 104065 - DNA, 236 bp, Heterodera glycines
  Promoter: Source sequence=SeqID_11309; Location=627..862; Strand=-; Gene=SeqID_46946
gcagtttgtctcattgtttttattctttcatcattcccctaattaatgcctacaaatttttctttttatttttttaagtttcgtttatttgaattgtatgttatagtttttgaaaagcatttatcttcatataaactgataaatcgttttgtttttaacatcattgtctggttcattcctaattatctctcaaaattgaaaattttatcttacatgaagttcaaggcattaaaatg

SEQ ID NO: 104066 - DNA, 874 bp, Heterodera glycines
  Promoter: Source sequence=SeqID_23651; Location=853..1726; Strand=-; Gene=SeqID_54348
cctagaagattttgatttaataacccgaaataaagaacgcatacgtaaatatgcattctttattatttgtgtgacatgattggaaaattgcaatttattatcaatatttatgcctaaatccctaattgtatccacaacatttattatatttccatcaattttatatatttctttggggtttttattccccaaatgaagtacaaaagtttttttaattgagattctgatctgccatttatttgcccattctgataaattatgcaatgctttatgcataatttctgtttcggttcttgctttataacaaatatacaatttaacatcatcagcatataattttattttcactcctgatggcaaagcatcaggaagatcgttaatataaatcaaaaataataaaggtccaaggacagagagccctgggggacgccagagccaacttttttactggaggataaatcatccccaattttaacacgaaaagtcctattactcaaaaagtcctttatccacatcaaaagtttgccccttatacctattttttccaatttgtataaaagtaattcatggggcactgagtcaaatgctttttgaaaatcaatataaatacagtcaacatttttttcatttattattgcctcgtaccaatcttccacaactgttattagttgactcgttgtagacctatttctaacaaaacaaattgaaattccgaaatttttttgttttttaatagaaaattgtaaatatttttgcttaaaattctttccataaccctgcagagtgagcaggttaatgaaattggcctatagttttcgggattatttttgtcaccctttttaaaagcggaaaaacaattgattctttccagatg

SEQ ID NO: 104067 - DNA, 1003 bp, Heterodera glycines
  Promoter: Source sequence=SeqID_15680; Location=476..1478; Strand=+; Gene=SeqID_79988
agttaatctctgccgtatttgtcggcctatccttttggcgctgtgtttgtccaaattcttagctttcccctgcccgagtggccttttgcttccggccggtagagagaggtcaatggcgaattggcggaggtgggcctccccgggggttaagggctcggggataagggctgatctctcacctttgtgttccgcccccttcccctccgggccctccttttttgcttaattcacatacaatattttggcctttattttttattttttgccaatttataaatggcccatcgcaaaattcggtcaatcaacggcttaatgtttttggaacaagtaattgaaagtgagctgagtgccattgtttttttgttgcaattgccaggcctttgcgttctgcgccgtttttgttgctgtgcaaagtgccaccgtaccactcgttgaacaaacgctaccgtaccagcagatgttgggccatccaatccatggcgaaagatgcgacccaaaaacggacggacaaatgtttccgattggcgacgctttagcgagtgacaaattcctttactgccatcgcgaaaaaaggtgaaggcaaactgagcaatgccttctgtttgggcatttgtccattcaattgaccgtttggcaccgaaaagaaaaggacgaccgaaatgactcatccaaaaaaggataattgccccatttaaattattccaattaaaaaagaaatgccttcatttccgacagagtttatgacattggtttttgcgttggcaattcgttcgatccgataaagcgaaaatgcattgccaaaacaacaacaattcacgtggaggaaggcgaaacgacgacaaacggagcacaagtgacaacaaaaggggattattcagcagcaaaaggcattttaaaattaatttattaatttatttattattttcccaaagtgccgacatttttgaaaatattttccaaagccacaaaacatcggaaagtcccctcgtcggaacaaaaaatg

SEQ ID NO: 104068 - DNA, 88 bp, Heterodera glycines
  Promoter: Source sequence=SeqID_4613; Location=213..300; Strand=+; Gene=SeqID_55102
tctctttcgctctccacttcctccccctccttcctattggctctcttcctcttcctcctcccctcagtgctgtcccttcactgctatg

SEQ ID NO: 104069 - DNA, 104 bp, Heterodera glycines
  Promoter: Source sequence=SeqID_10497; Location=554..657; Strand=+; Gene=SeqID_73713
tctgaagaaaaatccaaaaaatatatccaattattaattaaattaattaattacgcacataaatttcatcaccgtgtgctcatagtcgtcagggtttacagatg

SEQ ID NO: 104070 - DNA, 411 bp, Heterodera glycines
  Promoter: Source sequence=SeqID_4237; Location=3373..3783; Strand=-; Gene=SeqID_53715
tgccatcaccttctcacctgtcaatcacattttcgtagccagccaaaattcaaatttgggttctctcgcgtgccatccttctctgctggcgttcaaattgcttctttcgccggtcttttcccttctttcaccacacacaccactgaaaatcgatcacactcttccgctaattactccgccccttcgcatttgtgctggaattggcgtcctttcattcactcttctactctctcaaaaattcagccagctttttcaaccaaccttctcgcccagctaatttcttttttattgtcttcaatttcctaatttaattcgtcctttttcaattcttcttctctctatctgtttttttgtcctgacatttcgtcttctatttattcccttttcttcaacttttttttgctgaaaatg

SEQ ID NO: 104071 - DNA, 67 bp, Heterodera glycines
  Promoter: Source sequence=SeqID_10404; Location=46..112; Strand=+; Gene=SeqID_73598
ggcaaaacaaacagtaaaagaaattgaaaaacgatgtttatattttataggaattccttgtgacatg

SEQ ID NO: 104072 - DNA, 308 bp, Heterodera glycines
  Promoter: Source sequence=SeqID_43100; Location=1..308; Strand=+; Gene=SeqID_70860
tttaatctggtcgcgtattggagcatcccgtgaggggtcttttgcactctgtcccccccccccctcctccctttcccttttctctgctcatttttatttacgcccctccggcgaacaaaacattggtgaaagagatttccttccgtgcactgtccccttccccccccccccccgacaaatgcccataaaaaattgggcactcttcgaattggccgccaattgtcccgccaaaattggggtaacagaatttgaaccattccaagagaattttcagttttttttattttattcttttcttgccaaaaatg

SEQ ID NO: 104073 - DNA, 485 bp, Heterodera glycines
  Promoter: Source sequence=SeqID_8112; Location=1618..2102; Strand=-; Gene=SeqID_66996
agatagaaaattgtcctaaaaagagatagccattgttatgagaattaattcacaatttgcgcatttcttagggtaatggaaaaaatttagaagagctctctccggatcggattagcatcggggttaggcgatagaaaattctcttaacaagagatatccatttttctgagaattaattcacaatttccgcacatcttacggtaatggaaaaaattttgaagaggctctcaggatcggattagcatcgcggttgcgagatagaaaatcgtcataaaaagcgatagcctggtttgggcgatttcgtgcccagaaagtcgagctcgggacctcaatttccgtccgggaccgcgagaaaagccgagaccgggtaatttgtggttttagtccgtttaaaaaagaaaaaataataacttttaagtagaaatattttttattaattaaatttcaattggaataatttaaagaaaatagaaaaaaagtatatg

SEQ ID NO: 104074 - DNA, 499 bp, Heterodera glycines
  Promoter: Source sequence=SeqID_29527; Location=926..1424; Strand=-; Gene=SeqID_60019
ggcattttttttgctacttttttttgtacattattgtgtaacagtaccgataggtcacaaaagttagtccagtacatgttttggggtcatttgttcaaatatggacaataccccaacccgaaccttaattcgaacaaaaaggataaccaaattaatttgttttaaattgcaaagaaaagagagttaattctatactaatccattttgactattttttgaatgtttaaattgttttcctggccaaaaatgagaaaactcgaaaattttggattttctgtttttgttcgaattcagaggctcgtcggggggtttgaaattgtacgaaatgaaatttacatttctatgcgactaaaaaataccaaaaaaacacttaaagcaattaaaacttgaccactaaaaacagacaaattgtcaatcgccaccaacgcgtgaatcgcacactgccgtttatttcacaacaaacacgggcaaccagcagttgatcatctacggtgggatg

SEQ ID NO: 104075 - DNA, 198 bp, Heterodera glycines
  Promoter: Source sequence=SeqID_21782; Location=1821..2018; Strand=-; Gene=SeqID_45673
gcgtttgatattgtcagagccttgattattccgcttgatcacttttttcctcaatttaatcagttttttatattaatatttgggttatttttttggtcactggttttttgtccaatgatcatcttgaaacattattccattcaccatgagaaataaataattacaatgctttcaccgtttccccccaattaagcgatg

SEQ ID NO: 104076 - DNA, 89 bp, Heterodera glycines
  Promoter: Source sequence=SeqID_39629; Location=1..89; Strand=+; Gene= SeqID_68149
gtacatactaaataaagtacatttttgaccattgaaagtagtgctttatattgccattcttcaaattaaacttttgctaaaattccatg

SEQ ID NO: 104077 - DNA, 437 bp, Heterodera glycines
  Promoter: Source sequence=SeqID_20990; Location=799..1235; Strand=-; Gene=SeqID_51569
tgtcagaatttttcacaattaacctttaatttttacgctaaaaaaaaaatttttttaagcacaacgtctttcatatacacttaggcacacatttaagaggaaaaatcatagcataattaaaaacaaaacaaattttaagattttaaataagtatattattatattgcatcttgttgttggtgatcaacttttttatcgcaaaaaaatcaggaattgattaattaacatttcattagacggcgccaaactgtttccctcttgcgcctgtgctaatgtgggtgagctttttgatccgaaaagaacccctggctaccactgcgcgcctccttgtagcaacccgaaatgcaatacggcagttgtttgtggatctgcctttctttcagtaatcctaatttatatattgtataaatatatatatatatatttatagttcaatg

SEQ ID NO: 104078 - DNA, 1003 bp, Heterodera glycines
  Promoter: Source sequence=SeqID_14169; Location=1925..2927; Strand=+; Gene=SeqID_78174
gggaaaggccgtcaatggtcagagagatggaaaaaagcaactttaaaatgtagaaaatcttcacattttatcttaatgggttttttaataaattaatagggatgcgatttttaggtaagaaaaatcccagaataggtacttaaatcgcatccctataaattaatattttaacagaaaacgggaaaatagccataaaaatcacaaataaaaatgtattatttaaagaaaaattttcattttcttctttctttaataaaatcaaaagttttttttatcaccgttccccggtttacgaatccccgtccgggggttcccggtttagtcatccccgctgtccccgttctcctgtttgaccggggatctcccgccccccccccgcggtaacgaccctagtctgttctgtattggtgacatttcttcatgtaattttctaaatattacatgcattaacaatttttcttttcattaaatttaattcattttttattattaaattcacaaattgtgaaaaattatagtaaagcaatgatttgttacttattacctttattattatattttttttgttgttaaaatagattcttttcatcttttctataaattgccactttcatatttaaaattattgatgtgttgattttaattatttatgaaaatgagttggctaatatttattacttttcaatttaaaaggtgagcagatggaaaagcaaatgaacaatttcgtaatgttttattttaaagaaatgttaaaaaagaagcattacaaaacacatacctttccatttatttcttgtgaaattcaaaaaattattgaataattcacaaatatttaaataatatttatcaaattctgttatgcatacacacattaattaatttattgaagactcttaataaaaaaattgttaaatttataaagcccatcctaaaagaatcatttaataaaaattttcatttgaaatataaaatttacttttatatacaatatttttagaaaatg

SEQ ID NO: 104079 - DNA, 311 bp, Heterodera glycines
  Promoter: Source sequence=SeqID_18264; Location=315..625; Strand=+; Gene=SeqID_82859
atatatttcaatcgttcttgacctttgatgggtttattttattatgccattttaagagcaccattttttgaaattatttttgtcaaaatgatcgatcagtcgcattgaaatactgtaagggacaaaccgccgggagaggagtgacgggagggtttgctgaccgcgtgggttccattcccaccctgccatacagtactcttgctcatatgctcttcccacccacccccaacaatcgtaccccttattaccgtatcctatgattgattgtccatttcatctgtgtaaatccccccccccccctcccaaagatg

SEQ ID NO: 104080 - DNA, 280 bp, Heterodera glycines
  Promoter: Source sequence=SeqID_41410; Location=1..280; Strand=+; Gene=SeqID_69534
aagataatccataaaacaacaccgaatttagcctcccaaaatttcaaaacttatttcgaaaaaatatcaaagcaacaaaagaaatctgttgcaaattgcaaaaacaccaacaaataagcgtacagctaatgcattgtctattttgcaagaaaaccattcgtttttgtatctcacaaaaaatggaatttctgctgattttatcttacttaagcaaagctaatagaaaaaaagaaagaaaacgaatcggaggggagagagcacagaagaaaaggacaaaatg

SEQ ID NO: 104081 - DNA, 229 bp, Heterodera glycines
  Promoter: Source sequence=SeqID_4567; Location=5742..5970; Strand=-; Gene=SeqID_54918
tctaaatgactgacagggaagtgaatgataaggggcgtggcataggagggcatactgtggatggatttcgaaatcctcccgtctggaggtccctgcgtgctctcagttgagtgggagtggcctattcccacgtgacaccccccgccctctccgtcacgtcacatacagtacccccacacttttccttctcattttcatcttaacacacaaaaaatattcctcgaaaatg

SEQ ID NO: 104082 - DNA, 115 bp, Heterodera glycines
  Promoter: Source sequence=SeqID_1263; Location=2093..2207; Strand=-; Gene=SeqID_71020
agtgagaggggagcgcgaaaactagtgcagcagtcaggcggatcactttttgcccctttgttggcccccattctgattgaggctgcccgatacctgctttcgcgcagcaataatg

SEQ ID NO: 104083 - DNA, 62 bp, Heterodera glycines
  Promoter: Source sequence=SeqID_20642; Location=1194..1255; Strand=+; Gene=SeqID_51193
tttttaacagattttcactgaaatttttgacattttacactcaagaatattttttcaaaatg

SEQ ID NO: 104084 - DNA, 943 bp, Heterodera glycines
  Promoter: Source sequence=SeqID_8806; Location=1875..2817; Strand=-; Gene=SeqID_69285
tgatacatttgaaaatgtagagctcggctagcgcattcgaataacacaaaatttgttttcatttgcccccaaacaatccgcttatgacgggccgaaagaaaattcacaaaaatttggcaccggaaaaactccatttttttatgggccagcataataaagtaaacccaaaatgtaagtgaatttaaattggtcatgtgagatgtttagttttttatttgacccatccgttttctgggaaaaaacttttcgagaaaagctgaaaaattttccaattgcatcagaagcagactcaaattcttcaacaacataatgtaaaaaatattacgcaagaaattatttttacatcctttttagaaatgctgcataaatttttattgtaaatagtagagatcggctacgggccgggcccgtatacgggtttttacgggcccgtaacccgtaacccgtatttttttcggtcgatacgggtttttacgggttaagggttttacgggtttttagcccgtaagcccgtaacccgtatcgatgtcaaacccgtaacccttacccttacccgtacaattacgacacgggttttacgggttaattttttacgtttttaaggttaaattgagtaaatttttaaattttgtgtagtcaattcgccaaacaatttatttctctacttgaaactgtaacagaatgtgatttacatggacaaaaaggtgattaattttgtaactgccacgaacacttcgttcaaagcgattgaccatcccactttccattcattgctcgcgcctcaacaaattaaagtttttgatggtttaaagctttgtaaatttttatgtttagggagagagctattacagaaagcaaattcttcctgatgtgtataagcaagtgcggaagaaaatcaaaaacgaattagaagaatgtgaatggctttcattcacaactgatg

SEQ ID NO: 104085 - DNA, 98 bp, Heterodera glycines
  Promoter: Source sequence=SeqID_3171; Location=4723..4820; Strand=-; Gene=SeqID_83520
atgatcatttacaatcattaagaaaaacatttgaacgctttcgcttgtacaacctgaaattaattcccaaaaagtgctcttttgcatcaaaatcaatg

SEQ ID NO: 104086 - DNA, 144 bp, Heterodera glycines
  Promoter: Source sequence=SeqID_23937; Location=1579..1722; Strand=-; Gene=SeqID_54628
ccattgggaacaaccacaattctgctgccgtattaccccttttttttgtcttttttattttccgttatgttttaataatgctcatttgtcattattattatattacatatacattatttcaggcagaaggaattacgtttcatg

SEQ ID NO: 104087 - DNA, 1003 bp, Heterodera glycines
  Promoter: Source sequence=SeqID_7265; Location=934..1936; Strand=-; Gene=SeqID_64297
ccctcagttagagtatacaattttaaagttcttaatataaaatggaatatatttaaaaaatttccggttttttcgtttggtacgaaaatggtatttttttcgtttcgtgtttcgttttcgtgtcgaatgccctttttcgtttcgttttcgtatacgaaaattttttttgtgattttcgcacatccctgttcccaaactaaacatttaaaaatttcttacttcgatttttgccttttcgcgattttggtgccttatcatgcctttttcagtattttttgaaaatgttaataatattaataaaaagcaataaaaatcaaaaattacccctaagaagcgttcttaatttttttttttttaaatttagcaagacctttcattttaaaccgatactttcgtgacttacttctcacaattaaaatgcgggagtttgtcgagtgcaaaattttaattgtttaaccacaatctttgtagcaataattattaattcattaaacgataattacttttgtcccacattttgtcacgaaatgaaatgcgggagaattgtcctgcccaagtttatcccttcagtaaatgcttggcaacactttttatcttgtcaacattttcttttcctagcaatttctttaattaaaagataaatttttatttataattaatataactagggttataagttgtatgcactaaaaaatgccaaatatgcggataaaatatgcactaaaaatcctccaaatatggcctaaaaacccgaaaaatgcccaaatatgcactaaaatatgccttaaaattactcaaaatggcttttaaccctcaaaaaaatgccaaaattatgtataaatacagaatcgactttaaaaacatcaaaacaaaggctaatgagcgtttttagataattccaaaaaaatttgattttctaaatttatatatgcaatttcgaatttttaaaatttttatcatttctaaaaaaattgccaaaatatgctctaaaaacgcaaaaatg

SEQ ID NO: 104088 - DNA, 474 bp, Heterodera glycines
  Promoter: Source sequence=SeqID_36679; Location=85..558; Strand=-; Gene=SeqID_65935
actgaaaacgattttatgatgccccaggagcttaaattgctatattgagtttagatttagcattgtcatcccgtttttagtgcattcataatttaaatggactaaatgaagttttatttatgtaccctactaagcctaaaattacataaactttgatttttgtttggctcggctttatctgctcgagaatttggctaaaaaatggttggtattggtgtctcggtcgattttgtttttttttgtcccgagtcgagtttcgttctcctgcttcaagagtaagcgtcgccgggtgattttttgtgccataacttggtccataagtaaaaaaataattttatgatgccaggagacttaaatagttttaatttaagtttaatttagcattgtcattcattcttcccgtttttagtgtgttcataatttaagtgtgaattctacatatttgtttaaattgaatgtctgttttaacgaatg

SEQ ID NO: 104089 - DNA, 92 bp, Heterodera glycines
  Promoter: Source sequence=SeqID_17672; Location=1464..1555; Strand=+; Gene=SeqID_82202
aaaaaattttactttaagtctgaaaatgggtcaattacgcagacaaaaattttctcggtttaaaaaaaataatttttatttttaagatcatg

SEQ ID NO: 104090 - DNA, 455 bp, Heterodera glycines
  Promoter: Source sequence=SeqID_31848; Location=180..634; Strand=+; Gene=SeqID_62157
ggtaagccttttctgacccaagggggtcaatggcttaatggtctgtattaaagggctcctgatgtcccttttacagacagggaaaagattaagactcttttcttaatctttattcaatttacacaattacaatttaatgcaaattgtttggacagaaaactgtccggctgacttaatcaaaaattgatcagtgaagaaaatggagaatgggccggacttttataccctcacaaatcaatgggggcggggccaggcacgtgaaaaatgtgcacaagcaaagggaaaaattccctcaaaaatgatgactcataataaaaatgaagagagaaaaagagatgagtcataaaaaagaggagcgagcgaatgggaaaattgatcgacgaaaaaggatcaaaaaataaaggaaatttcaaagaaatttgtgtcgcttcggcgacagttatgtaacaattatg

SEQ ID NO: 104091 - DNA, 191 bp, Heterodera glycines
  Promoter: Source sequence=SeqID_45521; Location=1027..1217; Strand=-; Gene=SeqID_72797
atgattattattaaaattgctagcatttatttatatttgtaataaaatattgttcaattaaataaatttctataagtaaaattaatttaataaaattcttttttatttgaaaaaacatcagaagtgtttcctttaattaaatcattaaataaaattcagaataacgaacctcaaattggtgcctaagaatg

SEQ ID NO: 104092 - DNA, 1003 bp, Heterodera glycines
  Promoter: Source sequence=SeqID_9210; Location=110..1112; Strand=+; Gene=SeqID_70603
ataatttcatttacaattgaaatatttaaagttttaacgtgtttcgctacctaaaaagcgttaataaaaaattttatttgcctatttttgtgcctatttaatgcctattttgcgatttttttctgcctttttaggtgcctatttcgcgattttttgtgcctaaaaatcgcatccctactaatcaataattatctctaactctaacaaaaatattttttcaattaatttgccataattttatatttacaaattcttatttttcttcagtgatcggtattatttttttggagttatgttttttattcactttatcatttaaatttattaaaatattttatttaactttattcaatctaaatttgaatttgtttaataaattctcgatctgtattttgattttgtttaatttttttcgcgcagtacggatgagcgagacggaccacgaaacgtcggaggaggaacggagcggtaatctgtgccgactcgtccaaactcaaagccacgattttggttgtttatttgtcggatctggctatattaaattttgatctgtagaaaaactattatcgtgtagcttttttggtttttattattttttcattttaaaatgttattttaatgtttttcacaattaattaccaattgaattttttacattaaaaattttttaaggctgcacaacatgatgaagcatatttataaataaaaatagtaatttattgcaagataattagaataaatgtgctgtttttaaatgttaatataatcagttatttatatatttaaatagaatagcaaatattaaatgtaaattatttattatttaaatatttatattttggctcaaagtttccagcaaatatttttatgagtttgtttttaatggcatgtcattttaattatgaatttttgttcttataatcaaatagtagttagtatttcattatgtagacatacttatttaaactaaatcatgcgacatttgcggagcagataaaaaatg

SEQ ID NO: 104093 - DNA, 833 bp, Heterodera glycines
  Promoter: Source sequence=SeqID_20822; Location=774..1606; Strand=+; Gene=SeqID_51404
aactcacatgacgtcctgcgggtctcacttctctccttttcttcaatcagcacggtatgtctttcggtcataatttttattattaattagttgggtaattttccttttttgacccctatcatttaagcactttattttctttcattttctctgcactcacaagcttttcgatttcacccctccttagcttccggtgttcgcaccatttacactgtgattccttgactgcaatggcagaaagtgggatgattctgaaaaggtggcacgcctcaaggcatgccttgatggtgaaccaagacgtatctttgataatttaatgcctgcccacaaagcaacttcttcggaagccattcaaaaaatcaaggaaaaccttgacactccacaaaataaagaactcacctatcaggcactaagcatgtgtaaacaaagggaaggagaatctgtagatgagtttagtgcacgactgattcctctaattgaggccaccacggcggaccttacaactaatgctagtgaggaggtactctgtcgagcatttttggaaaaattgaatccaaatctcaaatttctcactcgaaccctgagtgggcccgtcagaagggattttcaaatattgagaatgaatgcacgggaagcagaaatgatgcatagagagattcctaaatctattccagcacctcttttcccaatttcggaacaacaaaatccgagattcaacaacaccgagccgccgaaccacccggaaggcaactttagaacatgggctcccacaggctctaacagagagcctataagtcccagacagaggaaccggaacaattgggataacaatg

SEQ ID NO: 104094 - DNA, 119 bp, Heterodera glycines
  Promoter: Source sequence=SeqID_2735; Location=3818..3936; Strand=-; Gene=SeqID_81347
ttttttttttttgcaaaacggtttatcttatattatccatgtttaaaaaatattatatatacacaataaagctttacagaaataataataataataatctcttaactattaaacaaatg

SEQ ID NO: 104095 - DNA, 616 bp, Heterodera glycines
  Promoter: Source sequence=SeqID_30261; Location=1057..1672; Strand=-; Gene=SeqID_60683
aataaaattgcattttccaaaaataatttcgaaatgccaaactattgcataattaggacaggtaattaattatatggtaaataagcaagaaatatggtcatcaattacggatcaaaaatcgcgaaatatggatacaaaattgcaaaaataaggacataaatttttccaaattgatgagaaaattctaaatcttcactttattaaattttaataaaaaaacgctctaaaatgggtgaattgatattaaaaataattcccaaagaaaaactacaaacaaagttaaatttattaattttacgaaaaaaggagccaaacgaattttcttcatttttagttatattttttatcaaaaataatatttgaaggcattcttatgataatttttgaaagaaatatttgtttttcatgaaaattttggtcataggtgaatataaaaataaatgggaaataaggaaaaacatggaaaatattttatagaattccatcgaaaaaataattttgaaaaactagaataaaaaatgtcattcttagttctatatatgcctatcataaaaaaaactgttataattgaattctttttaattttgcttcattaatttattttccaaccagcatg

SEQ ID NO: 104096 - DNA, 593 bp, Heterodera glycines
  Promoter: Source sequence=SeqID_7613; Location=725..1317; Strand=-; Gene=SeqID_65411
tttctttttaagcattaatctctcttttcccagcctaatgtttccatttaatctttcctatgttttccattctgtccttttcctttgtcgcttttgatgtttaacaacagactgctatcccatccctctctctcgatgttctcgaccacacccctcacaaacgatataaaagcgatcaaatccatttatttgtcaggtcttttaactcattctcattttgggtcaggttccctgcctgccatttctttgctttaaaatttgaatcacttactcacaatttgccttgcttttgcttaaataaatttccttttaacttgttgtgaattgaataagttttgggtacgaatcacttagggacatagcactttttggtgccacgacccgggagtaagccgtcagtgctcccctgattcgtagaagaaatcggactggtcaaagtttagtacttccagtgccgaaattcatttgagctggtcaaagttaagtacttccagccggagatccaaaaaaaacagaaaactgatcaaatttcagtgagctgatcaacttgtgtagtttcagccgggcttagtgccaaagaaaaaaaaaacatg

SEQ ID NO: 104097 - DNA, 400 bp, Heterodera glycines
  Promoter: Source sequence=SeqID_655; Location=5081..5480; Strand=-; Gene=SeqID_58300
aacaaatgaaagcaactaaaaatgccttcaaattcattttacgttatccttccttccaacacaagtgttgatggaaaccgaacaaactccttccgggtgcgtctgcctcgcaaaatccaattcaattccgagtgggaagtgggtttggcggtcattgtttatccacattcatggccctccattgggacggtggaagaacaatttgtgcaggttgattggcagaccggaagcacagtgcacattgccgtccccactacaaatattaaaaatcctgatgatctgagtaaaagtttgtacaggctgttgggcgagggaagcgaaccgttggcaaaaaaagcgcgtaccgctcagttggcattcaacaattccgcctcggttgctcgccaatgggccaaggatg

SEQ ID NO: 104098 - DNA, 578 bp, Heterodera glycines
  Promoter: Source sequence=SeqID_9424; Location=414..991; Strand=+; Gene=SeqID_71361
aaaaagaaaagaaggaagacgtcttcagaccatttcgactttttccctgtaaacgatgtactcttgtaatttcccattgatttccaacttttacacttgtcaaattttctttaatcaaggaatgacattcaaattagttctgcataaaacaatttctttctacgaattcgaaacaaatacagtattttatttattctgcctaaaattacaatttctttatttattgttagtaaatgtttttcgtttacctccgtttagtctccgcttatgttttctcatcagtgtgtcctaaaggcatctctcttttctcgacgacaatttatacgattctcaaactctgaggtggaatccctttttgtccctttttcctgtatgtttcttatcttttaaattccgcagttgaggcgttcgacgcgtttatttcgtcatttccatgccttacctccctctggtgttccagttaatgtaagcgaccaagttaagcttacaataagattttaatttgcaaaacatgggttcggattaattgttctttcggattgtgattatgtttaattgaagattgttttctttttatg

SEQ ID NO: 104099 - DNA, 493 bp, Heterodera glycines
  Promoter: Source sequence=SeqID_20722; Location=922..1414; Strand=-; Gene=SeqID_51283
aggtggcggaagtgcctctgatctgcaccccgatcagaacagagctcatcgagtcgggagcagtacccgacagcgacatgaggactatcacacagacaacacaaccgcagctgttgatcgggattcgaaaattctgggatttcgtgaccggctttcggaaaacggaaagggcacgtacattgtcgacacggtgtttgggccaatcgtgtgcggcgaacggttccaagtgagtagcggggcaactcccgctccgtccgtgttcatgacattgccatgcggagaagatgaacgcgatcaaatgccgccgatcagagcagttgaacaattttggtcattggaagcaatcgggataagagacgacccgacagacgacgcggatgcgcaagcagtgatacaattcgaacgatcagtgcgccaactcaacgacgggcgctactccattcgattgccatggcgggagtgccaccccgctttgcccaccaatttcagcatg

SEQ ID NO: 104100 - DNA, 81 bp, Heterodera glycines
  Promoter: Source sequence=SeqID_17461; Location=1580..1660; Strand=+; Gene=SeqID_81949
gctaaaatttttgttaattaattattcggtaactttagcaaattgttatatgatacaggcttccttaaaattctgaaaatg

SEQ ID NO: 104101 - DNA, 296 bp, Heterodera glycines
  Promoter: Source sequence=SeqID_43516; Location=325..620; Strand=+; Gene=SeqID_71153
acgtgcccattttcagccgaccacttccaaactcagtgacgtgcccgatgaggagggcgaccgtttgccttccggcgaactgatcgaggtggaggggacgcggctgaaaatatccaaaaaactgtacaaatgcgcggaaaaggagcgaaaagaagcactgaggtggcataattttgaacgaactgccgaattgggagagaaattccaatttccacagattgcacattccacgcaaagcattggagcggccgttgaagaaaaaaaaattgctgaaaagtgcaggcaaaaaaacgatg

SEQ ID NO: 104102 - DNA, 184 bp, Heterodera glycines
  Promoter: Source sequence=SeqID_4113; Location=782..965; Strand=-; Gene=SeqID_53240
gagtgcatggaaggtaagctccatttttgaggccatgtacattccaggtattaaccaggaatagcgcggtcatggttatggtattgagccaggacatgcggaccttgttcatcattttcacaaggtttcgatcccgtggcaaaatataggaaaaatggcctcgtgcctatgatttcaagccatg

SEQ ID NO: 104103 - DNA, 91 bp, Heterodera glycines
  Promoter: Source sequence=SeqID_7458; Location=1537..1627; Strand=+; Gene=SeqID_64882
aacacattgaccacattttgtgctgaagggcacgaaaaatgccctccttttcaatgccaaattgggtgccatttttgctgaagtggcaatg

SEQ ID NO: 104104 - DNA, 232 bp, Heterodera glycines
  Promoter: Source sequence=SeqID_17724; Location=1943..2174; Strand=+; Gene=SeqID_82260
aacccctccacaaaatttggaaaaattacacgtgggccaatttaatttttaaaatttttcaattattttcgtaatacaattaatttaaatttgttttctacatttctacatagggggaatataggggaataaagagaaaataaacccttgttagatgattagacaaggtgtggttaatgtttatgcagcagggactcatgcaaatgctcatgaacatagacttagccaaatg

SEQ ID NO: 104105 - DNA, 363 bp, Heterodera glycines
  Promoter: Source sequence=SeqID_23087; Location=1534..1896; Strand=-; Gene=SeqID_53793
ggattagaaatgggaactttttcaaaatttaaaaaaatgaggataaaggattcaattaaattataaacattcccctggcggggaagcgccgtttggggcctcattttactaaaatttgaccagaaaaatggcaaaaaatttggtttttttttttgtcataaatgcaatgcatatccatgattttcttccgtggagttgacactattagaacggtccctgtgattaatcagctattatgggttcgaatcaattccttgttctgtcaagacaaagagttatcgtgcatcccatgtgactgtgatcgtcatcagcatatagtggcccagcaaattgcttgacatagatatttttacagaaaaaatg

SEQ ID NO: 104106 - DNA, 202 bp, Heterodera glycines
  Promoter: Source sequence=SeqID_15538; Location=176..377; Strand=-; Gene=SeqID_79818
gtagagaaagaaatgagacgacttgtatttccgatttgttgattaaagttgttgtgttacccgggttttctttgaaaatgtttatattcggtttcacaaaccacggcgacagcttttttaatagcgtattgttttttcaatcagcttaaccaacttgaaacagggtatacacgcttcatcaatctttcgaaggtcaaatatg

SEQ ID NO: 104107 - DNA, 216 bp, Heterodera glycines
  misc_feature (23)..(23): n is a, c, g, or t
  misc_feature (53)..(53): n is a, c, g, or t
  misc_feature (110)..(110): n is a, c, g, or t
  Promoter: Source sequence=SeqID_3384; Location=2209..2424; Strand=-; Gene=SeqID_84465
taaaaaaaaattgtacatatctntattactttgaaagaaagttaaaataatgnatagaattaatgaaaacaaattgagggaatactaaaaatttatctgattaataaatntaaattatttttattattatgccgccaaattcaatactattttatagtactattaaaaaataaaatattcaaaaaatgcctattttcagttaaatgccataatatg

SEQ ID NO: 104108 - DNA, 861 bp, Heterodera glycines
  Promoter: Source sequence=SeqID_3212; Location=1106..1966; Strand=-; Gene=SeqID_83733
tttgcagcaaaccggcaggctctgatctgaccgacgatgatggatgctggtgtcctcggacgaacaatttacttttttttgatcgatcagtcccccccccccctctctcaactaaatgatataattacgacgattcgattcgattttttctcactttttcattgatttggttgtgtatgtatgtgttgtttcctttttcacacccaaaggcaattttccctttccatgtgtgcgcaatgaacatagagtttgcaattttcaaatttgttggacaaaaaacgcagtttcatttcggagggttttcatggctgtcctttgaatgtcccgacaaattctttacaaaaatgggggattttgagcgtgtttaattacaaaagtgcttaattaggccgtacaaatggttgaaaaccactcatttttgatgattatgttttaacaaataaacctagacctttaggcgctcccttcccgagtttttgtgcttttgagtcctgccaaaaatggaaaatgcctgtccggtggccgtaactacctatattttttttctctgaatcatgctcattatttggatgggtattcatttgtatgctccgttttctattcggttgtattgctgaagttttttttttgtctggcgatttgctcaataaattaaaacatgtatataattcatggaaacaataatagggtttgtcgcctttcgatttaccatttttcatcttcttatttttatttaatttttcataaattctcctatttagcaacttcatcaaatccaaataattaattaactaattaattaaagctgcctaattaattgtttgtctcaattgattgtcccgcccaaaaagcaacaaaatg

SEQ ID NO: 104109 - DNA, 675 bp, Heterodera glycines
  misc_feature (23)..(23): n is a, c, g, or t
  Promoter: Source sequence=SeqID_1112; Location=2485..3159; Strand=-; Gene=SeqID_67989
ctttatttatggtctgtaatttntgtgaacaaatataatgacaatttatttttaattaataaattaatcgctcgtaaaattaaaaaatattattattattttatcaaattaaatacatgtgattaacaaaagcatttaatattatttccaccaacattaatcgcgtttttgcttatgcaattaaccatcttaaaaaaaattttcatatttgttttattaaatcatcaataacgagatttgggcaaatgtcttaattctttgctgcgattacttaatacattgaaataaatataaaaaacgcaattttagcttggtatggggtttataggataactattataatgcctattttgctattttttcttttttttttttgcctaattaccaaattgtcaatttaaattcccagcctaaatttatgattttcaaaatctcataaacttaaaaaaacttatttacctcttttaaattttttcaagcctagtttgattgtccatttaatgtctttttgagattttttgttcctgttcatttgcctatattgcgtgttatttgtacctaaaaataagttcatgtcaggcttttccacaattatggtcctgactatttttattaaaaaattaattcattaatatagttaatgaaaataattttttcagtatttttatcagaatg

SEQ ID NO: 104110 - DNA, 1003 bp, Heterodera glycines
  misc_feature (924)..(924): n is a, c, g, or t
  Promoter: Source sequence=SeqID_24409; Location=379..1381; Strand=+; Gene=SeqID_55134
ttaaattacaaaaataaatttgtgtttaattttcaaattttactttatttaaaattaataataataaattcgttattttcaatacgaacatcttttatttggtatataattttcattatataatttttaattttcccttgaataaatttttactaagtttctttcaagaatttttccaaaaatcactgaaaaattgtttaatttttttttgaaattttcctataataaattttctaaaaaatttttaatttttaactaattttatttatttttttctacctttattaaacaagcaaaaataacccatcttttcacacttttctgcacaaatacaatcgtaaaagttgaagcaacattacatattatgtgtcatgtcattattattatataattgcagcgccgaaagcattgcgcgtaatcgtcgcgcgcgcacgcgcgatttgtcacaccaccaaattccattttccaattttctattcaaatataatttgttcgaaaaaatcccaaaattttccatggtaatatggatctaggggatgattaagttatttctgagcaaaaaatcatcgaaatatataaacataaaatatgcgaaaaaatctcaaaaaatatcggaaaatttattcccgagagaaagagagtcgagagcgaggggatcagctcattttccctctgacaaaaatataaaactttaagttttctcaagttttttgagttttattcctgtaaaaacttaaaatatttcaaaaaaatttatttttaatttattttttgattatttttaatgtttttgtcaaaattcagatattttattaaatcatatggccaacattgtccctcatgatgaggttgatgaagaatatcatcgtgaaacgagcgaaaattcccggccaaattacacagcagtgatgacaattgggccanatgagacaaatgaggaggacaaaatgacgacaaatgatgtggacaaaaggacgacagatgagacggagaaggataaatg

SEQ ID NO: 104111 - DNA, 149 bp, Heterodera glycines
  Promoter: Source sequence=SeqID_8346; Location=1..149; Strand=+; Gene= SeqID_67755
cagcagcagcacgggcgaaggagaggaacgaagcggaagtgaggacggactgtcgaggagaagcggaggggcggacgaacgcgcggcacagagcgtcggcagcagtcggaagcacttcacagcggacaggggaagcgggcggcaaaatg

SEQ ID NO: 104112 - DNA, 68 bp, Heterodera glycines
  Promoter: Source sequence=SeqID_39752; Location=1145..1212; Strand=-; Gene=SeqID_68251
ataaaattttctaagcgactaatattagcatttttccacgcactttggacgcccataaatcaatgatg

SEQ ID NO: 104113 - DNA, 162 bp, Heterodera glycines
  Promoter: Source sequence=SeqID_15816; Location=519..680; Strand=+; Gene=SeqID_80137
agttaaattaaaaaaaaattaaattaaaatttttatttaaaagaaaatgattaattaattacccattaaatttgctttttgtcttaatgggttttcgtttcagttttcccggccggcattcttcagcccgtcttttacaacaaacattttccacgctcaatg

SEQ ID NO: 104114 - DNA, 415 bp, Heterodera glycines
  Promoter: Source sequence=SeqID_9603; Location=954..1368; Strand=+; Gene=SeqID_72057
tcccccgtcgcccccaccgtcgggcgcggcacgcaatttcaatcagcttagcggcgcccgctcaaagtgcgtaatgtgacacaaaactgatctgaaacagagtgctcaatagtgctgtcttggttctttttgtgatcagactcttccaatgatgatcaattgttttcatgagcctgatcactcatagggacaataatagcctcaagcgttgatcaacagatcaccctgttttgtgacccttatccaacttgggtctgatcaaatcaacttttggtgccgttgtaggcgattcgactcggctgctgccgttcccggcgagttccactcggtgcagaatgcaatcgccgtcgctgtgctggtgcggctccaccagtggtgctgccggctgttctggctcaccattgtgtgcctgatg

SEQ ID NO: 104115 - DNA, 103 bp, Heterodera glycines
  Promoter: Source sequence=SeqID_7084; Location=1..103; Strand=+; Gene= SeqID_63797
taaaaataaataaatacaaataaataataaattaaatatcatttataataataaaaagaataaattaaatattttggtaaaattaaaatattgttctgcaatg

SEQ ID NO: 104116 - DNA, 806 bp, Heterodera glycines
  Promoter: Source sequence=SeqID_14986; Location=1..806; Strand=+; Gene=SeqID_79146
tctttcgtctatttctctgtctgctttgctctctttctttctctatttctttctctgaattctctgtctcttcttgtcaattctctatctgcattgctctctttttttctctgagtttctctgtcttatttccttaaaatttctttgtttcttttcttctgttctctctctttcttgtctatttctctgctttgtttctttttcttttccctcttctctttctcctacgccattttataaaatgtgctttggttggtgttttgttgtgaataaaacaaatatcaaactgaaaaagcagtagcagcagaagaactgacagacacatgcacaaaccctttcttttttgacaccgatttttattattttaaaaatatttatttatttttattattatccataaatacactaacccaaagaagtcttgcctcaaacatataaaattgttcaatgcttaatactagggctataattacatagaaatgctattttgagcccctttcttcatagcatatgcgcagaaaaatatgcaaaagcatagaatttatagtcctaattattacataataaaagtcagaattatcgttgtaaatattttagatgtctttttcaaatacccaaaagaagaattcccatattttttttaatgactgagttttggattccgaattgaatgatttgtcaaaagttacgcgcaaaaagtctttcgcaaaattaaaataattcatgcttactttctgtattatatgtatatatttttttgtcattttagcacaattttgtttaacaataaattttttgaaaaaatg

SEQ ID NO: 104117 - DNA, 920 bp, Heterodera glycines
  Promoter: Source sequence=SeqID_18228; Location=1..920; Strand=+; Gene=SeqID_82824
ttcccatgattttttggtgagaattcatcgactcccctagcatccgtttcaaataattgaagcatcttttttccttataaaagtgcccagtaatgcaaaaaaaggttagtgtcgtcatgtgccaccacctccccccccccctctccgaacggcaccgtgcaaagtttgtgacgaataaatgtaaccgaatccaccgccgacctttgccgccccccacgccccctattgtccctattttgggcacaagtaaatattgtaattttaaatgcgttttttcttttgttcgcgactgtaaaaatgccaaaaaaacctttaactgatctttatccattcactagcagaattgcaaaacaaatttcatttcaatgatttttaggcattaatcttcagtttgcaatccaaatatgtacttaagaaaattgtccattttctatataatgcaactaattcgcttttggctactgtatttattttaacagagattatttttatatttttttatattattattttaggaaagcattttaatttttttttcatttgttgtggctaaaatggcagtgcttttcaacggcaacaattttcggctttcgtgtaaatccgccgggtgccgctgctgctggatgacatttttgtgcgcaacaattttaagcattttttttgcttcaaatcgtgcggaagggtgtgttttaaatttaaattcataaaattttcttgaatttttgtacaattcttaatatttgttaagagagggtatgcttggtaaaattttcagctttatagggccatggaaatagctgaaaaacaacccaaaaaaaccctggcgctataattttgttacatactgtatttattatcattgtcccaccatttcctcacctttctttgagtaccgttgcctttttgtcaggttcatcatg

SEQ ID NO: 104118 - DNA, 262 bp, Heterodera glycines
  Promoter: Source sequence=SeqID_13233; Location=539..800; Strand=+; Gene=SeqID_77065
cctgcttaatttgttttgttatgcctttggcattgccaatttctctcactttttgtgttcaacaactgttcaatttactcatgtcaatctcttcttttcgatctgttcttttggctatgtctcaatgctctccattttttcctcttctttcgacggacggacaaattaataaattgttttattttgggataacatttaattattcatttggatattaatgttttgtagattttgtataatttcatcaaatctttgagaaatg

SEQ ID NO: 104119 - DNA, 620 bp, Heterodera glycines
  Promoter: Source sequence=SeqID_29395; Location=259..878; Strand=+; Gene=SeqID_59897
atcgcaaaaaccatttgaaagaaaacgaaatacgacgatcgacgagaccaaaaattaaatgatgttcatttaagcaaatttctaatttactttggaataaaaaaattatgatttagtttaaaatgacgggttaatgtaaatgcaaattaagttggaaaattttttgggcactgaattatttcctagggatttgaaaattcattaattttattcaaaatggatacccaattaattataattaaaataattcgaatgatgatgcaaattaagttggaaaattttttgggcattgaattatttcctagggatttgaaaattcattaattttattccaaatggatacccaattaattataattaaaataattcgaatgatgtcattgaaaaagaacaaggaaaaggaacctgaggtgatgtcattttaacttttctattttgtgtgctgtgctgggcattttattattcattcgttcctccgcctttgccttatcattttgttcatttcattccttttcgcgtaaacaaaaattttcaatttattattgctgagcaagtgggtatttaagcggggtttccttttgcaattaattaattgtaattaattgatcgtctccccaatg

SEQ ID NO: 104120 - DNA, 715 bp, Heterodera glycines
  Promoter: Source sequence=SeqID_17279; Location=890..1604; Strand=-; Gene=SeqID_81749
agttatttgccaaatttaaatttaaatttaattgattaattaaataattactaatatgcgcctaatgaagatgcaattaacaactgttgcgtggcgcatgacaagtaaaaaaaaaagaataattaattaaatttatttttgtttttaagctgctatggagaccaaaagggccttaagaattgtgatgacacattctgcaactgtttagaagtaaaattaaatttatcctttttaaaatatttaattttataaaataataaatttaaagaatatattctctttacaaaacaaaatttatttgattttgtcttttcagttgtcataatttttttgtttcactaaaattttttagtttatgataatataattagagatcggggccccgctgggattttgtcaggcctcccggccctgatcccgctttttttttgtcaaatcactggaaccggcagtcccggaaaaaacgggagtctaggtcccggaatcccgccccgctccattttccaactctcgttcccggcaaattaaaattccgggctctaaatataatataaaattttcacaatttttattaaaaaaaacttctaatttaatcagcggaaaaacagatagggatgtgccatagataacttacccttatggatgtatttgttggattccaaaaaattcaaattctaccggattaaaaaccaataaaattaattatattttaatg

SEQ ID NO: 104121 - DNA, 71 bp, Heterodera glycines
  Promoter: Source sequence=SeqID_2866; Location=1376..1446; Strand=+; Gene=SeqID_82048
cgtgtgaaataagattttgagattgaaattatggtcagtttcatttgagggatggcataaatggtggaatg

SEQ ID NO: 104122 - DNA, 74 bp, Heterodera glycines
  Promoter: Source sequence=SeqID_19059; Location=1018..1091; Strand=-; Gene=SeqID_83800
attttcagagtttttgaaaggacgggaacgggtacatcactgcgcaagagttcaggcacttcatgaccaccatg

SEQ ID NO: 104123 - DNA, 306 bp, Heterodera glycines
  Promoter: Source sequence=SeqID_28571; Location=372..677; Strand=+; Gene=SeqID_59170
ggtaattaggtttggatttccttcccattttgtggaatttgaaattttttcggtattcctattttgcgtatctttcgaatttttgaaaaaataaattcattaatatttttcagagagtgctctgaaacacaccaaactttatttacaggttaattaaggcaccctgatgcttttactatcaaaaagggcgatgaataaaaattctaaaaatttttaattgctttttaaacgagcgaaaaactttaggcttagcttttttagtgaaaattcaaacaatcatagtttttcgcgttctgttcagaaatg

SEQ ID NO: 104124 - DNA, 1003 bp, Heterodera glycines
  Promoter: Source sequence=SeqID_127; Location=5062..6064; Strand=-; Gene=SeqID_73477
attatcgggcgccactggaagcggtaaaacccaatggcttatgagactgttgaagcatcataacgaaatgattaacccacctcccgaaaaagttttatattgttattccgaaatgaacgattcggtcattgatttgattaagcgtggcatagaaactcataatgggattcccgatcagacattaatcaacagtcaacctaagcctctcctacttgtgctggacgaccttatgctgaacataaacaatgattttttagaccttttgtttacgcgcggttcgcataattggaacgtaaacgtaattttcgtaactcagagcctgtatgggcgaaatattcggacagcaagagcgaacagtcattaccttgtgctgacacgtaacccatccggacagcttcaggtacggacagtcggatctcaactgtttccaaagcgtttaaatttttttatggaatcatataatgacgcaacaaataaaccgtttagctatttggttataaatatgcatccaaatgcaccggaaactgaacgtcttactagtaaaatatttccagacgagcatagagtaatctatttaccgagcgaataatgtatgcgcgctaaccgccgcattgtctatataaagaaatgaatatagaaaaaaaactaaaatgtatcaatttagtccttacgttagggaaaatacagatttcttaaaaaagcttgcggccaccaggtctgataaacgaaaaaacgatctattgcagggagcatccgcagaacaaatacttgcccttgtggaaatttgcgcaaatattttaaaatttaattttcgtctaaatccgagccagaggcgacggttgtcacaatacgcggactattacagggccatagcacgcgctcgcagtgagaactcagctcggcaaaaacttcaacaagggagcggaattgcccttggtgctattcttgtgcctgttctcagtgtcttagcccaacatttgcttgaaaaaataacagcataatg

SEQ ID NO: 104125 - DNA, 186 bp, Heterodera glycines
  Promoter: Source sequence=SeqID_33165; Location=344..529; Strand=-; Gene=SeqID_63313
tatgtattaagtagaagacgccgaaaaagttgtagtttatagggccatagaaaattttaaattttagacaatgaaattttcggctcagtataactgaaaaaaaaaattgaaagtgtagtttatatatagggccatagattttttagatttaagacaaaaaatttcagcatttttattagagaaatg

SEQ ID NO: 104126 - DNA, 1003 bp, Heterodera glycines
  Promoter: Source sequence=SeqID_4885; Location=2422..3424; Strand=-; Gene=SeqID_56077
agtgaaaaaaaatttcaaaagtttcctctttgcaactagcgccgaaatgttcatacaacaacgatttgaacttagacaaagtgatgatgtaaaaaaggagagcttttccaaacaattgggtctcggatatgcttaacacttccacaaacgactaaacaatgacaacggtacatcaaggaacaaaatgtggtgcgaatccttgacgaggccgcctatgaatcggacgaaggattggcaaaccctggtcggactcgtttgcagggctttgtggtggggcttcacatccgtggaaatggagagtgattaagaagctaatgatacagattaaaaactgaactatgattttatacttcactttctatgtttctttggacttttataaatatttctttgcttttttaggctaaatttcattagcattataaatagctaaatataaattaatttagaatatatatttgatgaaattcattgtcgaaagatccattttaggttagtaggcgagatattcagtagtcgaaatgtccagtaggcaaacgtccgattttgggttagtagacgaaatgtcgaataggcgaaatgtcagtaggcgagatgtccagtaggcgaaatgtccgcacaccaaaaattttatcaagattttaatttatttgagaataaaacagagcggttggcgccgcaaagcggcgcccccaaggcgctgttattttatatttgaataattatccattgagtcatattaaacttcataatttatgcagttgaattttcaaaaggccttactgtgtatccgatagacaaataaaattttgaatttttttgaactacagtaggaacaaaattgagcaaacattggtttgacgggaagggacattaaaccaaatttatttataaattttataggcaagtgttttcgaatttttaaacattttcggaagcaaaataattttttttatttgcatcactaattatcgaaatttagaataatcagtgcaacaaaatg

SEQ ID NO: 104127 - DNA, 110 bp, Heterodera glycines
  Promoter: Source sequence=SeqID_31297; Location=1455..1564; Strand=-; Gene=SeqID_61661
ccgcatttacggtcagatttatcatagaatgaatttggctttgaatccagaagatggcgatgatcctacttatgggcagattttcatcgtagatactagaaaatgcaatg

SEQ ID NO: 104128 - DNA, 245 bp, Heterodera glycines
  Promoter: Source sequence=SeqID_30362; Location=1..245; Strand=+; Gene=SeqID_60777
ttttccttaaaatcgaacattgcagctataaaatataattcccttatgatttaagtaatataatataaaatgaactatgattagttcaaggcaattctcatgaccctttagtaaagtggacagcagataatacaaaaaattcttatcagtttccgatttgcatatggacgagaattttcatcatcggcaattaattccctcaaaatatttaccacccacccattctcctgtcgatttctgcaatg

SEQ ID NO: 104129 - DNA, 142 bp, Heterodera glycines
  Promoter: Source sequence=SeqID_18638; Location=111..252; Strand=+; Gene=SeqID_83293
ggtggtcgagaacagtgaataaataaccaattaaatggagcggcaattagctaattgaaggatgacagtcgcgcacacgtggcaagaccttcgaattgaaagcatcggaacgtcggaagacgcgcgcgggagggaagacatg

SEQ ID NO: 104130 - DNA, 851 bp, Heterodera glycines
  Promoter: Source sequence=SeqID_40070; Location=191..1041; Strand=-; Gene=SeqID_68508
aatttttattaagaaaaaaattttgaaaaaggaaagtttctgaatattgggcattctattttaaaaattttcaaaaaatcaatgcaggatcctgctgaatcctgcataaaaatcaaattggcaggtcctgttgcaggattggaattcaaaatttttacaggacaggatccggcaggattaatcctgcaaatcctgtaaatcctgtattttccaaaatatgcaggattgcggactgggatcctgcaaaatcctgcgcaggatcctgtcctgcgccgctctctacttaaaacaacaaaatctttttcttaatcaaaaaaatttttttgtcctagaattagggaaaacgtgttagcggtcttaaatttcgcatctgatcaattccgaatttctaatcccgaactgaaccggaagatcgaaatttcaaattcatttacttacaaaagtgcctcacttttgagttttatcaaaaaccaaagggggatagaccattttattttgcaaatttttttgtaaaaaatatgtagtcatgaaaacttgtcccttgggcttttaggttctctgatcacgaatctggcatcaatttttaccaattcctaatacctaactgaattcaacaaaaagtcgaaaattcaaatttttcgaattccttattaatgttcgttcgggttaaggattaagaattggtcaaaatcgatgtcagattcgtgatcagggaccccaaaaatacattatcagaggacttgtaaagtgataattatattttagtttcatattattttatttctgtctgtcaattttaaaatttctttttttttcaagattgccacttcttttgctgaccattgaaaatg

SEQ ID NO: 104131 - DNA, 115 bp, Heterodera glycines
  Promoter: Source sequence=SeqID_15213; Location=1..115; Strand=+; Gene=SeqID_79414
aaaaattgagaggaaaattggaaaattattaggagcaaatcggcaattaatacaaaaatggaaaaaagaattaaatctaaataaaaataaaataaaaaaggaattttatgagatg

SEQ ID NO: 104132 - DNA, 283 bp, Heterodera glycines
  Promoter: Source sequence=SeqID_2056; Location=1348..1630; Strand=-; Gene=SeqID_77558
atgggagaaaatttttcctatttatagtcgaacaaattgaatttagttataatttatttaattttataatttatttttatttaatttaactttaatattaatttatttttaatttaatttactttaatttattttattatgattttaatctctttaattaattttatttttattttgaattttatttttatttttattttttatttgtttaataacaattttttaattgttttgcgaacattaataatattcgatgatgaggagagtaaaagtataataaatg

SEQ ID NO: 104133 - DNA, 184 bp, Heterodera glycines
  Promoter: Source sequence=SeqID_16188; Location=1..184; Strand=+; Gene=SeqID_80550
ttttaatgactaccaaactcgtccaatcacaaaatcagacgtcaccgattaccaattccctattctgctctaccaccatgacaaacattttgatggcatcaaaactttgtcaaaattttggaacaaacgttactattgcctctcctgtgaatcagcattcagcaataaaccacaacattcaatg

SEQ ID NO: 104134 - DNA, 179 bp, Heterodera glycines
  Promoter: Source sequence=SeqID_15827; Location=2227..2405; Strand=+; Gene=SeqID_80153
aaaaataaaattgatttttaatttttatttcgatttttattttattaagcaattaagggttgggaaattttaaatgaaaaagggtgaaaaaatagattgtattaagaattttaattatattggtaaattaactttattaattaagctataacaatttcgaactctttgaacacaaaatg

SEQ ID NO: 104135 - DNA, 646 bp, Heterodera glycines
  Promoter: Source sequence=SeqID_603; Location=1563..2208; Strand=-; Gene=SeqID_57366
ttttgggagggaaatcggaagaatcaaaggccaatcattgccaaaagcagcagcagaacgaacaatgggacgaagtcactgatttaaaaatgagaggaaaagcggcaacggacacagaaaaacagggaaaaagtggcaaaagcacttttgttaacgacgagaacaaaacgagtccaaacacgggcattaatcagaagcaaagcgcattgaaaagaacaattgtattcaacgataaatggaaatgaaaatggcacaatttttgcctagcaacgaaaagaaattaacgagtgaaaaagtggcaaaaatgtcgaaatgaaaaaggggaaaaaataaaacagaaaagggcagttaaataaaataatgattttgtgaatggaatcagtgaaaaagtgatttaaaaccaaaaaatgaagccaatgcaaaataaactttgatgaagcattgtttgccattgtggagatggcttttgcgcaaatgagctcactaattggcaccctttcgtccgtccccctgcgtggcaattaaccgcgaattgtgctgtaatcccccccccccacttttccgacttattttaccttttccgcgctcaagccccccccccccccccaattgtccattctcccgttgaatttttcctcaccaaatg

SEQ ID NO: 104136 - DNA, 485 bp, Heterodera glycines
  Promoter: Source sequence=SeqID_26564; Location=1..485; Strand=+; Gene=SeqID_57300
aaaatccaggctcctcgagactggatccagggctggactgggattttttgaaattgttttaaaaagcaaacaaatgcttgaaaaaatcaattatttgctagaagcatctaaaatatctaaatataataataatgtgtttttaaatttatttaatctgtttttgaaaacttgaaaaaacatcggtcacttgaaaaaataaattctaaaatttcgtccaggaaaatccaggtttttcctgttttgcctggagttttattccgtattattcatcggttgggtcccctttttggaagaaaaattctttttatattcatgcttgtttagtatgatagttaatttgttatcttaaaaattttctttgcaaaaaatgaagggttttttctaaatataattatgtgatagtacaaattttaattattataataaatctatacattgaacttatttattttttaatttacattttttttatatttatagaaatg

SEQ ID NO: 104137 - DNA, 75 bp, Heterodera glycines
  Promoter: Source sequence=SeqID_12682; Location=1..75; Strand=+; Gene= SeqID_47070
cttggaaaaatggtcaaaaataaatgggttagaaatttcaactgaaaaattttatatttagggaaaaataatatg

SEQ ID NO: 104138 - DNA, 118 bp, Heterodera glycines
  Promoter: Source sequence=SeqID_32264; Location=338..455; Strand=-; Gene=SeqID_62581
gctgaaatgacggaaacaatttaaacaaacaatttgggagggatggatagacttaggaaaaatttgaaaaacataaaagatcaattttcttaaaaaaattttcaggataagacaaatg

SEQ ID NO: 104139 - DNA, 94 bp, Heterodera glycines
  Promoter: Source sequence=SeqID_13370; Location=162..255; Strand=+; Gene=SeqID_77244
tgttggccggatgctgttcaatgccttcgtgttgtggtgtttggcaccgcgtgcattcggcacggcactttcactccgtgtcaaattcaaaatg

SEQ ID NO: 104140 - DNA, 116 bp, Heterodera glycines
  Promoter: Source sequence=SeqID_6243; Location=1..116; Strand=+; Gene= SeqID_60858
gaaaaaacctcaaagcctcatttcaaaaaaaaacctcattgacctatcaaaataccacaaaatgaggctaaagcctcacatctgggagccctggttatatgtatgttttagctatg

SEQ ID NO: 104141 - DNA, 102 bp, Heterodera glycines
  misc_feature (40)..(40): n is a, c, g, or t
  misc_feature (67)..(68): n is a, c, g, or t
  misc_feature (75)..(75): n is a, c, g, or t
  Promoter: Source sequence=SeqID_42974; Location=891..992; Strand=-; Gene=SeqID_70761
tacacggaaagaaataatagttagtcctttgtgaaatttntagaaatctatccgtcaaatcgctttnnggaattntaatgagtaaatcagtaaccgtaaatg

SEQ ID NO: 104142 - DNA, 1003 bp, Heterodera glycines
  Promoter: Source sequence=SeqID_24591; Location=1076..2078; Strand=+; Gene=SeqID_55328
ttatacatattaactacttattatataagataaaaactattgaacagcatttaagcttgacaaaatgttctttgaattttcatcatttttcgtattttttcaattatccatcacatttctttaaataattatttaaacatttttgtttcgattttatgtatttacaatttgctttttctacaggaaatttttatgatggtttcatatagagactttttgtgcctttttcagtgccattttgcgctttttggtgccttaattgtgagctcaagccataactttagggccggcggtgctgataagagccgccgggaaattttgtaattttaatgctatttgttagcagattttgtctaaaaataccaaattttgaaattttgggctaattttttaagaaaagatagctttttggggggtcggcggtgccgataggcgcagccggaggaaaattttaagaatttttaatcaattttgttaaaaaaatggccaactgatttgtcaaaaaagtcggtcgattgtttcggttttttaattatttcggtcgaacggtttcggttaaaaaaccgaaaaaaccgaaaccgaaaaaaaccgaaaaactcaaaaatttctcggtcggtttttttcggttaaaaaccgaaaccgaaaatcgactttcttatgcaattgctttttagcagttttattctaaaagattttctctgcaattttattttttacaatttatttatgtttgcccgtatttacctcttttttcattaatgtaatgtattattcaattttataaaaacatattttgccaaatatttggcataaataatcgttaataaaaaaaatatgtttacgtttttacaatattgaatgcgtggcatttgtcggtctgatgtaagcaaatgcaatggcataatttgcagcatatttaagtcaaaaataaagatttaatttttaataattttacaaaaaaagaatattttttaataaaaaccattaagcaactaacataatg

SEQ ID NO: 104143 - DNA, 728 bp, Heterodera glycines
  Promoter: Source sequence=SeqID_3076; Location=1..728; Strand=+; Gene= SeqID_83094
ttatgggtattttaaggctacagaattgaagcatcattctgaggagggggggggggggggggaagcgttaggtccggatccgggtgaagtaaatgatttttctatattattttttcatgtttataaaacatttaaacgaatttcaatttagaattaattaatttttataatattgaaaaagaaatattttttcgaaaaaaataaaaaattttatttatcccccgggcagataaatagagacggggagattatttttcaagctagttcgaaatggtaaataattgaagacgggcagattaatggagacgaacatataattagagaaaatacggtaattgaaattctatttttgtgttttggaaaaacagaaacaaaatttttagacaaccaacaaaaggtcactcaatttcttttgtgaataactggttaatttttgtagtgagaaaaagtttattgaatttgcctgccgttcttcgtagtattaattttatcttttggttattcagccgcatgccgaaattattaaattagagacaaaacgccacaattggcgcgcaacagttttagacaaaatctctttttttgggttacatctttttcttgcagagaattttaaattactttttttaaatgcttaaatttcagctaaaaaattaactgatgaagaaaagaaaagaattgcgattaaatttattaaattaaaagatcattttgagaataaaaaaatg

SEQ ID NO: 104144 - DNA, 1003 bp, Heterodera glycines
  Promoter: Source sequence=SeqID_69; Location=1786..2788; Strand=+; Gene=SeqID_61207
tataaattcgagacgcgcatataaaaaatgaattttgaataatttaatttaagtcagagccgagttaaaaagagaaacttctttttggcgacatattttataaatttagtaccaatcaaaagcattaagatttgttaaactatttctaaacgattaagcaaatcacaaaaagtttaaagcttgaatactgtgcaaaaggttataattttaacttttaactattttgcatctatgccaatcattctgagttttgattagctaaacgcttgtcaagaagttttgactgataccaagtttaatggatttgatcaagaaatcaaaaacaatgattcttaagtttttcttacagacaatgaatgattagtgatgcccaaatttaccttattgcactcgtcactacatagggagactacttcaattatcgattgattggcttcgcagctttttttctctagctttttttttctcttgcctatatgtagtctctaaccgcaattaatttttatttatttttgaaatattttttaaatttaaatattttgattatttttatttattttttaaatttaaattttattaaattaaaagaaaaattcaaaaactgtggaatcgaacctttggttcaggccgaagccttaaccactcggccatgtagcactggggaaaaaggaagttaaatttgtttatgtttgttacccgataaacggtgagaattgaatgaaaggaaatagtatgtctttcatagaaaaaaaggatggatggaaaagcggccattatttttgtaacattctttattttcagcaaataaatttttatttttaaataattttattcgcaactaaaaaaatgttttttgttcgatggaggcggagtgtctccctgtccaaacaattttcttctgctgctaaagcattcgcacatttcacttttaaaattgcaggtgttaaccccataaatttcatttcttattcaatttaagtttttattttttatagaaaaaatg

SEQ ID NO: 104145 - DNA, 1003 bp, Heterodera glycines
  Promoter: Source sequence=SeqID_14377; Location=487..1489; Strand=-; Gene=SeqID_78415
cgtgatcagcaagcaaccccaaaacccattaaaaacatgttttcacgactttttaaaacaaaaaatttctgccaaaagtgggggaaccacctaactattaccttttcgttttcactagggatgggaatttaagtctaatgactttttttttgctgactctaaatgaccttaaaatgacttcaaaagtgttctacacaaaaaccccgaaataggcaaaaataggcattataaaagtcatcgtacgcacccaagaccaagcggaaagggcttttttcgtgcttatctattcgtattaagtgcgaaaaaattttaggcatttgcctaaaaaaagaatccctattaattacatttggctaattttcaggacttttttggatttatttagtgcttttttggcattttttgtgactttttggcatttttatgactttttcgtgactttttggcgcgatttttcaacttttttgagatttttcgtgacttaaattctcatccctagttttcacatatatcggcttagaaaaaatttttttttaaaatttttttcagggggtgacaaaacctacaaataccgaatttttttcttttcacacactttttgcctgaaaatcctaagaccagtcaaaagatcttttttaggcatatcttaagtaaaattaatttttggatttatacatatacataattccaacaatattaaagtttgaaatattcaataaattttgaatttgaacagtcgcagcggtgagaatcgttttttgatgaaaagggatggccaccagaactttattattttatgtgttattatttatttgttcagtaagccaatttaatttctgtcaaaattcattgaaaagttatgaggagaaaatattattaaaatttaatcaaatttattcagctttaatttttcaatggaaaacggacggaatggcctttataagccgaaaaaattaacagaagaaaaccataaattacaacttaaatcaagcaaaatcaaatg

SEQ ID NO: 104146 - DNA, 246 bp, Heterodera glycines
  Promoter: Source sequence=SeqID_16607; Location=929..1174; Strand=+; Gene=SeqID_47385
accacacggcattgatccatgacaaataaacattttttcaatgaaaatccttatttttaatggtttatgccatgtttctgttttttttgcgacttgcgctcctacaaacttcgttttgagatgatttcctcggtcacttttcgtttttccaatgccatctcctcccccgtcacttttccgccgttggcattttgcccctttgtcaaccattttcgacatatttcaaaacttcccaacgatggaatg

SEQ ID NO: 104147 - DNA, 75 bp, Heterodera glycines
  Promoter: Source sequence=SeqID_39347; Location=117..191; Strand=+; Gene=SeqID_67934
ggtgcgttggaatggcccaattcccggcaaaggcaccccccccccccacaggacgacttttcctcgcccggaatg

SEQ ID NO: 104148 - DNA, 410 bp, Heterodera glycines
  Promoter: Source sequence=SeqID_5754; Location=1000..1409; Strand=+; Gene=SeqID_59121
tgtctgtttaattaatttaacacaaaaaatacaattgaaccgttgaataaaaacttgaggacatcaccggtggtgccgcgtttatgtcgtcgattttaaaagttacgttccattggaaagagcccaaaaaagcacatccctttcccgattctgttgtactaaaggttaaaagggatgatttatatatatatatatatatattgaatttaatttaaattgaaaaatcatttaattaaattaatgatccccttggcacagattcctggcccaaaatacaattctttggtggcacaaaatgggagggaagaacaaacggacaacgcaatggaagaagaaagctccgattatctgatcaaagcgcacaccgtaaagtagcaactattggcaattaaggtgccattttcagaatg

SEQ ID NO: 104149 - DNA, 409 bp, Heterodera glycines
  misc_feature (70)..(70): n is a, c, g, or t
  Promoter: Source sequence=SeqID_16979; Location=944..1352; Strand=-; Gene=SeqID_81404
gacatttgcgcctttatccaaaatcgggttcaaacttaagtttttcaatccatgatcgcctaaatagctntaaaaaagcgattgaaaatgattgtatccgatcatttgatcaccaataaatttttgaaaaataataaaattttcaaacaacacaattaaaaattaatgttcctaataaactagaagacaatagtgttttcttaattttaatgctgtttaagctatcagggcttgaaaaaattcaactttgaatccgattttggacataggcgcaaatatcggggctcctcactcacaaagtgtttttcaaatttcgggtggaaaatcaggcagaggtaaaaagaggggcattagtgaatattaaaacgaaatttcccgatgtacgatattcccttctaatgaacctatg

SEQ ID NO: 104150 - DNA, 238 bp, Heterodera glycines
  Promoter: Source sequence=SeqID_30677; Location=363..600; Strand=+; Gene=SeqID_61084
ttggtattcaaaaagccaatttctgtgtaaaaaagcagcggacaatttgctgggaaattgaggcggggccgccgcaaacggacggtcggacggacggacggccatcgacggacggtcggctttaagccgaaactccgcccaaaatgagcagcataaatagcagattatggctccagcaaaatcataaccgacttcaaatccttcaatccaaaagcgaaccaatcaaaaattccaaatg

SEQ ID NO: 104151 - DNA, 429 bp, Heterodera glycines
  Promoter: Source sequence=SeqID_15697; Location=1..429; Strand=+; Gene=SeqID_80007
atttaattgttttatttgttatttaataaagggtattttattttattttttggttttaccaagtatttgaattttaaaaatttttgcttggcgcccaaacgagctggcgcccaaacgattgcgcccaaacgtgagcgcccaaacgggtgggtcccaaaagtcgcgatattacaaatcagctcgccagctgttgattttaaaaaaactgaaactttggcctcaaaacggaaaagtaccctttttattagtgtcgccctgaaaaaatgatggaccatgcgaactgttggttcggggtgagggacactatagtctggacagtatagtctgagccaagtttagagtatcataacttttttctcagcgagccaaattttataatctaggcatcattctatagcactatatgtttagtcgatggcaaagagaatg

SEQ ID NO: 104152 - DNA, 59 bp, Heterodera glycines
  Promoter: Source sequence=SeqID_27705; Location=1..59; Strand=+; Gene= SeqID_58375
ggagagaagaatttatgagtttttattctttacccaaatcatttttattataaaaaatg

SEQ ID NO: 104153 - DNA, 332 bp, Heterodera glycines
  Promoter: Source sequence=SeqID_1349; Location=2035..2366; Strand=-; Gene=SeqID_46829
tgtgggtgtttaatgaatgcccctgggggcaattattggaaatttaaattagaattttatagcgaaatcaattcgtagaaaatttacaattttcatgaaaatttgcttcaatcagttgtgttttagattaaataaaattggaaattttcactaattcatgaaaaaaaagttatatgaaagcaatgtgacgtcgggaaaagatttttgcgatttttgcgcaaaaaattggctaattttgcaaatatgcgccgaattttgaattttcaaatttttttttttaaaattctctccgttttccccattttgtcagttattttgtgtccattctgatg

SEQ ID NO: 104154 - DNA, 529 bp, Heterodera glycines
  Promoter: Source sequence=SeqID_7940; Location=1795..2323; Strand=-; Gene=SeqID_66445
tgccccccgtcaaaataggggtggggggatgcttatgcaagcgaaaggacaaacaaaacgatcaaattgctttagggggaaggaagggcatttgcttgatgcctcttttttgattgcacaattccctcctcggcgcccgtcggtcaccattttcacttaacatgctttgcttttgcgattagcggctaacacgcgcggcgcattgaagcggagttttgaggcttttttttttacaaataatgaatggaattttcgaaatgttttcccaaaaaattttttttttcgctttcccatttttgtcgaaaaacacgagaaaaaaagcgaattctcatgtttggcgtaagttccaaaatttacttagccggctttcatgtcattgaaaaaaatttttttttttgttttgcatttcttatttttggggtttccttttccgaagttatccaaaaaaaaatgccaataaatcatcaaaaaaaaaatcccatttcagtagtttcgttgttcaccaattatgagttcaataacggcaatg

SEQ ID NO: 104155 - DNA, 205 bp, Heterodera glycines
  Promoter: Source sequence=SeqID_32579; Location=1..205; Strand=+; Gene=SeqID_62885
aggctattgctgaaatggtaatttcacctaaattttcaaaaattgtaggacagaaaggaaaacatattaaatcacaaacgcaaaaagatgaacaaaatgatgaaaacggtaaaaaatatttttaggaccaataactcttagattaatttaaaatttacaaattaaaatttattattacgaggaaccaataattttagaaaaaatg

SEQ ID NO: 104156 - DNA, 725 bp, Heterodera glycines
  Promoter: Source sequence=SeqID_2285; Location=1..725; Strand=+; Gene= SeqID_78884
gttatggcagaaatagtacttattttcatacaactttttcttaagttgaccaatttttttttaatttggcaggctaatagagaaaaagctgggctttgaatgataccaagaatgtaaatttggttgattttaagcaaagttataccatgttttgtcggaaaaattgcaaaaatggcggattttacgaaacgtcccagcacggagaaaaggaaaagcaaagtccttttcaataccaattgaatcgaagaaaatttggaaattgatttaaattttaaatcgtttggccctaattttaacaattttattcagcgccgaaccaagcaacaaacaaaacggagaacggagttgcgcacggggatgaaaaaaagaatacgagtattttagaagaaaatgcttaatataatataatttaattattttaatttaaaataaaataaatataaatttgttaataaactttgaataaatataatcattttaaaaaaaaatcaattttaatacgaaaaaatttcgtactctccaattaaataaaatcaaactgataaaaaatgattatttttaggggccaggttatatgcacattcgctgtttttaaattttttaaaatattttttgaaaaatttcttgttttttaaatttgcattagatttttgttgtgatatgcaaaaaaatatcttcaattgacactttgaaaacttaaaattttttgtatgccctgataaatg

SEQ ID NO: 104157 - DNA, 128 bp, Heterodera glycines
  Promoter: Source sequence=SeqID_35236; Location=916..1043; Strand=-; Gene=SeqID_64835
ttccttttcactccactctcagattaaaaaaaaaatggacaatcatccccgaaaacgctcctctaacttttccattgatcatattctctccgcgcccaaaaagccccgtcaaggcttcctgatcaatg

SEQ ID NO: 104158 - DNA, 1003 bp, Heterodera glycines
  Promoter: Source sequence=SeqID_9401; Location=2132..3134; Strand=-; Gene=SeqID_71282
atacttactgtatatataacgataccgtaattttcaaaagtaaggatttagcagggaatggaaaatgccaatttaacaaattgcacccataattgtactttctgaataagttgtttatgatgaaaagagtttagagcatgagaatgaacaatagggctacgtttttgaatctaatcaccaaaatgtcatttaataagtaacagatcaattttcaaacttatctttcaatcactcaaaaaacaggtggctgttaacattatggatttgttgttggagagttgtcgtcgtgcgcccagttggacagtgttggtggacaattgtctacagatggtcaaacatttggtgagaataaacgaaaaaacaaattcaatttaggaagataaaattgggaaaatgaaattgcatgtttttatgtttatgacccaaaaatggccaaattggctctttaaaaagaatataatctgtgatcacatttagggaagttttaaaaagccaataaattttgctgatttgactagtattatttgtatttaaaagactggctccagtctgctttttttattattattttttaaataattcataaaaaataaataaccgagaacaagaaatgtttttagatgaccaaaaaatcctctaacaaatgcaacataaagcaaaaataactgaaaaagatgctagaatgataaactttgaaaaaaacaaccatcttaaataaattaaaataagatattttttgcttgtttttttcatttaaccagtttttgctgatccgtttcgaggtcatcgcggccaaaaaagccgaaaattggcaatagtaaatcgaccatgctctacatggtgtgatcatttttacagggttttaatatggtcatttcgctggtggagggcggttacaattccattaattttaaatttaatttttttggcgcataactaactgtgcttttttgctaaggtgtgtgcagacggtgacgagcccgaataccgtctagaaacaatg

SEQ ID NO: 104159 - DNA, 282 bp, Heterodera glycines
  Promoter: Source sequence=SeqID_2660; Location=3641..3922; Strand=-; Gene=SeqID_80938
ggtaagaaatgtcggaaaaaaatgaatagttgaaaaatctttggcactttaaggaatatgttcaccaattatccggttggccacccgaccgtggtgcagtttgacaaggacgtggaatggaggcgtccagaggacgttgttggcgacgacggcatccgccttgagggcatcatcaagtgcttcgtagtgccgccccgccactgccactacgatatcccggtccttccgtaccggctcaacaaccgcacgctgtttcccctctgccggacgtgttccgaaatg

SEQ ID NO: 104160 - DNA, 897 bp, Heterodera glycines
  Promoter: Source sequence=SeqID_7857; Location=470..1366; Strand=+; Gene=SeqID_66185
aatcagggctcagatctgtcctgatttatcagatttgtcctgatttgaagggtccaaatctgataaaattaaaatgtcctgatttgtcagatttgtcctgatttggagggagtgacccaactttgtcctgatttcttaaataaacttacaattttgaaattttatggcataatgtcactattttatcaataaaatataagatttatgacaaaatttggttatttttttaataaaaatctgttaacaaatcgattaaaaatcgcaaaaaattttccggcggcgcctatcggcaccgccggaccccctgtccatcctccaaaattttttgaaaaaatgcgacgcaaaaaaagcgtttttaaagcaaaaaagtcgtcgcttgacttttaatttatgcaaaattggccttttttggtgaaaatctgttaacaaatcagaattaaattacaaaaaatttttccgggggcgcctatcggcaccgccggaccccctcccctctcacttcccaaaagttttttggaaaaatgcgccgcaaaaaattgttaaaaatctgatttttttttatcccgaatgcactaaaattttatgattttttgaaattttatggcagaatgtcactattttatcaagaaaatataaattaaataaataaatttatgcaaaaataaaataacaaaaaatttttcccaaaaattgttaaaatcgttaatgggagacaaaaatatactatttgatacatttttgatcgaataaattgtaaaaataactgatttgaagcaattttgcgaaatgttcttatttttgaccctaaaatcttattttttggccttgatgttcttattttgaaaaattttcgatacgagccctgtttattaacagaactctgaatacatatcaatg

SEQ ID NO: 104161 - DNA, 1003 bp, Heterodera glycines
  Promoter: Source sequence=SeqID_12299; Location=1196..2198; Strand=+; Gene=SeqID_75889
tcccgagggccaaaattaaaaattttcgaaattttttaaaaattaaaaaatttgtaaaacgtaaaataatactcatattcatgctctgcactataaaaccggttagaaaaatggttttcacccctttttgactcgcaaaaaaaatttccgagatttgaggggttgaacaatacagtgcccctctctggtagaatgccccctccaattaaatgcccttttttggaggcgttgaacaatagaatgcccgggcattcaaatagcggatttacggtagctatttccttgcggtgagtccggaaacagagttaatttaaaaaatattattatttttttcttgcaatggaattaacgctgcctaaagcagacgtagatttgtttaattttggacataaattaaattaacatttatattgaatcttcaacaaagttttaaatttttcatgctgtaatttgctgaattcgagatttccattctaaattgagcattaatttttgtgctttttggcatttggtgtgataaacaataaattgttccatatttttttattccccataattaccgatttttaaaattatactcttttttggattaaacattcgaagaaatgaagctaatgaaaaatcaacatataatatattcaaactgtgcaaatataatttaaaaaatttttaaatgctattttaagataattattaccattgatttattcatttaattgcataagttgtccataattgtgtgatgcttgcctcccctaccatacccatttatggaaatctcaataattcatattataaaatttatctcataaacaatttgaaatgggaaaattatcctttttcaaaaatagcattcaaatttttgttcgtaaacatttaaatcccaattttaatcaacaacacattttattggtaaataaattgaacattatttaaactcacctaaaagttattcaactcaattgggattttttatgaaataatttttatttaggaaaaaatg

SEQ ID NO: 104162 - DNA, 86 bp, Heterodera glycines
  misc_feature (10)..(11): n is a, c, g, or t
  misc_feature (62)..(62): n is a, c, g, or t
  Promoter: Source sequence=SeqID_28853; Location=782..867; Strand=-; Gene=SeqID_59431
gtcgtcatcnnccattaaatcaatgcccacaacgtggccattattcttaataaattaagttntctgccttcgaaatacgtcggatg

SEQ ID NO: 104163 - DNA, 497 bp, Heterodera glycines
  Promoter: Source sequence=SeqID_21441; Location=1..497; Strand=+; Gene=SeqID_52049
atataacttttgaaaaaaattaatgcttttttgagaggttagtttatttttgcataaaaattgcaatgattaaagagaaaaatttcaaacaaatttcctgccgtttaagccacagattccctaaataactttatgcccaaaaatacagtatgacagcgatacaattagacaaataataatatgtatcaaagggtgtgaactatgaatagattaataaaaatataccaaaaattataaagaaaatgcttttttgaaataaaaaaatgttttttttttaaatcgaatgaatctttttttaagttttagtttaattaaaaaaaaagtctgtactatcgaaaaatgccaagatattcttgaatttgaataccttaccttttttttggaaaaagcaaatgttagtgaaatataagacgaatagaaaattcgcgcgccaccatttgggcgccataaaataaaaattgtagaaattacaaatttttcagcgcatcgcccaaatg

SEQ ID NO: 104164 - DNA, 430 bp, Heterodera glycines
  Promoter: Source sequence=SeqID_37514; Location=1..430; Strand=+; Gene=SeqID_66566
aatgaagtaagacaccgaattgtctctcattttttctttagtttgaagaaataaaaaaaaatttgaaaattactgattacgggaaatacggcatttttgaccccgtcatgacggattatggaatccataattaagaaaatcgccgtaattacgggtttccgtaattgaaaatccagttacacccagcatgctcggtagcttaatggtagagcttcccacggattgtgtggtcgattgggttcaattcccacagaagttgccaattatttatttgcatttctgttattgtaaaggaaaaaatgggaataatcagtgaatgattttgactggtcggtggacaatttgtgttggaattgatcaccaccactttttggcattccgacacatttgattttgtcatttttatgtgcatcataataataaaataatg

SEQ ID NO: 104165 - DNA, 1000 bp, Heterodera glycines
  Promoter: Source sequence=SeqID_5703; Location=1661..2660; Strand=-; Gene=SeqID_58972
tttttgatagaactttttatataaatgcaaaattgaaaaaatctgttcgaggaaaaaaccgaatagaatcaatatataattttctattagcctgctatttcaaaagcttcgtttgtttcaaaatcaaattccaatacatataggtaagctaattattttttatatcattactagggatagattttaggggtttgcttaatggtcagaaacgaacgaaaaacaatggtacttttctagaatacgggccagatccgcatccgctttcagactccaaaaaaagagtcttacccaccaagaaaacgacccacgcgaaaacgacccccgaccctaaaaagctcaaaaaggccaacgatatgtgccgaaaaattgaaaaaaaactgtcgaaaaaataagtgaatttatcgaaaaaatcacgttttttatccgtttcgctagtacgattctaatcaaaaacatttcaattctttgtgacgtaaatatttttctcgcttcaaatatttatttatttttctgttttcattgataaaattcaaattttgccttaaaaattaaaaaagccattaaaacggtcaaaaagtgcaaaaagaaaaaaaagaaaatttttgaacatttttggatatcttgccaagaatttgagtgcaaaaaagctactttcgtaaaaaataaaaataaaatttccaaaaaatccccaaaatatgtgctaaaaaaattagtgaattaatacatcagatgagaacgaaaatgtgatatttgtgatagttaccttaaaaacctccataattatagttatctgatattaattactacccaattcgctgataaaaggaaaatttaataattgaattattataaaaatgttgtcaaattaatgaaataatgattaaatgtggttaatattgattgaagaaaaattaagccatgctataaaattaataattacaaaattcattgcgaaaaatatttttataaaaataattcattatatttttacaaaaaaatg

SEQ ID NO: 104166 - DNA, 699 bp, Heterodera glycines
  Promoter: Source sequence=SeqID_2409; Location=1..699; Strand=+; Gene= SeqID_79591
ccataacacgctttcattcaaaacaaaaatgaacaaattcttacttcggaaaaaagattttgaaaaggagaatctttttctccgtgaatgctaagcaatttgacatctcagaaaaaagttgtgggaattccaaatttttattacgttataactcaagtcctaggaagatgatttcaaccaaaatgcgaaaactaatcatttttctattggttctaaatgtccaaagtgaatttttacccgtataaccaaaattataggaatttgcaaatttgatgttttttaatgtgttagagacatgaaaatagtacgccaaaatgagaggaaaagaaatgcaaaaattttaatcactccataactttttagttaaccctttttttgttcttaaaaacccttaaattttgttcgtaatttttttctctatcaatatgcaaaatttgaagaaaatctgtaaggcggaaaaaaagttctatagagcgaagtgaatgttgttttttacataattaaaatgaagagatagtacgccaaagtgagagaaataaagataaaaagtgaatgtgacagaacgccaattttttcccataattatccataaaaaagatttattgccgcttttttttcttttttaccgtccatgctacgacttaaacccgctgaggtatgggtagatactgtattttatgaaagttctttatcgaaatg

SEQ ID NO: 104167 - DNA, 96 bp, Heterodera glycines
  Promoter: Source sequence=SeqID_8838; Location=1..96; Strand=+; Gene =SeqID_69374
ctgtttttcttcttcctttcctgctgttattcttttccatttatttttttgattttcttttgcttccttttaatgatattttggaaagtgcaaatg

SEQ ID NO: 104168 - DNA, 273 bp, Heterodera glycines
  Promoter: Source sequence=SeqID_17421; Location=1..273; Strand=+; Gene=SeqID_81902
aataacagaaaataaaatatcccagtataaatattagccatataagaaaactaaaattctccctattgtaacagttacaaaaatggattgatcttaccatttccaagccgtcgtacggtatccctaatggcgccgctaccgtccgaaatgtttgcacactaaataaaacgaacaaaaaaaagaacaccaacagatcaacaaattctgctgttggtagtgcttcacgcaaaaaagcaatgttcaaaatttcgctggttacggtagaggacgatg

SEQ ID NO: 104169 - DNA, 633 bp, Heterodera glycines
  misc_feature (31)..(31): n is a, c, g, or t
  Promoter: Source sequence=SeqID_26149; Location=1..633; Strand=+; Gene=SeqID_56895
gaattggatgatgagggttataaaaataatntaataaactttttgctaagatacggttacggtttcattcgaatttgtgttcaaataccgagatttttttggcactttgtatttaaaaatctgaagcggattaattcaattttttttctttatattcttagtttgcataataaggaacattttcatttttttgttaattttcctgtccaacgggaaatgcatttgtacctcagttaaaaattttattttttatttcatttttaaacattcagacactcgagtgtcggcaatataacttcacctcaatgagccaatgaaaatgcccaggaatttatttcttattcaaatttgggaaggaacatttttaaattcgctaaaaaatttatataaggaaattaaaaataataatttataaatataatggcactaaacattcgatcacataaaaagagttaagtcacaaacaaacctaaacaaagccatctatcataaatataatggaaaaaattagagttgaaaaaatgattgtttggtctgccgccatccaaaacctttatttaatgacgaaataagacaacaacaaaacgataaactaaaaagcataagatgttatcaaaaaaattttagaaaatg

SEQ ID NO: 104170 - DNA, 899 bp, Heterodera glycines
  Promoter: Source sequence=SeqID_23699; Location=1077..1975; Strand=-; Gene=SeqID_54394
aaaaaatttgagaaaaatggcgagacacctctttgtagttgttgatccaatcaatttttggtggatccaaataatcactgcaaacaatctcttcggttgaccatcagttgtcggagtgtgcaaccatttggacaattttatttacatatttggtacatattttggggttttcttacaaatttcgggatttttttttacatatttatgtacatattttgaacactttttgtacatatttctagggttgtaaattatatggattaacatattttttcttcgtatatgctatgaacagggaacggatttatatgtgccaaaaaacccccaaaatatgtgctaaaaacaccaaaaaaggccaaaatatgtgccaaaaactgaaaaaaactacttaataaatacgtgaattttgcataaaagtctcattttttacccatttcgctagcaaaatgcttattttcggatttttcgctaaaatttgaattttgccataaaaatgaaaagatcattaaaatggtcaaaaaatgaaaaaaaaaataaaaaattttgaaaaattttttgggcatttggccaagaattttgctgccaaaaaagacatttttgtttaaaaaaatcaaattttttcaaagaattgccaaaatatatgacaaaaactgccgaaaccccaaaatatgtttttattcccaaaaagtccaaaatatgtttaggaaaataggtaaaaatgctatttttgagcttttcatgcgatagcatgtaccttctctaaattttgtgttctttttgcgctctctcatttttcctaattgtctatgctttaagttaacacagtttttttgccctttgtgacacacaaattaaattgaaaaaattggtgagacctgtgctgattgaaccacaaaatg

SEQ ID NO: 104171 - DNA, 340 bp, Heterodera glycines
  misc_feature (124)..(124): n is a, c, g, or t
  Promoter: Source sequence=SeqID_7295; Location=1..340; Strand=+; Gene= SeqID_64380
tttttgcaatttgggtccttttttcaagcctttttcagcattttaggaaaaaaatagaaaattttaaaattttttgcaattttttcttatcatatttcactgcaattccaaaaaaaatttttcncagcggcaataaattgcaaaaattcaaattagaaaaaatttttattaaattgtaagagcaagagaattaacaatctttagaaaaaaaaacattaaagcaaacacaattcctaagacgaatcagtttttttttgatgaattgatgttttcaataatttgttcaataaaaaattcgataaatcaaaataataattactttttcagaatctaaaaaatg

SEQ ID NO: 104172 - DNA, 114 bp, Heterodera glycines
  Promoter: Source sequence=SeqID_15755; Location=3054..3167; Strand=+; Gene=SeqID_80081
ttttcccttcttcggttttttgcgtccctctgtatttgcacacacacatatatatataaatatgtagataaaaaatttcttcctccattctactaaacccccacccccaaaatg

SEQ ID NO: 104173 - DNA, 673 bp, Heterodera glycines
  Promoter: Source sequence=SeqID_42388; Location=449..1121; Strand=+; Gene=SeqID_70285
agtgagtgagcaaaagaaatgggcaaaatgtgtgtcaataattgcgatcaaattagacacgcattcgatcgatcggacaacttggtgccctttcccctgtccgtcccaatcgagaatttctcgaggaatttcagattaccccctgatttagaggtttattctcatttttgggtgatcggggtgggacagggatggcattccgaggcgtcacaaaaattttcgtaaatcggaattccgaggcgcaaaaattttttcggaaatcatacttccgtgccattcctaatccctattaggggaaatattaaatctaaatttttttgttcaaaattgtttgtaccgtagcctcatacagtacattttagtaacattgctcttctcctatgtaatctgaattttttaattaattaaattgtgaaattattaatttcctttttctttcatggaactgttggatttgttcaacgaacgttcgctggtgtgggaagacgaggaaaaggtgaggaggcaatttgtggcgcaaaaagagatgagattagtcattttcaccgcgcacaccttaaaacaaaacaaaaaaggatcaaattacgaaatgactaatttttgcaatttttctaaaaataattttttttttttcatttttaaaataaaaatttttctttaatttcttaagatg

SEQ ID NO: 104174 - DNA, 55 bp, Heterodera glycines
  Promoter: Source sequence=SeqID_15065; Location=1076..1130; Strand=+; Gene=SeqID_79238
attgtccatcctttctttctagtcgccaccaaattgtccccccccccaaaaaatg

SEQ ID NO: 104175 - DNA, 346 bp, Heterodera glycines
  Promoter: Source sequence=SeqID_37657; Location=569..914; Strand=-; Gene=SeqID_66671
agttcggcacggatcgagaccgggatagaccatgggaaagagcagctcgagctctacaagaaggtatggaaagaaaaaatagttatttctgggactttttcagaaatcagaattaattctccaatgtggcccaaattttaggcccccagccacagccccttgcttctcccagttttaagtcttggatttgtcaaataaattcaagacttcaaattaataatcaaaaattctcttaaaatttttttgaacccaattcaaaaaaggaaaaaaatttgcagtcaaaaaattattcgaatttctccaattttgtttccataatttccgaaagttattcggtatcataatg

SEQ ID NO: 104176 - DNA, 325 bp, Heterodera glycines
  Promoter: Source sequence=SeqID_14300; Location=1..325; Strand=+; Gene=SeqID_78328
atattggattgggtgtgaccgtgtttggcaactacaaccttttccgcttgaagatgatccggaattgggtgcttatggacgagtggacgcatggattcgaaatcgaattcaaaacaatggattacaggggaggtctgcaagtttcccacaggaaatgtggaatatgagtgaaaggtgaaagtggaaatagaattttaagaaacaaaaatttagagttgagcaaaatttaatgaggacaaataacagcatcgaggggtggcatcgctctttcaatagccaattccgcttccttcatccgccattaagttattttgtcaaaaaaatg

SEQ ID NO: 104177 - DNA, 69 bp, Heterodera glycines
  Promoter: Source sequence=SeqID_10095; Location=1013..1081; Strand=-; Gene=SeqID_73163
tgtcggcactttcttttcaagttttttgccttccaatcaaatccccagtttttttcagatcttcaaatg

SEQ ID NO: 104178 - DNA, 247 bp, Heterodera glycines
  Promoter: Source sequence=SeqID_18365; Location=1357..1603; Strand=-; Gene=SeqID_82966
ggtgcgctcattggggagggattgagacagcatttgctaaagatagacccattattggattcaaaattcgagactttcatcgagagtggccggccaccactcattttcttaaaccccctcccaacatcgttccgccccgtttagtctcttcgccgactgttacgtcgcttcgggcagtgccgattgtaccgtggtgctttggcacttcagccaacacttgggcctactcgtcggggattacaatatg

SEQ ID NO: 104179 - DNA, 275 bp, Heterodera glycines
  Promoter: Source sequence=SeqID_24095; Location=1..275; Strand=+; Gene=SeqID_54795
tcttttgcatattgtaacaaattttgtcccctttccaatggccttactaaaattttccaaaaaaatttcctaaccccctaggaatttttttctaaaattttcccgattttcagtgtattttagggtgtcccgatcactatgaaggagtgatctgatcaagttgctgtaaaagacttttttggtcagcatcaaaagttagaacggcaggaattttttcagaatttttggccaacaaaatattgacgcattcattgataaagtgaaaaaaaattatg

SEQ ID NO: 104180 - DNA, 212 bp, Heterodera glycines
  misc_feature (158)..(158): n is a, c, g, or t
  Promoter: Source sequence=SeqID_15985; Location=3290..3501; Strand=-; Gene=SeqID_80343
tttttaaataaatcaaaaatggtatacaagaaatggcaatatgtatcaatcaccattgacatcaacatgtgcacatcattgcattgtatttatttaccacatgtctattggacattcatttccaaattatttacgaattcttgactacaattcaccancccgatttatttgtaactgtgatgcttaataaaataattgaaaattaaagtatg

SEQ ID NO: 104181 - DNA, 132 bp, Heterodera glycines
  misc_feature (27)..(27): n is a, c, g, or t
  Promoter: Source sequence=SeqID_40801; Location=1..132; Strand=+; Gene=SeqID_69041
caatgtcaaaagtcaattggtgaagtncaatgagcgatttcttttggaaatcttcaaaaattggaaactgttgcttttccgattgacaattacacggatgggcgcagtgacgggaattttttagaggatatg

SEQ ID NO: 104182 - DNA, 112 bp, Heterodera glycines
  Promoter: Source sequence=SeqID_42531; Location=775..886; Strand=-; Gene=SeqID_70401
tttcgttacataattgttggcctatctaattttactttattttcttccccagcaatatcttggtcagaaattcttgcccactattctcgccttcaccgccgacgccaaaatg

SEQ ID NO: 104183 - DNA, 82 bp, Heterodera glycines
  Promoter: Source sequence=SeqID_35970; Location=582..663; Strand=-; Gene=SeqID_65417
tcgttacggctgcgaaccaacatatttaaggacgagcagcagggtgaagacgaaggaacagttgtattcattcccaaaaatg

SEQ ID NO: 104184 - DNA, 222 bp, Heterodera glycines
  Promoter: Source sequence=SeqID_8530; Location=956..1177; Strand=+; Gene=SeqID_68411
attctgggcaattcaaaaactataaaataaaagaaataatgtttctagccgaggcgttaaataaagcattcggtttttggtggaacgaagcggtgacaattggcatcccggaaaatttggtggtcggcgcaaacaattttgagccgattgggcactttactcaggtgctttcttacgcttagactgaatgtttaaaatccatggccattgttttttcagatg

SEQ ID NO: 104185 - DNA, 338 bp, Heterodera glycines
  Promoter: Source sequence=SeqID_6469; Location=2825..3162; Strand=-; Gene=SeqID_61703
ttgtttcttctcgcccaaacttacactttcttcctcctctttttggctttgtttttgtccgcgcaaaatcggagcatcaaacgaaattataaggcaaatttgggaggaattgttttatttaaatgcaaatttggcgttcttattaaggaggccaaatggctgtttatcacttctctcatttgttcgctaattcttatcgcttgggcggtgtttcacactttggttttaattatataattaattaatcaaacttgaatttggctatattaaattaattaataaaattatttaattaataaaataattttttgctttttaaggtcagtgttcagcacatg

SEQ ID NO: 104186 - DNA, 165 bp, Heterodera glycines
  Promoter: Source sequence=SeqID_14557; Location=1755..1919; Strand=-; Gene=SeqID_78623
tgccctttcgaattgtaatgtcacaattggatgcattagaagttctatagagcgaagtgaatgttgttattcctaataatagaaatattagatagtacgccaaaaggagacaaaaaattagagaaaaaaagatagacaaggaattgtccaataaagattataatg

SEQ ID NO: 104187 - DNA, 162 bp, Heterodera glycines
  Promoter: Source sequence=SeqID_818; Location=1040..1201; Strand=-; Gene=SeqID_61943
tcctgttttcgattaaccttattagtatttatttttactgattgtttgttctatacatcattatgcttccggtattagtattttagaaaataagttgcacaaaatttgatttttgaaaatcataattaattaaattcaatttaacgcatccttcagaaaatg

SEQ ID NO: 104188 - DNA, 779 bp, Heterodera glycines
  misc_feature (7)..(8): n is a, c, g, or t
  Promoter: Source sequence=SeqID_35652; Location=310..1088; Strand=-; Gene=SeqID_65165
gcatgcnnctgcaggtgaagcaaaatttaaaattttaaaatttatcgtatttacttctctaaactaataatgttaatttatttattttctatgacgctatcctgtttttaattttcactctaaaaaaatttttttaggatagaacaggcgacaaaaacattgaaaaccttttatgaatcaaatacaaatcaaagaaccttataaagaaatattattttttttaaacatgaatatataaattattataaaataaccgatctagccacagaataggtgtgctatttcatgacttgttttttttgaggcgtatgaacattttctttttcatcaaaaaatatttttataaatatttatttttatttaatgtatttacatgaccccccggaaataaatgttttgttcattatatttctataccaacccataattccatctaatttataaatgtcttttcttttcactacaatatattaaaagacaaaaattcatttatagtggaaactaattgtgtaaatcttacagggtttcttattttcagaaagtattaacttttgaaaaaaaattcttaaatttacacaaatgcttaaaatagtacaaaaaaagtaaatttttttctcaaatatattttaaaattctgatcaaaatacactttttaaaaatggacccaaaaatttgaagttttttgcctttcatgactaaaagctgtaacaaagtgaactatttatatttttattatttaactcataaaataaccgattttatagtatcggattaatatg

SEQ ID NO: 104189 - DNA, 107 bp, Heterodera glycines
  Promoter: Source sequence=SeqID_8038; Location=1934..2040; Strand=-; Gene=SeqID_66779
gattggacgtcgaagacaaaccctttttcccgcatctttctaagcgtccggagaactacggtcaacacatctacccaacccctgacgactatttggccaacggaatg

SEQ ID NO: 104190 - DNA, 567 bp, Heterodera glycines
  Promoter: Source sequence=SeqID_19984; Location=702..1268; Strand=+; Gene=SeqID_84751
aactttcatttgaattgacactttgtcagaaattcaacagctcccaaatctccgccatcgcttcggcaattaacagaagtcgtccctttgtcgcaatccatgggccaccggggacaggcaaaaccaaagtcattgccgaaatcgttttgcaggtccaattcactcataagcgaatgctatctgaaataaatttagcatgtcaaaaagggcaaaaatgtgttggtctgtgccccgtcgcataaggcagtcgatgtaataatttgcgctgaatgtccttttcaatccctccgtttcagaatgcaatggaggcgtgcaaaatgaatgggttggacaattttgtacgtttgggggaagaggcggacgacggcgcactgagcgaatatcgaattgggaaattggcacaaaaccacgccgaatacgaacgcattgagaaggacattcggaactcacgagaaatcaaaagccaaagggactttctggacaagtcgcggctttgtaattccatttgaaactttcgccttcagtgaccgacacattcgccgttttcattcgcttttgaggaaaatg

SEQ ID NO: 104191 - DNA, 148 bp, Heterodera glycines
  Promoter: Source sequence=SeqID_1842; Location=1224..1371; Strand=+; Gene=SeqID_76307
ttgcttcgtagtgaattttgaaagcgattcaaaatacactttattggaatcctcaaacttgggtaattaaaccgaagggggaaatgggggaacggcacaaaatggggggaaaaatgggggacggcacagaaatggggacggcacaatg

SEQ ID NO: 104192 - DNA, 237 bp, Heterodera glycines
  Promoter: Source sequence=SeqID_23949; Location=1..237; Strand=+; Gene=SeqID_54642
tcaattcttagacatttaaaatgctttcaatccaaaattatatttttgaaagccaataattattacgtacaactctcagtttttttctgttaaagcgcttctgctggtggcacaaacagctgctctccaaacggacccctccgcgtcggacattgattacgaaatcgttttgccggttgcgtcgttgccgtcgctggactcgccccgggggacgacgttaaattggcaggacgaatg

SEQ ID NO: 104193 - DNA, 420 bp, Heterodera glycines
  Promoter: Source sequence=SeqID_15555; Location=168..587; Strand=-; Gene=SeqID_79838
tttttaacaaaaaatatttgaagacacgaaagcgaagaaacactccaaaacaacaatcaattagatgaaatgaaaaatgccttttttggtgagggaaagacatacataagagaaattggcaaaatcttttgtctctttgtacagctttaacagtatgaaaatttaaaatttggcaaaaaacattatgccataaaaattcaatccaaattttggagtaaatttttttttgccgttagccctaaaaatttttcacagctaggtaattaagtggaaccaaaacaaaattgacatcatcgtcgaaatcttttcttcatttttagcggctatctttatgcttttgtgaaccaattttcctaatcattcctcagcgattaaattattatttttttaaagaaaacgggttaattaatttctcaaatg

SEQ ID NO: 104194 - DNA, 89 bp, Heterodera glycines
  Promoter: Source sequence=SeqID_18336; Location=1349..1437; Strand=-; Gene=SeqID_82937
ttatgcgtaattttcttaagcacactttcttcacaatcaattttttttagaaaaacgccttactttcttttatttaaatctgagaaatg

SEQ ID NO: 104195 - DNA, 203 bp, Heterodera glycines
  Promoter: Source sequence=SeqID_17339; Location=1363..1565; Strand=+; Gene=SeqID_47436
aatggacaatacaatgaaagtccgtttgttaaattgtgataattaaaattgtggatcgaattaaaagaaatcgtcatttatgtccaataaaatcagcgttttaatggcttaaaatttcgctcgttttttaatgttaattcttaccttttattttgtattttttattttatctgttttttatctgcagtgaatggccatcaatg

SEQ ID NO: 104196 - DNA, 737 bp, Heterodera glycines
  Promoter: Source sequence=SeqID_6162; Location=2297..3033; Strand=+; Gene=SeqID_60564
aaagcaaaatttactatatttcataaaaatttgccaaagatggttaaaaaatttaaattgtataattttttatcttttatcccaacaattgctttccatttgatggtttttataactaccatttataaaatataaaaaatataattttattttaacaaataataaaaatttaaaaatttgaaattgcatataaattttgaaaatcaaatttttttgcaattgagcaaaaaatgctcctcagccattgttttggtgtttttaaagtcaaattgtttttaaagtcaattctgtatttttacacaatttttggtattttttcactttataaggcattttttagtgtatatttggacattttcgggtttttagggcatttttgggggataaatctttaattatttattattaggggttccttttttaggaacgaaaaaccgcttaataggtacctaaaacgtagaaaaaaaccgaaaaaagcattacagaataaggcacataaatatttttaaataaataaataaatgctgtggactgctcttcggcctgagggaattttagtgccgtcgcctccccccgcgtctttttttatcggcagcggcgcgattttggacagaaaattttttcttttttttcgaaaaattttacgtaaaattgatttaaatgcaaagttttcaaaaattagtaaatttatctcaacaaatttaagacaaaattgaaataatgctcgtttcaaaatg

SEQ ID NO: 104197 - DNA, 856 bp, Heterodera glycines
  Promoter: Source sequence=SeqID_10224; Location=1..856; Strand=+; Gene=SeqID_73370
agatgcatgccatgctgcatggatcattttcagtacacatgtgtcaacgattggaaggaggtcatttttaattgcaaatttcacactttaaaaaaaatcatttgtcattttttgattatttaacaattttttttgtctatttattattttattttgtgcggcacgcgcacggtttttttaaaacgatccccccccccccccccccccctcctacaaaaaattaagaaaaatttcttatggtttgaaaaatatttaaagaaattccgataactaagtttaattttttcaagtttatgaaaaactttttcgaaaaaaattttaaatgagtatttagaattttttaaagaaaaaatttttttaataaaattcaacaatttaacatttctttgtttgatttctatgaaattttatttttcatttaataatttattaatttaaattttcggatccgctgcgcaattgaaactcaaaatttttgctaggccgaatatgattaacccacaaatccgcatttaaactacggaatcccgcgcagggattacgggattttgaaatattgaataaattttacattcttattcagcttagaataatcctttgttttttataaatttcccatcaaaaggttgaggcaatgtttccgaccacaaccacaactacgaccacaacaactacaacgctggccccagttcatccgaccgctgtttgtgaacataagcaatttaaaggggtgttagtgcgcttataaattccgccaatcgtcggaaaatcaaaaataattcacaactttacttgagaaagatcacaccaacaaaaagagtcacaatacaaatatggtaatacaatttaggtgatg

SEQ ID NO: 104198 - DNA, 148 bp, Heterodera glycines
  misc_feature (117)..(117): n is a, c, g, or t
  Promoter: Source sequence=SeqID_9250; Location=1780..1927; Strand=-; Gene=SeqID_70759
attgccattagctggactgtagagttctaaaataggctttaaaaggggcttatttctgaataaagatttattcctttttatttcggcattacccgaacatttcattaaaatatcttnttatgtggtactattaaaaatttgaaaaatg

SEQ ID NO: 104199 - DNA, 460 bp, Heterodera glycines
  Promoter: Source sequence=SeqID_7721; Location=3640..4099; Strand=-; Gene=SeqID_65728
ttttgaagttgggaaaagcgaaaaatgaagggaaaatacgaaaggcaaagagcaaaagccaatgcaagccaaaagtgaaaagtctgctgaaggaaccgccaattcggtggtgggagatgaacagcgaaaggcgaccggatccaatgcaaagccgacgattggtcgccagccccacaatttcccctcggggggcggagggtggtcaccgccgcttccatccgcccgatcaatgcgccgatgggctgcaaattgcacattttgtggaaagcgacagaaacttgaccataattaatttgaaaagcagcaacttttgaacatcttcgctttataccaaataaataatttataaaaaataaataaattcggtaaatgaaaacgaatgtcaaatgaattcattttaaaggtcttcatgcaaatcattgcccaacgaaacaaaatgccaattttcagtgccaaaatg

SEQ ID NO: 104200 - DNA, 405 bp, Heterodera glycines
  Promoter: Source sequence=SeqID_10924; Location=1848..2252; Strand=-; Gene=SeqID_74226
tctcctcctctcacttgtcttgtgctttatgggggccgtatcatttaattgggattttggggaccgtataattaaaataaatattttttgctgttaaccagggcggtagcttaaattacaaaaagctccgtttatcctggcagcaatttgccttttagggcttgaggtctttcgcttgacttgactaatttcccgagtcgtttaggtgccctgtcgtcttgtgcttcatgggtggcggtgtgctgctcttcaggccatagtttgtttaagttttttgactattttccatgcccaaatatttattattcattcacgatttcacgccatttccatgccggcgctcgcatataaataccgagattttactcattcctcctcactccactctcagattaaaaaaaaatg

SEQ ID NO: 104201 - DNA, 149 bp, Heterodera glycines
  Promoter: Source sequence=SeqID_24421; Location=527..675; Strand=-; Gene=SeqID_55152
gcatcgacaaaaattggattttgactctgtttaaaaagtgaaaaaaattaattgttttttttgtttttggaggttgaaaaattttcgtaaataaattttaaaaatacttttacaattaaaagaataatagactaattttattctgtatg

SEQ ID NO: 104202 - DNA, 173 bp, Heterodera glycines
  Promoter: Source sequence=SeqID_26008; Location=1258..1430; Strand=+; Gene=SeqID_56760
aaaaggggaagcggactcattcttcggattgccgccatttgtataataaaatgtaatcgcttttttctgtctttcatttacataattattttatcgacaatggtttttctattccattacatttattttttacgtattcactttgcttggatcgatttagcagcgtgaggatg

SEQ ID NO: 104203 - DNA, 516 bp, Heterodera glycines
  Promoter: Source sequence=SeqID_2350; Location=3324..3839; Strand=-; Gene=SeqID_79267
tttcccaatgtcaccgataggtttcgtgaacaatcaccaagtaatcactcccttatcagcaaactcttcattcaaattcgttttatatgtaacaaaatcatgggacacctaatgaattattgccaaattagcaaattagccgtctttcttcgtcccatttcacaatgtcaccgataggctgatcagccagcgctcagctgccccaccattcctccttatcagcaacactcaaattggagaaaagtcataggaatttaattaattaattaattgctaattgaaagggcttattagcaaaatggcggcttatcgccatgattgaatgtgttgagatgagagggagtcaaatgacatcagataattgctaagcaagcaaaaatttgtgaccactttagggggtatttaagcaaagcgatcggaacggttgggatcattctatggaaacaaattcgccattaacataattaccaaaccgacccccaacccatcgtataacaaacacaaattgccaaaatg

SEQ ID NO: 104204 - DNA, 93 bp, Heterodera glycines
  Promoter: Source sequence=SeqID_19351; Location=1..93; Strand=+; Gene= SeqID_84087
cccaatgcccaacagaaaactgttgatgacattggcagtgttgttcggctttccgaacacaacgtaaattctctccaatattggaagaaaatg

SEQ ID NO: 104205 - DNA, 275 bp, Heterodera glycines
  Promoter: Source sequence=SeqID_7642; Location=1757..2031; Strand=-; Gene=SeqID_65501
ttcagtcaaatcaacagtcaacttccgcaattccactacgaccccgaggcagataaaacattctcactttggtgggatcgttttggacaatttgtcgaaaaggacggtaaggatttgaccggcgacaacagcaagttcttcctaagaagccagccgaaatcgaatttcagcttacaatttccactcttaagtcactttttggcgacactaaatcaatttttgtcaggcacttcgaatgctttcagctgtcgtgtggcccctcacaaaatgtcatg

SEQ ID NO: 104206 - DNA, 59 bp, Heterodera glycines
  Promoter: Source sequence=SeqID_1530; Location=395..453; Strand=+; Gene=SeqID_46915
cgtactttttttttattaaaaatgtttcatgttaatcattcattcactgttaggagatg

SEQ ID NO: 104207 - DNA, 703 bp, Heterodera glycines
  Promoter: Source sequence=SeqID_8483; Location=1..703; Strand=+; Gene= SeqID_68231
ctcaaaattacgacttttttggaatttcatgttataacttttttggtaattgtctaatcgcgaagcaatagcttagaaatatcttctaaacatgttaagctttcgattgataccaagcttgctgaatttggttaacaacaaaaaaagttataacccaaaaacttgggctggcgccaaaacgtcggcgccaaaacgatacggacccataatgcgcaccggtgccacggttatagtaattccttggccgtatacctatttcatgccagaaaccacagatttgctgaaaatattagttttacatgtagagagcttcaagaatgaaaaatcctagatctgggttccatgttggacctttacttaaattttctggacaaaaataaaaggaaattccatgtcaatggaaaaatcaaaaccttgatccatgctaagctctagttcatatagatagagctcgacattttgaaaaaagcctgtacttgtacctatacctgtatttcccgaatggcctgtacctgtattttctgtacaaaagtacaggaaaatacaggttgaaaaacttgcctgtacctggatccaggaaaaacacaggcctggatcctggtacaggtcgagctctacatataggtagtttttaattttgctgtcatcatttcaagataaaaaaacggactaaaaaaacattttcttaattcgccctcgaatg

SEQ ID NO: 104208 - DNA, 295 bp, Heterodera glycines
  Promoter: Source sequence=SeqID_618; Location=3264..3558; Strand=+; Gene=SeqID_57574
atcaatgtggaaattaggaaaaattttcgaaattctttctgatagaactgttaaattaaaaataggaaaccgaatggcggaaagacccacaaaattattatatcccttagaaatagaggatgaaggcgaagaatagctataattttagataatttaattaaatattatataatctattaataaaatcaaatttatttatttatttaaaatatatttttaaaaaaaatatattgatactttaattttaaataataatatttttactcattattcatatcattattctgacagaatg

SEQ ID NO: 104209 - DNA, 92 bp, Heterodera glycines
  Promoter: Source sequence=SeqID_29406; Location=247..338; Strand=+; Gene=SeqID_46162
ggtaaacatttataataaaagcatttttatcacttaatttcccttaggttgttcaaaatgtgtcttcccaagcgcagtacacagtcagaatg

SEQ ID NO: 104210 - DNA, 441 bp, Heterodera glycines
  Promoter: Source sequence=SeqID_41665; Location=988..1428; Strand=-; Gene=SeqID_69742
gaagaatggaagtgcgaaaaacgaatgaaaatatatctttaaagtaattaaaaatgatttttaaattgtttaattttacaaaaataaatttatttgatgaattaaaaaatgaattttattttaaaatgtttaagaattgagaaaaaagaaattgaaatattttgcttataattaaagttgttagaatttgaaaattgttttttgttatctatgaacccgattactattattatgtttaaaaatttaaataagaaatttttacattgaaattttattttgaattatgattattattattatattatttttctcatttgtatcattgccaaataatagcgaaaatctattacattattttattgattataaaatgagcagaaattaagcaataaaataacattaaaaatatttaaaaaaaaaaatttcaaaatagtaaaaatg

SEQ ID NO: 104211 - DNA, 508 bp, Heterodera glycines
  Promoter: Source sequence=SeqID_3426; Location=1..508; Strand=+; Gene= SeqID_84640
taatatagccacaatttatcattttttgtttcccattcatcatatttcgttaaactcaaatttatttttaaaaaaattctcgatttttttcttgggacggagttggcgggacggagttggctcgggacggagttgccctgggacggagttggcgggacggagttgcatgggacggagttggcgggaccccttcataggttttaccgcttcgccaactggagtcggggtcgttttggcgcccacgttttggcgccgacgttttggcgcccacgttttggcgccagggtcgttttggcgccgacgttttggcgcccacgttttggcgcccacgttttggcgcccacgttttggcgccaaaatgtagagaaagggcgaaattgtatatttttttgttttttcttggagtggggcaaagtctataaaaggagcaccttcctagtagatttagtattttttttattttcattcttcaaataacgcatttttgttttttcttgtttaggaaatg

SEQ ID NO: 104212 - DNA, 283 bp, Heterodera glycines
  Promoter: Source sequence=SeqID_15868; Location=1..283; Strand=+; Gene=SeqID_47323
tgtatgaggcaatcgaaaaaaagctcgtaaaagaatatatgtaaaacaataggtagatactgtgtgaaatttttttgtttatctacatttaccatactgtaagtaaaggattcgttttttaaggactagctaggcattgtcttttgtcttattggtattgtagttttcagtacaaaaattcttatgcaatttctttctgtgcattaaataataaatttaaaaaatatcaatttaagtttcgtatacaatacatataagctaaacaaagaaaaagctttcaatg

SEQ ID NO: 104213 - DNA, 88 bp, Heterodera glycines
  Promoter: Source sequence=SeqID_13600; Location=1821..1908; Strand=-; Gene=SeqID_77500
tctaaaaaattatattcattttttcttatttaaaatagggtttaaagtttttgcagcacccaattaaaattccaggtcaatcattatg

SEQ ID NO: 104214 - DNA, 372 bp, Heterodera glycines
  Promoter: Source sequence=SeqID_693; Location=2776..3147; Strand=+; Gene=SeqID_59127
aatggcacgcaaattctttttgatctgagaaaagttatggatgatgcctttgtattgtttgggcgctttttctctcgtttcatcattattgttttatcactttttgttgttctcaaactttcaactttttgtgctgacgaatacttttcccaccaattttcacatgattaaagagcttatcgataaaaatgattttcaatttaattgatcgtcaaccttcattgtttattttgatttgtgaattcggtttttcatgttaaaaatggtatttagcaaaagaaaattgcaacggatagattagcaccatttgttaacattgtcaatttgctgtttctgaataaagcggtggacaattggcatttagtgcccatg

SEQ ID NO: 104215 - DNA, 308 bp, Heterodera glycines
  Promoter: Source sequence=SeqID_481; Location=978..1285; Strand=+; Gene=SeqID_53922
agagaggcgtaattttggcgtcgtttggacggatagtttttttttgtgggcacccggacccgacatatccgtacatatacaaggggtttcttgagacagggggagtggaccgtaacgaaggtagagaggaaattgcgcctagaagtccttaaaaaatacgatcaaaacgcgcaaaataaaaggaggtttgaatagcaaaagaagggtctccgtcggagaagatttggaccttcgtatgtaatatcggttccgagataccccccaaagacactctttgtatatgtatggacggacatatccggaaaatg

SEQ ID NO: 104216 - DNA, 231 bp, Heterodera glycines
  Promoter: Source sequence=SeqID_7548; Location=1726..1956; Strand=-; Gene=SeqID_65174
atttttttttaattttctaaccctagaaattttttgagaaattactgaaaataggtttggaaaattttttgcggggtgagtgaacgtattgtaaccgataatccaaaaccacaacattgggctcagaaaatcagattttgggatgagaaacccagaacttttacagattttgtcctaaaattgtccaagttttgcgattttgagttttgtaacttttcaaataatgaaatg

SEQ ID NO: 104217 - DNA, 1003 bp, Heterodera glycines
  Promoter: Source sequence=SeqID_5268; Location=1187..2189; Strand=+; Gene=SeqID_57518
tagacctgtacctggttccaggcctggtttttttgcagatacaggtcagaccattttttggcaatctgggtttttcctggaccttgattttcctagatttttatccatgaaatcaagttccaagttttttttatagtactgaactttagttttataattgaatttccgttccggtaaaacgtcatttttaattccgatttcttactgtatttatgtatcatttacacaggaaaattatcgttggacctatcccttgctggtgttttcattgctcactcccgttattctggtgtccatgattttgcaagaccgccgaacagccgcaaaatacggttcacataatgaccggtcctattatcaagtactgtccaattatgtaaattgaaagataatggtgatatgtaatcatattctattgtatttaaatgttaaatatttatttgttatttgatttcaatcgaacgtgttgaaatgaattcctttatttctcagtgttttgtttaaaattcattgtttcacattttgtttaatttacctaactgctttgcgatgacaaaactttgtttgtttgttatttgtttgatgatttcgcttttttcctgactgcgctttgctccattattgattccctccctccccctttttaatattcacttttctcccttttcccaccatttgtcccatacgcattcatttattcctcgtactgctgatgatttcgtttaccacaatcacaccaatgaatatcgttttgacagaaaggtcgccgccgttaataaaatagtcaaagtgtgattcgataaagacaacacaatccatcccatccctttttccattttacgggtttttgtgcaacgtccacaaagggtgagcaaaatatttaattgatcaaagccgagaatttattttttttttgattgaaagaaagcaattgcttttagtgttaacatcggatttgttttgttgctgcgagttgtaatcaagcgactttcttacgctgatg

SEQ ID NO: 104218 - DNA, 767 bp, Heterodera glycines
  Promoter: Source sequence=SeqID_4913; Location=1625..2391; Strand=-; Gene=SeqID_56177
ttcacaaaacacggtgccgtccggttaatactaatgtacggcgggacgcaagtcattttcaaattttttaaatttttcaatttttgacatcacttctcgccaattttctccatttgtagtagacatagcctgacgccattgataccattttgtagagctcatcgagatgtacaaaaagccgctggtaccggcaagcttagcttgggttggccatcgacaggggggggcgaggctgagggtcctccggcagatgtgcccgacccataacgggctccaagtgaatggattaagaaccggacccggcctgggagatagcccttaaaaaactgaacaaaaaattgttcttaaccgggccggtccgggttccggatcaggcacttttggtgcccgaaagtggtgcgataggcttccggaaaatgaccaatcaatcactgagttttttgtggatcgcccacactgagtttttttgtggatcgactcagcacgaaaaataaggcctttttaaaaataatttcaatattcatatggattaaaaaatgttcatcaaattttcattgaaagatgaaaaaagctagcatgaatttaattactaagccaaataatgaatttataatttttctaaatttaattaatatttttttaaatgccataggatctcttctacaggcttttgcctttgcctgatttattcgaatggcacaatgccgcaattttccttcaacatcgaacgatggattttcaatcattaaattctctgcttcaaaatg

SEQ ID NO: 104219 - DNA, 288 bp, Heterodera glycines
  Promoter: Source sequence=SeqID_1396; Location=1723..2010; Strand=+; Gene=SeqID_73262
tgccgggataaagcaatgaataacccccgcccctccccctccccctctgccccaacaaacacacaattggtggcatttcagggcattgggggaacgaacaccgcccgccatttaatccccggcaaactgtgcttctccaaaggaaggtttattataaaaatggcacaatcacttaaaaaaacactccatcatttctaaagaatctaattgggtaaaaaatggagacatttgtatttgaaaagttgcgtttttatctgaaaaatgtagatttaaaaaaatcccaaaatg

SEQ ID NO: 104220 - DNA, 96 bp, Heterodera glycines
  Promoter: Source sequence=SeqID_44494; Location=1170..1265; Strand=-; Gene=SeqID_71978
tttcatttccaaccagttctccttttcattcggcggcgaatggacaggcttaccagccggcacagccgttgatgcaaatggtggtgccacctaatg

SEQ ID NO: 104221 - DNA, 1003 bp, Heterodera glycines
  Promoter: Source sequence=SeqID_5843; Location=165..1167; Strand=-; Gene=SeqID_59422
tgtgttggtgaagtgcgatgagtgcggtaaaatggtgaacaaaaggaggggaagatacagtacagtaatcactaaggaggtcacatcgatggaccgatcgctcctacggtaggacaccaaaacggtagccattggcgtttgatcattcattccaaaaagcctttgttagctgatcagtcggcgctgtttcttctgttccttctgatcattttgccagttcacttttcatcagtttatcacccgcttaatcagtgctaaatcaattcaatttgtgtacccaaagtttcccttacctccaaatctctttctctctctgcccttccctcctttgtccatcagtacatttggtgccattttgtgagttgtgccgtttgtgttggtgatatggtacacgtgccaatcggaataattacccaaggagaaatgggaaaaatgaaaagggacggagggggggaggagagatcgtcgagcggaagtcaattttgcagtcacatttctaaaaaaggaatgaattcggagcatggaacgaaagtaaagccatgggaatggcaaaagggaggagaaaagtggcattttgagaaatggaacaccttaaatatgggaaaccaaacaaacacataaacaaagagaggaaaaagggggaaatttgggagaaaaagtgccgaggaatggggaaaagccatggggagagggaagacaagcaaaacgaaaggggaggggggagagaatgctatggggaatgaagctgcaataggcagacgaaccagcgaatgcaatgggaggggggggggggctttgattatgaaccggtttgggatggaatgcgaatgttttgttccctcccatgggcgcaaatggggggaaaggggggggagtacttgtgtaatcggtcattgggaaaagaagagaaaggaagagtggtgagggaaggggggaggggagtggtgtggaagaatgcggaagaggaagagccgctgatagagaagcataggaaagaaagatg

SEQ ID NO: 104222 - DNA, 1003 bp, Heterodera glycines
  Promoter: Source sequence=SeqID_2574; Location=1514..2516; Strand=-; Gene=SeqID_80484
caatccctggatttcttgccttttaataaatgcccgatcaatagcaaataaaatagctgatttagaacatttagctaaaaaatacaatccgtctataatcctaatcaatgagacctggttaaactccagaaatacggtagaagcggaacttacaataaattgtcaataccaaattgtttatgcaaaccgaacagaaaaaaagggcggaggatcggcaattctattaaaaacattgatcccttatcagacacttttctctgggacaaaattccaatgcgaaattatacacattaaattactttttaaaaaaccaattcaaattataaatatatatcgtccaccgaattgtaccgttcagaatactaaaaagctattcaaatttatttcggatcaaagcgattccgaaaatatcatataatgtggggattttaacatcccaaacattttatgggatgaaaataaggtaaaacatataaatgatcctatgtcaaatatgctgattgagtttatgaaccaaaaacaattgaaacagcatgttaaagaaccgaccagagaaaatacgattttagacttagtaatgactagtgaatcagaattaattaatgaattaattgtattggaacatttttcaacttccgatcataaaatggtcggatttcaaataaaagaaaaattccggcgtaataatcccagtgtttatagaagagattttaaaaatattaatttttcgaaattaagtcgggcgattcttgaaaatcgtattgatttatcaataaactcagtgtacaccgttgatcaaaaatataaagaattcttaaataaagtactgaaattatatgatacttttataccaaatagacctctaaaatcgataataaaacaatcgtatcctcaaaaaataagagatttattttcagagaaattacgtttgcataagcttgtaagaaaatttcctgaaaaaagtgaaatcattttaaattacaaaattatttctagggaaatg

SEQ ID NO: 104223 - DNA, 1003 bp, Heterodera glycines
  Promoter: Source sequence=SeqID_953; Location=19..1021; Strand=+; Gene=SeqID_64897
tgttttgggtggagaaatgctttttgcttttacttcccataaattggtttcaggacattggacttaaacatcgaggcttattcgcttctgctttacgccgaggggttgtacaaagcacagagatacgggttggaagggatcggcacagcttgggttgggttaggggggaaatgaagtgcacccatcgatggcacaagtttcgttgaccggagagtgccattgtaaatcgtcgtcttttcacaaatgcgatgccattagcttccagattttgttgtttagtgaatctggcgaattggatggctttccgctcctttttgtgccgggtaatgccggttcggggcgacaagtgcgttcattgggctcactgctgcagaacaaaacggagaggctgggaacgcacttccatttcgacacatttgcactcgacttcaacggagtaacagcaaatgagcgggcaattaattgaggcaattagttaattgcaatattttggttgaaggaaatgaccgcgctgaacttcgattacatcgaaagtcaagcgcagtttctggccgattccgttgggcacattttgtcgctgtattcgccgcacaaacagcccaaaattgtgctcattggccattctatgggcggaattgtcatccaaaaaatgttggcggacaatgccaacagatggagcaaacatattgcatttgtactcacttttgccactcccttctcacagccgcgtaagaacaaaatgagtggggggtgggcgagagaatggcatcagacaaatgccactgattgaggggcgggagagaaatgccactgattgaggggcgggagagaaatgccactgattgaggggcgggagagaaatgccactgattgaggggcgggagagaaatgccactgattgaggggcgggagagaaatgccactgattgaggggcgggagagaaatgccactgattgaggggcgggagagaaatgccactgattgagaggcgggagagaaatg

SEQ ID NO: 104224 - DNA, 309 bp, Heterodera glycines
  Promoter: Source sequence=SeqID_26575; Location=1..309; Strand=+; Gene=SeqID_57310
tcaaaattgaagtgcccatacctcagccggtataagtcttttagacatgcgtttttttgaatattgtagagaattttgtgctctataaaatgggcctactcaaaatttccagaaaaattttcccaacccctagaaattttttttgaaatttacccctcgttcccagccaaaatgggctgatcagatcaccatgaaggagtgatctgatcaacttggtgttgctaccttttttgatcagcatccaaagttatgcttaagcagctgaaaccgagaagaatcgaatttgatatcgaatatacctaaattatg

SEQ ID NO: 104225 - DNA, 312 bp, Heterodera glycines
  misc_feature (24)..(24): n is a, c, g, or t
  misc_feature (66)..(67): n is a, c, g, or t
  Promoter: Source sequence=SeqID_42804; Location=1479..1790; Strand=-; Gene=SeqID_70607
ttttttttttacaaaattatctcnaagaatatttatttttaatttaattatttttaaatgtttatnnttgtttcaataattctcgtttttagtctatattttatggccatttttgtaattttataccatattttttgaaccctaaccattaaattttgataatccaatgaataatttttactttaattaattcactaattttcatcatttaaagtaggcaaaaatcacaaaaaaataagtaaatttaactcgcaaagtttaaaaaatattttgtaaatataattaaataatttttgcccttattaagcaatg

SEQ ID NO: 104226 - DNA, 320 bp, Heterodera glycines
  Promoter: Source sequence=SeqID_11077; Location=1..320; Strand=+; Gene=SeqID_74410
gtaaggagttcggaataaagcacacttttacgccgccattccatcctcaatccaacggacaagtcgaacgtttcgttgacactttcaaaagggcgatgatgaagtgcaaaggcgacaagaacagccttgaaaaagtgctgctctcctacagatcaacaccaaattctgccatcgacggatattcgccagatcaattgttccttggacggaaactgcgcaccaaattggcacttgtccacccaaaaggacaaattgatcagtcggaaaaatttgaaaaaggtaagttcaaacagcatcaaaaggactactctgccaaaatg

SEQ ID NO: 104227 - DNA, 249 bp, Heterodera glycines
  misc_feature (40)..(40): n is a, c, g, or t
  Promoter: Source sequence=SeqID_13022; Location=3181..3429; Strand=-; Gene=SeqID_76798
atttttcattctaatgatattttaaaattaatatattatnttgccattctctcatgccatccttttttacattaaaaaatatatattttttgcaattttcagtggttgggctttattctcgcccaaatttgccgatggttccacccattcttgggacagaaatcttccgaaagggatggacgcacattggggggccgaatgaagaagttggcacgtggtctggtgaaggatggcattggcgacaaaatg

SEQ ID NO: 104228 - DNA, 229 bp, Heterodera glycines
  Promoter: Source sequence=SeqID_5074; Location=1430..1658; Strand=+; Gene=SeqID_56806
ttttcgaggaatatttttgtgtgttaagatgaaaatgagaagggaaaagtgtgggggtactgtatgtaacgtgacggagagggcggggggtgtcacgtgggaataggccactcccactcaactgagagcacgcagggacctccagacgggaggatttcgaaatccatccacagtatgccctcctatgccacgccccttatcattcacttccctgtcagtcatttagatg

SEQ ID NO: 104229 - DNA, 64 bp, Heterodera glycines
  Promoter: Source sequence=SeqID_29721; Location=103..166; Strand=-; Gene=SeqID_60188
gctgaaggagcagggacaaacgatcagctttctacgactgcaggtccgcaacagagacgcaatg

SEQ ID NO: 104230 - DNA, 997 bp, Heterodera glycines
  misc_feature (55)..(55): n is a, c, g, or t
  Promoter: Source sequence=SeqID_1898; Location=2061..3057; Strand=-; Gene=SeqID_76637
tcataaaaaaatgtattttttcaggaaataatctgcgcaattaaatttgatcatntaatacaccaaataagtgtacaaatccgtgggatcatttctcggtaaaacagagagaggaattttcgcgcattaattatttataaattttgaatatagtaaatttattaattagctaatttttgatttttttggcattggctttactcaaaaactcaaaattcttagaaacgataaaattccaaaatccgttttaaaaatttggattcatataataaaataatagtaattaaaatggtttagagtaatgattcgattgatcagttttttcgagattctcaaccaaattggacgaataaaggaaaagaatttggtgacgaaaatgaacgcggatttgtgatgagtgaagtgaagagaaaaacgacacattgtactccaataaagagaattgtgttgtattgcattgtttgtacatgtgacctttcccataaaatgggtttgaagtacaattttttttgtctaaaattgttttttattttcaaattttgaaaaaaaaatttaaattaattttaagatttaatggaaatgcctaaattttttatagtttaatttacgtattatttattttatgctatgtaatatgaatgaagttggttatatttcattttaataatcaaaaaaataaataattgtttaataagtgaatttcaaattccgctttgggataaataataaaaaataaacaattaaaaaaatttaaatatgctattctccatctttggcttgacttttcgatgttttgtcgccacaaaatttgggtcattccgccataatttttgtggatttatttcgctggtgtcagccgcgcaatgtacacgataattgtggtgaagatgatccgtcgccggatatatccagtccccttatatatttcacccaatagactgatggaataagggggaaaataaaaaaattaaatcggaattaaaatatttcagtcatg

SEQ ID NO: 104231 - DNA, 430 bp, Heterodera glycines
  Promoter: Source sequence=SeqID_6272; Location=1456..1885; Strand=+; Gene=SeqID_60975
tttcgtgcttaaatatttgaattttgatacatatttctcattctagtgcttaaaatttcggttcttttatcatctcttttcctcatttaattattatacttgtaatcaaaaatgaatgctattaaatcctgaatttttggtcttttccccttgaaatatggttgaggccacaaattagtcgtggacataagaatataaattcaccaatttaattttattatgttggcattctgaattgctttgcacggctatccaccttttgagtacatatttttctttctctggctcttttttctttaacaccccctaccatttcgtctttttatcattaactctctcttttctttatatttttcaatttatccatatcccatccatctaatcatgctaaacaaacagtactaaaatctgtcccaattgtttagaaatg

SEQ ID NO: 104232 - DNA, 137 bp, Heterodera glycines
  Promoter: Source sequence=SeqID_24602; Location=555..691; Strand=+; Gene=SeqID_55340
ttccctggctttatgtaaatggtcaacgagtgatcagtttgtttgaataatttaaatttcaaaattcaaaccaaaaaatcgtaattttaccaaaagtaattagaaaaattttcttttaaggatgcctagataaaatg

SEQ ID NO: 104233 - DNA, 450 bp, Heterodera glycines
  Promoter: Source sequence=SeqID_3117; Location=1670..2119; Strand=-; Gene=SeqID_83279
ttttttaagaattttttgtcataaacgacaaatggcgctcgatgtttgatgcggaggctcaagaagtagacgaggagacatgtcggaaggcatggagaaggaatagaaagatgatgcttttagcaccgacgaccagggtgcgtttatttggggtttaaaaaggtgttaatttaaaaaaaaaccgatttagttacagttttgggcattaaatattttcaaaaaggctaaattgtttttgaattttaaatttattaaagccttttacccaaaaaattagaattttgaaaagaaattaaaagtttttaaaaagcgtatttgttattatgttattttagacatttcataaaaaaagtctaaattgtttttaaactgaatttatttaaaaaaaattttttttacgtttattaagaaacttttgtcataagcgaaaatttgccctggcccttgatg

SEQ ID NO: 104234 - DNA, 308 bp, Heterodera glycines
  misc_feature (43)..(43): n is a, c, g, or t
  misc_feature (147)..(147): n is a, c, g, or t
  misc_feature (167)..(167): n is a, c, g, or t
  Promoter: Source sequence=SeqID_22608; Location=1..308; Strand=+; Gene=SeqID_53274
atcatcaaaatgtcggtgaattcaagggcatgagattgattgnaaattaaccatatggtgaatagggtcacaaatccattaacttatagactataaaaccgaaaattgtgagccgtatattcattcgttcattcgtaatattaaatntaattttatttagatcaatnttattcaaataatttcgcaaatgtctaagcaatgtaaaaattttcaataatagatgtatgaataatttttttctctctagctcaagctgtgtttgagcgctcaccaactcctgactctgagctcaacgaattatcggcatg

SEQ ID NO: 104235 - DNA, 1003 bp, Heterodera glycines
  Promoter: Source sequence=SeqID_11723; Location=280..1282; Strand=+; Gene=SeqID_75211
ttttaaaatttttattactttttttgttttccaaaccatcttttttcacggcgctcttttctaaagacttttagggagaaagggtacggcgtcctgcggtgccgataggcgccgccgggaaaattttgaaaatttggttagatctgttaacagattttgtccaaaatatgctaaatttttgcgattttgagccaattttttaataaggtttatgaatttttgggccggtgataccgataggcagcgccaggcaaattttggaattaagctctattttctaggatttttcaccaaaaaaatttatgaatttcggtaaattttgtttttttcgatatgtatttgtcaaaatatgccaagattggtcgatttctatgagtatttaaaaaaatcattttgtcacaaagaaaataattaaagaaaaaaacgtcaaacggtattgaactcacgacagaaagtaatgtcagtgtgatgcactaacctctacaccacattccaaatgtccgaaattgagcaaatcttctttatttaataaaaatttggcaaaatggttaaaacattcaaatttcgtctaagttttttgcattttctcccacgaaaatgccattcttaggggtgtatatttaaccccgaccccgatcggggttaagggtcggggttcggggttgtcggggtatgaagagtcgggttttccccgaaaatgaccaaaaatgtcggggttcgggggcgggctcaggggcccaaccctaataaaaatgaagaaaacacagatttttttggtcgttttcgagagtgagaaatagggcgtcggaaattgtttgttttcgtttttgtttttgttttcgttttgtttttttttcttcactatcggcagtaattatatagctgtaagtttttcgtaagttcggcattcgacaaaaaaacgaagggtcaaaatcgattcatttctaattgattcccagtgtacactggaaatggcgcaaatgacgcgtttggcgacggaatg

SEQ ID NO: 104236 - DNA, 145 bp, Heterodera glycines
  Promoter: Source sequence=SeqID_10515; Location=1347..1491; Strand=-; Gene=SeqID_73742
cgttaatcatttttttattgcccaaatatttttttcaataaaggatagaaataaattattttattaaccaaattattttagcattgaaaatttatgtatttccttttatttttgttacttttagtttttcttcaatttaaaaatg

SEQ ID NO: 104237 - DNA, 581 bp, Heterodera glycines
  Promoter: Source sequence=SeqID_39358; Location=1..581; Strand=+; Gene=SeqID_67940
attaaaaataattttttttggggtggagccccggattctccagtattaccgtatattgataatatccattttccttttatgacgatttttgaaattaaaaatggttttatgacataaaaaatgcaagaagtattaaaatgtgtttacgatcggcgggtacggagcatttactcaatgaatggacagaaaagaaaaataattaagaaaaagtaaaggaatccaacaaaaaattatggcagaaaaaccttaaaattttttgaaaaatcgttggcacttaaattcggtcattccctaattgtctcccctcccccccccctgagggcaaaagcagtgctgcttcctttttatcaattatcatttgtgccttcatcaattcattaattaattactctgttcaattgaggattgattgattatcttcgacaataatttttgttgagttactgaccaaaattgccccattctctcctcaccaattcattgattgaatgcctttcattcattaattaatgtaatacattttttttattattttataattgttgatacaaattccgaattattaaaaactttttaacatg

SEQ ID NO: 104238 - DNA, 701 bp, Heterodera glycines
  misc_feature (44)..(44): n is a, c, g, or t
  misc_feature (58)..(59): n is a, c, g, or t
  misc_feature (64)..(64): n is a, c, g, or t
  misc_feature (86)..(86): n is a, c, g, or t
  Promoter: Source sequence=SeqID_23310; Location=493..1193; Strand=-; Gene=SeqID_54012
ttaagtgaattaaagctttaaaaatagcaaaaaatcgggagaantttatgagattatnntggtntataaatgtcaaaaagaaaaanagtattccagaatttctggaaaaattcgaattttcagaaaaaaattcataactcggttctgaaaagtcatactctaaaagtaaaatactacaaaaatccgcaattttttgctctattatataaattttatttcacatttttatcacttttttgaaaaatgttataaaaataaaagtgattttgggattccagaccaaaggggggtgaccaggatttttgagtggaaaatttttttcaccaaaaatcttccaaaaacatgtcattagtggttatttgggccgctgatcacgaatacgtgatcagatttcaattgttacatcgttaagaccttagaatccctgtgtgattggggattctgaggcatcattttgagggggcggggggcaagttcgaatccgggcggtgtacattattttctatttattttttgcttattttaatgcttttaattaatttaaaatattttgttgagttaataaataaaaaattatatttaaattaatttttttttgataaataaattttataagtttaaattaattatttttttaattgatagaatttcatctatttttttaattaaatttgttaaaaaatattttcaaattattaatg

SEQ ID NO: 104239 - DNA, 123 bp, Heterodera glycines
  Promoter: Source sequence=SeqID_12887; Location=775..897; Strand=-; Gene=SeqID_76623
tgtgaaacaaatcgatttttatttatttcaaaaattaattgaattgaaatttaggacattggcattggcaccgttttcaatgacatcaaagcagaaaaattcaatgaaaatttggccaaaatg

SEQ ID NO: 104240 - DNA, 97 bp, Heterodera glycines
  Promoter: Source sequence=SeqID_24524; Location=1..97; Strand=+; Gene= SeqID_55251
tatttgattaaaaaagctatttttaatagtagaaaaatcatttttaattaaaaagtttttaaaatgttaataattaaattattaatttaaaaaaatg

SEQ ID NO: 104241 - DNA, 178 bp, Heterodera glycines
  Promoter: Source sequence=SeqID_25831; Location=1..178; Strand=+; Gene=SeqID_56597
ttccttccataatttctgtgtcaatctcttttccaattgtccattgtacgtcttttgttttgtctttgtccttccattggtttctttttttgctttgtttgtccaattttccatttgtttcgtcccttcttctaaacctcgtacatattctgctgtgcttcagcacctcctattaatg

SEQ ID NO: 104242 - DNA, 726 bp, Heterodera glycines
  Promoter: Source sequence=SeqID_14689; Location=901..1626; Strand=-; Gene=SeqID_78800
tttgtggcacgtttttctgtcaatgtaattaatggaattgcacctgtcaataataggcaattaggaatttactaatgatattagggattcactctgaacatggccatattgttttgtttttgtttatttcttcttccgtccgcgaataatcacatcgacgacatgaacgacgggtgacaaaatttcgaaaggaacagctgagagaatgaaaaatgtagtgaaagcgacagcattaactaacttgggacagttccaacatgtagaagccatgggaaaggaacttacgactttttttggtgcaaaagcatccgctgaacaaaagttttggaacagtgaaagaatgaatgtaaaaacagaattagaattaaacaaaatgagtaatgaacatacgcaaaagaaaggaagttgaaataaaccgttcggagaataattccgtcgtctgacagacacagtgaggagacaatcggacaattcgattgaaaattctcaataaatgaagatgccggaaatttgctgacaacaacattggttattctcgatcagctcttctagcaaaaatgtgacctaaaaaaattcttaaagcaatttttaatttcacaaaaacaaaaatttgctcgaaatactgattgttagttaatttaaaaaaatttaaatcaattatttagtgtaaattatttatttatttttaatagaccctccgcttccgtgaataattatacaggaatg

SEQ ID NO: 104243 - DNA, 432 bp, Heterodera glycines
  Promoter: Source sequence=SeqID_22719; Location=521..952; Strand=-; Gene=SeqID_53405
gctaaagcaaacggctaataattttgcaagcctttttggattcaaggaaagcagagacaggtggcacaggctctcttttttcggtttgaaaattgggttccattttaatatttaataatagccaaatcaaaaaaaaattgttcttacaagggaacctcgcgaactgttagtcaaaaaatgggtataaatttggtatcattggatagagagcatgttcgacttctattgtgatttttttagtaatagtggtatataggaaaatataaagttatggcctcaaaaatcgaaattttgactgtgttttcactaaaaattggtggctcagttggttaaattcgcatttttggagctcgggttcaaatccacacaaaaataaattaattttaatataaataaataattttaaaaagcattttttagactaagaaaatg

SEQ ID NO: 104244 - DNA, 891 bp, Heterodera glycines
  Promoter: Source sequence=SeqID_29001; Location=1..891; Strand=+; Gene=SeqID_59565
tttactcatttttgtaaagacatgaaatttcctttttcgttacgcgatttacttcctaaattacaatcgctaattattgcgacgaattaattcgtttatattttaaggcaatgctcataattaccagtttcaaaatcactatcatgttttagctcaatattttattttactttagataattacatatataaagtttatatatatatattttctattatgtaattagcgggggccgggtggaaagttagagagagaaaaacgtagtcgcgagagagtctacgaaaataagagaacagacgcttagagaaaggcgagggatttgctgctcccagtgttaatggaaaagttcgttatttgaaccaatgcttttttaattataagaatttcataaaaacccattaactattccttttttaattataagaatttcataaaaacccattaactattccttttttaattatcaaaaaaaatccttttttggtaaaagtaatcattcaaaattttttcacctgcgtgataatttgctttaattttggtttttatgccgtgattaccattttatcctattgttttgggattacgtcaattaatttaatatttattaaaatatatccattaaaaggtatttaatcctacgaaaaagaaactaaatgcaacccaactcccattatagaaccatttttcaattttcattatatcattaaaagcacacaaactgttgacgtgctaacattttttattctcaaataaaaagcaatttgtgtccctaattagttttagatttcatataaaaaaaatttatctttgcagcaaaaaaaaattgtaaaaatttcatttttacccttaaatactttatttaatttacggcgatagaacataaagctaatg

SEQ ID NO: 104245 - DNA, 934 bp, Heterodera glycines
  Promoter: Source sequence=SeqID_4304; Location=1..934; Strand=+; Gene= SeqID_53966
aataaaaataaattttgaaattcaaaaccataaggggacaaaaaagagaactgaaatcattagcatattaatctagattttttttttgtttttttttgtcatcacaacaatgggagggattacgaaaatttttaaaattaaaagttgtcaaaaaaactcaaattaattaatttttgtttcggcttagaaacaaaatggatacaaaaagaacaaataaatttgttaactcaaatatcaaacaaaaagcatcgctttcgtcctcacacaaatcgatcttttaaatttccataatattcggctgttaaaagtccgggttaatttcaaaattgtttgtcccgttaagcaatgaaaatcaaaactaattttattagccgtttctttggtttaccgtgcttactaattagtaccccccggggcttctatttttcaacccccctcgagaggggtattctaatttagagggggggggggggtactaattcagtaaatacggtatattgattatgaacatttcaccgcaacatgtagaaaccgtaattttgaaaaatacggactcggaccaggacctgaatatccgagttcgctggcaccggcctggcttagaacaaagcccggcgggcatatttcaacttcgagaaacaaattccgacaaagtcaattgaaaatggaatgaattttcaaacttgttctgattttcacatttgtcctgagaaaatgaataaaatgacgattttttttgttattataattaatgtaaaatatttctgttttggatgaaaaatttgttaataaatgtcctgattttttatgtttgtactgacttttttataatcgatccaagcaataaattctcatttcttcatttaataaagataaaatttcctttttttttgaattgtaaattattactaatatttattgccaattgaaaatg

SEQ ID NO: 104246 - DNA, 140 bp, Heterodera glycines
  misc_feature (47)..(47): n is a, c, g, or t
  Promoter: Source sequence=SeqID_42632; Location=1..140; Strand=+; Gene=SeqID_70483
taagaaatgaatgactttcctttttatgttctttgtctgtgtgttgntccataggtaataaatcgggtcaaaacgggcggtgaatggatgatcagacgatcaaagtgtatcattaattagctaatgagcttaatgacatg

SEQ ID NO: 104247 - DNA, 378 bp, Heterodera glycines
  Promoter: Source sequence=SeqID_40325; Location=1..378; Strand=+; Gene=SeqID_68696
ctccattaaagtgcagttttcgtatcttggtactcatttggctgcatatctgtagtacggaaaaaatattaatatccttttttaatatcaaaaaaataatttttattgtatttttaataattcccccagaaaaaatttaatcaaatttcgcagaattttattatgatacaacaaaattcagtggtaattttcagtggttttatcgacaaaaataagcccttaaagtgcagttttcgtatcttggtactcatttggctgcatatctgtagtacggaaaaaatattaatattcctttttaatatcaaaaaaataatttttattgtattttaataattcccccagaaaaaatttaatcaaatttcttagaattttattatg

SEQ ID NO: 104248 - DNA, 1003 bp, Heterodera glycines
  Promoter: Source sequence=SeqID_10442; Location=848..1850; Strand=+; Gene=SeqID_73639
aactatttggatcaaaacatattgtaattgtcttgttcaccattcattgtatctctctctcaaatacacgcaaatgtagcctttatttctcttttatatctcaaattgtttaatcatttagtcattttattcgtttttctataaaatttacacataattaatggaatgaggatgaaattggcaaataattaaacactcgaagttgtcattttcaggtagaaaatgcataattatgcgaaataagttacaatttgtgaaaaattaaggattagaagatgcaatttttaataaattatcgaattggtcgtttttatattgaaagtgaaatttgaaaataattaatcaatgggatgtaattttaggtgtaaaatgcataatttaatagaaagaagacataattacagaaaattaggaaattgaagatacaattttaataaaaattaaggaaaaataatgagttacatcaaggaattactcaaaaaagtgtaaaaattatacatattggtgtggttgcgtgagtctagttgtttaagcatgaggataagtgtgttatagagtgtgttcgagagttctcatattattatgtaacttatataaaaattattaattgtattcttaaacacaaacaatgttcattgacaattcaacgtaaatgaaaagtttggattatcaccaaaataattcataatgttaatacaataacatttacaataagaaataattaactaaccgaaaatgaacccattcccatcctacgcgattgacaatttaataggaaagtttttaaaatatcataaataaaaatttgtgtttcaatgataccggttagcgagagattaaaaattatttaaattctaggctatgcaggaggcaaaagaatacataaaaataagtatagtaggtatgatcgttgtcgtagacagagacttttgaagtattggctactggtggaccaagcctaatggggcattggctaccggagagcctagccttatgaggtatg

SEQ ID NO: 104249 - DNA, 814 bp, Heterodera glycines
  Promoter: Source sequence=SeqID_549; Location=4638..5451; Strand=-; Gene=SeqID_55920
aattactaattggattttatttaatttactttttggccaaattcaatgatttttgaattaaaaataatttttagaccaaacattgtttaacgaattgaccaaagaagcgaatttgattgaaatggttgaggaaaaagaacgtgagaaattccgattgacgaaattggcacaatttccggaaggatggcaagaaataaaatacggagaaaattcaaaaataaatgaggaaaaaacaaagcaggttttgctgttttattgcataatattgagtaaagcattagccaaatttaagattttaaaagagacgcaaaaaataaatcattcaaaagaaacgcttaaaaatttgacggaaaaattggagaaaatcattcaaaattgggtgagagagaaagggaagggccaaatttggaaaaacagttagtaattaatttgccaatttagtcggcggaggtgcgaattcaattctcaagtttaatgcatttgcaaatgcaattggaccaaatcgacgccattggcattttgccgcatggctttgaccagcgaaatgtcctcggcaaattccaatgcgaccaaagcgacgccaaaaggggcgaccaatgcgcggaccaatccctccactgcacactttgcagggtgagcagagaatgccatgggaacaaaaaacaaacactttgccaacaattaattcaaaattcaatttcagcattcgaatgtcaattctttgtataaattttccacgatgcaaaaaatgtctattccacgaatgacactcaaatttatggacattttgttcgaattaaaatttttcagaatg

SEQ ID NO: 104250 - DNA, 989 bp, Heterodera glycines
  Promoter: Source sequence=SeqID_3512; Location=1..989; Strand=+; Gene= SeqID_84977
tgctcttgcgtggactattttgtttttgaaacaaattctatttaatttttatatcctttaactgactcattttttgttcttgcaaaatctgcgctgagattcgttaccatttttttattttgcatatattaaaacacatttttctctcccaaatcacattttctccgaatacgtgtcgaattagagcgattttttaacaagtaattttaactatttgggatttttgtcaattgccacttatatattttggcttgtgaaatttttttaaaactttttttttcaactatttttgcttgtgaatgcaaactttgttatgaaaaacgcaatcaaattaaataaaatgcgccctgagaatcgactaaattttaaaaaaacgcacctaagaatcgacttttcaaaaagcaaaaatcctgtccatgatgaatggtgggtggataaacgaaaacattttactccagaaaatcttaaaatgtttttcagtttgttagcgacttgttaggtatctatctatttctctgttttatcacctaaaaatcctagacttgctaatgaattaaagcaccaaaaaatatttgcgatagcatatttttgcttatggtaaaatttttttaataaaatccgaaaaattcattcggagtttcaaaaaaaaataaaattaaccattaaaaaccttttatgaaaaacaataaatatttcaatcataaaatatttattaaaaaattttaataattatttgactgatcgcttttttcaataggcgaggattaattggaacaaaattgaaatgttcttttcatgcaggtcacttgctgatttagccatctgtcagctccatctcagcccggattatgccacaaatgacgacgatctgctgctgctcacagagaatgagaataagactgtgaaggaggaggcagagatgccatttgcagaaattcctccgctccgttttggcatcaaaaaagaacaaactcatcaaaaacgccatg

SEQ ID NO: 104251 - DNA, 172 bp, Heterodera glycines
  Promoter: Source sequence=SeqID_11683; Location=2011..2182; Strand=-; Gene=SeqID_75157
tgtgatttttaaaattcaataaagcgccaaaatgatatataattttaattttccatttttcacatttatatttaattttctttttaaatacctattttattaatcattttattgtatgtaaatttgcacttttcaggtttaaaattaaaaaaagaatacgacggtttaaatg

SEQ ID NO: 104252 - DNA, 806 bp, Heterodera glycines
  Promoter: Source sequence=SeqID_3372; Location=1528..2333; Strand=-; Gene=SeqID_84421
atttaatttgagaaatgatcaatctcaatttgatgctctctttttctctccgaaatgcttttgttgattctttcgttcgaataaaacatatgtacacttaatatcttattgaaaaccttactaattaaattaaattaaaaattaagtttccgaacctcggaatttaacaaaaaattcaaaattttcaaaactcacttttatatcgtacgcccaaagagcaaaaaacaaagtatcatcaaatcaatccaattcgtcgtaactcaaaaatgatcggtccttttttttaggaaaacagcgccacaaaaacaacgattaaaagcaaaaaatttaagaaattttaatttattaaaaaatccagaattttgggacccagaaaattccaagattccagatcccccccccccccccgaaattggcattgcttttcaatggcaactcgtacaaacaattaccaaaaaagttatacatgaaaaacatgaaaattgcgaaaaggtcgaaattatgaagttttttcttaataaaattttttccaggctagaaaatcatttcgtttttgtaaggctaatagagcatatgaagagctttcgaatgataccaacaatcttggatttggatgccaaagaaaaaagttatagcgaaaaacataaaaatttttaaaatctgcccacagataacacacaagtacctttttttgtacgagttgccatgaaaccttttgttttaccaatttttgtgtttagacatttcgccgtgccaccacttctgtctgttacaatattcaactttatttttgggtggacacaatg

SEQ ID NO: 104253 - DNA, 426 bp, Heterodera glycines
  Promoter: Source sequence=SeqID_17200; Location=1..426; Strand=+; Gene=SeqID_81663
ttaagttttacgcgttttgctccttaaaatccttaataaaaagttttaaataacttttttcatgcctttttcgggattttcgtgccttttcatgctttttttcaattttttgcgccattaagtgcctttttcgcgatttttggcgcgccgttttttacattctctaataacaacaatgagcaaaaacaattgtttcgatgtccccaagaaacagttgtcattggaagagacaactgatcaatcagttcagtcaattttggccgcaatcgattcgcagaagcgccttttttaccctttaaaactgagggccaacatttcggatgcaaaaaaaacctaaaaatgcgctatccaatcttccaaatctttctgattatgtcttttatttgtcgctttaaatcggcggtaatcttccgatcggacacaatg

SEQ ID NO: 104254 - DNA, 184 bp, Heterodera glycines
  Promoter: Source sequence=SeqID_12321; Location=964..1147; Strand=-; Gene=SeqID_75917
ttccttctctttggttccattttcatgcagaattttctcacttaattaagttagcacaattttgtgcttttcctccccattatgttcctcgtcgtaattttgtgccatgtttggcttttatttaaatcaaaaccagcgaaaaagaaataaattattttattttcatatcaaatcagtgaaaatg

SEQ ID NO: 104255 - DNA, 241 bp, Heterodera glycines
  Promoter: Source sequence=SeqID_21454; Location=1..241; Strand=+; Gene=SeqID_52061
atgcaaagaaaatgaacaatcgaattttgaggaaacctcccagtttttggcttaataatttatgaatttcattttaaattctctcaaaatatttttcccgcattttaagttggatttgcactgatgttttgatggacattctgccattttttgaccatgcccaacttggcctcaaattggcactgatttcgccacgtttcgatgttttagtggacacgcattttgatggcaaaagcgaatg

SEQ ID NO: 104256 - DNA, 609 bp, Heterodera glycines
  misc_feature (46)..(48): n is a, c, g, or t
  misc_feature (53)..(53): n is a, c, g, or t
  misc_feature (73)..(73): n is a, c, g, or t
  misc_feature (96)..(97): n is a, c, g, or t
  misc_feature (105)..(108): n is a, c, g, or t
  misc_feature (118)..(118): n is a, c, g, or t
  misc_feature (134)..(135): n is a, c, g, or t
  misc_feature (138)..(139): n is a, c, g, or t
  misc_feature (142)..(143): n is a, c, g, or t
  misc_feature (146)..(147): n is a, c, g, or t
  misc_feature (150)..(150): n is a, c, g, or t
  misc_feature (156)..(156): n is a, c, g, or t
  misc_feature (160)..(160): n is a, c, g, or t
  misc_feature (162)..(162): n is a, c, g, or t
  misc_feature (165)..(168): n is a, c, g, or t
  misc_feature (173)..(174): n is a, c, g, or t
  misc_feature (177)..(177): n is a, c, g, or t
  misc_feature (179)..(179): n is a, c, g, or t
  misc_feature (184)..(185): n is a, c, g, or t
  misc_feature (195)..(196): n is a, c, g, or t
  misc_feature (204)..(204): n is a, c, g, or t
  misc_feature (206)..(207): n is a, c, g, or t
  misc_feature (225)..(225): n is a, c, g, or t
  misc_feature (229)..(229): n is a, c, g, or t
  misc_feature (236)..(238): n is a, c, g, or t
  misc_feature (246)..(250): n is a, c, g, or t
  misc_feature (258)..(258): n is a, c, g, or t
  misc_feature (267)..(268): n is a, c, g, or t
  misc_feature (277)..(277): n is a, c, g, or t
  misc_feature (281)..(281): n is a, c, g, or t
  misc_feature (284)..(285): n is a, c, g, or t
  misc_feature (300)..(300): n is a, c, g, or t
  misc_feature (317)..(317): n is a, c, g, or t
  misc_feature (327)..(327): n is a, c, g, or t
  misc_feature (330)..(330): n is a, c, g, or t
  misc_feature (336)..(336): n is a, c, g, or t
  misc_feature (338)..(339): n is a, c, g, or t
  misc_feature (343)..(343): n is a, c, g, or t
  misc_feature (347)..(347): n is a, c, g, or t
  misc_feature (351)..(351): n is a, c, g, or t
  misc_feature (355)..(357): n is a, c, g, or t
  misc_feature (369)..(369): n is a, c, g, or t
  misc_feature (380)..(381): n is a, c, g, or t
  misc_feature (390)..(391): n is a, c, g, or t
  misc_feature (394)..(394): n is a, c, g, or t
  misc_feature (408)..(408): n is a, c, g, or t
  misc_feature (414)..(417): n is a, c, g, or t
  misc_feature (420)..(420): n is a, c, g, or t
  misc_feature (424)..(427): n is a, c, g, or t
  misc_feature (433)..(436): n is a, c, g, or t
  misc_feature (438)..(438): n is a, c, g, or t
  misc_feature (448)..(448): n is a, c, g, or t
  misc_feature (457)..(457): n is a, c, g, or t
  misc_feature (466)..(468): n is a, c, g, or t
  misc_feature (474)..(474): n is a, c, g, or t
  Promoter: Source sequence=SeqID_13434; Location=1..609; Strand=+; Gene=SeqID_77324
aattttaactattgcccctgctctatgtgtactcctgttaagcaannngctgnccatgggcggaaaagagacncccctttcccccagggggcaacnnaggaacannnnggccaacgcnccacgggaaagaaggnncgnncannaannggnctatcngagngngannnncagcnnacncnccgcnngcaagggccnnggccgcgncnnccggggaaaagccgcggnccancacaaannnaaggaaannnnngcgggggnccgacgcannagaagaagncganggnncaacggcagaacaancggcagcagccgaggcngagggaaggncgncaaaananngccncagncganccannngagcagaagcancggccagaaannggcgaaggnnaancaccggagaaaggnaaggcnnnncancgcnnnncaaaannnnanccaaagacancaaaaggcnaaaaggggnnnagaaangggcaatcctgcagaatggatgtctaatttaactttgttattttagctaaaaatgtttgccattgtctaaactatgattttattactctgacaagtagggtggggatttatatggacataaaatcgcaaaatatg

SEQ ID NO: 104257 - DNA, 725 bp, Heterodera glycines
  Promoter: Source sequence=SeqID_2450; Location=1..725; Strand=+; Gene= SeqID_79789
aatacgagaaaatcttagaaaaatcaaaaaagaaaatttcaagaaaattcaaggaaataaaatcgatccctgtttaatccaatggtatataacacatacgcatttccgatttccagttcgggtgggtccattgttagattttcaaaaaagataaaatagtgttttttctttaaatgttttaatttttttggcggcggcgttatgtcccggcgtcgttttgtcggggatgtgattgtcctgttccggagccctccttaaatttttaaataaaaatctccgccccttcccccgcggcggaatttccatgccccgggcggtggcattctcagaaaaccttccagcgccctttgcccctctgctgccatcccaaaggatttgtttgcctctctctctctctctccgctgtctttggcacaattcgccccattcttttcccgccctttcgctcgataagtgaattccaaatttggcaccaccaattgctattcattgcgacacgaacggacaaatgtgggcaacacgcggacagacaaatcggaggaacagaagcaacacatttgtcaaaaaggacatccaattgtcataccaatcattagcactaattacatttaatttcgatcatttatttcattaatttggacagagcaatcaattaaagggggaacacaaaagggatgaaaaatgtcaattgaatggtttaaagagcagaaaagcgagcacaaatg

SEQ ID NO: 104258 - DNA, 79 bp, Heterodera glycines
  Promoter: Source sequence=SeqID_17439; Location=1..79; Strand=+; Gene= SeqID_81924
tgcgatttatctgtccagaaaccatttttccaaattcttagaagaaaaaaaagaaacctcgggaaattcgttgcaaatg

SEQ ID NO: 104259 - DNA, 93 bp, Heterodera glycines
  Promoter: Source sequence=SeqID_8290; Location=2486..2578; Strand=-; Gene=SeqID_67589
gcagtcagatgtatgggaatatttcgaatcgggactggccgggaattctattttacttggtgatagtggctatccattaaaaaatggctaatg

SEQ ID NO: 104260 - DNA, 325 bp, Heterodera glycines
  Promoter: Source sequence=SeqID_36701; Location=801..1125; Strand=-; Gene=SeqID_65950
ttgatgcgcaggtaatgcttaagccttcgatggatcacattattttgcttcgggggttgtcaaagaaacgaatgtagagtcaatgaaatccttagggagaccaaaatttattttgtggattgcggtgaaagtgacacaagtgcaagaaagaaaaaacagggatgttcatgaagagttggagagagctgaggaaggaggtagctttgtagcacatccgatgattccgcagggtttggagttgagaagggcatgttttgcgtcaaatcttccatctcgagttgccaagctggacacaaatcaaggaaagctgatgagggcagtaatg

SEQ ID NO: 104261 - DNA, 188 bp, Heterodera glycines
  Promoter: Source sequence=SeqID_42399; Location=130..317; Strand=-; Gene=SeqID_70295
aaaagggctacgacagggaatgggaagattgggaatccattcttgatgaaagggaatctaatgtgattccaattcctaattacggaggtctccctttcagagaacaggcatttgaactttcagtcccgtcggatattgcagaagggcaatatcccgtctcaaaaattttaaaaatattgatgggaatg

SEQ ID NO: 104262 - DNA, 157 bp, Heterodera glycines
  Promoter: Source sequence=SeqID_14025; Location=1350..1506; Strand=-; Gene=SeqID_78002
cagtcaagccaaactgtcacaaatccgaaaagggacgaaggccaaacaacaagcaagctcaatcatcatccgctccggcacaacaatgttggcgatgtggttggacaaatcacagccactgggagtgtaagcataagtcagcaaagtgccaaaaatg

SEQ ID NO: 104263 - DNA, 276 bp, Heterodera glycines
  Promoter: Source sequence=SeqID_1045; Location=1..276; Strand=+; Gene= SeqID_66816
acgctgaggacgccggtaaggggcaatttgtgtgtgattgaagacaggctgactgctgctggagttggttgttgttgttttttcctttcattttatcagtgcaatcaatacgttcccccttcgaaaaattgttttagttttataaatttcttaattttttcaaaacaatttacctttttttactcgataggagtatacggtagtatgtacccgtctactgtatcatgtacaagggtagtttcatcattgttaggctaataaacgattgggacaatg

SEQ ID NO: 104264 - DNA, 244 bp, Heterodera glycines
  Promoter: Source sequence=SeqID_2504; Location=2225..2468; Strand=-; Gene=SeqID_47315
agttatgtgtgaaataggtggagtgagggtggcaaaagccttaaatcttattgaagtctccaacgatatcgagagaaatgctgagggtttctctactcgcgggtcgagactctcgacacgccgagtaattatcatcctaaccgtcacccccaccctcgttgattatcaccttaattaatctaccctccccattttatgtgccatcgcccgaggatcgctacgacgaccgtgccgtggtccgatg

SEQ ID NO: 104265 - DNA, 227 bp, Heterodera glycines
  Promoter: Source sequence=SeqID_19907; Location=682..908; Strand=-; Gene=SeqID_84670
cccccccccccccccccccgccccgcccctccggcgagggcacctttccctaattggcttaatttaccaaaacagggtaataaaataagtaaaatgttttagtgttaacggatgttaacgatacggaagatcgtttaaaagaatttattggtgctgaaaacattgctacagctaatttgttgtttggcttaaacggggaagagtgcagaaaatttgttaaagtaatg

SEQ ID NO: 104266 - DNA, 176 bp, Heterodera glycines
  Promoter: Source sequence=SeqID_8592; Location=1..176; Strand=+; Gene= SeqID_68632
gctcaggaatagttcaccatctttcgggtctcagcgcatacgctctgtctccgccccatcgcatgcgatcgagacgggactatgttgcgccccaacaccgcagtgccagggatcacacatcagctccgtaagaagccttcactttcattgcgcctttgggttttgaacacccaatg

SEQ ID NO: 104267 - DNA, 230 bp, Heterodera glycines
  Promoter: Source sequence=SeqID_5199; Location=386..615; Strand=+; Gene=SeqID_57241
tgtatttggagggtgtcaaatcaatttttgtttcttccattttgtgcgaaatttgcaaaagaaattgaaggaacaaaatttgtggcaggttttaataatttttttttaaattattgcggcgccgaagtgcccccgacccgtttcagcgctactgcaccgattctgtgtttgccgagaacgctcgaatgatcacgtctgttgcgttcgtgcccttgtgtgacattagaatg

SEQ ID NO: 104268 - DNA, 438 bp, Heterodera glycines
  Promoter: Source sequence=SeqID_40640; Location=1..438; Strand=+; Gene=SeqID_68906
atactatcattcatctcaccataacaataaagaattttcttaggcggtggttcaattagattcttatgatgttttaaaattcgtaatagccaacgggtcttaccactcccggtagcccctgagagaattagagtgaacggaccgcgaaacatttttaatgcctcttatttatttgatctatttatattttcatagggaacatatttcgcgcatttggggcatatccagaaattatcaaaaaatgatgtaccgaaatgcaaaagactgtgctttttacacctgctacaaatctcgtaatgacagggacagtaatgacaacacttaattttatgtgggcagttcatttttcaatttaattttattttgggttgctatttatagaaggggtatataaagggagtgaaaggaccatttgattgataccttgtatcaaaaatg

SEQ ID NO: 104269 - DNA, 1003 bp, Heterodera glycines
  Promoter: Source sequence=SeqID_8120; Location=970..1972; Strand=+; Gene=SeqID_67037
tcggcataccccaaattaatttgatttcattttcttttatcagtaaaaatttttctgtcatttattttttcagtttttcttactgtatgtttttttttgtagcgcaagtaccgtaaccaaacaaaaaagcgtaccatcaattgactggttgtttctaatatcaaatgatccgaggtataataatagtaaagccctattagcaaaagtatctgatcaatttcaaataaccaaaacatgcccaagcaaaatcccttaattatgggtaattaacaaatattcgatcaaaatctagcaaatctatcaacagatcagagatatacaagagtaaagttaattttaatcgcctgtttaaatagattttcataatttttaaagattttccgttttttaattgagagttttcgaaattttaatcctttgaattgtccaagccttgaccccattaataaaacatgcccgagctaaatcccttaattatgggtaattaacaaagaaattttcgatcaaaatgttgcaaatcccttaattagtgtaaaagcgcctcaaattaactgctgctctccgcaaaaagcggtcactagcatcacagtgcaattagtagaagaatgtcagtgcaaaaagcagcacatttcaatttctgtatcaaattattcacactttagcaccgtaaagcactagcaaattactccatcactccaccattttcattttttttgggggggttgggattgatcacaaaataaatccagaaatttgcgaaatcccaaaaatgtcatcagagtcatggcatccccttgggggtgggcactgctggccgggacaaacaggatggaaagtggtggaaaagcatgctttttaaaagtggtcgccgggattgggatttgggtgggaacgggtgagtcccactttaagaaatgctttaacgcgcacccatttgggacatcccaaaaatgtcatcagagttatggcatcccctcgggggtgaagcatgcttttaaaaatg

SEQ ID NO: 104270 - DNA, 844 bp, Heterodera glycines
  Promoter: Source sequence=SeqID_6838; Location=1..844; Strand=+; Gene= SeqID_63050
gagagggggagagagagagagagaagagagagagagagagagaaagtgacagagaaagaatgtgagttaaagagagagagaaagaaagagagggcgagaccacatgctctctcatccacataaaacctttcagttgcgcaacaaacggatgccgaattcaaccaatgggactgaagggtatgtgactgattgaatggttagaataaaactgaacccgttcgggatcaatgcttcaggcaaatccagaagaatgtgccgtccgaagcgcgcagtgaaggcggtgccaccaaaagcactgcgtcaaaagtcagttttatgaagattgtgggtaattagctccttgagactctcgactttcataagttttaatgctcgagactctcatgccattgttaatactcagccaaaaatgaattttttgaacagaatcgcccggaggacaaagacggacgctacaccgaggcaaaggataattcgcaccgtgaggcgcgagcattgttcggcaagcagtgatcggaggcggatcaatcgatcagaagcaatcaataaccaatcgatcggagagaatttctgttcccgagttgcttttcgagactaacaaaagttaatagtattttggattcaataagttatcatcaaaatttttcgactaacgcagtgcaaaaatgaatttttgaaattttagtaagaaaattttatagaattttttaaggacaagatttataaggacttttggggaagctattctgattcgatgtttcgttctctagtcacaattctcgtttaaatatgcatttatttctcgactatcattaaatctcattttgaatgcatttacagtatg

SEQ ID NO: 104271 - DNA, 53 bp, Heterodera glycines
  Promoter: Source sequence=SeqID_287; Location=1650..1702; Strand=-; Gene=SeqID_81326
aataccccgcaaccattttgttttgtgtacactcactcattttgtaaaatatg

SEQ ID NO: 104272 - DNA, 789 bp, Heterodera glycines
  Promoter: Source sequence=SeqID_9565; Location=1324..2112; Strand=-; Gene=SeqID_71911
aatgccaatgcaaatcgaattgacttaggcaaagttagagttgagtgaattaataattttctttccattaaaaatttagcaatttgtcatgggttgttcagatctccttgactgatggagattattgtgttgttttttttttctgaaataaattttccccagcacgtttttctgctatcttttgaaaaaaagatttggtaccataactcattttttttaaatttatttttcttgttgctcgaaaagatcattttttgagcgagtttgacaaagttccaagcgtgaagttgtctaacaatattaagatgatgtatgtataattcaaggctaatgtattggttggatacatgtccgatgggttacagtgctctttccttgatattactatactgttttaaattcggttgatcactgcacttcttaaacgcactgtaccgtctcgtttaagacaacagcattgggccatgcgtaactgggcaccgcagcgtgtagcagatggaccggcagcgacactttttgacgccggcggcggcgccccggtcagcggttcgtcatccgcgacggcgggtggcggcattgttgtgcccggtctgctggagatggctcagcaccagcaccgcttcaacgccaacctgttcaaccggagcttttcctcctcctccaattcggcgatgccgtcatcggtggcggcggcaattgcttctcctccggccatcacttcaacgccaacgacggcggcactcgcggctgcttctcttcgctcgccggcagtcaccacatacaacaatg

SEQ ID NO: 104273 - DNA, 116 bp, Heterodera glycines
  Promoter: Source sequence=SeqID_6102; Location=1835..1950; Strand=-; Gene=SeqID_60341
agtagaaaagataaaataaaaaacaaaaatttaagatttttgcccgtttcagacgcgacgaggcgggccgtgccttctctgcagctgcacaactcgagctgagcgacacggccatg

SEQ ID NO: 104274 - DNA, 794 bp, Heterodera glycines
  Promoter: Source sequence=SeqID_3674; Location=1770..2563; Strand=-; Gene=SeqID_51406
tacaaaatcaagggttgacaaacccaatttaaaaaaaaaacacacacacacacacggatcaccaaacccaatcaaaaaaccgaaaaaggacaccataaaaagccaaacataattaaaagtcataataaaccctacagcaaacccatcactaatttaaataattaagtggacagagcgactcctaattcaattactccgacgaccaaagccaacacgaaaaagaaacaagtggcgaaaagcactacactgactgaacttataaaatttaaaaacacaaaccgaaatacaaattaacgaaacttcgcccgaaacatacagagaatatactgaaagaaatttacaaaaaaaaggagcaaataattaacaaaaacaaaaaaattctgtgattatatatattttttttaaatttcgtaacaattgttaattctgtgatcattaaaattataataatatttattaacttgtgataaatacctaattaaaattctcatttttctgattatccactaaataaccataaaaggatacttagttaattattttaaaattttaaaatacaaactatgtccggtacgcttcgtagcaaaatacccctccttaatcgcgtattaaaaagggaaatagaaacgatcaaaacaaaaattgaggaaaacaaattcgaatatgatcaaaataatcccggagaatgcatgcggatattcaataaaacaaaggaaattatccaaaaaatagagccaaattttgaaaaattaaaagccttaaataaaaggtggcaaaatttaatgagaaaaatg

SEQ ID NO: 104275 - DNA, 166 bp, Heterodera glycines
  misc_feature (11)..(11): n is a, c, g, or t
  Promoter: Source sequence=SeqID_2889; Location=1620..1785; Strand=-; Gene=SeqID_82203
tgctttatctncagtgaatggctggtaaaataaaataataatttacacttaaaatattcaaaaaaatctttaattttttttaaaacattaaaaatttatgttttaaaaagagatttttaatattgtatgaaataaacataggcatcactttgtgcgggttggcatg

SEQ ID NO: 104276 - DNA, 83 bp, Heterodera glycines
  Promoter: Source sequence=SeqID_2692; Location=4083..4165; Strand=+; Gene=SeqID_81110
attatggaaaaaaaggacacggagtcactgctcgactatgacgaggacgaccaagaaaagtcgacggagcagctaaaaaaatg

SEQ ID NO: 104277 - DNA, 122 bp, Heterodera glycines
  Promoter: Source sequence=SeqID_8378; Location=4058..4179; Strand=-; Gene=SeqID_67858
tttccgatccaaacaaatccaacggcacactttctacggtaattgaaaagctatcggaatttgagcgagaaatcgaaggaagtgaacgtaacagtgaaactgctgtgtacataaagggaatg

SEQ ID NO: 104278 - DNA, 68 bp, Heterodera glycines
  Promoter: Source sequence=SeqID_44333; Location=894..961; Strand=-; Gene=SeqID_71829
tttttcgggcgccctttttccacacaattgtcggtgccgggttgccctccacgacgcatttgatgatg

SEQ ID NO: 104279 - DNA, 206 bp, Heterodera glycines
  Promoter: Source sequence=SeqID_6370; Location=1431..1636; Strand=-; Gene=SeqID_61295
atgaccaattttgacaagcattgggcatttctgtcgtagcaaatcttggaaaaaaatgaaattcaagaccaattgaacccaaaaatttgaaaatttcggggatagggttggaaatcctctaaatctggtcttataacgagttgacgttcattaacaggaaacttgccgaagaacaaaacagtgtgtcgccagtgcgtccgaacatg

SEQ ID NO: 104280 - DNA, 58 bp, Heterodera glycines
  Promoter: Source sequence=SeqID_17808; Location=1..58; Strand=+; Gene= SeqID_82339
tcattttaacatactttgaatttttattaatctgctctttttatttcagtatcaaatg

SEQ ID NO: 104281 - DNA, 547 bp, Heterodera glycines
  Promoter: Source sequence=SeqID_871; Location=1..547; Strand=+; Gene =SeqID_62991
tcggcacacggtctctctctctttctctacccgctccctttccccgcccccttttgtacattttgctcttcaggtgttcgctttcttttggctttggtactgtctgcttttatgtgccacaacgtatgttttttatggggaatgaacgcggcttcttttccaaataaaaaggagaagtattccaaaacttttcttctcactccgtaaattgtgggggatataaaaagttggaaaaagctaattaatgacagggatggtccccggaattcggtgaggagggattaattaccgctagtgatgctcgaggtttcggtctcgagcatcactaattaccccctccccctccatctgctgaactcacagcaacacttggtaattaagctgttccgccctgttttggctcagcaacattctgttgcacatcgcccgggtggactacgtgctgaagtttatgcaaattgctgaacacagtgaacaacagcgaagcagcggcagaacgccaaaactatcgcaacaaaagtgggcgatggtggaggagggcgaaatg

SEQ ID NO: 104282 - DNA, 64 bp, Heterodera glycines
  Promoter: Source sequence=SeqID_9887; Location=1663..1726; Strand=-; Gene=SeqID_72915
ggttgttgactagtttcagtttcacatttttctaaatttcacttgcttcattctttaggtgatg

SEQ ID NO: 104283 - DNA, 84 bp, Heterodera glycines
  Promoter: Source sequence=SeqID_30832; Location=1292..1375; Strand=-; Gene=SeqID_61233
ggtaggcggtgtttttatttgctttttctttcggtttaatgttttgggttttttctctttgcaaaggttcttggcaaacatatg

SEQ ID NO: 104284 - DNA, 57 bp, Heterodera glycines
  Promoter: Source sequence=SeqID_28278; Location=1..57; Strand=+; Gene= SeqID_58907
tttaggagcatatgctttatttcatgatatttttaacgctttattcggctggagatg

SEQ ID NO: 104285 - DNA, 769 bp, Heterodera glycines
  misc_feature (151)..(151): n is a, c, g, or t
  Promoter: Source sequence=SeqID_15571; Location=1..769; Strand=+; Gene=SeqID_79855
aaatagttgttcaataaatttgaagcatttacttcaagaaaaatgtaatccttggaaaaaatttcaactttttgttagaattcgggtccggggttcggaattgggtaaatccgagttgagattcgtaatcagcacctcgaaaacctcttanaagttggtttcgaactcaaaataaaaaataaatttttttttttaaataatccgggaccacaattctttaccattgcccgaatttatttttatggcccaaaatggactttaaaaattgaaattggttttttttctccttttaattgtccattttcggctgccattgtttttgtcattaattcgttttctccatttttgttttgcttattttctcgccggttagtgggtgtgtaattaattaactgtaacttgttaattatgtaattagcgtgtaattataattgattgtctaattgacctaaactcattagcaacatttgttgttaaactgttgttttgtttttcctaacttgtcaaaatcaatttttgcccagcagtcagttccttcttcgtttgttcttcattcatccgccaatttgtactcattaattaatgtccattagaaatgcttcctcccctgataatgatgatcattaaaatggtgctcttttaaatgttttttaatatttttttctcaaaattttcgtttaaaaattcaatttatttttcaagtttagttttttgtatttattttaaatttaattcccacagttttttgttttgatgtaaatttttaatg

SEQ ID NO: 104286 - DNA, 267 bp, Heterodera glycines
  Promoter: Source sequence=SeqID_6795; Location=2298..2564; Strand=-; Gene=SeqID_62936
actttgtatatgtaaagtatgaagcagatatcatgatcatacatagatagatcactttaaattgccttataataaatgagattttggaggaaatgtcgcaacaaaaaaaaaccaaaatgattatgcagaagtgctcatcacattcggctttttgcaaatatgtttgtacatgatgatgatgatgatgatgatgttgttgttttgctcccaaatacataacaaaacaaattgtaaaattataagtaaataaatgactaaaaaaacatg

SEQ ID NO: 104287 - DNA, 67 bp, Heterodera glycines
  Promoter: Source sequence=SeqID_3282; Location=1031..1097; Strand=-; Gene=SeqID_84044
cgtttgccccccccccacttttttaacttaatttttcattttccagccgcctattgaaaaaacaatg

SEQ ID NO: 104288 - DNA, 68 bp, Heterodera glycines
  Promoter: Source sequence=SeqID_20933; Location=1272..1339; Strand=-; Gene=SeqID_51516
acggctcgcagcagcacattcggcgtgatgcggatttccaagagcgcagtcgcagccgtggcggcatg

SEQ ID NO: 104289 - DNA, 577 bp, Heterodera glycines
  Promoter: Source sequence=SeqID_1761; Location=2410..2986; Strand=-; Gene=SeqID_75762
tgcgcgcacccattttatggtggaccttgtggggagtacaattaaacttcccaaagcggcgcttttcttttaccccccccccccccccttcattactaattaattaaatttaattaaaaattatttcaatttcccttgcaattatactatttattctcccatcacatttctgatttaattttgcaatttcttacttttccccctccaatttctattttttcgcattaaaaattatattttttttgtttgattttcctgtattcttttattaatcactcccaccattttttttctttctttcctatttatcattactaaaatgtttaaccaataaccaaaattaatagtaatattaatgaaaatgctttgaatagtaaatattgaataattttgtttattaaattaacaaataaagtattttaacaagtgatgtgttaaggccgtgccaacgatcaacccgaaattacattgaggagacaatacgactggacaaaacactaacacggcgctgacattggtcacagaccccaaatgaggcaaatggaaagactcggcggacacggaccacagccaaatg

SEQ ID NO: 104290 - DNA, 894 bp, Heterodera glycines
  Promoter: Source sequence=SeqID_1987; Location=519..1412; Strand=-; Gene=SeqID_77205
gcagcagaggacgccaattcgtccgttcattgagcattgtcggacgccagtgggtaagcaaaaaacaaaaaaaaaaaaaatcatgaaacataaaaatggttcctctccccgcccccgagttttttttttaattttccaaaatttcaattttttggaaaatctgtttaaatcggtcaaaattcaaaggtttttccgatggacttacttacgggtctgggtacgcccttgattagaatgttttttcttaagaaatttcaaaaaaaaaaaaatttttttttaattttgcagcaattttttcaaaattttcttgcgggggtaggaaacgaattgctcccggtgggttgaccgttgggccgagtattttttttctatcggatttttcgctgaattttttcaaaaaatttgcaccgttcggcgacacttttttgggactgccattttaaatttgtttttttttacatcattatttaattctatacatttttcagatcgcgttttggactttttgatgggtgaaagtatcaacagtcggtcggtttttaacattttttttcactgatttattatagcaaaacaaaaaaaggaaattttttccgaaaaaatattaaattaaaaaaaaattcgagggagggcggaagaacggtacgggggaaacgaacttctcccattttattcatttattttttgccccattagaattcatagccctgacaaaacatttatcagaaacatttctgtggtcttccatcggtgctgatgtgtgccgctggggaaaaaattttattttattttttgaatttttgtgaatttctaacccaattttttgcccatttgattgttttcttgtacagttacgcgctgatctgtgcccattgtcacacccacaacggcatg

SEQ ID NO: 104291 - DNA, 60 bp, Heterodera glycines
  Promoter: Source sequence=SeqID_14743; Location=1360..1419; Strand=+; Gene=SeqID_78871
ttcttgcgacccatggcttaaatagcggccaattgtgaactaggccagagagcaaaaatg

SEQ ID NO: 104292 - DNA, 1003 bp, Heterodera glycines
  Promoter: Source sequence=SeqID_1000; Location=2195..3197; Strand=-; Gene=SeqID_65725
gctgctggaggtggtcgggtcgttttggcgccgacgttttggagccagcccaagttttcggactataacttttttttattgttaaccaaatttaacattcttgttatcattcgaaagattaacgtgtttagaagctgtttctaagctattgtttcgtgattagacaattaccaaaaaagttataacatgaaattacaaaaaaaaaaccaaaattttggaagttttttcttaatacattttttacaggtacattttttacaggctaaaaaatctttttgctttttgtaaggctaatagagcacgtgaagggctttcgaatgataccaagattgtttaatttggcctacaacaaaaaaagttataatcaaaaaactcgcgctggcgccaaaacgtgggcgccaaaacgacccagttccgctggtagggctcggcttcgccgccgccaactcggcctctggccgcgagtttttcgctgcgagagtattttatgattccagtcagttgacaatctcgggtttttatacaataactttgttcatattcgaacaaaccctatcagcaaatattttttgttaattgcctaaacattgcgatttataaattttagcttcgttagacttagtgctttcgaatgctaccaataagatagagtgatgttctttggttctttgatgcggaagagcaaaagatcaacccacggtgggactcgaacccacgaccccagctttccgtgctgtgctctaaccaactgagctacgcaggcatcctctccattgctctcttctctctcctatcttaggaggagaatcactctcttaatctccttcactgccgtcttggcacaaggggagagagtgaccgcatttatcacatccccggcctttgagaagaccggtccccggtctctttgatgagaaagctccagtctttggataacttctctcagagtggggagggggagctgtcggcttgacacaaactccacaccgaatgtgattccatg

SEQ ID NO: 104293 - DNA, 85 bp, Heterodera glycines
  Promoter: Source sequence=SeqID_29245; Location=1..85; Strand=+; Gene= SeqID_59770
gcggtacgccccgctcggcgaccacagcagcggcggcgattgtggcggtggcagcgcaacgcgcgcggcagcagcggcaaaaatg

SEQ ID NO: 104294 - DNA, 379 bp, Heterodera glycines
  Promoter: Source sequence=SeqID_2387; Location=1004..1382; Strand=+; Gene=SeqID_79480
tcttaaaatatttaaaaaattatcttaatacaaatttatttttttgaaaatcaaaaatttaaaaattttcattttcccacttttgcttaaaataattaaaaatattcactgtttttgtgaggaaattgatgactccaaaatgatggcttttcctttgtcatttttggtttgctttggcactgtgcgaattttaatggcgcgccaaattattgtgacatttttgttgccatcttttggcatcttttgcacacattctttttcaatcgaatttccctggggaattaatatgtaattttaattaggtattacccaaatttaccattttagcgccaataatagattttcttttgacttttgaatttccgcttttctccaaatg

SEQ ID NO: 104295 - DNA, 168 bp, Heterodera glycines
  Promoter: Source sequence=SeqID_21155; Location=1..168; Strand=+; Gene=SeqID_51736
aatttagtgcccaaacttcccggtgcccaaatttctcgctgtccaaacttcctggtgcccaaacttcccggtgcccaaacttccgccccccatttaaatggtgtctttccaatcctttccccacactcttcattcatttatattatttattgtttttattaccacatg

SEQ ID NO: 104296 - DNA, 1003 bp, Heterodera glycines
  Promoter: Source sequence=SeqID_19368; Location=629..1631; Strand=-; Gene=SeqID_84097
acttcgtaaaggcgaaaagattaaacaattaaagattttcaagattgaaatagacaatttttcgttagatttcggcaccgccccctccaggggtggggcgcgcacaaaaaaaaaaccgcggccgcacattcaaattgccgcggccgcgcatcgcgcaaaaaaaaaaccgcgcaccgcgcattaaattgccgcggatcgcggatcgcgcatttaaaactcaaaattttctaatttttaaaccgttttttaactttttttttaaattttcttatataaaaaagtaattaaaatcccgaagggactgaatgggggaggaggtgagtcagtgttcaaatttgcgaaggaattccagtcatgaaatcctatgattttttgtttttcagaagcttttttcggcgcgctttttctaaacttttgtgaactgataggggggggggtggatccagcggtgccgataggcgccgcagggaaaaattttgaaaattttagtgcaatttggttaaagttttgtaaaaaaatgacctattttgtgatttagagccaatttttttaaagaaaaattaaggttttctcagctctgacgggaaaaattggaattttaaaacgaatttttgagaaaataatacaagttttcaaaaaaaatttcatttaaattttgaatattcaaaaaagacatcgtttcaaaaatttttctttatagaaattttacaaccaaaaaatgcgcggcgcaccgcgcaaaaaaaaaaaaccgcggccgcgcaccgcgcattcaaattgccgcggccgcggatcgcgcaaaaaaaaacgccgcgaatcgcggtcgcctccagccctgcgacctaccctagtttggacccaagacaaacagtaaaataaaaatggctgcattcaaataatcttttttttctctagctctgttttctccatttctgacttttaaatttgtaaatttattttgccgtccgtctattcttcaccgttttgttcgaattccttcaaaatg

SEQ ID NO: 104297 - DNA, 274 bp, Heterodera glycines
  Promoter: Source sequence=SeqID_12133; Location=1..274; Strand=+; Gene=SeqID_75710
gagagctgttttttatattacgccggctctgatgcacccaccgacgaaatttcttcattggccgttgatccctcgaacatcaatgactcgccttcaggtcataattggggtgacagggaaatccaaggaaacccgaatcccccgaaatccccctgcgccccgcttctttccgcctgccaaccgtgcccttcctttgagccgcactttgccgttgtccaactgtactcgcccacaaccttcaccaaaatctgctcaaatcgaacgaacggcgatg

SEQ ID NO: 104298 - DNA, 77 bp, Heterodera glycines
  Promoter: Source sequence=SeqID_38087; Location=1203..1279; Strand=-; Gene=SeqID_67007
agtgatgaaaagggagtcaaattagcataattgaaaggtttcagggcattgagaatcgtcagacaaagcgcagaatg

SEQ ID NO: 104299 - DNA, 89 bp, Heterodera glycines
  Promoter: Source sequence=SeqID_7144; Location=653..741; Strand=-; Gene=SeqID_46376
cacaattagcactgttttaaggaatacaaaaacattgtccacaaatttcctccaattaaaaaaacatttcagagcgtttcctgcaaatg

SEQ ID NO: 104300 - DNA, 192 bp, Heterodera glycines
  Promoter: Source sequence=SeqID_995; Location=1725..1916; Strand=+; Gene=SeqID_65600
ggtaagaaatggaataattataagtccaaggagaaatattgacgaaattttatgaacaacaaaatttcctttcttttcccctgggggtgcatcggcgtattactcgcatatgaatgaataaatgggttattgttttcctattataatttcatcttcttccacagggctgtgattagcatcaaagctgagatg

SEQ ID NO: 104301 - DNA, 224 bp, Heterodera glycines
  Promoter: Source sequence=SeqID_15021; Location=1..224; Strand=+; Gene=SeqID_79182
agcctcagacctggggacccctgattaataacaagctaattatgagcaactttctgtgattaaacattagggcttccattttttctaagaaactgctaatttttttttttggacctaattaaatttgttttacaataacaaacggacattccaaagacaattttttaaaatgaaatgatattgtttgacctcataaataattctttttaatttctaagattatg

SEQ ID NO: 104302 - DNA, 431 bp, Heterodera glycines
  Promoter: Source sequence=SeqID_25417; Location=810..1240; Strand=-; Gene=SeqID_56159
ttgtgtgccactgaatagcagaggatatgaatttttgagcactaacattaaataggggggggggggtttgtcgaggccgtttctgaacacaaatggaggggatgtaaaaagaagacaaaaaaacacacgaaaaaaaagagaaaaaactcacaaaaatgttgcaacgggtgcacttctatatgggcaaatggtagtagcgaaggtgaaaaggatgaaaacgcatccccttatatatcaaatgaaatttggcaaaatgttgggtttaagaattgtcgtggctgagattgaataaaaggaaccgacattcgcattttcgctcacttcccaataataaaataatctcaacgacgataattgcgcaaacactttcaacccacacatcttccacacacgtcaacttcgaccgcgcttgttctccaatcaaccaaatg

SEQ ID NO: 104303 - DNA, 621 bp, Heterodera glycines
  Promoter: Source sequence=SeqID_5485; Location=928..1548; Strand=-; Gene=SeqID_58220
ctaagagtctgtagtctgtgtccagccagatctggctttttctgcgtctggatttttgtccagaaaatataaacagttccaagcaagtctggttgctgaaatttgtgccaaactaaaataggattttaaaaccaatctctatgaactttcgagtataaaaaaagacagaatttgttgaaatcgccgaaaatattcgcctgcaccgagaattgtagaaacaacattgcactcatccggcactttgcaatttcaggtttactttttaaacaaatcatttttgacataataacctaaaatgaggctttgtagggtcgtttcctttgttttcttaagctttgacgttcaaaaatttttttttcacttaatttaaaaaagaattacctagcctattttacaactagcaccaaaaatttaatgccaaaaagctaaataggaaaacaaaaattagcagaagtgccgccgtatgaatacaatgtttaactattttattaatttttttgcacttaacgtgttctaaacctttgtattatgataccatttactatacatttttttaaattaaccgtttgtaatttattttcaaaaaaaaaagttattttacagagactcttaaaagtgatg

SEQ ID NO: 104304 - DNA, 133 bp, Heterodera glycines
  Promoter: Source sequence=SeqID_6980; Location=489..621; Strand=+; Gene=SeqID_63476
atcagcttaacattgatttggagaagccgctatatccagtttcaacaatgaattgggggggggggaatggaaaaattgatcctattttcgttgttaaatgaccaaaatcattgctttatccccccaggcgatg

SEQ ID NO: 104305 - DNA, 412 bp, Heterodera glycines
  Promoter: Source sequence=SeqID_11619; Location=466..877; Strand=+; Gene=SeqID_75067
atatttataattgattaattcgattgtgaaaaatagggatggtaattatattaggtttttatagattttttccaaaattagaatatctagggtcaaaaattagaacatttaacaacatagcttgaaatatttttacaatttaatcaattaatgtcaatttctgtattttcgcctcctattatcattttaaacaattttaaggaaattagaaaatcgtaaactgcatagggatcaaaaatcaagaattttttcgcagtgaattttttcaaaaactttaggggaacagggggagggccggcggtgccgataggcgccgccgggaaaattttgaatttgaaatgtaatttgttaacagaatttatcaaatgacaatattttttaatttaaaattcaagatcttaattaaaaaatg

SEQ ID NO: 104306 - DNA, 288 bp, Heterodera glycines
  Promoter: Source sequence=SeqID_14709; Location=1..288; Strand=+; Gene=SeqID_78825
aggggggggggggtgattgagaaaaagtaagaaagatttaaacaaattttcttgcggggtacctgttggtacgttgctaggtcgttacacaaattttcgtttttgatctcattcgaaagcctaaatttgatcactcgaggctgatcaggcttataaagataattattcaattctattgtcattgtccctcactataaaatgcttttattagttgattaaaatcaattgataattgcgttttaattaaaataaaaatttaattaaaaaattacattttaaaataccatg

SEQ ID NO: 104307 - DNA, 245 bp, Heterodera glycines
  Promoter: Source sequence=SeqID_2754; Location=5924..6168; Strand=+; Gene=SeqID_81427
gtcgtcaaaaaataatttgatttattattttttttaaaagatgtatggaattgtggccacagtgggcgaaattggctctgtgttcgccccttatttggatagaattgtgagtgggaaatttataaacaaataatcaaattagctttcgaatttatgataattattcaagttgttatttttaaagaaatcaacaacattttacaccttttcattgctcctttccctgtcagggtgacgaaaatatg

SEQ ID NO: 104308 - DNA, 210 bp, Heterodera glycines
  Promoter: Source sequence=SeqID_25593; Location=1..210; Strand=+; Gene=SeqID_56331
ttgattttttttggacatttctttattaccaatgaaatgattgtctagagaatttagaaatacagtagttaaggtgtttccctccagcccgcttagaaaaaaaaaaattaaaaattactagggtaatacataagtagggttgcgattttaatgaagaaaactcgaaatagtttttcatgaaaataagcaaattttaaattttctcgcatg

SEQ ID NO: 104309 - DNA, 499 bp, Heterodera glycines
  misc_feature (68)..(68): n is a, c, g, or t
  Promoter: Source sequence=SeqID_1444; Location=950..1448; Strand=-; Gene=SeqID_73582
ttttgtaaaatataaaaaagatttaaaattttggatcatacttgacttctttgttatttgttatattntaatttttttcacgtaaaatatttgaaaattcgattttttctgttttgtattaaaaaaagttaaaacaaaaaatgaaaaactgtggaagagcgaccataaaatcagaagtgtaacccggaatttattgaaaactttattaaaaattttaatggaatttatgcataaaacgaccaattctgcagattaagtcattttttcggcaccactggaggaatttggaaatatgtactggaaaccaatatgacttatttgaggtttttgggtttaatttttgaaaatccaaaaaaaagaagataaaatggtaatatgcgctaaaacataagtggacgcgtttcgcgcaaaaaagtcgccgcgataagcagtcgccacaaaatttcaaaatgaattcgcaaaatttggacatacaaaataaagttggtaggtgacaatg

SEQ ID NO: 104310 - DNA, 500 bp, Heterodera glycines
  Promoter: Source sequence=SeqID_8472; Location=1478..1977; Strand=+; Gene=SeqID_68191
tttttcgtaattggaatgcaacatttgactcaaacttcagtttcttattttcaaaaaaatttgaattgtcatacctaagaaaaatagctttatatttattatcagggctgtccgtccaaaatatgcaaatgcatatttttttcctggattctacgtagtcggatataggaaaaacattttcttttgggttacttagggtggaacataatttttgatacccaaattttttccaatttttaaaaattcataactccgttatttctgcgcctatttaaatgattctttttttattttgttcttcatggtgtcctcttttatatctcttactatcgtttcactttttatttgattgatagatttttctgccttttttcccgaccatgccaaaattgaaaattggcccactaatttttctcgaattttttatggtcaaaaaccaaagctgatataacaaaatcttagtttttctatacaatttagaccagtagaatccgaatatg

SEQ ID NO: 104311 - DNA, 834 bp, Heterodera glycines
  Promoter: Source sequence=SeqID_18750; Location=2070..2903; Strand=+; Gene=SeqID_83426
aatctgctcccgatggtgatgtaatgaacgatttcgtcaatagcattcaagcggcgacaagcaatatgcaatagcaaaaaaaagcttaaacgatggactcgctctgccctatatataaaagttgttgattgctcaatttgtggttctccatactattattcacattttaaaaatgttaaattctcaatcgttcagtaataaagacatttgtttcaaattgccttgcggtataattatttccgggccatcctatcgggcaaaacggaattcctactaaaatttattgctgagtgcaatgaactgatcgcacccagtcccatctcaattatgtactgttttggtgaaatgaattcggcggttccgctactgcaaaaggcgggagttgaggtgtattcgggcgtgccctcggaggagctgattaggcgtcttcccaaaccgatgctgctcatctcgacgatctgatgttgtcaatcgatgagcgctatctgtccgatttgttcaccaaaaaatcgcatcaccatcagtttgcggttgtgttcatcactcagaatttgtttgagcggaagatcaaggtggcgtgcctttcggcgcagtatttggtgctaatgcgcgcgcccaactctctgctgtccattcgaaatattggagttcagctttctccgcgtcaactcgattttttccttgacgcctaccgcaaggcgaccgcccgcccctatggttatttgctaatcgatatgcacgcatcatctgatccagcgcttcgcctccgcaccaacatatttaaagaggagcaggatgaggacgtgggaacagttgtgttcatccccaaaaatg

SEQ ID NO: 104312 - DNA, 620 bp, Heterodera glycines
  Promoter: Source sequence=SeqID_13378; Location=971..1590; Strand=+; Gene=SeqID_77262
atggcggattaaggaattgatttgaatttcttcatattccaattcaatttttaaaataatttttatgaatttttttctttaaattattttctcaaggaaaaagttccagtcccgatcgaaaatcaaggtccccccggtcccggtttttccaaaaatccccggtcccgctctactctattacaaaaaactattagtttttttaaatttttttaaatttaaaattaaaatactttaaaaaaagttttccctttcttttggccaaaacacaatttttgagaatacaattcattaatttttttttttcttttctgtggatggaggtcatttcttatgctttttatacaattttgttgtgaattttttgaaaaatttattaaatatttaaaaaaatttggatttgcaaataattgtttccttttaatttaattgaaaatttaaaaaattatcccaaaaataaattttacagatcgaaaccggacggagaattggcttttgcgctgcaattggaccaaattttgggcaaagttttcgctttcaatttaggcaggcatttttttagaaaaaaaatatctgccaaaaaccaaaaatttggcatttttttagttgaacaggaaccaatg

SEQ ID NO: 104313 - DNA, 216 bp, Heterodera glycines
  Promoter: Source sequence=SeqID_2511; Location=5447..5662; Strand=-; Gene=SeqID_80147
ataaattattagtctctttcagtgaaaaagaaaaaatcattttgtgtcattttaaggaaatcatggaaatgattgttgagcttgagaatcggatcaaagcctaccgattcgtggcttattccgccgtttgcttttccgtcgtttcggatgctcagcgttgtgtgttacagcttcccctcggtgtacaactatgtgcaccacgtgcgccgtagcatg

SEQ ID NO: 104314 - DNA, 292 bp, Heterodera glycines
  Promoter: Source sequence=SeqID_2606; Location=1872..2163; Strand=-; Gene=SeqID_80675
tttcctgcaataaatgttttcatataaaggtttaaaaaattcgatcgggtttagaatcgttcaacaaatgcatagataaattttttgaatattatacaatcgtgctttttgctctctatcaatttattataaaaactagcgggtgcgtgaaccgtcggatctgggctgggaaaaagcgcttcgcgctttgtgagcttcgctacctaggcgcgttttagtctgttagggtctttgcgtcagccgacatgcacttggtttcctccaataattggagttgacacatcgcataatg

SEQ ID NO: 104315 - DNA, 1003 bp, Heterodera glycines
  Promoter: Source sequence=SeqID_15860; Location=366..1368; Strand=+; Gene=SeqID_47321
ccgcttatcatttgttgctattcatctctcaattaactaattaattaccttaattacccttacacaattgccaaggtcacttctctttcttgctaggtgagcaaaagttttggagcaattactacaaaacattaaacagttgttgctctatctgcagaatatatttttaaatggcttgaaaaatatgtataatataaaaatttaataaaaataaataaaaggattttaaattcattttccaaattattcattcacaataaataaaataaaaaagttattatttatccataaaaatcataaaatagtttatttttaagttttttttaaattatatatttttgccttataaattaatggaaagaaatattttttgaatttaaataaaatttccttttttccgttttaatttaatgctttaagtcacttgttcaaaaaatgcccaagttatttttactaattatatttttaaatgcccaaattcctcccccccccctttccttttccaaattttcgccctttccttttccaaatttcgttgcgctttctcttttccatcagggattcctcttcttctctgttttttcacaagcctcccatccattcgtcttgcgcactgactctgaccagcccccccccaaataacaacaatttctcatcgattctttccgtccatcgttatcgccgcaactgggtcttttagttggcgtcgcaactgcctccaccagtcgccccccccctaagtaacagcaatttttcattgattcttttccgcccatcgccgttatttccgcaactttggatggcgttgaatttgaaaaaaattattcattcgttttatgcgattaaagattttaccaaatttaatatttaattcttttaatttttttacttatattcaaataaaatttaaatcccgaatcccataataaaaattaggaatattttctgtcatgtggtcctttttcaaaattatttaatttttttcattcagtatttacaaatg

SEQ ID NO: 104316 - DNA, 174 bp, Heterodera glycines
  misc_feature (86)..(86): n is a, c, g, or t
  misc_feature (149)..(149): n is a, c, g, or t
  Promoter: Source sequence=SeqID_32286; Location=1219..1392; Strand=-; Gene=SeqID_62595
catttgtgaataattttcataagttaaattgccaattatgggatattctactgcaataaattggactgggaggcccattccaaatntaccagatttttgggccttcggaattcgaagtttttttcggggcctttggtcccatctctgantacatatacatgacctgttcagatg

SEQ ID NO: 104317 - DNA, 105 bp, Heterodera glycines
  Promoter: Source sequence=SeqID_10608; Location=1041..1145; Strand=+; Gene=SeqID_73841
ttgcaaacaccgaggagctgaaaatttatataaaatgaccatttaaacctgttttttttttttgcagaattttcctagtcgtacaaaaatctaaccctgaaaatg

SEQ ID NO: 104318 - DNA, 567 bp, Heterodera glycines
  Promoter: Source sequence=SeqID_13043; Location=1462..2028; Strand=+; Gene=SeqID_76825
tttccgccgccttttcccaaacatttttaacgcgtagcggcaaaatgtgtgcttttaataaataaataatatgcccaatcgttctgtgtcattttataatgatgagcaaaaagccagcagcagcaaattaagaaattcacatgcggccaaagtaaagaaatttttaaaatttaaaattaataataattaaaaattcgaaaattcgaaaatttccgttttgagaaaaatttttctaaaattaaaaaggaatatagcaaaaattagaattgttttccaaattagcaaccacgggttttcatttattaattattaaaaaattattttgcatttttttgaaaaatttttcatcaaaaaaccaaaaacgcacgcaaagtatcggattcttcgaaaaattatttgtatttcgtttatttcgaaatttaaatatattcttaaataaaaatcaaccctcgcgtctgcgctaatgtgaaatcccagccgaaccagcaggtggtcccaaaccgatcgcaaccttacaaaaatggtgccaaaaagaagagcacttcttttgaggcaatgtccacgatg

SEQ ID NO: 104319 - DNA, 74 bp, Heterodera glycines
  Promoter: Source sequence=SeqID_16745; Location=490..563; Strand=-; Gene=SeqID_47391
caaaagggatgaagaggaggacaaaagggaggaagaggagcacaaaagggaggaaggggaggacaaaagggatg

SEQ ID NO: 104320 - DNA, 1003 bp, Heterodera glycines
  Promoter: Source sequence=SeqID_1639; Location=7342..8344; Strand=+; Gene=SeqID_75005
aaaatgacaaccctgacaatttccactcgaaaatatgtacattttcatttattcctcaatctaattttcatcatatcatccttattaaatatatttatgatctctatactcatctgcgcctgacaaatcagtgtaattgagctagataaaatgccagtccctggttgaaattttggttacgccacccgaaattgaaattgatcagaaaaaatgaaaattagaactttgttcttattgactgtaaagtgagttatttctatttttacaatgacattttagcagctggacttttcggtaatatttcgagctaaaatggcaggaaatacttttatattaacccgaacctaagagagattaactttggtacaaacgcattctcgggtcaccagtcatgaattgcttttcagagcatagtcaacaaaatgacagcacagactttttgtttgcactcagactcaacggcccaataattacgctacagttaagtggatacagaagaaagttactgtacagccccaatcaatttcttactaattaaaacgcaaaattatgccaaaggaattgcaagcaatcaatgcctcgcggcatgttaacttatggaaaatttaagacattctttgcgattgtagacaaaactttcaaaaaattatttagataaagatgaaataatttagtatgctgttggaagaaaaaaattaaaatttttcgtactttgcggcaaataatttcaacataactccaaacacacaaaaattcgttgagggaagagtggaatccttattaagtctagtcaacaattattaatttaaaggacaagcgcgtaattgagtttttaatagggcttattccatgtgttaacgtccctcttgggggaacagtcaaattggtggcaataaatctgccaaatagaaccaagaaattttatcaaagcattttttaaaagaataaattaatttcgttgaagatataaataaatttttgtacatttggcaattcaaatatg

SEQ ID NO: 104321 - DNA, 392 bp, Heterodera glycines
  Promoter: Source sequence=SeqID_36225; Location=843..1234; Strand=-; Gene=SeqID_65606
tttttggcttatttgttgttgtcatcatttttcttgccgtattcattggcatttgttcctcacttccaattcctttattattttccccattttcctttttcatatttttggcactttttctccatcttcctccctcaattgccattggataatcgcccttctgaaacattttccaccgcgcccgaaccaaagagggcgatttgccattgcagaaggaatgggcacaacagcagacaaactttgggaaagaaaggcaaaatggggaaaagaatgagcagacaaacgaactgattggccatcggaggaaagggaacagcccgaggcaatgcaaaggtcggaagagttggcacaacccgagaggatttggccctaaagggacaaagaaagcaatg

SEQ ID NO: 104322 - DNA, 931 bp, Heterodera glycines
  Promoter: Source sequence=SeqID_6761; Location=1626..2556; Strand=+; Gene=SeqID_46307
agcagcacaaccttgaaccccaccgatcggtagccgaattgtttttgcttattttatttgttattgtaagccgaggggaccgtcttttctagtgggcggtgatgtgctaattgacttcatttcaattttaaattattaatttctgtggcgtttcgtatatttttaagagactcaatatattttgtgatgtttttggttgttttatgtagtttttaattttggagaagaaattgtgctgaatttattatttttgtttgtcgtcgtattttaactgtttggtataaatttatttgtgttttgttttgttttgtaaagacagatcgcagagaactgttgacaatcgccgttttgacatttgaattgggaaaagtggacgcaaacaagcttttgttttcaacttggcgctcctgcaacaaaaggttggcttgcttagtgacgactaaacggaaaacttttacgtcggccatataagttgcgataatcctcgtgttggattttggattttatcgacattatcatatatcgacattatcattttttctgtcctcgtgttggactcttcatgcatcccaccgaattataaagcactcgtgttgtgctcttcaagattctccaataaagcactcgtgttgtgctcttcaagattctccaataaagcactcgtgttgtgctcttcaagattctccaataaagcactcgtgttgtgctcttcaagattctccaataaaactcgtgttgttttaaaaagatgattaaccgctctccaccattcaccagacaacgagctcgagatgcggcggcattacagcaacagcaaaacggagttgtagggaatttaagcaggccgaataacaccgctaacacataaaatcgaaatgtttcgttgaataaccgggttgatggtgaacttttagagtcagaagaaagcatg

SEQ ID NO: 104323 - DNA, 691 bp, Heterodera glycines
  Promoter: Source sequence=SeqID_27555; Location=248..938; Strand=-; Gene=SeqID_58256
tttttatttgttcgtatttggcatttaaatagcaatttaaaatattagaaattcaatttaaaaatgatgggaattttctgccataaaaaacaattttctttatttcttcagtgactattcgttttttgttgcgtttgatcagtgtgaaatttgattcaattacgaattgcgcccaaatgcccccggggtgcacagtgtacaaaaaatgaaagtgtttgacccttcactctctcgcgacaatttggcctccaaattggcgacaacaatgggacacaaactttgccctctcttttctgaatttctctcccctccccgcaattctgcgcattttgtaattcattcttttgcccctcgaccatttgagcgcattttttgtcattacattccaattaaaatcaaataaaataaaattaaataaaattaaaataaaataaagcacaaaacagaaaatagcagaaaggagaaaagaagaaaagaggggagagaagaaggaatgggaggaaaagcatcacaataataagtgtttatataatggaaagggatgataaataaataaataaataaaaaataataataaaggaaggaaggaaaaagacagatggccaaacaaaaagtggcatcaacaaacgaacaaatggcacaataaaaacaaattaaaaataatgacaccgaatttgacaacaaaggaatg

SEQ ID NO: 104324 - DNA, 1003 bp, Heterodera glycines
  Promoter: Source sequence=SeqID_10110; Location=2105..3107; Strand=+; Gene=SeqID_73193
aataagcaaaaatattagttctggaccgggttcgaacctccgctctttttctcttttaaatgaatttttcttaacaaatatttgtaaaaaaataatatgaaaacacacgcaaattcacctttatttaccaaatggatcaaaaaaggcaaaatatgatttatcaaagatgaagctgcattatggttgcgccacatctatttcaaaagaagtctcggcattttttgtattctcggcactttaaaaaaaaattaattattctacgtatgcatccattctttataacaacaaattctttatttaatttatttgtttgtctttatgtttaaatatctttaaaaaagaaattttcatatatggccacttccagtaggaattgagagaatgcaaaatcactttgaggggaggtggggggcagcaacacaacgacgacgggacgtcgcaatttgcgcatcgcataataatagacaacggcggatggacactgctgatcaccaccgattgggcagactgatcggagccattgtgttgcacagagattgtgacggccgcagaattggagtggctcaaaattgtccacattttgacgcaaaatttcgcatactctgtcccatccgacgcgccatttattgtttgatcaaattaataacattgttcatctaccggtgttcacacagcagcaggacttgttgtcgtcatgttttgtttttgtgttggaattggccattacaaattggccaaatatttcgcgtaccatttacagattttttcactctttaaattatgcaatttcagcagctctagattcattttaattaggccgtcaataatttagtttataaaaaatctgattttgtaatcagtgtgatcaccctcaaatttttatcccaaatcatatatattaattaatccatgtggatgtccatgcggccgaaaccgatggagattatgcattaaattaatatttttttagacaggcattataatttgtttcggcataaaaatg

SEQ ID NO: 104325 - DNA, 63 bp, Heterodera glycines
  Promoter: Source sequence=SeqID_13618; Location=1..63; Strand=+; Gene= SeqID_77523
ttcatcagttggagcggaatattgcgcaaagacccgctaattatactgaggaagcagctaatg

SEQ ID NO: 104326 - DNA, 95 bp, Heterodera glycines
  Promoter: Source sequence=SeqID_25843; Location=1..95; Strand=+; Gene= SeqID_56610
ccccccccctatttaatgcatgttgacgtctgcctctgcccaaatcgtttattattaatcatttttgatttatttgcctaatttgtcaggcaatg

SEQ ID NO: 104327 - DNA, 259 bp, Heterodera glycines
  Promoter: Source sequence=SeqID_20817; Location=1..259; Strand=+; Gene=SeqID_51398
aaatcaaaaatttgttcggagataatgctattttgggcttctctcgccataactaagccgcaaaaaaaatatgtaaaaacataaaaatccgggccctagcgatcactgatctgcaacgcataaaactatagtgaacaaattttcacgaaaagatgataataagaccatatctgggacttagaacttgtatcaaattaatagattaattgttggttaatctctattacgactaacttcaatcgtttctcagcaaaatatg

SEQ ID NO: 104328 - DNA, 82 bp, Heterodera glycines
  misc_feature (72)..(72): n is a, c, g, or t
  Promoter: Source sequence=SeqID_39054; Location=957..1038; Strand=-; Gene=SeqID_67719
catgatagaatagataattaaaaaaatataaaattgtctaaaacgacataggttttggctatatgtcttttnaaaatgaatg

SEQ ID NO: 104329 - DNA, 57 bp, Heterodera glycines
  Promoter: Source sequence=SeqID_22731; Location=1949..2005; Strand=-; Gene=SeqID_53423
tttcttattggtagcaccggatggttgccccaccgcgccagcagcaattaactaatg

SEQ ID NO: 104330 - DNA, 214 bp, Heterodera glycines
  Promoter: Source sequence=SeqID_22461; Location=874..1087; Strand=-; Gene=SeqID_53133
aaacaaaaattacagaacattattgaacaatttggtaaaattttatgcgaaatatgccgaggtaattagtaggaaatactaattgattaattagtaatttaatttttcctttccttcacttttcgaactcgtaaatgacgttgagctgctccgccgtcttcacgcagaacaatttgatgttgtacttgctgaactttatgatccgtgtcccatg

SEQ ID NO: 104331 - DNA, 108 bp, Heterodera glycines
  Promoter: Source sequence=SeqID_43928; Location=1103..1210; Strand=-; Gene=SeqID_46759
ctctcacaatcaaacacacatagcaatagaaagaaagaaactctcaaaatttcaaattgtcaaacctcaatttctcaaaatgtgtgcggtcgggcctcccaattgatg

SEQ ID NO: 104332 - DNA, 117 bp, Heterodera glycines
  Promoter: Source sequence=SeqID_10462; Location=1..117; Strand=+; Gene=SeqID_73664
tccttctcccggaattcgttcatggtttttacgacctctgacgaaacaaaaaaaattggtagaaattaaaaagctttttaattattaatgtttgatttcccatatatttaagtgatg

SEQ ID NO: 104333 - DNA, 1003 bp, Heterodera glycines
  Promoter: Source sequence=SeqID_18396; Location=1240..2242; Strand=+; Gene=SeqID_82997
aaatttttggggggggttttttattaatagaacactttataaaaaaaaattttgggggttatttttttttttttttttttttaaaaaaaagaaaaaaaaaaaaaaaattttttgttttttttttttgggaaataaaaggaaaaaagggcttccccctccccaaaaagggtttaaaaaagtcccctttattttttccccgggaaaaaaggggggccccccgggggggtgggaaaaaaaaattaatttattttgccattaaaaaaaaaaattaaaaaaaaaccccaaaatttgggcagggctttgggaaaatcgggtggtttcagtcaaaaaatgttaaaatttgaaattattggtccaaaatggactaaattgggggggggggggggaggagacgatttaccaattttaatttaggcaaatttacggatgaagaaaaaggcgacctcatttttgaacttactctttttcttttaaaataaatttttttaaaattttgttattatataattcaaatcatattatgagaaacatatattataatataatcatatttatttgcatgaaaaaataaatcttttctaatagtgatcaactgggcttcattttctactctactgctcatcatatatttgccatgaataattgctgtcaaattaagtaaacatttattttaatgcttttaatataatttgtttttagaaatatttcatcattaaaatgaaataacacctaatattttctttacttttatttttgatcgtcttaataaaaattaattatgttgaagcaaaaaaggaaaagttgcaacaaaaatcatttgatgaaatatttggagaaaaatggaaagaaaaagaagaaaaacagcgaaatgagcagaaaaagagagaaattattgaaaaatattataaaataaaagaaaaaataaagcaaaaaggaagaaaatattcggcaaaagaatggggaaaaattgaaagaaaaatagcaaaaaaatttgggacaaatg

SEQ ID NO: 104334 - DNA, 201 bp, Heterodera glycines
  Promoter: Source sequence=SeqID_39232; Location=1041..1241; Strand=+; Gene=SeqID_67852
tttttggcaaaaaatcgtcataattttctcgaaagtaatcaaaaaatcactatatttttctgttaacctaataaatttatgaaaataaattattttttattaaaattattttaatttgcttaaatttttaattttactttttactttattaatgaattaattaattaaattacaaattttatctagtgtgaacaaatcatg

SEQ ID NO: 104335 - DNA, 1003 bp, Heterodera glycines
  Promoter: Source sequence=SeqID_5878; Location=2102..3104; Strand=-; Gene=SeqID_59524
aacattgaacaacatcgccacccgttgcagagttatacgaacgtcccctttttcaattgagaagattattcttgcccttgatttttatttttgtcagaccaatattcgaaaatttttgaatttcaagataaatctgaatagacaatcaaatgtttataatttttaattaaaaaaaaataattaaactatttttatgacaagaccagtaatttaccattggttcgttacctttgcgctggttggacccgccccctgctgctgttggcgttggatttctcccccccccctccctcccttctaattggtctttatccttctgtatttctgctgctgttctcgatttgttcttgtgtttgtttggctttctctgtctgtgcgtgcgtttagggatttgaattagtcaaatcggaggacaattaatgcctttcgttactctgtataattaactaattaatgcataaataccaaacctaaaaattattaataattagcaaagtccatttggctaattgccttttacctagagtgcagcgggaccgggacctggacacggacaactgagtaccaaggtcccggttttgaccgggaaattcccggcttttttcccagccaaaaagtcccggtttttcaacccaaaaagtcccggtcttgcccaaattcccggtcccgctgctctctacttttacccccaaagttaattatttgcttacacttacaaatgtttttgttctctttattttcagccagcaccttctctcaacgatttaataagttttctctatttgctgcacagaatgccttttgcgaatttcagtgtggacagtatcctttccaccggagaagggaacagcggcacttccaaagtcattcattttgccattccattccattagcaaatccccccccccccaattagtgccacaattcctttcgtccctccgtcgtttccgcttcgtcatgccatggctgtctcactgacgagggaagttcctgtttcgaaatg

SEQ ID NO: 104336 - DNA, 1003 bp, Heterodera glycines
  Promoter: Source sequence=SeqID_20472; Location=1747..2749; Strand=-; Gene=SeqID_51008
ttttatttttttagctgcccgatttgctggccctccgtctgataatttatctgcagaaaattgatcatctcatcgattaacttttatcttgcgaatcttggaatcaattaaatagtgaattaattgttttgacattatacgaatttattaaaatgacaaaatgtgcatttttaatagtttttttctgttaataaatcgatgaagaatatgaaggataattgtaaattttcattgaatatggaccagggcttaaaatgaacccgaggaatttaactcgaagtcgtttaatacgaactgggaaatggaattaaaaaatgcttccataaaataaatcaagtattttttcatttttaaatgagcaaaagttttttcgaaatttgactacaactgcttgataatttttttttgtcaccaaatcacaccaaaaagcttgagatggtcaattttcgaagataatttcatttcaaaatcgaaaatgggaagggcttggtgaacaattggaaaaaattttccaagcaatattcaaaaaattttagccgatttgaggaaagaatagatttattttgttttagaattgaaaacacaacaatacttaaaagtaacattaacaaaaatagtgattatgatcgaatttgtgtatgcattgttaagggtttattgttattgcatgaattcttttcaaaataaattacaaattgaattcgaattttttaaaatccgttttaaataaaattcgattcatgcaataacaattagcaatggcaaagtaaatgctaaataattgtttaaaaatatgtgttgaattactaaaatgaatttttcatcatcgcatcagacgtagttgcgggaaaccaaggttttaatgaagaccaaatctaaaaatttaattcagtaagtactattaattgagaccagagtcaattggctaagtaacaataagagatactcggaaatcgttgcactaaatatgcactagaaactggactaaaaaagtcaaaaaatg

SEQ ID NO: 104337 - DNA, 1003 bp, Heterodera glycines
  Promoter: Source sequence=SeqID_24682; Location=403..1405; Strand=+; Gene=SeqID_55428
ccgtttgtttttgctcacttcgccaaatttggtgcacactctgtcgtccatgcaatagaagtaagtgccggagagattctcggccctatcggacagaagcagttccatcgactagaccataatggaggccaaatgccggcataaatctggtattgggtgccttagtttggccaaataccctcgtgaatggcattctgtcccccttttcggtgactccgttccccttacatattgtatcattccatttgattacccagcgatttcgctgatctctccgtgccgttccaccactttcttaagtgccatgacaatctcttctccccttcgccgcacacaaaagtcggacggaggaaaagcgcgtggaagggctgtcctcaacaaattggcaatctgtcattattaatcatttgttcttttcacatttcgcatcgtccggaagggttttcccgcatttgtctcgcccggccaattcggcctttgtccgctaatggccaagcaaaaatttggagggtaatccgcgatggatgtgctcagcgctttcgaacgttcgcccgggggaatgttggcgaaaacatcggaaagggaggaaaaaattgtgaaaacggaggaacgaattggaaaaaggggaaagagaaaatgccagtggacggacacaattgaattaggccattctaagtccaggctgccaaaaaaatttcggtggggtgaatcctaaggctttttagctcataacgggcctaaaaatctccaattgcagcgccgggcaaaaattgccattttgccaatttttgggttcaaaatttcaaagaatatggccaaattggagttcgtcattgccttaggcgccgccgagaaaattttttggaatataaaagaaaaattgaattgaaatttggaacttcaaaaaatctatttatttttggccagaagagaaaaaaaaacaattcttcgaaaataaactgtctttattttaataattgtagcactggcccacagtcgaatg

SEQ ID NO: 104338 - DNA, 933 bp, Heterodera glycines
  Promoter: Source sequence=SeqID_17214; Location=3320..4252; Strand=-; Gene=SeqID_81680
aacccgcttcaatgatatttatcgacagtgatccgtcatgatgtttaaaagaccccgtattgttcccccacatacctatgcctaattgctctattgtctgtgatcacgtatatcatttgtaaaaccgttgtgtgatcattatttgtgtatatgtatgtatattgtatgtatgtgtttggctgatcagcggatgtcgataaaaggaactaaaaattaagtgcaaattttcaaaacatttatgccgaattcaattcaaaggcaataaatggacatttttacggaaaaatatgggaatgttaagctctataatttttcggatcggaatgcttctcaagttggtttacatgtctttttaattgttttggtcaattgtcgaaaatcgaaaaagaaaatggtacatacttgtgtgttatctgtgggcagattttcaaaaatttttatgttaaaaatgaaaaatcacagtaaaaacaactttttaaatttcagcataaaaatgtaaaatacacattttaaaaataaattcaacaataattttaacaataaaaaacgtaaaaattaacagaaattcacgggttcataaggtaatttggacaataaaacaaaaaatcacgggttcattcgctagttgcgagaaattccccggagaaacacaaataatgtgaaattgagcgccaaagtggccggttcccaatcttaatttttaaaaaagcacatttttaatctgcgataaacagttggaaatgccttccttatatagccccgttgattgggttatatgttaaagttaaacattttattggaaaagaagtttattttttggctatataaagggtcgctttccgcccattcgtccattccatcactctcatttcatatattcacgacactttcatctgctgcttcatctgctgtcatcaacaacgcaacgccatg

SEQ ID NO: 104339 - DNA, 380 bp, Heterodera glycines
  Promoter: Source sequence=SeqID_1874; Location=829..1208; Strand=-; Gene=SeqID_76519
caagtatgtaaaaattgaatataaaatatttggcaaaaaccgtgtcgtgtattgccgggaaaccgagtccgggtccggatcctaatttttcaacggctattgggtccaacaatgtattgaaaaacctaaaaaaatatttattttttaattatttttttcacgaataaaagcttgtcaaccaataataaaaacatttagcttttttcttaaattcaaaataaattttagaaaatttggtcgaatatttcatcaaaaaaaaaagaaaaaaatatttaaattaatttcattcatcagttactgatttatgaattataatcgtgctgagacaaagtgcgaataaaagggcaagcttcaagggatttttttttaaaagctcaatg

SEQ ID NO: 104340 - DNA, 77 bp, Heterodera glycines
  Promoter: Source sequence=SeqID_23792; Location=610..686; Strand=-; Gene=SeqID_54493
atttatggggctgactgttatagtttttcgtatacggtgctcgagttgctttggctcgagaaaagactcccggaatg

SEQ ID NO: 104341 - DNA, 239 bp, Heterodera glycines
  Promoter: Source sequence=SeqID_21466; Location=1..239; Strand=+; Gene=SeqID_52074
aattttctttttttcttttttagaattcatatgattactattttatatatatattattttattttttaaattgttaatttaaataaattgaaaatatattttataatacattttatttttaaacttttgatgacttttgctattaaataattgattttaaaattaaaaataaataaataaataatttttaatttttaatttttcaaaataaaaaaaacattgccatcgcggcacagatg

SEQ ID NO: 104342 - DNA, 1003 bp, Heterodera glycines
  Promoter: Source sequence=SeqID_1639; Location=1969..2971; Strand=-; Gene=SeqID_75006
cacaacggactcgaaccaccaccctttgtccctttactatcttacaaaaaccactgagccacacatgcaaatcttttctggtacaggagctcatttctgggatggtgtgttaatttatgcgcttttctgtcgccgattggcaaaaactgggcagggggagggggtccgatcattccttgcactcttctaaaatcatagatattttgtcaaatctatgattaaaaagtcatcagatgttaaaataaatatcatattcgtgatcagcaaccttgaaaaccccaaattacgaattttggaatttttttgaagggggcagcataacccggaagtaccataaaaacagcctaaaattgaaaaaaaaatggaaatgaaaaggaaagagtgttggggtggaagggaggggcagacaaaatgagagagaaagggagcaaagatggcggcgcctggtacgattggctgcggggacggctgaggcaatgaatgagtgggaagcagcaaaacattcaccggcgggagagagaaaggccctccccccccccccccactgctcaccaaatttaccaattcttgaatatcgcttcatctacaatgcgttgaaaaataaggatactcctttttgtgtttaccgcttcaccatgaacggttgaaattttaacatttgcgttttaaattattcgagatttaaaaagtttcgccagcggcacctactggcatcgcaggctccctttaatccccaagttttttaattgtacccgaaaaacaaactccatatttttcgataaaacctctcaaatcgttaattttaattttaatttcgcggatttaataaatcaattacttaaaaatccctatggctaatataaaatccattacttttttttctgcagcttcgactaataagccaaggctgaatgtcctcctctctgctgattgcatattttgctgcttattgctaaccctctgctgaatgtctttaatccaccaattttccatcattgagatg

SEQ ID NO: 104343 - DNA, 106 bp, Heterodera glycines
  Promoter: Source sequence=SeqID_5767; Location=1..106; Strand=+; Gene= SeqID_59159
tttatcatttcagaattttacgctgggcaatttgaaaaactgtaacatcacagaacagttggacaagtcaaagataaaggaattcaacattggcattcacgtcatg

SEQ ID NO: 104344 - DNA, 53 bp, Heterodera glycines
  Promoter: Source sequence=SeqID_1188; Location=1..53; Strand=+; Gene =SeqID_69539
ggaaacgcattcgcaagtccgcagaacagcgtctttaacggacggaaagaatg

SEQ ID NO: 104345 - DNA, 412 bp, Heterodera glycines
  Promoter: Source sequence=SeqID_10046; Location=6703..7114; Strand=-; Gene=SeqID_73110
aattaataaatccataacaagcacaaacattattatctcgattttaaaactcaataaattttatttgaaatttaaataatattagaaaatctttgtgttttccaatcctatcaaggaggggaccggtaaattgaactccttaaaattatacattagacaattgtacaattaataattacacactcattggaaaaatgaaatccgccatgaaaattaaaccttattgaataacaaaccatcatgaaaatgtctactaagatttttattattatgcgcattaattttcgaaaatgcaattgatcagaaataagctgtacaaaataagtctagaatgaagttatgatgaaatatcttggccaaagatgatacgacgagagcagaagaaaacatctgccaaatttatcaaataatg

SEQ ID NO: 104346 - DNA, 151 bp, Heterodera glycines
  Promoter: Source sequence=SeqID_21856; Location=1388..1538; Strand=+; Gene=SeqID_52486
ttttttgggtcaatactttagaaatgatccattaaaatgacgagaatctaacattatactgtccctaataatgggcggggcttaaatacataatttacacactcgtagtgtcatcattatttaaatttagtacactcatatacatccgatg

SEQ ID NO: 104347 - DNA, 273 bp, Heterodera glycines
  Promoter: Source sequence=SeqID_5624; Location=2511..2783; Strand=-; Gene=SeqID_58685
aattcctgctttttcgcttttgcgctgaaaatttttttaaaataatacgagtaaaaaatgtttgtccgatgagcaaaaaaattttggattccctccgaaattttttctggctacgattaatatggcttaagaaagtgagcatggtcaacggtagaacgcgtaaacttttaaaaagtaattttcctttattttgtagaaaatccatgaaaaaaattttttttttgaaaattaatttggtgatcaccccatcggcaaacacattcagacggaatg

SEQ ID NO: 104348 - DNA, 520 bp, Heterodera glycines
  Promoter: Source sequence=SeqID_23023; Location=2415..2934; Strand=-; Gene=SeqID_53723
gggtacaccccaaaacgtcgccgccgaaacgtagccgcaaaaaaaataaaaaattttcaaaatttcaagaaacttaaaagtatttaagctttttgaaaatctaagtgttaataaaaactaaatttgctgaatttccgggaaaaaaaacttgaaaaaaatttttcgtattaagttagctaactaaatttttgacaatttttctagatttttttctaaaatttaaaaaaaaaaattgcggcgacgttttgtcctgctccaccgggaaatggcaggcggagcagtggcaagggacaaatgatgggagatggatggcctctgtcttttataaatgaaaaatatgtttaaattggtgtgccatagtagcaaaattacgtcaaaaaagcgcactaaattttgaatttatttcccagtgagagaattggtggtccggcaactttttttgccgtcgtattttttcccaaatttagtgccggacggggccgacggcaccaccacttttgtggtgcccttcctgcagatg

SEQ ID NO: 104349 - DNA, 265 bp, Heterodera glycines
  Promoter: Source sequence=SeqID_18800; Location=887..1151; Strand=-; Gene=SeqID_83479
tttcgatcgacactctttttaattaggggcaaatgcgattcggtggtgttgctgcgccgacaaaacattttgatgatgcaacttaggaaaatcagcagacaaaaccgggaaatgagggaggtcattgcgaaataccagcagattcccaacctcttgcaagcaataaagtcagtattttatttaccaacaaatttcataaacaaatttaaaattaaaataatttaaattcatacactaaatgtaaaatgatcaaatatttaaaatg

SEQ ID NO: 104350 - DNA, 232 bp, Heterodera glycines
  Promoter: Source sequence=SeqID_31563; Location=1..232; Strand=+; Gene=SeqID_61895
cagcggaaaatccagtgtggtttgggttgggaagcgcaaaagttcggatcgtggaccccacccaatcaggtaattgcagaagttttgtttcaacaaaaaaaaaaaattaattttttcactaattgctagggttcgagcagggcgtggcctacggcggcgtagaaaacgcagaatttttggaagccgggaaaaatacaatttgttagtgaatttgaacgactaatttcgcatg

SEQ ID NO: 104351 - DNA, 1003 bp, Heterodera glycines
  misc_feature (92)..(92): n is a, c, g, or t
  Promoter: Source sequence=SeqID_24960; Location=195..1197; Strand=+; Gene=SeqID_55696
cgtttagtctacagcagtgaaatttaaggtagaaaatattgtttaagtagaaaatagaatttcaatgtttgactcttttttctctctctcgngcgtgcgtaaataataatacgtgcaaatggacgagggggggggggaaagagcaatggaagtgaatgaagtgtaattaaagaatttaatgattttaaccttaataaatgaacagcctgctgctggactgatttggatgctatgcaaccaaaggagtgtcaattttctaaccaaaaaataatttttattaaacaaaaaataggaaattttagtattaagaagttatttcgtccagagtgccgcactcaaaagaaattgagcggagagaaattggaattggaaaagcggctaattccaaaacaaatttgtacctcattaaggcgacatgggactgaatttcccgtggtgaccagtccattcaaaaagaatgtattattgtacagcaggacagaaaaatgtatcttgagatctgcacggaggcggctaagtttaaaaaagtccttacaacaaaattaattttggcaaaactgcaaaaatgccccccggcgaatggatgtaatttttccccttcgtactgcgccatcaaatttacttttttaaatattttcgagattctcgacgcaaattgctcacataaataaagggtctccgccggagattaatgggagagagagaagatggcagggagggcccaaaaataattttcggccgtacaaataaatttgagagagaaagagatggaagatgaggagaagaagagtcattcactcgcatattaaacagtgaatttgtgatgagacagtttttgttaatgggccattatcattcattgactgaggcatcaccagttaattggataataatgccttttgacaccactttcgaatttgggagggacaaattaattaattaatttccttggacgagcaggaggatgaagacgaaggaacagttgtattcatccccaaaaatg

SEQ ID NO: 104352 - DNA, 1003 bp, Heterodera glycines
  Promoter: Source sequence=SeqID_337; Location=470..1472; Strand=+; Gene=SeqID_83074
ttttaataaatcaggtttttaaaaataaatcttactggcgtattttcactgggcgaaaaacccctaagagggggccgaacaatttggctctgtatacatcaaagttttgatgccctgcctttttgttgttttggaaattcttcatgattttttttttgcatttttggcggttttcatacccgattcttattgttagcactaataagatggctaattccttccggtcaaatgatgggctgaagaataaaaggagaaaagtaattagttctaagcatgtttgaaaacccaaaatatttattatcaaagggttaaaacaaattctatgctttcagttatttcgcaatgaaaaattaagtgctgtgctataaaatgaaaagaagctaaaccaataaaaagaaaaaattgacagaataaagagatgaagtgaaaaggtaaatgataaaacaatgaatggtttgaaaataaatcaactaatgcgaccaccaagctggctgccagcattagctccaattaaatttaaattttaatgaaataatgtgcgaaatgtcatatagctgaataaataaaatgagaaattgacagaagaataggcataaaataaaagggtaaattatgagaccaccaagctagccagcttaagctccctatataagcaattgctcaggcagaaattatatgataaacctattcaatgttaacttaaactacattgcagtcctattagtttttaaataaaattttatttattatttattgaaaagtaatttttaattctcgtaccaattgttaaacatctcataaaataaatctaaatattaaaaattaaaggccgttcagtcaattaattggccgaattggagctaaactggcgtttcagttcatttgatcatcattaccattcaaaaagttgagtatttaagaagtcttaattgtcagtaccaatcaaaattttgactttagcccaaaactttttaaattttatttttagttggtttgtataatg

SEQ ID NO: 104353 - DNA, 1003 bp, Heterodera glycines
  Promoter: Source sequence=SeqID_13709; Location=811..1813; Strand=-; Gene=SeqID_77626
aaaatgcggatgatgggcagagatagataccggaaatgttttgaaaaaggtggcacatcaataatatgaatatattcatatgtaaaatatacatcgatttattaaaaattaaaaaaaaatatatattgaattattataaaataaattttataaaattatttcattgcttcaattcgttgtgacggtttaattcgtcagtgcaacaaaatccatcattggacagtccgtcagtggcaaattgtagatggacaatccgtcatttgacaatacacaggtcggcaatctgtcagtggacaatccgtcagtggacactccgttagtattagacaatccgttatttttgggatgtatttttttcgtgactggaaatggattagtttgaaaatctctgttaaaatccgtcagtattggcattcgtcagtggacaatccgtcagtattggaaaaagcgtcatcaaattgtggattagcatacctaatttatattttaacaatcatttaaaaagcataattaaaaaatgcgtaaaatttactttactattctaattttatatgtttagctctatttgcttgcaattttctattattcttatttctcaacattcaaagttttataatttttatttaaaaaatttaatagggtttattttttgaaaaattattctaaaatatttttattttttttctattgtaaattaaatgcaagtatttttttacaagtattttctattattttttatcatttttcgatcaattccaataaaaaaaatttaattccttataaattttttaaatgagactgctgtgaattattgtttgacatttttcataccagatagataattttcttttaaattttattgccatttttaattggtgaatggatgataacaatttgattattcatttacaataattaagataaaaattgggacttcaattattacttttaaattaaaaagcaaaaaaaaatatattaatttatttttttattaaagaaaatg

SEQ ID NO: 104354 - DNA, 1003 bp, Heterodera glycines
  Promoter: Source sequence=SeqID_2; Location=5908..6910; Strand=+; Gene=SeqID_50779
cgcacaccgaacggtctcggcaaaatttgagaaatttcctaaaaattaaaaaaaaataaaggctaaaaaaatatttattttatgatatttaaatatatgtaatttaattaaaaagcattaaattttggtgaacaaaaaaagtattcggatttcccttactatattttccggttgtgttttgcaaatataatttattaaccggaaagcacttttttaaatttagtaataacagggaacacattccatttagttgttttccggatagtttaaacggtttaagtaaaacccggaagctgtttaagtacaaaacctaaaaaaatacataaaaaatacaaaacatgtcgtctgttttaaaaataacgcggaaaactccggttaattctaaaataaataaaaaatgctgtaaggaaaattttaaaaaaatcattaattaattattcctgtttttccatcaacaccaatttttcaattttttgattttaatagctgagttgctaaagttaagtggcattgagcgtctgctgttgtaccgtcgattcgccgcctatttttttgaaaaaaaacaaaggggtttaggagtcataatctcgaatatgacatccaatctgagttaattggtttaaagtgtgttggaggctttgacgcattgacctcatgattaggaattttatcaagcataaagacatttgtaattaataaatattttttttttttctttaaattttgatccaaaaagttcaatttaaatgagttcatgttaatagtttgttgctgtagaaaagctataaaagtcacaaattaatgttctcagttttacccaacaatttgggcaatcaattggattaactttgcagcatttgcagcagttttcaaaatcatagtgaaatgttattttagccatttttatagagatttatattgaattccgatgcaaaatttctattgcttaataattagaaaaattttgagtaaaaactaaaaggagaatttcgattaaacaatg

SEQ ID NO: 104355 - DNA, 389 bp, Heterodera glycines
  Promoter: Source sequence=SeqID_2928; Location=1301..1689; Strand=-; Gene=SeqID_82371
atttattttcacacatttctttttgttgataaatttagaataacttaaagggaaattttttatagtccataccattaatgtctacgagagaaattttctcttctcaaaacttattttatttcacgttgaaatttttcgaaataattttggtatcataccattaaactaattagaaggtctttcacgtgaaaaagaaggtcattttttctattaattgaacgaattttttgtgcacgtgaaaatgttattaaaatggtaccatcttgaaaatatatataaaagttatggtttacaaaagaaaaccatttcataatttggcttttaacgaataaaattcgattttcttatagtttttaactaattagcctattttaagtattcacaatatg

SEQ ID NO: 104356 - DNA, 249 bp, Heterodera glycines
  Promoter: Source sequence=SeqID_34707; Location=840..1088; Strand=-; Gene=SeqID_64430
ttttaaggattttgctcttcgctgcttggattacattgaccaaaatgccgaaactttgtttgaatctgaggaatttttggaaatggaacaaattttgttgtgcgaaattctcgaacgtgaccaattgaaaatcgacgacgaactcaccatttggaattcggcacttactaatgaattatcatgcaaatttaaaattgaaattcatttcgcaggcactccgttgggctgacgcgcaatgccttcaaaatg

SEQ ID NO: 104357 - DNA, 106 bp, Heterodera glycines
  Promoter: Source sequence=SeqID_9459; Location=2059..2164; Strand=-; Gene=SeqID_71499
cgtaaataaatttaaaaattatttccaattttttaattaaatttttttcaaggttctaaattttcaattttttaagaagcttcgtccctgctctcgcaaaaagatg

SEQ ID NO: 104358 - DNA, 495 bp, Heterodera glycines
  Promoter: Source sequence=SeqID_7692; Location=2329..2823; Strand=-; Gene=SeqID_65642
aaattggactgggattactattaatatttattattttaatactttaaatcaattaaaaaatcaaccccggcttaatcggaaaaattaagaggggaatatggtaaagttagaattattttttttttaaatttttcacggttacgcttagcatcaatcacattagttgcgtcagttgattgataatcctataaaataaaaaggctacggataaaaagtcttagtgttgctaaatatgggatcaatcaatcgatcgatcaattgactggggctgaccaaatactttttgatcggattttcttgcgatcgataaccgtttctttcacttatccactatacagtaaaagtttctttatcaaattgcttaaaagaagagaaaagcccgatcaaattggtccaattaatggctcattaaatggtggcaacaaattgtcaaatgcattacggtatggcggccgtccaataaatacggtccaacagcgagcggcggtgaaaatg

SEQ ID NO: 104359 - DNA, 450 bp, Heterodera glycines
  Promoter: Source sequence=SeqID_11296; Location=1595..2044; Strand=-; Gene=SeqID_74668
gtctcataattcaggcttaacccctaggcccattataagcagtgagcgggtggggggagaagtttttttggaaaatttgtatttgttaaaagttagtgttaattttggtaacaatttgctcagaatttattgggattactcgtcactaccgtgatgacaaaattttttatttctttgaatgcgaaccaaaattttttttggacacttttaaaaacttatttttgttcccaactacactcgaaactacagaaatttgttggcattttttgtagtctcggtttcgactcttataggtcgagtctcgaaaagatgacaataattttgcacaaccttgatttaaacagttaaaatttttgtgagttttaatcacattgttactaattgaattgattaatcggcataaatttttttcttataatttagctttaaacaaatctttaaaataaaatg

SEQ ID NO: 104360 - DNA, 180 bp, Heterodera glycines
  Promoter: Source sequence=SeqID_5039; Location=6970..7149; Strand=-; Gene=SeqID_56679
tattgagacgctgaaacaatatcaaagggcgaaagattaaacaacaacaccagccgatgggacctgagaattggagacagttgagggattgacatccggaaaagagacgggcctcagttggtcttgccaactccacgcgttggagaagtcaagcgcccacgggtaaatggtaaactcatg

SEQ ID NO: 104361 - DNA, 644 bp, Heterodera glycines
  Promoter: Source sequence=SeqID_38646; Location=1101..1744; Strand=-; Gene=SeqID_67397
aaaatgtcaaattcattttttaaaagatttttttttaaaatacttttaaatttcaaaattcagtaactcaaccgatcaaggttccattgaaattgagccgatcatcagcccatccgaaaattactccgaggaaccggaaacccgccttctactttgttggcaagcaaaattgttttttctgttgataaatgtaattttaaataaaatttcgaaaatgggtgtttttgagcgcataacaaagcggaagtggcaagtaacacatattgatttttaaaatatttataatttttataatccatattgattcgtccttatagatattctcagtgtcaaacgacaaatctgttttttatttttggttttacataaataggaatatgtaattattgttattcataagtatgtttcagatcttttcttcttttaatgaaatacttctatattaaggaagtagtttcacaaaactatacaagtgtgcagaaatagattattgtttttagagagttaatgatgcaggggaattcgtcggtgccaacagtcgccgtcgtgaactttttacatattttggatgcaattttttttagggttttttttttatttggaagtcccgttttgattgatttataattaaacgaacagtgatg

SEQ ID NO: 104362 - DNA, 139 bp, Heterodera glycines
  Promoter: Source sequence=SeqID_17823; Location=1662..1800; Strand=-; Gene=SeqID_82353
tttttgggttactttactctttccctttttttcatttttcaatcagcctccactaattacactaattaattttcaattagcctctgctaattgtcccgtggaggtccccgatgttgaagcagcagcgttcaaagtgatg

SEQ ID NO: 104363 - DNA, 1003 bp, Heterodera glycines
  Promoter: Source sequence=SeqID_3544; Location=241..1243; Strand=-; Gene=SeqID_50805
atgggatttatttgggatttctatcttaaaaagaaaacaagttattccagaatttctgaaaattttcgatttctcagaaaaaaattcataaccgccttctgaaaagaaatttttgaaacttaaaatactacaaaaatccgcaatttttttctttataatataaattttattttacatttttatcactttcttacgaattgttacaaaaataaaaccgattttgggattatggaccaaaggggtgagcataggatttttgagttgaaaaattttttcaccaaaaatcttcaaaaaatatgtctttaggggttatttggccccctgatcacgaatacgtaatcagattttactttcgacatggttaaggcctcagaatccctgtgtgattggggattctgaggcacccttatgaggagggggggggggcggcaggttcggacccggtacggtgtacattatttttttatgcactcttgggtcatgttcaccatggataactaatcgcttcccccccccccccccacatcgtttccccccactgcgagaaagttttttttaaatttactaacatagaaatttttcaagaaaaaatagctgaaaatttttcttagaattttcttataaaaaactttctaagaatttttcttgaaaaattacaagttagtaaatctttttaaaaaaattttcggggtgggggggggaacgagctgctcccacagcatggtcgatttgctttgccacgaaattaaaatttttaaaaattttccagcaaatatgaaaaaatttttgaatcccccctaatgaaaatttaaaaattttatgggtacattgttgaattttatagtcaattttcgtaacaaatagcattcacattttcaaaaaaaaaatttgagaataaggcgagccggcggtgccgggaaaacttgtaattttaatgcgcattattagcagataaaatttcccttctatttcagtatgctctcacgtggtcacccaggagatg

SEQ ID NO: 104364 - DNA, 55 bp, Heterodera glycines
  Promoter: Source sequence=SeqID_30843; Location=72..126; Strand=+; Gene=SeqID_61239
ggcaatttttaaacattttatttaaattaattaattattatttttaggtcgtatg

SEQ ID NO: 104365 - DNA, 441 bp, Heterodera glycines
  Promoter: Source sequence=SeqID_10665; Location=1..441; Strand=+; Gene=SeqID_73911
ggttattattctatggtttcacaaatttttcgattattttgagtattttaaaattggtttttgaaaaaaataaatgataattgcatttaaaaaatttcacttcacttttttatttttattattataataaatttttatcgaaagaatttatttttatttgaaattaaatgaagaaattaatgataatgtgaggtataattgagaattttcaaacacaactaatcaaacaaatttatgaatgtcatttatgctggattttaatagaagttttggaggaaaatcatttcgggggattccgaatgtcccatggattcctaagaaaaatggtttcctttttacaaaataagcccggtgccgagttatgacgtgccaaattttatagttttttatgtataaaaaaaaatttgcatgtattttatctatttcaaagcttttaaaatg

SEQ ID NO: 104366 - DNA, 111 bp, Heterodera glycines
  Promoter: Source sequence=SeqID_2218; Location=682..792; Strand=+; Gene=SeqID_78526
acccatttgttccgttgcttttagcctgattttggtgctgcggtgacgcgcattgtttccgatttcggcgctggtcgtgtcaaaagtgaggcgcacgaggaagtgattatg

SEQ ID NO: 104367 - DNA, 301 bp, Heterodera glycines
  Promoter: Source sequence=SeqID_13090; Location=1985..2285; Strand=-; Gene=SeqID_76876
ccttcaatgaaatggggacgcattgaattatttaatgcccagaggacaaattgcctgagggatcagtcgtccggcaggcgccggaggaggaggcggcacgggagcaagaggcgggggcggcaaagcagcaatgggtggcgcactttaaagacaaactaccaaaattttttttgccattttcagtaccatccgactgggccatgggcaggggcacacggaccgtaactgaaaagcaacggaaaatgaattcggagaggggcggggggagcttacgcagaaggaacaccgaatcctaaaaatg

SEQ ID NO: 104368 - DNA, 295 bp, Heterodera glycines
  Promoter: Source sequence=SeqID_21929; Location=312..606; Strand=-; Gene=SeqID_52567
tttttcggcttttgctttgtttcgtcggcttctccgtccatttgcttttgctctacgccgtctttgacatttatttttcttctccaattgtgcgcggggcgcggccttttataatcgccaaaaattcggagagttttacgcccgccgatcgcatcgtttttttctcggcaggtcaaacaaatttgagacatttaccagtaaaatttacttaaaggtaattttaaaacaaatgaaactttgagaattggacacatttaaagcgaaaataaaaattaaaaaaaacaaattaaaaatg

SEQ ID NO: 104369 - DNA, 1003 bp, Heterodera glycines
  Promoter: Source sequence=SeqID_12661; Location=1314..2316; Strand=+; Gene=SeqID_76336
gagttgccagcgatgtactcttattaatagaattaacgacttaaagtgtagagcgtgccaattcgaatgtccttcagtaaatgggcgatcaaaatttcttcacaaaattaaatgtttgtttatttttattgttagctaagagtaaagctttaaaaagttttttagtaccacatatttccctcaactcggcattggaaaagattgacaatgccattgattttgttgcaaattcaatcgtaccaaaaagtgaacaaaatgtacacttttaccatgctcccgttgttttgtgcgagcatcctcaacccaagtctgtgaattggacatgtccaagctgtgcacagaccaacacttcgacattgaagaagtgttcatggtgtgacacggacagagtcacgggtagttcaagcgaaattgaattcaaagcgtagataggtaactgtgattgaattaaagatgttacaacttggtactggtgctgtcagaattcgaattgtgctcttcgccagccctttcctccgttcgacttaaaatgtcctttatgccgaacaaaaacttcagcaatgaagccgggacattccaagagtatggtgagggatttatattcgtcaatcaaatgctttaaagtgttcccatataaataccacgatacaaaaacatctaatgccatgattgtatggattaaccaagcaagaaagaacaaaacttatggcataaaattaagtctggccaattattggtgttgtgaccgagcagtagtctattgctcggtcaccacaaaaaaggaacttcaagtttttagctctgaattgagcactaagtcacaaacgaatatcagaatatgcctcacccgactgatggggatattcgctcgacttttcagtgcttttcacctacttcctcccctttatctatactttttggtgcttatcagcactacaatgctgccgtagtggcgtaatgtggaccgtggcggccttatggaattaggttcatcaaaccaatg

SEQ ID NO: 104370 - DNA, 236 bp, Heterodera glycines
  Promoter: Source sequence=SeqID_28289; Location=1..236; Strand=+; Gene=SeqID_46095
ttttggcgctaaatcaaaatttgaattttcgcgtcgatactctgtgggtggagggacgcttgctgggtggcaatgccgtagggtgaaaggctaatttaatgctattttaaatatatttatctattttaaatatgtgtttttatttaatttagaattatttatataatttaaattgtttatttttaggaatgtaatatatattatttaaatgttttatttttagatatcccaaaatg

SEQ ID NO: 104371 - DNA, 79 bp, Heterodera glycines
  Promoter: Source sequence=SeqID_21219; Location=1265..1343; Strand=-; Gene=SeqID_45629
ggtggtcaatttaaacactaatggaccccatcagggaactccgtacgattggccgatgaggcggggggggggagggatg

SEQ ID NO: 104372 - DNA, 397 bp, Heterodera glycines
  Promoter: Source sequence=SeqID_15588; Location=1103..1499; Strand=-; Gene=SeqID_79878
ttttacaagggaaaatcccaaaaaaaattttaagttttgcaaagtgttggcgttctgattactaaataaataataaacctatttgcactgagagcccaaaattgggccgctgtgtcaacccatagaaaaaattttcgaccataactatatcagttgcgccattttttctgggggtttgacgaatgttcagccaaatttttttggattttgttcgaatttgggcccgatgttcaaatagggtcgaaaaccgttgcttgccggatcttgataaatgatcccgaaagcttattaatttggcttttttattttgaaatgtgaaaaaaaaaatatgggacttaaactgtaaaagaagaaactaaattaatttattaattcatatttttaagaaaacaaaatg

SEQ ID NO: 104373 - DNA, 465 bp, Heterodera glycines
  Promoter: Source sequence=SeqID_20947; Location=737..1201; Strand=+; Gene=SeqID_51528
ttttcgctttttatttgcatttgtgaaggaatgtccaaattaaattatgcttaattgacagatctggctttaaactaattcataattatcaaaaagaccaaattaaattatgcttaattgacagatctggctttaaactaattcataattatcaaaaagaccaaatataattatccttaattgtgagtttggctttaaattttattaaatgttatacagaaaaccaagggttagcccgaatggtaataatttcattctattttatattagcaattcttcagtgtttgaattttcctttgcacaatgatttaaatttggctttctataagaagtataaaaaagattttttaaaattttttgaaaaattaaattttcaaaaatttatttaatcctattctagcacaatatttaaaatcattatttggctaattgtccgacaataatattccaattttcgtcaaaatg

SEQ ID NO: 104374 - DNA, 362 bp, Heterodera glycines
  Promoter: Source sequence=SeqID_9304; Location=1596..1957; Strand=-; Gene=SeqID_70918
ttttgtcgtctcgaaatgattttattttatttttcttcaattaaatgacaattcattttttgaggcatttaaatgattttttctgattaaaaaactgaataaatcattattttacttagtaaaataaggaaatcctgtttaatttcaaagaaataataataataattttatcttaatgacaaaaaaattgccaattggtaaattaatgattaaataaaattttattactttctactggcgctcattcgaaaataataaacatatttcaataaaaaaaaaataaattcacaatgtaaagagattttagaaaaattaaagagattttatgaaatttcattatatcagaaaattggtgtaaaatg

SEQ ID NO: 104375 - DNA, 382 bp, Heterodera glycines
  Promoter: Source sequence=SeqID_10274; Location=1..382; Strand=+; Gene=SeqID_73432
aaaatttattaatttttttagcgcaaaatcaacaccctttgcgaaattttcgcttttttgcttatttttaacataaatttattaatttttaagaaaatttaaatttattcaatattctcgagaaattttggcgaaaaaatgattttttgaaaaatttttcgggttttgggctcaaaaaggctaatttagctgctgggggccgttctaatagaggtttttttgaaaaatgccaaaatatggacataaaatatggacataaatcgcgaaatatggaaaaatatggaaaatatggatatagaaatccttcctagaagcttcaaaccaagctaaaaacatgtttttcgtgcgtttcaggcctcccacattccaggaaaaaaatatg

SEQ ID NO: 104376 - DNA, 151 bp, Heterodera glycines
  Promoter: Source sequence=SeqID_21856; Location=1386..1536; Strand=-; Gene=SeqID_52487
tcggatgtatatgagtgtactaaatttaaataatgatgacactacgagtgtgtaaattatgtatttaagccccgcccattattagggacagtataatgttagattctcgtcattttaatggatcatttctaaagtattgacccaaaaaatg

SEQ ID NO: 104377 - DNA, 270 bp, Heterodera glycines
  Promoter: Source sequence=SeqID_8142; Location=2449..2718; Strand=-; Gene=SeqID_67116
aaagaaagggagcgaggggaggggaagagttaaggcaaaatgaagagaaaagggaggggaaagggcacattttatgagctaaactctttccgtgtgccatcaaatgcttattaattgcccatttctgtctttttaagcccaatttccaattgtcccacgccggcgattgaattgcaaaatgaccaatcgaaaaatttgaacggcggagcgtacatcaaaaaacagaggaacggaagaagaaaacaatcgcatggagtggagggacggatg

SEQ ID NO: 104378 - DNA, 1003 bp, Heterodera glycines
  Promoter: Source sequence=SeqID_4639; Location=206..1208; Strand=+; Gene=SeqID_55194
ccgcgcagcgccgcgggaaggtcatcaatcatccacctgtcaccaaaagtgacaggtggaggaaattcaatttttcttttgtaaatttaaatctttttgatcccaaaccttttgggcggttttaatttctcaaatcctgagtttttttttatgacggtttctctaatcctgaaattaaaaattcattttttgaaaatgtgccaaaacagtgcgggttttttttgcatttcctccccgctcgccccgcgccgcgatgccgccgccgcgaaaaaaaaaatcgataacggaatttggaagaagtgtgaattaattgatattagcagcaaacaatgacatgaataattattgaattgcacaataaaattgattatttaaaaataaaaatcgaaaatgaataaataaattaaaaaactttttcaaaagtaggtcacctttcaaccaaaattgattgatgggtttttatttctcttccattatttcgaaatctgcacgtgactttttgttcaaattatttcgcaatatctcccctaaattaggtcaactgtcaataaaatgtgattgattggcttcttatttaaatgtctccattatttttggttccaactatttcgcaatatggcccgtaattttgcaaacctgtcaaaaaaaaaatgattgatgactttcgaaataaggaatatccaaacgatttttgcacggtttttgaataaaatgtgacagctgtctaccgaaatgattgattaccctcaaaattaaggcaaccccagacagtcacgtgactagacccctcccctctcgcccaatccgtacacccggcccaaatcgaaaatcattcaactaaatagttggatttcattaaactctcttcgcgctctaattttaattcactccgctctatttttatttgcattaattaaatctattactatttacttacgtcttttttcttttaaaatctctctaccctctttaattcttctgctgcaatttcttgtttaaaatg

SEQ ID NO: 104379 - DNA, 92 bp, Heterodera glycines
  Promoter: Source sequence=SeqID_1033; Location=1153..1244; Strand=-; Gene=SeqID_66568
tttggccattgcgaaccgaattgtttaaaggtggacaaattattttttgataaatttcgaaaaagctagttggctagcaaaagattaaaatg

SEQ ID NO: 104380 - DNA, 82 bp, Heterodera glycines
  Promoter: Source sequence=SeqID_36822; Location=287..368; Strand=+; Gene=SeqID_66051
ttttacagaaaaacacctaaaaaatataaataagccaaaaaagtaaaatattattcttttaatagcctcttaatttttcatg

SEQ ID NO: 104381 - DNA, 237 bp, Heterodera glycines
  Promoter: Source sequence=SeqID_29256; Location=1..237; Strand=+; Gene=SeqID_59785
attttattcgttttcctcctttttaataatttgtcatttcccaatgatttcctttgtttttcagatttatttaatttacagcgcaaattgtgcagcattaattagtaattgaattttctcacaatggccctgccaatggtcggcggcgtttatttgggccatttgtggcgcggcacaaccggcaaattgcgcgccttggcccgtccgctgctcaaagatggcatcggcgaccgaatg

SEQ ID NO: 104382 - DNA, 1003 bp, Heterodera glycines
  Promoter: Source sequence=SeqID_2; Location=13307..14309; Strand=+; Gene=SeqID_50780
gagtcggctactgcaaagacttatttgcttaaaaaattgcaaaaaccattagttatgagtgtaaaattatttaaaaaatagtatttctaatatgaatcataaaaaacagaattattcattacacctttatctgcacgacaggggccgtaaattaattttcttttgttcaaaatttaattttaataaaaaaaattatttattgttagcaaaatgaattaataaatcaacaaaaaatgttaatcttcataatatttcattttttttttgaaaattctctcatgtttttcttttttatttttgttaaccctctcaaactaatttaaaattaatttacaaattttttttcggcagtagttaatatattttttttataaattcttctagcaaattttagccatgcataattttttaaaaaacataaaagtttgaaaacataagtaagttttaaccacctatttattcagttgtttttgcactgattgaaggtatttgcatttatccattcgcggactctgtacgccacagactaattaaaaccttaatagtcaaaaagcagatacaaatcttaaaaaaataaatttgaaaatttaaaaacattttaatatcaatatcgtcaaggtatttaatttttttaagctcaatttttaattataaattttttaaaaataaatgcatttaaaatttttccgcaaaataaactgataattgtgattaacatcgatccgttaaaaaatgctgctcatgtggataaattctaagtaaattattttaagttatattgtcggttgcttctgattgtgagcaatttttaactcattcattcatacaattttttattaggttttggcaataaaattcgtgtacacgattaacctaattaattatagttttttaaatcggcaacgtgatccgcaattacgcattaaagtttcgcaaaatttgactattaattaaaaagaaagtttttcatttttattaagtgctaattgaatgtaataaaatg

SEQ ID NO: 104383 - DNA, 253 bp, Heterodera glycines
  Promoter: Source sequence=SeqID_2928; Location=3819..4071; Strand=-; Gene=SeqID_82372
tagcggatgaggcaaaacaatcaatcgaaatagccaaaaattatcggcaagaaattgggcaaacctatcggaccgcttactcacagcccgatttaggcattggagacttggccaataaattaaaagaaacaatgcgagaaaagcaactacatttggaaaggccaagaccccaaacagaatttagggacgaatttattgcatataaaatataataatataaaagaaaacaaaaataatgaaaaataaaaaaatg

SEQ ID NO: 104384 - DNA, 63 bp, Heterodera glycines
  Promoter: Source sequence=SeqID_13331; Location=1..63; Strand=+; Gene= SeqID_77196
caaataatcgagatggattgaattcaactgattgagatcagtgagaattgttggcgaagcatg

SEQ ID NO: 104385 - DNA, 69 bp, Heterodera glycines
  Promoter: Source sequence=SeqID_95; Location=4472..4540; Strand=+; Gene=SeqID_66044
tttaaaatctgtgaaaataaaaaaaaaaactataaataaaaagaaaattacataaaaaaaagtaaaatg

SEQ ID NO: 104386 - DNA, 56 bp, Heterodera glycines
  Promoter: Source sequence=SeqID_18174; Location=336..391; Strand=+; Gene=SeqID_82758
ttttcattccaacttttgaagggaaggactaaggcacttctcttgctcaattcatg

SEQ ID NO: 104387 - DNA, 144 bp, Heterodera glycines
  Promoter: Source sequence=SeqID_19383; Location=2400..2543; Strand=-; Gene=SeqID_84106
tcagacaatgtcactcaattccatgccgcagaattcttctctagttgcagcgagtttggcatcaaacataccttcacccttgcgtatcacccgcaatccaatggccaagcggagagattcgttgatacgttcaaaagggccatg

SEQ ID NO: 104388 - DNA, 141 bp, Heterodera glycines
  Promoter: Source sequence=SeqID_14648; Location=1294..1434; Strand=+; Gene=SeqID_78747
ttcgttgagcctgtcaaaaaaaggaaatcgtttggacggaaaaataaacaaattctgccgattgtacgcactcggttgaactgcttggagatcgtgccgacccgcttgaagtccttgaacgggagttgtgaggcgacaatg

SEQ ID NO: 104389 - DNA, 53 bp, Heterodera glycines
  Promoter: Source sequence=SeqID_23199; Location=395..447; Strand=+; Gene=SeqID_53909
ttagaacatttaaaattacataaatactaataggttaaactagattaaaaatg

SEQ ID NO: 104390 - DNA, 391 bp, Heterodera glycines
  Promoter: Source sequence=SeqID_834; Location=920..1310; Strand=-; Gene=SeqID_62448
tcggtgtgttggtgaagaatttgcttgtttgtcgaggccgtttctgaacacaaatggaggggatgtaaaaagaagacaaaaaaacacacgaaaaaaaagagaaaaaactcacaaaaatgttgcagcgggtgcacttcgaaatgggcaaatggtagtagcgaaggtgaaaaggatgaaaacgcatccccttatatatcaaatgaaatttggcaaaatgttgggtttaagaattgtcgtggctgagattgtataaaaggaacggacattcgcattttcgctcacttcccaataataaaataatctcaacgacgataattgcgcaacaccttcaacccacacatcttccacacacgtcaacttcgaccgcgcttgttctccaatcaaccaaatg

SEQ ID NO: 104391 - DNA, 87 bp, Heterodera glycines
  Promoter: Source sequence=SeqID_30223; Location=1..87; Strand=+; Gene= SeqID_60658
tttggaagagatttcccatggaaaatttcgcgtcgcttcgctttcaattcattttggaggacaaccacggaaaaagtggtaaaaatg

SEQ ID NO: 104392 - DNA, 52 bp, Heterodera glycines
  Promoter: Source sequence=SeqID_31158; Location=1137..1188; Strand=-; Gene=SeqID_61532
aagaaaatttggccatgattttgagacaataaatttaattgaataaaaaatg

SEQ ID NO: 104393 - DNA, 1003 bp, Heterodera glycines
  Promoter: Source sequence=SeqID_498; Location=1411..2413; Strand=+; Gene=SeqID_45807
ttggatattcgcccctaaaaatccctattttgagtgttcgcccctaaaataagtttttatccctattttggcgtttcgcccctattttcgcccctatttcgcgaattttttgcccctatttaggtccctaaattggaatttttcgcccctaaaaatccgcaccctaataataactttaaatttatgaatgattgcaaaaattcaatttattttatttaagaaaataattagcaaaaacttcgcccaattagtgacactttttgcagcccttcgaattgtcctcagacaaatcgcaaaagccatctttgcaacggtcacagctgaacaaattaacggataaatggagtcattgtttaaatttattattattattattttaattttctgtccaatttctcccactttttcccctgcacattttccttgcaaaggcattgtccggccaccaattggcgtgccgtgtcatcctccgccacgcatgtgccgtcgttttgggtgccccttttgtcgcattggcatggacgacaaacatttgggtcttgaagagaacctctcatggaattttaaatctttaaagagtttttaagtgtacaaatccttcaaattggcattattttgaaaggacatttgaaacaaatgtatgtacgttaattcacttggcactgttcacaattcaacccttttgtgttgtgtttgcattcgtaaatgtcatggacaacctcataagaacggctttaaatcaacaaaataataataattaatcaaattgaaaattgtggcacattgccgcgcctggcatggtggccgtactcatattttgtgtatcatcgtgctgaattaagatttaatttgaaaaatattcaaaataggaaactctcgcacattttggcgcactgcaactgcacacaatgcaaaaaaaacgtccaaaattgtgtataaaagtcgctgttgtgatgcatttttctcatattttactaacggggcgtaacacaacgagaagatg

SEQ ID NO: 104394 - DNA, 429 bp, Heterodera glycines
  Promoter: Source sequence=SeqID_40752; Location=1..429; Strand=+; Gene=SeqID_69002
ttataagaaataaacttctaaatgcggaaaattctgaaacatacgaaattgtcaaaaaattttttatgttcaaaattcttattgaaaataacttttattttgaaattttctcaatgagaagaaaattattttctttaattaattttgaggtacatatctaattaatattttcgttaattaaaaaaaatttcgcttttagtttcaaaaatttaatgaacaatttttgagaaatcttttgtccatattttgggattttttcatttgttttataatccatttttaaaatatttttcaatataaatccgagccttaaataaattataaaaaataatagaatagtgtttttaataatattttaagcatttttcatatgaaaaagggccgactgatcagccgccgccgccttgggcaaatttggcacgggaaatg

SEQ ID NO: 104395 - DNA, 271 bp, Heterodera glycines
  Promoter: Source sequence=SeqID_22274; Location=416..686; Strand=-; Gene=SeqID_52945
ggtgcttcatttactacaaatttagaaattttcaagaaaaaatcttagaaaaattttttgtatgaaaataccaagaggtaaaaaatttttttatgatttttttgcaaaaattttcgaaaaaactttttaatgcatcataaattttttaaacaaaaatcgctgaaaaatttttgaaattccttttcttgaaactttcttataaagttctaagtttttttgtgaaaaattttagaaattttttaaaaattttagtgccaaaaaatcggcgatg

SEQ ID NO: 104396 - DNA, 72 bp, Heterodera glycines
  Promoter: Source sequence=SeqID_39065; Location=1..72; Strand=+; Gene= SeqID_67721
ccggaattacggcaaaaaaatcattttgcaaatgatttttaattgttttagacaaagcctcatcctcgaatg

SEQ ID NO: 104397 - DNA, 1003 bp, Heterodera glycines
  misc_feature (128)..(128): n is a, c, g, or t
  Promoter: Source sequence=SeqID_9441; Location=359..1361; Strand=+; Gene=SeqID_71429
accttttaggcaaagatctttttgtgattttctgaaaaagttttttcactaataacagtgatctgatctgggtgaaaatattgaatgtgatttacagtatgtcaaaaaatacattttttataaaatgngaattaaaattcttatccaaaatgctgacttgaattaataaataattacaattttcactaaaagtttattatttacaattattaaaataaaatctttgcaattgtcggtagcaaaacaaataaatattttgaaaaacttaataagacacaaaaatatcaacattaaaattccttaaatttttaaaaatttacaaattaataaaaaaaaaacttttttttctttatgatactagggctcggatttttaggcaaaagcctattttttttcctgagctccccgtggcctgaaacgcacgaaaaacatgtttttttgggctgttgttaagctacttttcgagttattagtgcctttttttaggcttttatttttaaagcctaaaaagcctaaaaaattttgaaaaaacctattttggcgttttgcccaaaattattaacaaaaatgcaataaaaacgaaaaatacacaagaattgattttttgggaattttaaaaatacatccctaagaatcgaccaaaatttttttcaaaaatacactgctaagatttttcaaaaattcatctccaaaatttatttatttattttcttgacaagaatttgtgatttagaaattatttatctcaatactgatttggctgaatttttttacttttttgaatacattttgtcattttacaccccctaaaaatgaggttttttagtgcctttttcccatttttagtgcctattttgggggtttttttagagcctaaagcctacctattttggcagtttttagagcctaaaaatccgagccctacttatgcccatatttgaaaaaaaatttccaattaaatatttcagaaagtgatttattcgccaaattgaacttacaaatg

SEQ ID NO: 104398 - DNA, 136 bp, Heterodera glycines
  Promoter: Source sequence=SeqID_16535; Location=415..550; Strand=+; Gene=SeqID_80943
ggtacggacagcgcgggacagaatctagagagcatccgggactctcgctactcgaattgcggaggctcgagaagtgatcgaccaagaccttaccgaaggggaggcagcgtaccaagcggcgcgacttttggccatg

SEQ ID NO: 104399 - DNA, 68 bp, Heterodera glycines
  Promoter: Source sequence=SeqID_33987; Location=694..761; Strand=-; Gene=SeqID_46372
tgtatgttgttacttgaacagatttaagcattatttaattttctttttcaactgtcacagtttaaatg

SEQ ID NO: 104400 - DNA, 440 bp, Heterodera glycines
  Promoter: Source sequence=SeqID_32125; Location=1..440; Strand=+; Gene=SeqID_62454
taattttgcaaaataataaataattgatgaaaaagtcagaatttggaaaattttaaaaacaacaagcgttggcattttttcaggttaagttagtcctttacaatggagaaggcctgcaaaatttggagagattatatcgattttagtgcgctaggttcgatgaaactttataaaatataagcctaaactttttggcctgtttaaaaaggaattaaaaatttttaaaatatttattcatctccctttttgatagtgaaagcatcagagagccttatttaacttttaattaacatttggtgcgtttcagagcacgttctaaaaaatatttatgaattaattttgcaaaataataaataattaatgaaaaagtcagaatttcgaaaaattttaaaaacaacaagcgttggcattttttcaggttaagttagtcctttacaatg

SEQ ID NO: 104401 - DNA, 212 bp, Heterodera glycines
  Promoter: Source sequence=SeqID_6215; Location=1361..1572; Strand=-; Gene=SeqID_60761
ttcactcgcgcattcccacaaacagccgacggtttaaacgccaatcattttatgttcattcatcatcatatttgacccgcggactggccaattcataagcattcacaccaaaagccattcccgacgccgcccaattcattcgactctcattcggactcgatcattgcattgttttcatttcactcataatcatggcaaatcccgcggacatg

SEQ ID NO: 104402 - DNA, 475 bp, Heterodera glycines
  Promoter: Source sequence=SeqID_25281; Location=1..475; Strand=+; Gene=SeqID_56027
gttggcattttcgagtctgacaataagctaagccccccccctttcttcccatggaccgagatcaaatgcatttccggtcaaaaacaaaatgttcaccatttgcactgcggacaaaagcaaaatcaaattcaaggcacaggacatgtcaatcaatcaggcactgattcataaattattttaaatttttaagctattataaatgggggaggctgtggcatgacgcccggctgtgctttgattcgattttcacgaaaatggaactgaattttgcaattcccaaataacccgggacattaattatgcctttgttcaatttcaaatttaaataattttttattaatttggaacaatttccggggaccggtaaattggactctcgaaaaatccccgcgctggatccctcccgttccgggaaatctgttgttttaattttttttttttctgatattttccaattaaatattcaccggttatg

SEQ ID NO: 104403 - DNA, 968 bp, Heterodera glycines
  misc_feature (740)..(740): n is a, c, g, or t
  misc_feature (762)..(762): n is a, c, g, or t
  misc_feature (771)..(771): n is a, c, g, or t
  misc_feature (813)..(813): n is a, c, g, or t
  misc_feature (829)..(829): n is a, c, g, or t
  Promoter: Source sequence=SeqID_5904; Location=2615..3582; Strand=-; Gene=SeqID_59624
ataagaaaaactcgaaaaattctaagatttccagagatccccgcttaatataaaactccagagaagtaagctttttttcaacgccaatgaatgttcgtattattgtgcgaattgatatgctatacaaatcatatattgttaaaagtatacaaatagctttcgagggcaaaatcaaaaaacgaaatcattagaattattttcttaatttcctttacaataattttttcgtttaaaaaatacaaaatataatttataaaaaattataattttaattatttcaaaataaggaatttccccattatgtataatgttaagaaataatgaaatatctattttattttatttgggagtatgacaaaacgtcgcccctcgaaacattgccgaacgaatttttggatataattctttagcaaaaagttcgaaatctatgtttttgggttccttttggccataatttttttttctcaaccaaaataaacattcttagtattgtacaaaaacacttaaagatatttttgtgatttggcaaaataataaaaaaacgcctagaggtaccgagcaacatcaagaatacttaatttgactaacacggacataattatggtccaaaaagtattctggcgacgtttcggccggagacattttgggatgcacccatttaatttatgcaattttcaaattatttttatgtccattatggtccaaaaaaagttttggggtgcacccatttaattcaccanatttttaaattaatttctgtgncccaatctncaaaagaaatttacccgagttccattaaggagaaaatacganaggcttaataacgttntaattgcatttaaagggggtttgttgtcaaaagatttaaaaaatgaaatgtgtacaaaaaattgcgaagtttggatttttggccatttctaaaaatttccttaaaacccccttaataatacagatagataacataaatg

SEQ ID NO: 104404 - DNA, 338 bp, Heterodera glycines
  Promoter: Source sequence=SeqID_29571; Location=1..338; Strand=+; Gene=SeqID_60047
cagtccccccgaaccgatgcgcccagatttatggggagaccgaatctttcgggattagcttccctatagtctgtactttaattctgcgttggattttgctccccataattgcgtgagtaccccaaacggacacttgaataaatcgatttttttatttcataaatattttttcagaaagtgctctaaagcgcaccaaattttatttacaagtcaattttagcactctgatgctttagtatcaaaaaggaagatggagaaaaaattttttaaaaatttttccttatattttggttatatcgttttgcttttggtggggtgcttggaacagtggaatcatg

SEQ ID NO: 104405 - DNA, 786 bp, Heterodera glycines
  Promoter: Source sequence=SeqID_10274; Location=1990..2775; Strand=-; Gene=SeqID_73433
aatgtgatgggaggattgcgccatgactgaccactaacccctcggggttatatccctccgttaaatgaattcgtgaccaaattagaccattttattcattgttttgtttattaccaatcccatgcttatataagctattcgtcttatctataccaatgttattccactcattaaataaataataaattaattttgtaaaaaggttcatacgagattaatgtttcctttctcattaaacctgattatgtatggtatctatatttaaaaatattcaataatttatcgagccgtggccgtccacgtacattttgctgccggtaatgccgtgcattgtactttttggattatgcaaaagtttttactgagaatccttgtcgggaatggccaatttggcaaaagacaatggccaaagagggagcaaaggccaacagaaaaattcgatttgaaggatatgcataactattttagaaaaatcatttaggtaatttataaatggacaaaaataaaaagaaataggatttttattccttttaaattcatttttcttgagggtccattctgatttcgaaattgcattgtcataggtcattcattatcactcgttttgatcaattcacctaattagtgaattaatttgctgctgaaattcccccggcgccatctctcaaacgattcacaatttttctttataaatctcctctcaaatgcttttcattttctttgtttctattttcgctattctcgcattccaaattcattttttggcatttgcaattcccgaaaatg

SEQ ID NO: 104406 - DNA, 364 bp, Heterodera glycines
  Promoter: Source sequence=SeqID_35269; Location=1..364; Strand=+; Gene=SeqID_64859
agaattaattggtgttaattgggaataatttaatatttgtgattgattttcttattatctaaattgtgatatttcctattcaatgtgattttcgtgcttagtattagtcactcttttttgttgttgatcgttctgtctaaattgctccacctccgcttttcctctctatttaaacacgcacgtttttcgcttcaacgcattcttttcatctgacatcttattatatttaccaaataaaacttcttttatttattcggtatttatcccccccttattcaccccgccctctctccctcgcgccttcccatttttgcccccctttgccgcccgagtcaacaagtggtgccgttagcaatcaaagatg

SEQ ID NO: 104407 - DNA, 151 bp, Heterodera glycines
  Promoter: Source sequence=SeqID_8996; Location=67..217; Strand=+; Gene=SeqID_69944
gctgaaaaaggtaacacttggatctgcagaggaacaacatgattataagaggtacaaccacgagtggaaggttcgaaagatacaaccttggctagaaaaagtaacactttggtctgcaaatgcacaaccataaggaggaattacaaccatg

SEQ ID NO: 104408 - DNA, 85 bp, Heterodera glycines
  Promoter: Source sequence=SeqID_16241; Location=1..85; Strand=+; Gene= SeqID_80620
cagtgacccgcggttgtcagcggttgtccgcgcggacaaaacgggcgcagtgtcaattgccatcgctttgggtgccgaggcaatg

SEQ ID NO: 104409 - DNA, 659 bp, Heterodera glycines
  Promoter: Source sequence=SeqID_283; Location=1..659; Strand=+; Gene =SeqID_47389
aaaaatgttttttttttgccgtttttgcccaattcctttgttggaaggacacaatctgtgataattattgttaaataagctgttaattttacttctttttttgtcttattttcatttgatagtttaatgatattccgtcggtccatcggcgggcgaatgcattgtcagcatcaagcacaaaaaattcaatctaattaggtatgcaacatatcggctgattgtcagcactgagagtgggcatgaaagcatagtatgctaatatgatgattgtgagataaatatgggtataagcgtcagcgaaagaatgttaattgattcgttttttcagatagtttggtatgtaagtctataatatttaaagacattgtgtaactctatatatagatgaatcgtctgtcggcgaaaccgtttgtcggcgaatcgtccgtcggcgaaccttcctgctcccgtttttctctataaattttaagcgtaaaaactaatgcattttgtttgcacatatgacaatgagttctgttactaattacttttgtcagatgtccttccttcttgtttacttggtctcagatttgttatcgttaattattcggtacatatttttattttttagactaaccatcctttcattgactctgtctttttcatcttaatacgaaatg

SEQ ID NO: 104410 - DNA, 879 bp, Heterodera glycines
  Promoter: Source sequence=SeqID_10636; Location=2926..3804; Strand=-; Gene=SeqID_73872
aaacccaactcgtactgtttttcgacaaaaaaattgtcataacttttaacattcttggtatcattcaataacccttaaaattctctatctacaagcaaaatgtaagaaagcgggaccgggaaatttgggcaagaccgggaccgggacttttttggttgaaaaaccgggactttttggctgggaaaaccgggaaaaaagccgggaattccccggtcccggtcaaaactggtcaaaaccgggaccttgtactcagttgtactgttatccgtaggacccaagcttaactagtaccaaaataaggtacaaccccaaaaccagaacatttattagaaataaccagggcttccatttttatgtaagaaaaatcgcgaaatatgtaaataaaatatgtataaaaaatgctaaaatatatgacctaaatagacttagaatcatcttttagtatttaaaaaaaaaaaaattaatttttgatatcccatttcaaaaaaaaaaaattatttttttggagcacattttcacaaaaaattctataaattctcaaaatttttgaaaaaattgcgaaattttggatatttttgggggcatttaataaaaaattccttaaaaattctcaaaaaatgcaaaatatgtacgaaaaaatgcgaaaaagtccagaatatgtataaaaatatgtacatatttaatatgtagaaaaatcccaaaatatgtaaataaaagtcccaacttttgttcgcaaacacaaaaaagaaagtgtttttcccactatttagagcatggaggccaggaaaaaaatatgtatttacataaaaatagaatccctgtttataatcaaaatgctaaaatttattgtttttttattgatgtaaatgactagggatg

SEQ ID NO: 104411 - DNA, 96 bp, Heterodera glycines
  Promoter: Source sequence=SeqID_30538; Location=1209..1304; Strand=-; Gene=SeqID_60954
aggcaaatccccttaattacaataaattaataattcccaagtttcgtttccaattcccccccccccccccctcagaattatttggccaccgcaatg

SEQ ID NO: 104412 - DNA, 84 bp, Heterodera glycines
  Promoter: Source sequence=SeqID_36236; Location=1..84; Strand=+; Gene= SeqID_46458
cttccaccagaggacgtcgcaacaatcatcacgcagaaggtagtcttcaacgccccgttcgacaacaaggccacctactacatg

SEQ ID NO: 104413 - DNA, 1003 bp, Heterodera glycines
  Promoter: Source sequence=SeqID_40204; Location=277..1279; Strand=-; Gene=SeqID_68608
aataaaaattatttttagattaaaataaagaattcgaatatgcaaaatttaatttaaaaagagatcccaaaattttacacttgaaaatttattaaagaattaatcaaaatgtattttatgttgaaaattaaataaattaatatttaatttaattaaataaacaaattaattattttaaaataaatttgactaaatataatttagttttaatgctttgaataatcatttttctgatttagcgcatattatcatggcgatctgttctgtatacccttgaacgaatatttctcattaattgaattttttttatttaaattatattcttttgtgcattaaataatttaatagtaatactattaattgcatatatcgatttttaatatttatttatatatatttttaatcattttttatcattttatttattagaaaatattgttagtaattaatgtttttttaaattatttttttatttctttacgaaattttaatcttcgttactttatatattcttttgggccgttgacgtaattaaatcttttagagtcattttatatatttttttcttttaatttgcttttattgtgtaataatttgatgtgtaataagtttgttttttcactttttaattctaattataatccgttttcgatatcaaattaaaacatttattttataactcctttataattataaaaactaattctttcatttttaaatgctttttacattgcctcattagttttattctttcattgaaactatttttttgtgaaaatctgttaacaaattgcactcaacttttcaaaattttgcccggcgacgccttcggaaccgctgaaaacttgtccccaaaaagtttttttgggaaaagcgcgccgcaaaaaaactttttattgtatttttttgatagtaataaaattttcaaaatgcttattttttgttagaaaaataatgattttgaaaattttcatctgacaggccctgatctaaactatgaatg

SEQ ID NO: 104414 - DNA, 137 bp, Heterodera glycines
  Promoter: Source sequence=SeqID_6785; Location=3093..3229; Strand=-; Gene=SeqID_62897
aaaaagcgaggacagatttttcgtcagtttcaaagtcgttctttcttctcttttttcattgaaaaaatttctttcgaaaatttatttttttaaaattttatttaaaatatttaaatttcagatttattttaatgatg

SEQ ID NO: 104415 - DNA, 376 bp, Heterodera glycines
  Promoter: Source sequence=SeqID_11760; Location=1..376; Strand=+; Gene=SeqID_75257
taataaatatttttaaagtaataaattgataggtcatctcatttctctgtttgtgtacacataaagctaacaaatgagcacctccaatataaataaagtgattgattcagagatgttaattaacaacaaattgttagcctaaggcaatcgccgaaatcatcgagaaatacgaggaaaagcattcattcccacccgctcccttaagtagctttgatcatttactaattaattacatttgtgcataaaaagaccgaacgcagcagcgctttcacattccttttttggctttgatcgcgaattattatcggatattatgtggctaaggacgttgtgctaattaatacccattaattaattgtttaatctattgaaaatg

SEQ ID NO: 104416 - DNA, 251 bp, Heterodera glycines
  Promoter: Source sequence=SeqID_191; Location=1933..2183; Strand=-; Gene=SeqID_77166
tctcaccctaattatattgtattgtccactaatggattttcatccattgacgtatttatttataggagtctttacataaagtgcagacggataaatgtacaaaatttttaacagctttttctcatggaggagagaatttttcagtccctttcttggggctcattcgtccgctctcaaaaatccttttttgtgagtaacttaaagaaagtgtaagtttgagcgaacgtcacacgaaaatttgggggaaaatg

SEQ ID NO: 104417 - DNA, 1003 bp, Heterodera glycines
  Promoter: Source sequence=SeqID_28851; Location=323..1325; Strand=+; Gene=SeqID_59429
aaaaatttttccatcggcgcctatcggaccggccggaccccccccccccccccccggttctgcaaaggttttttggaaaaagcgcgccacaaaaaagcggatatgaaaatcaaaaattttttcgcccgaagagcaaaaaaaagctcttcgcgaagttgtttctggctaggggcctgaagaggacttcgggaagtttcgactacgaccccccccctggacttcaatcgtatgaagtggggtgacaccccactactatttcatgcatgtttataaggatggaacaaacttgcatttgtgatgattcctcactacattttgatgtagctagttgaggagtgagaggtattatggtttatattagtatattccgttttccacttattcattatgtccatagtttcttagttattgtttataaatttttgcaaggtttttgaaattattaattcctagagaatacttaaagccataaaattttcaatgaaagaatttagttgtctttagcaattttatgattttatttttccattttaacaccatttggaggatttataaaagccctgcttgctgattatgaaccgacctatcagccaacagtttgtggttttttatgggttttgaaattttcaaaaactttatcataattttcgaaatttcctaaaaatactcattgacgcatcatcggagccagtttttatatcaagtttttgtttttttaattcgctaatgtggaaccctttcgccaaagtcatcatcattcatcaattaatcatgcaatgaaagtcgtccttcagcagcaatttaccaaaaaaccattaattaccccattttatttattaagttagagaaatcttttctctttttctccaaaaataatttttgaaattacaaatttttgtaataaacaaatttattaattaatgataattagtgaaaaatatgtttaattctatctccttttgaaggaataattagaaaaataaataatttagagaaaaaaatg

SEQ ID NO: 104418 - DNA, 64 bp, Heterodera glycines
  Promoter: Source sequence=SeqID_10135; Location=1..64; Strand=+; Gene= SeqID_73229
ccaaccaaatcgaagacagcaagcacccattcaaaatccgtgttttttcgaaaatgttgaaatg

SEQ ID NO: 104419 - DNA, 82 bp, Heterodera glycines
  Promoter: Source sequence=SeqID_4925; Location=1..82; Strand=+; Gene =SeqID_56227
atgtgccaagttcaaattggtgaaaaacaaatcgcgttttattatcaaagacatccctgctgaccctgaggcactcctaatg

SEQ ID NO: 104420 - DNA, 477 bp, Heterodera glycines
  misc_feature (34)..(34): n is a, c, g, or t
  misc_feature (69)..(69): n is a, c, g, or t
  misc_feature (74)..(75): n is a, c, g, or t
  misc_feature (97)..(97): n is a, c, g, or t
  Promoter: Source sequence=SeqID_25854; Location=1..477; Strand=+; Gene=SeqID_56624
gtcatggatttcgaagttctctgctggactttcnaatttatagaaatgatttatcaaaaaaagacaatnttacnnccaaacacttcgaaaatgtatntgatttgcgttgtatgggctaaaaatgataaagaatgagatttttgggaatttttatgcaaaaacacacttattttttcaatttttaacacatattttagcacatattttggcatttttgggggtttttagcacatatttcagcattttttagcacatattttattacatatttcaggatttttagcacataaaaatccgggccctagtaattacgttttttcctgcgcagaatttactttttaagcgatttttatgcaattctacttttaaaatacatccaattatctccataatttgatatcttgacacatttctcttaggaaatgaattacccatccggtagtatttactcaccactaataaacacaagaaaatatg

SEQ ID NO: 104421 - DNA, 92 bp, Heterodera glycines
  Promoter: Source sequence=SeqID_8654; Location=822..913; Strand=-; Gene=SeqID_68780
acttttgaattttggagggatgctcaaaattactaaggaaagaaaatacgggaaaagtcggagccaacgaagagcataaattgccgacgatg

SEQ ID NO: 104422 - DNA, 96 bp, Heterodera glycines
  Promoter: Source sequence=SeqID_32440; Location=1..96; Strand=+; Gene= SeqID_62746
tttgtccacttactgctattttgtaaccccgaactccacacaatttgttcgaaagtcgaaaattttggtagcagaaccaaaaagtgagcaaaaatg

SEQ ID NO: 104423 - DNA, 84 bp, Heterodera glycines
  misc_feature (79)..(79): n is a, c, g, or t
  Promoter: Source sequence=SeqID_25610; Location=1847..1930; Strand=-; Gene=SeqID_56358
tgtgagcagtcaacagtttctgttgcattgaagctgttcattggtgagcctccaaaaaggaaaaacaatactatttcanagatg

SEQ ID NO: 104424 - DNA, 1003 bp, Heterodera glycines
  Promoter: Source sequence=SeqID_23697; Location=330..1332; Strand=+; Gene=SeqID_54389
gtgccctaaaaagggagctcaagcacttttggtcgggatttcttccaaaaaagaaggaaaaggaaaagggaattaaatggaaaggaggcaagtgattcggtggtcaagtggttagtgtgcttgcctttggttctgtgatggctgatggttcgagtcccattaatttatgggattttcccgtcaaatattatatttaaattattcgttttaaaatttatttttaatgttttttttataagaattttatgagtgagttaaaagagaaagaaaggcataataaaaaatatggaggagcaaagtacttttggataaaaattgatttctttcctttctttcctttttttatatgtaatgcacactcgccagtggtctttaacctcgccttttcaataagcaaaaaatgtctcctccttttctttccccagttcattatcaattgtttccatttacatcagttttttactgctcctacttttattcaataaatatttccaactaaattattgctgttttaatagcataaatttttagtttttgcctttggtggtggtgggcgacggctcgggtcccacctattctgggtgttttcatccattattttattacattttttgaacgattttattttttttaaattaattaagtttattaaaaataatttattttaaatattaaaaataataattctttcttcctaatttagcccaaaaatctattgtttgaccttttttgtgcaaaatcatttaaaaaatggagacaaattaataagttacctaaacataaaattataaatattttatgccaaaaaaagaaggaaagtgaaaaggaaattaaaaggaggcaagcgatccggtggtcaagtagttagtgtgccttcctttggtgctggcttcccatgggttagagtcccatttcttctgattattttaaagcaaatattatattgaaatttttctaatttttgtttttttacaatttatttttttaattaattaactttatg

SEQ ID NO: 104425 - DNA, 508 bp, Heterodera glycines
  Promoter: Source sequence=SeqID_22745; Location=1..508; Strand=+; Gene=SeqID_53436
ctcaagaccgagattcttgtccagcaccaagaatgaatatgaaacgaattaattactgctgcatttcgcatttgcctgaaccctctgtcccactttacgttaaagccgtaatattttttcaaaaattttcataaattttctttttaccaattccttcttttttcaagaaaaatgatgaatgattatttcgttgtcgcattaaatgttttttaatgcttctttaatcaaatgtaaaaactaaaatggcgaagaaaaagttttacgataaaaatgcttagtaatcattcaaatgtctgtctggttgaatttttctaattatttaattaaaaaggcattcttcgcaaaattgtttcacatcaattgcttctccattccttttgtcatacacaaaatgttaacaaccaaacattttttttagtataaattgagaaatttttgtaaacaaaaaatcaaaaataaattaaatccaaaaattcctccattattgaaaaatttaaattaaaaaatg

SEQ ID NO: 104426 - DNA, 424 bp, Heterodera glycines
  Promoter: Source sequence=SeqID_15979; Location=123..546; Strand=+; Gene=SeqID_80337
tggtcaatgtgatggtagtgccaaagtcaatgccaataacgacaccaacaacggcaacaataataataattcacgatcgtccccccaacgatcaccccaactgcatgcacaaaaagtgaattgttttccacaaaaaaaaacaatataaaaaatttctaacttcctgaaatgtttaaagaaaaaccttaatttatttaattaatttcccgatatttttttattttcaaaaattttgaaaaatccaaatgtttaaattgtttaataaaaaaaaaaaacttttaagttagaaatttaaaatttccttttttgtaattattttaaaaattttttggcagtgcaacgccgaatttaaaaaaaaaattataatgaaatttatattgaaacttaatttattataattttcaatattttatagcggcaaatg

SEQ ID NO: 104427 - DNA, 686 bp, Heterodera glycines
  Promoter: Source sequence=SeqID_8014; Location=2737..3422; Strand=-; Gene=SeqID_66688
tcttaaaaattaatgattatttgttaggattttcgctgccgccaagcgccagaatcagtggaaatcgtaagaagcacgaagcctacctaacctggagttttcagaagtttttcgagatgaaagtcaaaagaatatttaagaaaaggaaggatcatccatcttcgggataaatttttttttggtttaggttcgttgcgcctggaaaactgttccccccccccccaaaaaaaaatgttggatcaaactctgcgcctgcctcgaatattattaataaaatgatatggaagtaaattaataatatatttcatagaaatgaatatataataaaaatagcatttaaatagcaaataaaattattttttatgggacggttttttataaaagttaattaattcgtcaggaaatcgaaaagttgaaaaagttatgctcttctgtgatgagccggcatttaatgtgaataaatgaacgatttatttgcttgtaaaggtcatttgttctcagccaatagatggaaaacggatatgcaaatgggcagaaaaataataataataataatgacctccaaaatcaaggagaaatcggcaaaccatcaataaaaagaagcaacggaagactttcaaatgccaaatttgggggtccaaaatcccatttaaaaaaatgttttacaattagattatgaataaatg

SEQ ID NO: 104428 - DNA, 258 bp, Heterodera glycines
  Promoter: Source sequence=SeqID_2642; Location=647..904; Strand=-; Gene=SeqID_80861
ttggaagaatttgcagaaaaaaaaaatgtaaaaagaaatgaatgagaagggcattctcgtcgtcgatgacggcatatgtttgctcttctccgttcgcgtctcgacctactcacaatatttattacgctgataagaaaaaggggccatctcaaaaaattatgcaaattatataaagctaaaaaaggatgaacggtccggtatataaatggggacaaacaaatttagtttcattttgatcagattttcaaaaaaaatatg

SEQ ID NO: 104429 - DNA, 647 bp, Heterodera glycines
  Promoter: Source sequence=SeqID_1801; Location=4344..4990; Strand=-; Gene=SeqID_76063
ttgatcaggaagccttgacggggctttttgggcgcggagagaatatgatcaatggaaaagttagaggatcgttttcgtggttccatttttttaatctgagagtggagtgaggaggaatgagtaaaatctcggtatttatatgcgagcgccggcatggaaaatggcgtgaaatgatgaatgaataaataaacatttggagatggaaaaatttcaaaaaacataaacaaactatggcctgaagagcagcacaccgccacccatgaagcacaagacgacagggcacctaaacgactcgggaaattagtcaagtcaagcgaacgacctcaagccttaaaaggcaaattgctgccaggataaacggagctttttgtaattatagctaccgccctggttaacagcaaaaatattaatttaattatacggtcccaaaatcacaattaaatgatacggtccccataaagcacaggacaagtgagggcggagaggaaaacagcagatgtgcaaaaaaaaaagatgaaaatttttaaaatgaatcgggaaaatgaccgggtgtacgatgtgtgcactttggccacgcccacttgcgcaccaccaaatgattcccagcaagaaatcgaaatcattctttattcaaattctttaaaatg

SEQ ID NO: 104430 - DNA, 123 bp, Heterodera glycines
  Promoter: Source sequence=SeqID_28705; Location=579..701; Strand=-; Gene=SeqID_59283
tttgggaaataaaatctttgtttgatatatatattttaagtttatcagcttaataattttctaatttaaaggttaaaatgattttaatcctgtctttttcactttattttcaaattttaaatg

SEQ ID NO: 104431 - DNA, 714 bp, Heterodera glycines
  Promoter: Source sequence=SeqID_21178; Location=203..916; Strand=+; Gene=SeqID_51765
attaatgtaaatagcatacaaattggcaattatttaaaataaagtctggacttggatttgcatattctggagaaaatccaggaaaatccaaattgccgaaaaattgcatggacaaatttccaggaaaaacctaggcatatagattcatgtccagatcggtctctaataattaattaatttggattaatttgtaaaatttaatttaaaaaaaacattgacatttttattgccaattttttaaattaaattttaaatttttcatttgtttgttttgccaaggttgcctgcttcaatgagcacgaatgttgctcggtgtgggccgggaaaggcgagtgcgagcgaaaccaagcttacatgagttcatggtgtaaagcaagttgcagacaagtaagccgaaaaacaaaataattatataaatataatttaattataaagggtttatctaaaaattaatttttttttttataaaacattcaaaaattttattttaaattaattgttaactaaatgaaattccaataataaaattctaattattgaaaaaatcaaaatttattattcatttattttacacaaaggacaaaagaaaaaattatttagaaaaaaattttgtgaaaaatttactatttttcaatgttttaatttaatgcgtttaatttaatatattgaatttaattaattaattattttggatttagtgcgattttgactatg

SEQ ID NO: 104432 - DNA, 285 bp, Heterodera glycines
  Promoter: Source sequence=SeqID_32297; Location=1..285; Strand=+; Gene=SeqID_62605
agatttgaccagcatggaaagccggtcggtctgagcccactcctcggttaaccccgtgaactgcttgaatttcttggttaaggtgtttccgaagaacgaaaagggtcatttcattttgccaaaggatgagaaagggtcgcccttcttccccgtcgatgatcgaacagtgcctatttttccatgggaccacgagaaaggaatgccaacatttcctgtcggtcagcctttgaatattagataattgtggtttattctggtaaattgattgttgtacgcttccagatg

SEQ ID NO: 104433 - DNA, 169 bp, Heterodera glycines
  Promoter: Source sequence=SeqID_29990; Location=295..463; Strand=-; Gene=SeqID_60451
aactaaacacgataatttgtgtttaaaataatttaaaattagtttaattatatttaaaaaaacagtggataagtagggggacgttaccaattattcttagacgaggttttgccttcttttaattgaagctgctttttgtttaggccgaaagccattattatgcccaatg

SEQ ID NO: 104434 - DNA, 98 bp, Heterodera glycines
  Promoter: Source sequence=SeqID_40519; Location=1..98; Strand=+; Gene= SeqID_68822
gggcgcttcgcgcctgttttttagcttgttaggccgcttcgcggccttggacgggcgcttagcgcccgttatttaaattttgaggtacaaaagtgatg

SEQ ID NO: 104435 - DNA, 287 bp, Heterodera glycines
  Promoter: Source sequence=SeqID_4209; Location=1071..1357; Strand=-; Gene=SeqID_53604
ttagggatgtggccaccacccagtgttcttattgtgaatcatttgtcacgctacaaacaaattcaatataattctcttccccttcagtctgccaactcaagtgcgtgtgggcgtcatgtcattttctttttgtactgtcgatgtgttggaatgacctttgaaaaaattgtcagctttttgcactatggaaaggtgcaaccagatgctcttgtaaacaattttgtaaaaaccataattttaaaagaatataaataatgcaaaaacagttggaaaaattttaaaaaatg

SEQ ID NO: 104436 - DNA, 1003 bp, Heterodera glycines
  Promoter: Source sequence=SeqID_12367; Location=2153..3155; Strand=-; Gene=SeqID_75971
ttaaagagggagcccggaaatgcatagagcatcaccgaacgacaacaaccaccacaacgccgccgcaagccgagggcgagttttggcactttttagcaactataaatatcatcccaaattattacttttgcaatttttatggcattgatcactaggacatttttttattgtcatcatttttttcaatgaaaaaacctttttctggaaattaaattaaatcaaaagaataatttaattcaatgaattaattaatattttttcaattaatatgcattgatttgcggatataagatgtttcttgttgttattagtgcatttttttctttcacattattcgttgggtattaatgatggcgattaagataaacgcaaaacaatgcattaatttgaatcagaatgctttcactaaaagaaagattatttcattttaataggaatgacattagaattttgaaaaaataaaattaaattaaaatttcagtttttattttttatgcttcaatcgacaaaaataaactttttcatcgcattatttctcttccatttatttgttatattttttgtatttcataaatatttaaatggaaacaatgggccaaaagcaggcaaaaattaaataaatttaaatttcatgtattatttatttgtttttatttttcaccctaccgtaccctttgccctttacagtaaagccccggcacagagaaagtgcactcgcccacaaattgttggacggcctttggggcattgaaattggcgcttctgttcagaatccctttggtttacgtgcactgaatgtggactactcagatgacccaaacgcattttatcagcaacatcaaacggaaattgaaggtcggcatttggaagaggacaatggcattggcatttgatgggattggccaaaggcaatggcacttttagcaaactataaaaaaaccaaacaaaaccaattggtcgttctgttgttcagcaaacagtccattaattaactattttcatg

SEQ ID NO: 104437 - DNA, 612 bp, Heterodera glycines
  Promoter: Source sequence=SeqID_1421; Location=1021..1632; Strand=+; Gene=SeqID_73446
attacatcttaattatacaaactttgggaaaaggtgcgatggtttgcttttttcaaggacatcctttggatccaaggacgcttttccatgtcctgttttggactattcacatagtttttttccatctttgatgttttgtcagacaatacaatttctttctttcttttttgtatttgtttgctcaccgacccgctttcattcatcccgacaattgctgctgttgctctcgttgaatttttttttgcctctattgcaagccgagaacagcatgctctcgagtggagaatgttcatgttcatgcaccctaacctcctaccccaacaaaatttccacttgagaatgtatttggagcattttttgaagtatgccatcgcttggagatggagcggagcgcggcacttgaacaacgatttgttggcattttaggagcaatttttgagtggtgtgccaaccgacagtcgcgcatgcaccgccgataagcctctggtggggggagcttggccccatataaaaggcgtaaatcccaaccaacaaatcatcaatttgcgaagtcaaaaaattctttcaatctccctcacattcaattttcttggctcaacaaacaaaatcatg

SEQ ID NO: 104438 - DNA, 106 bp, Heterodera glycines
  Promoter: Source sequence=SeqID_10204; Location=975..1080; Strand=+; Gene=SeqID_73326
agtaaaaatgccattttttttttttgcaaaattttccattttcacctcccctttttatttcagtgtaacaagtccaagtacgacgggatcaacaggttcaactatg

SEQ ID NO: 104439 - DNA, 576 bp, Heterodera glycines
  Promoter: Source sequence=SeqID_285; Location=841..1416; Strand=-; Gene=SeqID_81141
ataatattctgctcattattagtttggtcggtgtaataaaaggatcaaattaaatcgactgatcatttatttcctctgggagcaattaagatcaattagaagtgaacatggtcagatagatttgtgcttcaatattttgtaattatttgaaaaatttctcaaaattataaaatcatatatagacggaaaaatgtttgtaaaaacatgagaattcaaaagaaaatgttaatagttatgatgatcacttgcgtgaccaattttaattagtaagcaattaaagaaatattgaaagggtttaacttttttttttttgcaaattggaaagatcgattcacaacactatgaattaaaaataacatcgttgatcatcataaatttttcttaaaaattcctttttcctctccaggcttaaattcaaaattttttatccctttttctctcataagcccttttcccagcctttccaattcaaatttttcccatcgggccaatttcccattccctgaaaatccccttaatcccgcatatatcccattttgccgcctcatcggaaccgccccctgcaccgcccacatg

SEQ ID NO: 104440 - DNA, 249 bp, Heterodera glycines
  Promoter: Source sequence=SeqID_3194; Location=1..249; Strand=+; Gene= SeqID_83618
acggccccaggcccggacggcatccgttactcagtttggaaaaagtatgaccaaggagcacatgtcctgacgtctatctacaactgtgtcaaaagagctcaacacatcccccgaaattggaccaaatcagtcactgttctgctccataaaaaaggagaccgaaatgaagtgtcaaattggcgaccaattgcactttcaaataccatcggaaagttatactcttcagttttggcaaaccgattggcaatg

SEQ ID NO: 104441 - DNA, 120 bp, Heterodera glycines
  Promoter: Source sequence=SeqID_27018; Location=1..120; Strand=+; Gene=SeqID_57742
ccttttccctctctctcttttcatttatatttcttaatttcggacttttgtccctctccatccgtcactcctcaaattgtattaatcacttccatttgccattttcccattcagccaatg

SEQ ID NO: 104442 - DNA, 428 bp, Heterodera glycines
  Promoter: Source sequence=SeqID_2523; Location=1955..2382; Strand=-; Gene=SeqID_80198
gcctttttaagtttcgggctgtgattttttaagcattttaaggccataatttgacaatttttgccatttaattgggtacttttataattttttaaaattttgttttctggggttttcgggtacgctgatcacgaatatgacattcatgtccatctattaaaaccccggaccagaattcgaacaaaagccgaaaattatttttcacatgtattgtccaaaaacgattcaagtgcactgaatggccgtgaatctctattttttatattcccgtctatttgaatcgtttttaaatgtgaatttggtgaaaaattaatttcgccttttgtttcaattcgggtccgggatttgaaatatgtgaaactttggtcgttttggggtatttgttttaacaattttggtgaatttattcattttttaaccagaaaatg

SEQ ID NO: 104443 - DNA, 767 bp, Heterodera glycines
  Promoter: Source sequence=SeqID_11469; Location=1348..2114; Strand=+; Gene=SeqID_74872
ttcactgaaaaagacaaaaatgaaaaaatgtaaaattcgtaaaaattattattttacattaaagccccataatcatggctttaagaaaaatgtatcttcccccatgttttacgtaggaagacaaaataaaatatttcgtgtcaaaaaatcgatagaatcgataatgccaacgcaaagaaaattcatggaaaagtagcgaaaaatatttatgaataaaattattataaatcagaagacacaaaaatagttttaaaatgatcaaatgttaattatgaacagggctcacaattatgaggctttggcctcattttgtggttttttaaaaggcaaatgaagcatgatttttacagtgaagctttgagacattttttgtggggttttttttggattttttgcccataaacaaacaacacaaattactattagaaatatttgcaaaatattaataaagatttattattatttaaaaaaatttccatttatatgaatttcacccagcaacaatatattaaataacgtcaaaactatgtattcagagtagaattcgcttcttttcctcttttttcccaatctttcggctgtcaataatcaaaacacacggagaagcgcgcaatttcttaaattaattttgagttaatttggaatttcttttttgggtattattttaatttaattagtcattagtcacgcttgggtgcgatccgggccgaccctggggaggcattgggttgtggggacaaagctttctagaaagtccaattaaaatg

SEQ ID NO: 104444 - DNA, 496 bp, Heterodera glycines
  Promoter: Source sequence=SeqID_12924; Location=1..496; Strand=+; Gene=SeqID_76673
atcaaacaggcgcgccatatgtttattcttttttttctcttaaaaatttcatcatttgctgagcaaacatatcgcatttactatcttcaattcaatcactcaaaatttatttttggtaaataaataaatatttgtttaaattaaaatttgattttttttttggcatttctgatattttatttaataatttttatcggaccacttgtccggtctcggaatgatttcaacaaatttataaataaattattacaaattaaacagtcatgtcaaaaaagtgttgtttcatcctctttttaggctgataaaaaaagatcttttacatcaacttgatcagattacccttaataaaatcaattattcaattcaaaaaaatcattaaaaacaaattcttttaaataaattttctaatattattttaattattaaattatcatattttttaaatcttaaaattaatctcagcagtgaattttatagtccattgcttgttaaaatg

SEQ ID NO: 104445 - DNA, 264 bp, Heterodera glycines
  Promoter: Source sequence=SeqID_2318; Location=7355..7618; Strand=+; Gene=SeqID_79089
aagttagatggaataaataaaagttataacaaacttggtaatttatgttcatttctgagcatcagttttagaagaacaaaatttataattcattaatttgaatctttaaaacttaaattaaattgaatgcaaaaattgaatttacgcaaattaaccaaggaaaatgctttataacattagacaagaaaaattgttgatttctctaatgtttactatggcaaatgcggtcatttctcaattttagtgagagaaatttatttaatg

SEQ ID NO: 104446 - DNA, 67 bp, Heterodera glycines
  Promoter: Source sequence=SeqID_16133; Location=1329..1395; Strand=-; Gene=SeqID_80497
gcagcgctaatgatagcggtcatgaggtgatccaacagcaggactattatcttcaccacccacaatg

SEQ ID NO: 104447 - DNA, 88 bp, Heterodera glycines
  Promoter: Source sequence=SeqID_19931; Location=87..174; Strand=+; Gene=SeqID_84691
cgtgagttgatttttgtttttcgcctaatattttgttgcattaaaattgcagcggatctcaattttttcgtaagagatagtgagaatg

SEQ ID NO: 104448 - DNA, 75 bp, Heterodera glycines
  Promoter: Source sequence=SeqID_27985; Location=1..75; Strand=+; Gene= SeqID_58642
ttgcaaaaccgaaatttgtgggattcaccgccggcgagtgacggattttacggacggatgagaaacggcgaaatg

SEQ ID NO: 104449 - DNA, 384 bp, Heterodera glycines
  Promoter: Source sequence=SeqID_1836; Location=381..764; Strand=-; Gene=SeqID_76258
tctgtaacagatgccgcgcctcgacaccatgaaacttttggtgcccaatcttaaccacagctttccgggtacttttgacaaagatagaattaaaaaatattaaaaaattaattaaaatatctgactttttgtgatcagtaggattgaaattttaattatttaccttattattataatattattaaatgtgacaaataagtagagagaaaaaaatcaatttacaatttaatgagtgttgtaatcatgtcaatatttcactttaaaatgtgtagaatttataagagaaaaatataaaattcattttgagaaatatttttatattcttatttatttcgttcttatcaaaaaatattattataatttctaaaaaaaaattctgcaatg

SEQ ID NO: 104450 - DNA, 439 bp, Heterodera glycines
  Promoter: Source sequence=SeqID_8164; Location=1..439; Strand=+; Gene= SeqID_67187
cattgcttatcgcgacagaatacgtggaaagtaaaaatttgtaatccgaaatcccaatttcaacggaaatattccgtattgggcaaattcgagaaaatcaggtcgccgaacaggctgaagacttaagtgatgaacagaggaaagagtgggttgaaaagaccaaaaagagcgaattggcgtttgtctatgagtttttggaaaaacgcgttttgccacatgacgttcgcgatcgagaaaattattgtcatctttgcacaatttttcgttaatcaacggacttttgttccgcaatgagaacgatggaaaactacagctttttgtaccaaaagagttcagggaaatgatgataagagaaaggcactcgggaatttgtgcggggcaccttagcggaaaaaaaatttttcgtcagctctcggagctttacttttggccaaatatg

SEQ ID NO: 104451 - DNA, 176 bp, Heterodera glycines
  Promoter: Source sequence=SeqID_35831; Location=1026..1201; Strand=-; Gene=SeqID_65298
cagatgcgtcacgagaacgagctgttgaggcgcgcgtgcgcaaaggaacgcgagcgccgtatgttcactaccaacgcgtacagacagctgttggagcagttcaaccatttggtggacttccggcgcgtggttgtggccaacggagggggcggactgtcggaacaactgcaacaatg

SEQ ID NO: 104452 - DNA, 60 bp, Heterodera glycines
  Promoter: Source sequence=SeqID_20563; Location=1..60; Strand=+; Gene= SeqID_51115
aggcagatttcatttaataaacctaatttgatttgagctccttattcttgaaatcaaatg

SEQ ID NO: 104453 - DNA, 821 bp, Heterodera glycines
  Promoter: Source sequence=SeqID_8779; Location=765..1585; Strand=-; Gene=SeqID_69199
atagaaccgatcagaaatggggacggacggaggacggaaaagttatcagaggaaaatgcgatcagataatcagcccaatccattgtagtcaatttttagtgtaattaatccgaccaatttgtaacttttttgtgcaattggcaatggcttttgtcattaaaaaacaattttggaaaggaaattaagcacaataatccatctttttgtatccatttttgtgttgtgcaatttttggaccaagaaaaaaaattgattgatgatcttccctaattatttttttattttgaaagtttttccattatttaaatttttccgattcttttttttgcgtcatcccactgaacaaataataatttctttccaaatgaatgggaattttgctgaactaattccaattaataaattcaattaattaaatgcttcgctgtaattttgtcaataaatttggaaaatatttctccttttttctccccataatttgtcaacttttaaagtgtgaagtatgttttggatttttattattataagaattttaaaaaatgaaattgaaaatttaattttatttatcaaaactacaaattcaaaactaaaattaaaattttcgaacattaacattgaatttcttttttaatgtatagcatttgatcgaataataaaactcattgtcagccaattgcgattgatttggcggcacaacacggcacgcgaaatcggcatggaaatggcgacgtggttcagctgtgggaggagaatcagcggttgagcaccaccgaatttgggaccaaattttggcaaatttcaattttagaaacccaaaaatg

SEQ ID NO: 104454 - DNA, 626 bp, Heterodera glycines
  Promoter: Source sequence=SeqID_24971; Location=1..626; Strand=+; Gene=SeqID_55706
ttagggaatagagggtaaaatctatcccactttaaaagtgctttacatgggcaatagaggctggaacaattggaaaattttgcgcaatttttggcaaatattaaaactaccgttaatttttttaattttaaaaattcaatttttgttgttgtttgagctattaaaaaaatcttttattaaatctttctaagttcaaggaaaatcatgattacattcaaaattttagtactgttaagaacaaaataaaaacaggtgtatcattcaaaaaataaataaattttatttaaggaaaatgtgtcaataatcaaaatattttaccattttaatcagtaaaatatatacagttgaaataatttataatagatttaaattttgtattaagttttgtcaattttttgttttgttttgtgaaaattatttgatttcacatctccaggattcgaacttggttactttttttcatttaattaggcaaaatgatgtcctacataaatgataaacaaatgagccaaaggctaataaaataaagataaaagaggctttaacaaaaaatgtgaaaaattacaagcaaagaccaatcggtacttgtctagtttaggtgatacgtttaacaacattttcagatg

SEQ ID NO: 104455 - DNA, 154 bp, Heterodera glycines
  Promoter: Source sequence=SeqID_2968; Location=1..154; Strand=+; Gene= SeqID_82557
tccatatttttaccagccctagtcatcagtgcagcattttttgtttacaattattaataaaatattttcaccgaaaaccgatataaattctaagtttttaattttaattttatggtttttcgtcttatttttccggctgatctctaccgtaatg

SEQ ID NO: 104456 - DNA, 276 bp, Heterodera glycines
  Promoter: Source sequence=SeqID_3739; Location=1328..1603; Strand=-; Gene=SeqID_51695
atatataagaaaaaaaaaatttggtctgaaaatcaaaaaacaaaatagcgcttcggattcccacatccgacgaaatctttttctggctatgggctgccttcccctatattgtcatgaatttttttttaatatcccatagaaattggaaaacatttttgaaattttagatattatctatcactcagccaaaaaaaaatgaaaaaataataataaatttgtttgaaaatttaggcggatcattattttaaacaatttgaaaaatttgttgaagcaatg

SEQ ID NO: 104457 - DNA, 279 bp, Heterodera glycines
  Promoter: Source sequence=SeqID_34718; Location=668..946; Strand=-; Gene=SeqID_64440
ggcactaaaaatttgttttagaaaaacaaaaaatttttccaataaaatcattattttgaaaaaatgatttattataattaacatttttttaataatataatttataaatttttgcatctaatttcaatttcaatgccactttctaaactaacagaattttaccagaaaaatctttgttcatttttttaaattagcaaatttagataatttttgactttgagtacttttctcacctattacaatcacttattgtgaaatttaattcttttttagataatg

SEQ ID NO: 104458 - DNA, 370 bp, Heterodera glycines
  Promoter: Source sequence=SeqID_1832; Location=1488..1857; Strand=+; Gene=SeqID_76218
gccgttggtcttataagattaaaaaaaatttttttttcggaaatttatttttaataattcaaatgaaatgtaattaaaagtaaataaataaattattgattggccaataattacaatgatttaaaataattcttatatattttttcttcatttttggaggttcaattaaaaacagttgaactttatttctgctaaaaatttgctaaattttaatcaataaattcactttaaatttgatgtgcccaaaatgtctgccaattatttattaaatctcaattgaaattacaaaaaattcttgcaattaaatgcgatcaaatcttcaaaaagcttgtcaatggacgacaaccgattggcaactcgtaactcaatg

SEQ ID NO: 104459 - DNA, 59 bp, Heterodera glycines
  Promoter: Source sequence=SeqID_6618; Location=2900..2958; Strand=-; Gene=SeqID_62223
gggaacattacgagacgacatttttggataagtcggccttgggactgcgaagcaaaatg

SEQ ID NO: 104460 - DNA, 487 bp, Heterodera glycines
  Promoter: Source sequence=SeqID_13826; Location=1573..2059; Strand=-; Gene=SeqID_77765
agtaaaaattcgcaaattcaaggcggtgtaaaatggttggaaaatttatttaaaaaaaaaagtaacaaaacagccaaattagtagtgagataaataatttttaaaatcaaacattcataatccaaaaaataaataaataaatttaagagaagaaaatttttcatttcataggtgtgtatttttttaaattcccaaaaagtcttatgggtatattttgcttctgtttttttttcttgtgaaaaaatggctaaaatgtgtgctctaaaacgcaaaaatggcaaaaaattttgtgtttgcgatcaaaagttgggaattttatttatatacctattttggggttttttcgatattatatatgttcatatttttatacatattttagactttttcatacatattttgcaaattttttcttacataattttattttacctagtttatcaataaataacaaatttaaatgatcaaataaaacatcatacatatg

SEQ ID NO: 104461 - DNA, 926 bp, Heterodera glycines
  misc_feature (23)..(24): n is a, c, g, or t
  misc_feature (45)..(45): n is a, c, g, or t
  misc_feature (56)..(56): n is a, c, g, or t
  misc_feature (60)..(61): n is a, c, g, or t
  Promoter: Source sequence=SeqID_9187; Location=1..926; Strand=+; Gene= SeqID_70529
tcgagagcttgaactgtaccgtnngttatattctctgtcatatanaatctcataanagtnntctcaacagtactgtaaggaaaaatataataaactcacccggatctgattcgaaaataatcaatgtgatattgacctcgtttttaatttaaataattaatttgtggcattttgtctatttaattttgttccacttctaaattttttttgttttctcagtgttttctcatattatattttggcttcaaaatgatggtaatttattctcatcgctctccgactttcgaatttttattgaattaaatttgttctgttttgtgctgtggactttaatttgtgttggagatacacttttggttttaattgtttgagtgcaattcttttttgttaattttggttgacgacgaacggggacgagaagtgaattcggaggagaagagaagagcccgcaaaagccctgcatttgtgttctccctcattttcttcgaatattttcgacgtggcgctcctgcttttctgggtaagctcagcgacgggatttgattcgattttcggttttcaacaaaaagggagcaaaagtgggaagtaaattgggattgagcgcattttgaggaaaattagtgattcacagggtgaacactaaacaatttgattgctgtcattcgaaagatagatccacaggttgggctatcagattttgaatttgttatcggatcaactcgccgtttttcttcacactcgccatttttgttttgttccgcagtacggacaaagcacaactcaacgattttgtttcaacagcgacactctcagtaaggggttgcaacaaaactgcatcaaaagcgacactctcagaaaggggttgcgccacacagattgtggttatttgaaattcagtggataaaggaaaaaattgttgaaaaatg

SEQ ID NO: 104462 - DNA, 62 bp, Heterodera glycines
  Promoter: Source sequence=SeqID_18637; Location=880..941; Strand=+; Gene=SeqID_83292
aaatgggttgataatccacatggattagccgaagagcaattaaaaccgaagggataaaaatg

SEQ ID NO: 104463 - DNA, 871 bp, Heterodera glycines
  Promoter: Source sequence=SeqID_38657; Location=1..871; Strand=+; Gene=SeqID_67406
agaaaaaggaaatacaaaagcaaaattggctatctcttccttgtgaacgaatttttcgtcaatacaataaaatttgaccaaaagaatttgctatttatttactgctcattggtcatttttatgtatttttacaatatgaatatttttaaattagactttctcaaataaggctttttgcaagcaaaagagattttcgactttgtattctttaatcaaactaacaattccaattcgatacaaatttttttggaaaacaattagctattgaatgataccacaaaatattaatttgatttaatttccatctcttttctctttttttccttttcacgctgttttttttttgggggggggggggggtgcgctttgaactaaaaattgacaattttggaaaaaaaaatccaaaatttgtacaaaaatttttcctgctgttctttggtgtgaccacgactcggagtgttgttggggtctaccctaccccaatttgtagatacattttcggcaaaattaatcacttttaattcgcaaagtaaacgagtcgacggcaaaaaaggaaccggccaaaaacaatcatgagattattatttttgttcatttatctattcattattaggtcacaattttgctgaaattattgggaaattcaaatatgaatgatctctatgggtcatcattttgccgcaatttattcttaattgaccctaaaaatatgtaagcaaaatcaggcagaagaatgaatgctcatttatttattcgatccctttttaacgaaataataattatctataaaaaaattaaaatctgaaaatgatttaaggaatttgcattttcttaacttattaaatgtcaatctcaaccaattctacaaatg

SEQ ID NO: 104464 - DNA, 271 bp, Heterodera glycines
  Promoter: Source sequence=SeqID_3536; Location=1409..1679; Strand=-; Gene=SeqID_85078
tgttagcttagtaaataataaagtgcgaatgtttcctgttggaaatggttctccatttaaatatcgttcggtggcttttcctctcggccataaataactccgccccttacaattgcctcaggcaaaagaggcggggccttttgaagatttttaaaactttttattattttaattttcttggttttttttttgcaaataaaattcaaaaattattttcatttggcccaatgaaagaatcaattggtgcaaatttaaacttttccaaaatatg

SEQ ID NO: 104465 - DNA, 989 bp, Heterodera glycines
  Promoter: Source sequence=SeqID_15918; Location=1..989; Strand=+; Gene=SeqID_80262
agcgatgaagaaaccgatggacgcaggcacagattttgagcaccaaatgcggcggcgattttcggtcagtagcggataaactcccaaagcccccccccctccttcacaaagattgaactccttccgacccccttcagtccgatttgtaatatccatcgtccgtccgtccgtctctccattccgctgaccttgggggggagagatgctttaccaacagaacacaaatcgatgctggtcaaacacttaaaaagcattcaaacttaaaaagcatattctgttaaatatttgttggtgaccttttctctctcccatctctttaattattaatttttgttaaattttgttttatttaaatttttcaaataatcatttttatactttttgttatcgtttccaaacagaaaaaaagaagaatgaaacccacgaagagaatgccatcaggcaaaaatcgaatgtttggctgcttaaggaaatgccattggcactgactctcccccccccctttcccccgtcgcttctctccgctcggagtgtctttttgaaacccttcgccttttgttgttttttctccagtattttaaaattctctcccgggcattcttttctacatttttttttgttttgttgttttgccattccatcgatttgactcatttaattgtgacgaacgaaactcacgaaaatgaaaagcgggtgaaaacggggggggggggaaagtattttttatcgatagttgcttttatttcaccaacgaagcacttagggggcggggggggggcagtcacacggcaatttggccccgggggaacccccgccaaacggtccaacgccctctcccacttttccaagtgttccctcccctttccccattcccccggtgctcccccattttttccattcattcgcctccccccttttccacgtcagcttatcacacactttcgtagaaaaaaattcgaattttgactccaattctcttggcaccgatg

SEQ ID NO: 104466 - DNA, 193 bp, Heterodera glycines
  Promoter: Source sequence=SeqID_21284; Location=577..769; Strand=+; Gene=SeqID_51881
tgtgtttaaggtgtatcgtttgccaaaatttttgttttttttaaatgtataaaatcccgatttaatgaaaatgtcgggctggacgaaaccggaaacattaaaaataagaaattttaaacgtataaaatcccgttaaaaatatcaaaaatctaacttttttagtttctaaaatttttaaatttatagagaaatg

SEQ ID NO: 104467 - DNA, 347 bp, Heterodera glycines
  Promoter: Source sequence=SeqID_25118; Location=928..1274; Strand=-; Gene=SeqID_55848
caaaattccgtcgcgacaaaatcccgtctcagcaaaacccgaaaaattccgcctccacctataagcgacaaagcataatcgtacgagttcttgtacaagcgtcagattcaaatagaatagcttaagacctaataaagccaaaatttctcattttttgtctgccattcataaagttctgataaactcaaatttatttgtaaaaaattcgtgaattttttcttgcggcggaggtggccttttttgtttttttggacggagttggggggacggagttgacccgcttcggtttagatggtatcacaccttttttgaaaaatttttcaaaattttcaagtcttaaaaacatg

SEQ ID NO: 104468 - DNA, 80 bp, Heterodera glycines
  Promoter: Source sequence=SeqID_9935; Location=1..80; Strand=+; Gene =SeqID_72970
atgcggctcacaacaaatgtgaacagtttaaatttgctaacatcgcactgcaaaaatatttgaattattgtgacaaaatg

SEQ ID NO: 104469 - DNA, 803 bp, Heterodera glycines
  Promoter: Source sequence=SeqID_10687; Location=595..1397; Strand=-; Gene=SeqID_73937
aaaggaaaaaattttcaataaatttttatttgaaattgtaagcaattttcttaacaaacttgcattaaaatactcaaaaattttcccggcggcgcctatcggcaccgccggacctccattttaccatatttttgaaaaatggaggccaaaatgtcaaaaatattaattttttggcgaaaacggcgaaaaattttgtaaaatacaccccataattcgggatttcaaaaaaccaaaaatacaccccaaaaaatcgacttaaaaaagaaaaatacacccctaaaaatcgaatttttgacttcagccctcccccccccccccaaagccaagggttcacatttgtatcatttctattgggtccggaaaaagtagcacgaaattttttttattttcgattttataagtaattttcaatatttcgctatttacatttaattagagttttgtcctcaatgtaagcggatctttccatttttgtggactttttctttattgacaataaacaatgatgaaaaaaataaaataaataaatcgtatgtaaatttttatttctttttaaaatcattttttaacaacctttcaacccattcaaaaggtccgttcacccctttttccgtcaatttattttcttatatgatcataaaaagttaacaaattttttgcacataattattttttttttttggtgtttaagctttcttaaaataaattttaaaaattcacacattccatttttcatttttatttcatgcattttaatattttgtttccagcaggcacaaaatctgttcattcatattttaatg

SEQ ID NO: 104470 - DNA, 1003 bp, Heterodera glycines
  Promoter: Source sequence=SeqID_11055; Location=2606..3608; Strand=-; Gene=SeqID_74391
tgggcaagagggagggatttcaaaaaaataaaacaaaataaatatgtaaattgttatatatcattaaaatttataacaagaacccgtctaattttgtttaaactcataaaattttaagtcttgaacagactaagccttgtaatgatacaaataacacatgtatgacattgatagggtgtagaattatatgcacatgcatatttttttcctggactgttggaggtctgaaacgcacgaaaaacatgttttagcttgttttgaagcttctaggacgtatttccatatgcatattttgcatatttatgcctagttcgcgatttatatgcatatttgtgtgtattttggtattttgtgcatattttatgtgcatatttgggcattttttaaagaaatcctctattaaaacggtacgcccccccccctattaaagcggccattttcgtaggataaataatgatttatccttattttattgttttgcaacgattgtttttcgcgttaatttaaaatatttttgcatccttcatttaattttccttttggtggttgtctttgtcttcgtgttatctcaagttttatatattttgtgcttttgaattattgtaataaaactacaaaatttggtgcttttccccgtggactttcattcaacaacaacaaacgcccaaaggcttaattggtactgttatttgagttcctaattgcaatttgccttattctctaattccttgtcagtaaagtggtgttgaaaattaagtaaatctttccttgaccccaaaatctcaacccaaaccccagcaaatcccaaagtccctccccgaaaatacgccttttctccaacgtggcgctcctgcaaaagcgacgtaaaatccaacctttcgacaccgaattgcaaaccgattgtgtgcaagcgacattggaaatttggtcaacaccaattgtggaggatttttgttttgaattttttctttctccttttcatttcaaagtttagaaatgtatg

SEQ ID NO: 104471 - DNA, 86 bp, Heterodera glycines
  Promoter: Source sequence=SeqID_220; Location=20877..20962; Strand=-; Gene=SeqID_78208
ttaaatgtgattcgcgatcatcgaccccaaaaaccctaggaaagtgtgtttcagggctttttaaaatttaattttttcagagaatg

SEQ ID NO: 104472 - DNA, 277 bp, Heterodera glycines
  Promoter: Source sequence=SeqID_19155; Location=648..924; Strand=-; Gene=SeqID_83903
ttttcccatcataaaaaagtgagaacaaatctgtgctggacacaaagacagttgaattgggacaaacagttcgtttttgcggagtaatattctcgaatcggccaaagaaccgatacccgcgggcaaaacgccgttggcaatcggaaaatggaaaagagaaatcagaagtgaggggatgggagtggaaagtggcacctcgagattactgtagcaggaggagcgccagagaatgtcggaaagcggcgaaagggacggctaaaccaagggacggacaatg

SEQ ID NO: 104473 - DNA, 1003 bp, Heterodera glycines
  Promoter: Source sequence=SeqID_26111; Location=323..1325; Strand=+; Gene=SeqID_56859
acattttaatattcagaaaaaaatttcgggggggggggggaatccgaagaatttttttggtcaaaatttgtttagattattttaaaaaattcagcgccggagagcaaaaacaggaattgtaactatttttagccaaaaaagactaatttttgccattttggagtcaaaatttaaaaaaataaggtaaaatcgagtaaattatggtccggcaatgccgataggtgccgccgggcaaattttttttgaaaattttaatgattttattaagaaaaatcgacaaaaaattttaaaaagtaagaaactttggtttttataaaaaaataatcttgcaggaaatcgtctcgaaaaataatcccaaaaagccaattacggatcaaaattacagaaaaatccacaaaaatccgtaagccgtaattacgggggtccaaaaaggccgtaattcccgtaatccgtaattgcgcccagccctgattgctatcattcaagagcccttcagattttattagcctgcaaaatttcataaaatttgtttaatatataaaaagttatggaaaaaatgctcgaaaatctgagtttttgaattcatctggccataacttttttgtatcttaaagaaattttctgacattttacaggctaatagaggacacttagggctatcgaatgataccggcaatgttgaatttggttgagaatggaaaaagttacagccaaaaacttgggcccgtgcgaaaacggcccgtacgaaaacgacccgaaaaaagggacaaagaatttaaaagactgaaatttgaaaaatgtacatttggcataatgtataatttattttaaattcaaatctttttgtatgtacacttaagaaaaatgaatgccaacttttacatcccaattagctaggtaattagctattcggacacaaaattttttgttgtttgatcattttcatgttacaggtgtttaaaataagagctgaatattcaaatatttttagaagatcaaaatg

SEQ ID NO: 104474 - DNA, 79 bp, Heterodera glycines
  Promoter: Source sequence=SeqID_36652; Location=1..79; Strand=+; Gene= SeqID_65909
ttgaaatcgactgaagaagccagcaactgggtttgccaaatcgccaatttcttctcaaattccggcagcacgatgcatg

SEQ ID NO: 104475 - DNA, 128 bp, Heterodera glycines
  Promoter: Source sequence=SeqID_3914; Location=2734..2861; Strand=+; Gene=SeqID_52412
acttaattattcaaattattcaaaataataatacaagacaagactaaacaaaataaataaataaacaaacaaataaataaacaaaagggaaagaaataaaattaaattattgcttcggcaagaaaatg

SEQ ID NO: 104476 - DNA, 425 bp, Heterodera glycines
  Promoter: Source sequence=SeqID_5211; Location=845..1269; Strand=+; Gene=SeqID_57279
ttgtttgaattgatattgaaacaaatattagctaaaagattggagaatatggacacctcgaattttgtatatagagaccggattttgaaacaaacggactggaacttgacgatggatgggaccaatgggactaaaactaccatttttccggttagatatttcatttgaggaccggaaatgggctatcattagcagggctgcaaaaaatatgcaaatgcatatttttttcttggcttctccaagctctaaatagtaggaaaaacactttcttttttgtgtttgcgtataaaaatcgggacttatttgcatattttgagtttttctttatatttaatgcatattttaccattttctatacatattttcagattttttttgcatattttgccatttttcgtcaaatttttcagatttgattgaaaatg

SEQ ID NO: 104477 - DNA, 884 bp, Heterodera glycines
  Promoter: Source sequence=SeqID_14778; Location=887..1770; Strand=+; Gene=SeqID_78918
gctgaacggggggaggaaagggaaaaatgaatggtggcggaaaagcgcatgaaaatgggggggggggggggatcaccgatcttgaagaagtcatctcgtcaaagagtgaagaagctgctgttgacgaattggaattgtgttgtgataacaacagagaggaaagaggagaaagggaaatgtgtaacccctaaaattaattgcaacaattaaaattagggataaagtcgatttgaaaagagtgaaagcggtaaaagcaattttctattgaaatttaaaggggagggggaatatctgaagacatatgtacttttagcttagatttgcatccaaaatagtgtacaaaacgaaaaatccggaaatttatgcattgatttccctattctgtgtttttctatgccttaaaatttttttgaaaaaactaataataagcgttctttttgtttttcaattaaacgctctaagtaaatgtcaaaaaaaatggtaggacaattaaaaagggacaaacggagggagaaaatggacagagcggaagagtgaatttgatgaattcaaaccaaaaaatggacaaaaaaaaagttcaaatttctgtatgactgagaaaaaatggcatttttctccgtatttaagcggtgaattccccaccaaaaccatccattcattcaattgctgcactcacttccattcttttcccccatcggtcgaatcttcatcctgctgctgctgtacaataaagataattcccgtcagtttttttttgttttgtttatttcggttttcaaaatgtattaaattttgtgcctttttcaggatggtcagagcaacaacggccaggacaagggcatcagcagcgcgagcacggagcatcaaaatcaatcgtcgaaatg

SEQ ID NO: 104478 - DNA, 82 bp, Heterodera glycines
  misc_feature (9)..(9): n is a, c, g, or t
  Promoter: Source sequence=SeqID_27161; Location=1..82; Strand=+; Gene= SeqID_57861
tcgctacanatttcggagtcaatacaacgactttcgaccaaatcagcagcaccagtgacaaggcgttggtcagccaacaatg

SEQ ID NO: 104479 - DNA, 282 bp, Heterodera glycines
  Promoter: Source sequence=SeqID_367; Location=557..838; Strand=-; Gene=SeqID_47618
ttcattacaattccaattttacgttcgcatttttgtgcgactttcatttctgtttttgcaaaagaaatttaatcggccaccttttcaattcaaccgccccacgcattcattaactttttgtccaattcgatgatttggggcgtggcaattggcctttgctattttaatcttataaaatttcccacaaaaattaaattttggaatttctcatttaattttattccttagtaatttttgtgtaacaaattttaaggcatttgttcactttaatattttgccatg

SEQ ID NO: 104480 - DNA, 569 bp, Heterodera glycines
  Promoter: Source sequence=SeqID_29267; Location=980..1548; Strand=-; Gene=SeqID_59795
ctctagagtcaatttttaccaatttttatttaaaaaataaattttaccttttaagaatctaatttagtcacctatttccaagtagaaaagaacacagttaaaaatgtttaccgattttttatttaaaaaaaattaatttaattattacgtaatttaattttttattaaaaaagaaattaatcattatgttttttattaaaaaaatcaatttaatttagcagcctatttaattttaaaaataaaattaaatttttataagaaatttattaattacctaattaagagcagaaatgttgattgtgatagttttttggttatttcagtccaatttataccccccctcccctctctctctctttctctctaccaacaatctttttttttcaaaatggtaaaactttcatgaaagcggcatttaaaaaaatatattgagtgagacttttggcctaaattcaaaaaattactagaaaatgtaatttttcgtaaaaaacacattacaaattttgaaaccggcaaaaaaaacacctgttgctgagactggtctggtcgaactgtttgccattggcatg

SEQ ID NO: 104481 - DNA, 1003 bp, Heterodera glycines
  Promoter: Source sequence=SeqID_6158; Location=594..1596; Strand=+; Gene=SeqID_60540
acgggggcccaaacgctctggtcccaaatgtgggcgtaattccaacacaaaaatgatttgattcaccaatgaaactcatttaataagtaaccaaattcatgcatttttaatttttattttatttattaaatcccattaagaaatattaatttgccaaattaagcattttaaaatgcaactcaaaaaagcaaaatcacttttgttgctaagttttaccatctttttctgtggccacgcattttgtggacaaactccggtccaattcacaacaaaacataaccttttgttcacggcattaccgcccgacaatggggaggccgtatacaaatttgacggtaattaaaaagcaattaaattcgatattggctaattacctaattaggcactttttacgcggatcgcatcgcccaattggaatacatagcggaggaggggggaagcacacaatccaacgactgtttggaatacggcgaatatttgaagcttagagaaagcggcaattttacaaaggaaacaatcgaaaaatttgaaaaggcagtgaaacaaatggacgcaaaaattgagcaaattaggggagaaaacccaattttagggacaaaacgcatcgaaatgaacgaattcagggcaaaattggacaaagaaattgtaattttaaaattttgaattaattgtaatttaaaaattataaataaaaaaggattttggattaattacaattttaaaattaaataaaaaataattttggattaaaaagttactttaattgattaattaattattaatttcattttttgtcttgtgcgagtgactcagctgatcgtaatcaaagcgaacaagaaattgtctatttgatttctgggaataaaaaataattgactaattaatgaatttttgttgttaattgcccaatttgctaaattagggccccgcagctgacgatgagtcaccaccactgctgcaccaattggtgatcaaatgcaagcagttcatgcgaaaattaatg

SEQ ID NO: 104482 - DNA, 97 bp, Heterodera glycines
  Promoter: Source sequence=SeqID_5753; Location=1132..1228; Strand=+; Gene=SeqID_59120
ggtccgaccaattctgcaattgttattcaatgaaagatcgttttggatttgttcaggcattgaaaagtgcgaacaattggtgaccgtcgccaaaatg

SEQ ID NO: 104483 - DNA, 118 bp, Heterodera glycines
  Promoter: Source sequence=SeqID_9148; Location=355..472; Strand=+; Gene=SeqID_70402
ggtgtctcgccatttttctcaaattgtttttgtttttcccaattttgtttagacatttctccgtgccacctcttcggccagttacactgttcgaattatttttcgtgtgaaaccaatg

SEQ ID NO: 104484 - DNA, 470 bp, Heterodera glycines
  Promoter: Source sequence=SeqID_2473; Location=1336..1805; Strand=+; Gene=SeqID_79897
aaattaatcaaacatttaaaaaatagtaaaaattacaatttaaattaccaaataagccaaaaaatgaaaatgaatgcagcagcgatcaacgatcgctgccataaattattgtagaactgcggcttggaattttcataaaaaatcatctaaatagtgaataaaaataaataaattataatgaatataaaaattatttaattagctaaaaataaagaaaaaacaaacatacataaaataggcaaatgatgagtcgatcgaacagagccatcgttctctgctggtcactcattcgagaatggcatatgtaatgtgaatgtaggtcacacttacgaccgaaacaaataagagggaccatcttattaaatgataaataaataaataaataaattacggatgtataaattaaagaggtgtatataaaaggtggcaattttttggatagattcattttgctattttcttgaaaaatg

SEQ ID NO: 104485 - DNA, 55 bp, Heterodera glycines
  Promoter: Source sequence=SeqID_1302; Location=9555..9609; Strand=+; Gene=SeqID_46783
gtatttaaatatttttgttcacatctttttgtgtatattttattaaataaatatg

SEQ ID NO: 104486 - DNA, 685 bp, Heterodera glycines
  Promoter: Source sequence=SeqID_19396; Location=1..685; Strand=+; Gene=SeqID_84121
taattttcaaaaaggacacacacaattgcttctttggcttttttgacgagcaaattcgttgccacctgaaacaattggatgaatttggcgcggatgaattggacagaccgtcgacagattttatggaagcatttttaaaggaaaagctaaaaaaggacagggcgggggaacagcacaattacaggtggattattaattagaaaattgcagtaaagtgactaattgatgatttggagcaaaaagcgaatgccatggcatggcgagagtggcgaactcttcccccccccccctccacccccgccccagaaatccgattttcattttagcttcttctattttcaaaaaagtcaatattactttaattaacggagttaaagatttgtcgaatttttgattcatttgaatttttaatcttaaatagataaaataatctttagtggagtgttgatgcttttcagttcagtttcatgtgtttaagccgatttcgtaccaaaactagaaatatttttataactttttttaattcaaatttttaagttttgaccaactgaaggcaactttattcgatctttggatttcgggacaggtaggcattatgcgtacggtatcgtcttttgtacagtaggattgtaaaaaaacacaggaaacgacaacgacagcgttggcctggggagccgcttacatg

SEQ ID NO: 104487 - DNA, 67 bp, Heterodera glycines
  Promoter: Source sequence=SeqID_12178; Location=1499..1565; Strand=-; Gene=SeqID_75754
ggtgttttttaaacatacattaattagttaatcaaagttaaaccataattttaaggggaataagatg

SEQ ID NO: 104488 - DNA, 808 bp, Heterodera glycines
  Promoter: Source sequence=SeqID_7198; Location=1..808; Strand=+; Gene= SeqID_64115
agtctcaattttaaagcgcagataagttttgatgctgatcaaaaggtcttacattaaccagatttgttgtccacatcctcacttaattgacgatcaccacaaatttttaaaataaaatttcgaaattaagctcatttggattcgtaatttaaatatttattttcaaaatacaaatcagttaatataaatttattaataaaaattaacaattaaaatgtgaaagaaagaaaaaatttcaaatataaaactaattagcaccgcactggtttggcacccccccaaaccccaaaatttacataacaatgtgagaggaagagagaaagagaggaaaatcaggaatttaaaacagaaaattaattgacattatttgaggcattatttgaaagactgatgatttgttcaataagagtggtaaggtcaccagtgtcaaaacaattataataagcagtacggtaacgctcatggaggaggacggtgttccagccttttctttttaaaacgatgttcaggaggagacggcaagtgcgtccgtttccatccaaaaatgggtgaattttggcttaaatacttttcttgcatgttatttaagcgagaattatctttattaaagtaaaataaacgaaatattacaaaaaactggctaaaaacgaatattattaaagtggatcgttttatgaaagctaccccgacatcacattggcatggagagttttgattgtctcaaaaattacaccgattagaacaatgacgagaagcggaattaataattttttacggacaaattcatacatatacaaacatcaaaatg

SEQ ID NO: 104489 - DNA, 161 bp, Heterodera glycines
  Promoter: Source sequence=SeqID_2255; Location=4228..4388; Strand=-; Gene=SeqID_78757
atgcttcacggactgagaaaaacatagaggaggaagagctggaagaggagaaacaaacggaagaaaaagaagaagaagatgatgagagtgatgaggaagaagaggaagaaagagagagtgtggaaccagcagaggaagagaaagaaaggaacgaaagaatg

SEQ ID NO: 104490 - DNA, 1003 bp, Heterodera glycines
  Promoter: Source sequence=SeqID_10846; Location=1334..2336; Strand=-; Gene=SeqID_46906
agatttaataaaaacctggtctttgtttctgaagtcttcattgagaatatctgattcatgtgcaaaatgccaaatccaattatttggtaaagtttgtgatatacaatcgacaattttcggcgtcttgagtcaaattaaacaatgaaatggcatttgaaaggtacaaaatcttaagttaactacctattttgaattttaaaagggcttttacctgtgctttcaaccgtagtcttttgtgtacattttggtcagttgttgcctcacgtaccaaccgaagcaattgaagcgatttaatatcatttgaataacaaacaattaaaacatcacgctaaaatttgaataaggagtaaaaacacggcactaatattgtaatcgatgatttattgaatagtattaaaaaccaatttattgaatagtattaaaaaccaacggggtaatccttttagtttgcaaattttttttgtgatacataataagtcgtgaaactttgctcccgtgggttttccgggtcgtgattacgcatctgacacccattttgactaattcctaatccctaacccgaccatcctcctttggtttctaataaaattcaaaaacgatttgctaatgcccaaaattcgacttaccctttgttggtctttaaacacgcgatttttgccaagacaaaaagcaaatttctgtctaatcattttcgaaaaacattgtagacaatatcctgcaacttttgtattttccagttgaaaaaagctaccatctccattagaacatttcaaacattgagtggttggcattcttttgagtctaaaaattagtggcaaacaaattaaaacaaatccagtacaacctgagtttctgctttttaaaatttcaactcgattggttcatgggaagtgaccaaactcccaaaaaatagggtgtccttattctaatgttacacagtgtataatattcattacctaactgcctttattttaaagtctaaattctgtttaatgtgtcaatg

SEQ ID NO: 104491 - DNA, 604 bp, Heterodera glycines
  Promoter: Source sequence=SeqID_25439; Location=782..1385; Strand=-; Gene=SeqID_56173
taattaaatattatttaaatttgtgttttattgttgcaaatttacgcattccatcggtcgaaagcatcaaatagagaaaaaggcaaaatccagaaacgaaaacccagcgagaaaatgtaagaaaatttcatttttttctaaaaactataaaaaatattattaatagataaaatatttaacaattttatgagaataagcattttttattttacattatgcctgacgtaaacaatttttggtttacatttatattattattcaattaacattttttccaacatcaaaatatgactgacgtcattataaaaaatattcattacataattttacgtaaataaatttaaattaatcaaatataatttataataaattatacaatcacaaaagataaattaattatttggtgttatttatgagataaactaatatttatataatataaaaaaaaatctgtgctacataaataaaagacaaaaacgctatgattgtgacaaatacttttgtaattgtctatatgaaacaattgattgttttttaacaaaagtttaaaattatacggttttacgaaatgcaccagtacgctttttagctcagaacaaaaatg

SEQ ID NO: 104492 - DNA, 1003 bp, Heterodera glycines
  Promoter: Source sequence=SeqID_2192; Location=1081..2083; Strand=+; Gene=SeqID_78406
taagaaaaagataaagtggagaagaaaatgtttaaaataaagaatttttattatttggcatttaacctggtttttgtttggttaaaaatgaaaaaaaaataaatttcaggatttggatctggaaacaatgattacacctaaaagggacccaaaatgccaatgagaatcaaaggtcaagaaaaaaaaaattttccaattaattgtaattcgacccgttttctcaatttaccagttccagatttttaaataatcggaattattttccgttacaaataattcatcttcaacttacttttgctttatttcttgcccgcaggcaaaggagtttaagtgaattattggagttatttgtttttcgatagtttaagagaaaaaggtacatatatgagcaaaataaaagacagaaatgaaaatgaataactgtgaaaagaatttatgcaccgatcatggagaaaagggtgagacaatgtacacaaaactagtttaacagagagcagatgtaagcataaatggatgcaagagaaacgatttgagagacaaataaaataagtcaataaattggaatattttaattattattattttcgtttaaatttagacttaatactggcttttattttgttatttttccaaaacaaatattaaaaacctatgaaatataattattttatcaaaattattgttttcatatcgttaggatcgaatttaacgtaatgatgaacacttagaatattatttgcataatttggaacaaaatctcggccgacacgctatttaaaatagtactattatataattattggcgaaatgtatttaaattaaataatataattaagactgagtaccaagtaattattttattggctgtctatccttatttttagttaattttatgtgcttgtgcatttaaattatttttttaaaactttttgtcaattaaaaaatgttaaagggtgttgaaaaacatataaaccatcatttcagctttttctcggccgacatg

SEQ ID NO: 104493 - DNA, 57 bp, Heterodera glycines
  Promoter: Source sequence=SeqID_6976; Location=3791..3847; Strand=+; Gene=SeqID_63461
ttttttctgaaaatcaacaaaattaggattttttagtaaaaatctcctaaaaatatg

SEQ ID NO: 104494 - DNA, 111 bp, Heterodera glycines
  Promoter: Source sequence=SeqID_18474; Location=1..111; Strand=+; Gene=SeqID_83084
aaaagtgccaagtcgccagttttagctttgcacgtgtatttttttttgttgtttgttcagattcgcaacctcaagttggattgggatgaattcgacgcaggtgatgcaatg

SEQ ID NO: 104495 - DNA, 330 bp, Heterodera glycines
  Promoter: Source sequence=SeqID_10; Location=1..330; Strand=+; Gene =SeqID_69055
tcaaaaatgttggcacatttaattgcgtgaaagggtataatttcccaaacgattaaatgtaagcgcatatttattaagaaacaattgggcaaaattcaaaaattttttaaagattttgccaatttaaatttacggtttttgagatcaattttggcattttctccgaaaaatttataactaaaaagtgtttgggtgtctgtagccctaaaataaatgaattaatcaaaccattaaactaaaattgataggcatattttgccccctaccaattaataccaattttaattaaatttttagtgaattcttttttaagctaaaaatttcaccatg

SEQ ID NO: 104496 - DNA, 604 bp, Heterodera glycines
  misc_feature (53)..(53): n is a, c, g, or t
  misc_feature (89)..(90): n is a, c, g, or t
  Promoter: Source sequence=SeqID_13912; Location=1..604; Strand=+; Gene=SeqID_77864
gtaaccagacaaaaaaatcaatcgtgtaaactactatagagtagagcggaccngggactgggtactgaaaagacgggacaactgatacnntacaaataagtccggttttgaccggaaccgggactagtcccggttttcccagccaaaaattcccggttttttaaccctaaaaggttccggttttgcccaaaatttccggtcccgctcttcttctctaggtaaaccaaaaaaataaaagtgtattttatatcccgctccgtttcataatattttttcaagaaaatgataaagtttttctattttttttaattaaagatttcatttaaaggatattccctctcactggctgcgggtttattctgcgtaattcaatttttataatttatttaatgggatcagacaaaaggttgttgcttgttttatagtctaatttattcactgtgcaacgaataaacattattattgttttgttaattttcgtgtttttgataatgctttattcaattaaaaattgccaagatattgacaaaatgtgaactttaataattgtgtttactccatttcttgtccattgttggatattgcaacataataattgcaaatg

SEQ ID NO: 104497 - DNA, 231 bp, Heterodera glycines
  Promoter: Source sequence=SeqID_33209; Location=523..753; Strand=+; Gene=SeqID_63340
attctccaatgtggcccaaattttaggcccccagccacagccccttgcttctcccagttttaagtcttggatttgtcaaataaattcaagacttcaaattaataatcaaaaattctcttaaaatttttttgaacccaattcaaaaaaggaaaaaaatttgcagtcaaaaaattattcgaatttctccaattttgtttccataatttccgaaagttattcggtatcataatg

SEQ ID NO: 104498 - DNA, 870 bp, Heterodera glycines
  Promoter: Source sequence=SeqID_12454; Location=1..870; Strand=+; Gene=SeqID_76082
tattttaatacatattttttcggaaatcggtaaaatgcgttattcatcgggttattcattctattgttgtttaagcttaattttcgatcacattttatggaaccataatttcaaaaattttcccttgttcatgttttcatattgccttctccaattcaagacaaatttgaaaaacgcagacaatttgaacctggcttcagtaaaagtgcagtatgactttgtctgataaattattagttagtaataacaatttttttaattttcatattttagtccttcacttatattaaaaatattaatggaaaaaattttattaatataaataaatgaatattaattagagtagagcgggaccgggaattttgggcaaaaccgggaccgggacttgccgggacctgagaagccgggaccgggacctcggttttttttcgggaccgggaaccgggaccaaccgggaatttttaaaaattcaaaaaaattcaaaaatttttaaaaaaattcaaatttaaattttttttcaactgaaaataataaattaaatttttattttgtttttttatttaataaaatccaaaagttaaagctaaatttaatttttcactcagacccccattcttaccagtgctcgtttttcccggttgccctaccgggaccgggacctgagcttttcaaaatccgggaccgggacctctgaggaccgggaattcccggcccggtcccggcgcactctaatttaaaccccttaataaatcaaatttaaaacaattgttccaggtttacgactgcaaaagaagcgacacattgacaggggtgccataaaaataaaaaattttttttttccaaaatttcttgtccccaggcctatcgatg

SEQ ID NO: 104499 - DNA, 264 bp, Heterodera glycines
  Promoter: Source sequence=SeqID_30406; Location=1072..1335; Strand=-; Gene=SeqID_60816
aaaaaaatcacgaccactctgaaaaaacagcagaccactgggtgccctgttgtaaattcaatcataattttttaaatctaagaattttttatggatatatgtttataaaattgccaatttttttttcatcatcgcaacgtggcttttcgattgacagcagaatatcattggcccaataatattttgcatttgctaaatttttcccatttttcatttcttaaaaaaatatccaacaaaaattattttattatgatatgaaaaatg

SEQ ID NO: 104500 - DNA, 114 bp, Heterodera glycines
  Promoter: Source sequence=SeqID_3533; Location=1147..1260; Strand=-; Gene=SeqID_85055
aattggacactttcaacgggtgtgctgattgttgtcgcgctgagcctggagcgttatatgtctgtcgtttttccgctgcattttcgcacatggaattcgccccagcgagcaatg

SEQ ID NO: 104501 - DNA, 405 bp, Heterodera glycines
  Promoter: Source sequence=SeqID_32136; Location=128..532; Strand=-; Gene=SeqID_62465
tcactaaaagtttaaataaatataagcaatatttatttaaataaatataagcaatatttatttaaataaatataagcaatatttattgttaaatagaaaatttcggtgtttctaagataatattctcggtccctgaaagctgaaaaaccgattggctttcaaactcgcaaatttgaagccaaatgttgagtccaatctccatgcaaaaatataaggggtcaacaatgaatgtgcggagggggaaataacaaaaacataatgcacacatattcaaatggtgtctcccgaacacaaacatttaggcctttttgtggtgaacggacaaagtgtagacaggcatgacaaaatgtccatatctcttgaaaatacaacttttatataaatctttttttacaggcaacaatg

SEQ ID NO: 104502 - DNA, 618 bp, Heterodera glycines
  Promoter: Source sequence=SeqID_5930; Location=1..618; Strand=+; Gene= SeqID_59713
gattaaaagtgtttatattatattagtggcatttcctttctttagtgaatgtttttacattttttagaacaaataaagtgtgtgaaatggcagttaacgcaccttttttgagccaaaagttacaaccgatcaaaattggcattttataagagttgggctagggaagttttgccagaaattttccgtttatttttaattaaaaatatttttttatttaaattattcccatcgcatctttgttctttctttacaccattcatctgctgaatgaaagccacgattttctgctgacattaaaaatattgattctgtctgtcactccgcagcatttcaatcagggctgtgcgaaaatcacaaaaaaactttttcgtatacgaaaacgaaacgaaaaagtgcattcgatacgaaaacgaaacacgaaacgaaaaaaaatattttgaaaaccgaaaacgaaacacgaaacgaaaaaattttgacggacgaaaacgaaacacgaaaacgaaaaaataaccattttcgtacgaaacgaaacgaaaaaaccgaaaattttttgaacttatttcaatcataattaagaaacataaaactttaaaattgtatcctctaactgaaggaatg

SEQ ID NO: 104503 - DNA, 721 bp, Heterodera glycines
  Promoter: Source sequence=SeqID_2679; Location=3378..4098; Strand=-; Gene=SeqID_81041
tttttttgtcccatttttctcatcgcattatcgggccgggccggggggaagttcgggagtgcccgaagcagcggcaaattcgagcagttcggtctcccaccagtcggagcagccgaagagacgggtgtgaactcccgtcgtcgtcaagtccgagcagggtagtgagggaaggaagagccgggcggtgccaaatcgtccaacgaaggacagggccgttcgtcagcgcaactcccaccagccggagaagcgcgcagtgggcgggagtcgaaacccgtgatcgtcgagtcgagaacgaagcagcagttcaaaggggtccgacaagcccttctccaaaccttgtcggtggtgccgttaagcaagcagcaaatcgctgcacaattccatcaagcaccagtccattttgtcacccctccccctcccattctcgtccccatttggcgccgataggatcggtcggcagcatcagacccatcagagctaacggcaaaagggggcgcaattccctttacggcatcgcgagcggagtgaacagaaagagaagggacgagagcggtgcagaggagcgggaaccaatcccgcctcagcttggcccaccccaacccccaagcgcgtggcgcaatccgggactctcgctactcgaattgcggaggctcgagaagtgatcgaccaagaccttaccgaaggggaggcagcgtaccaagcggcgcgacttttggccatg

SEQ ID NO: 104504 - DNA, 69 bp, Heterodera glycines
  Promoter: Source sequence=SeqID_40978; Location=177..245; Strand=+; Gene=SeqID_69197
atttacgtgttaatacacggtcatgagttacgtgttaattcacgatcatgatttacgtgttaatacatg

SEQ ID NO: 104505 - DNA, 561 bp, Heterodera glycines
  Promoter: Source sequence=SeqID_6385; Location=1908..2468; Strand=+; Gene=SeqID_61338
tttggccgccgcggtgcacaacgaggatgaatggttgcgcacccagcgcaaattgggcaagttttggccaaacttttatatacactggtcagggccaagaacgaatctggcatccattacgaccaaatgccgaatccatagcccgaatttgaacaaaaaggtttcgaagtcttttaaacttttcgttcaaaactcgggttaaggactcgccattgagaccaaatttaagtcagataggtattcacgattagctctcatttataatatttattccctaccccaatttttattgaaataattttgaaacttttttttttgaacgatggatttttgctagtccctttttgttgaatttgccattttcccagttgccgaagctgctgcacttcggcgccaacgtgagcaggtggtgtgctgtgcgtcggtgggcgcttcctacgcatttttggcactttctgttgcactcagtttatccgtggtcagtaaaaaagcaaacaactttttttttaaactttaatttagattttttcctaaaaatttctcaaatatttaggctaaatg

SEQ ID NO: 104506 - DNA, 1003 bp, Heterodera glycines
  Promoter: Source sequence=SeqID_7294; Location=2129..3131; Strand=+; Gene=SeqID_64379
tatttaaataaacatttattgattgacttattgatattggaaaaaagccacttccagaaaaatgatccgaacaatgagacaagaattatgatctaataaaataattaaaattcataaattaattatttttaaactgcaataaattattttacaaattcgaaattaacaaaaggtatattaaatacatatttaaatagttattattaataaataaactttatataaaagtttatttttttaatttatcataaatttttgctttataaaatcttaattgtatgcaaataacgagctttaaattttatgacatagacattaaaattgatcatagcaatgcataaaagacaattgtttaacaaaaattcaacatttttctcttagccaacattgttttaataaatatcaacactggcgttgatatttatttaatatcaacatacattaagccatcaacgtaatataaatgctatttttaaaaattcgataatttttaaaatgttaagcaattttttaatgacttttggcggaaaaataaaatgtggagagagatagaaaagtgagagagtgctgaatttcagtcccagtcatacaaaagcatttttgtgaagaagaaccagggattcttttttatgtaatacatgtttttttcctggatttgccttttttgcaattttggtgccttttttcatgcctttttcagcattttaggaaaaaaatagaaaattttaaaattttttgcaatttttcttatcatatttcactgcaatttccaaaaaaatttttcccagcggcaataaattgcaaaaattcaaattagaaaaatatttttattaaattgtaagagcaagagaattatcaatctttagaaaaaaaacaattaaagcaaacacaattcctaagacgaatcagtttttttgttgatgaattgatgttttcaataagttgttcaataaaaaattcgataaatcaaaataataattactttttcagaatctaaaaaatg

SEQ ID NO: 104507 - DNA, 213 bp, Heterodera glycines
  Promoter: Source sequence=SeqID_14376; Location=2812..3024; Strand=-; Gene=SeqID_78414
agtgagtacatttacaattgaattgggataaagcacatggagagaacttcaaaaaggaacgccagtagctcaacaggtttaagtgatagattacggtataaacgccataatgaccacaggagaaacttagctatttgttttaaaaattggcggaattaatgttcatataagccatcgaattgatggtggattctagttacagtttacctcatg

SEQ ID NO: 104508 - DNA, 113 bp, Heterodera glycines
  Promoter: Source sequence=SeqID_34965; Location=682..794; Strand=-; Gene=SeqID_64646
tactgtaccaatcatggcaaagggtgtttacagtaacgcgcagttttgatccaatcactactgtaacaccgttatctgcccatttcctggattctgtacattttcacgcgatg

SEQ ID NO: 104509 - DNA, 589 bp, Heterodera glycines
  Promoter: Source sequence=SeqID_34724; Location=284..872; Strand=+; Gene=SeqID_64446
tactgaaaatgtgaggaaaataaattaaaagggcggaaaaaataggaaaagcaattaaattcacgaactaatcgggaaatcgaggtcaacaattaggtatttattacctattcacgtttaaacggccaaaacaactctttataaaagaagaaacgaaaacaaaaagcatttggaattttggaggggaaaaggaaaagaaagcaatgcacaatttggaaacgaaaagccaaagtgcgagtgccaaattgcacaaattacgaattacctgttttttgtcggcgtacgccgcacaaaacgcgacggatcgaatttcgttgttgtgtctcgtcatgttcactttttgtttgcctttcctccacgcgccgatcgcacgtgcttttttcgctccctgtttctgttctccctttgcctttgctctctctttttgttccaatatttcgttcaattcgttcgttccgttgttttttcagcccatttctcattacacctttttttattcgtaaattactactaccaaagaggtattttaatttcaaaatgattgcctcaacagtccattcatccgtataatttgatttaatagaaaatg

SEQ ID NO: 104510 - DNA, 292 bp, Heterodera glycines
  Promoter: Source sequence=SeqID_16782; Location=2285..2576; Strand=-; Gene=SeqID_81199
atggctattctaactcaaagagagagagacggacgttgcgtttcaaattgagtgtggggagaaaaaaggatcagatgatccaacaaactccaaagacgttggccgtttttaagtaccaacaaaaggattagtctcattctttttaacaatgtctttcttggtcttccctgagaatgatgcatttttatcctaatattcaaaacactttagcctatggaggtgtatgtcgatgatgaggctaagctcacgcttcacggacttcaacagtattatgtgaggctgaaggaaaatg

SEQ ID NO: 104511 - DNA, 610 bp, Heterodera glycines
  Promoter: Source sequence=SeqID_24382; Location=1052..1661; Strand=+; Gene=SeqID_55114
aattgtctattttttttaatttaccaactttttcaatttttgggattttcctttttggataaagataattgaaaaataaagcgtaattaaattcaatccaatattatgtaggaaattaaaaatggaatgaaaaattaatgaaaattagaaaggaagaattttgaaaatataatttttgaaattatttttaaactacatttttgtccacaatattttatcatccctaattataccatagcaacgtataacgattaatattttttaaataaaaattgttttaaaaaattagtgaaattcacatgaataaaataaaaaaaatacaataaatttttgtaaaatcaatatacttaataagaaaaacgaagaaaaatgcaaaataatgcatattatgattgcgaaaataagcagaaaaaaataatattgtaaacaatattattatatatatattttattatctattaaatattattaaaagttaataaaatgcttgtgcgcttattaatggtactaattttaatggtgtcattaagcacatcgactaccaaaagtttccaaattggtgaataataatattaaaaaaataaataaacgtattatatttttagcaatg

SEQ ID NO: 104512 - DNA, 178 bp, Heterodera glycines
  misc_feature (89)..(89): n is a, c, g, or t
  Promoter: Source sequence=SeqID_30549; Location=1504..1681; Strand=-; Gene=SeqID_60965
gcattcgggatttggggcgattcaaatgtcgggttatgggaatcggggatttgggcggcaactctaaagagaattattaaattaaaatntatttttaattttagctctcattaaaagttcgaacaaaaattttacggcaaaaacaacaaaacatttgttaacaacatcagcaaaaatg

SEQ ID NO: 104513 - DNA, 81 bp, Heterodera glycines
  Promoter: Source sequence=SeqID_11027; Location=4270..4350; Strand=-; Gene=SeqID_74355
ttcgaatttttgcaattttcatgtataacttggtaattgtcaaatcgcgaagcaatatcttagaaaaagcttctaaacatg

SEQ ID NO: 104514 - DNA, 757 bp, Heterodera glycines
  Promoter: Source sequence=SeqID_6815; Location=1292..2048; Strand=+; Gene=SeqID_62976
ggaccaacaaaatcaattgatcagacaaattagccccaataatattaattgttaattaccaaaaatggaaaaataggaaataaaaagtcacaagggagacgggctaatccacaggcaatcctcagaggaataggatttaatccgttcattaaatttaaaacattttcatcctaagacaattatttgtggatccgtttttcgtttgtttcatttcaaaaattgggaagtttgttcattttttcaacaccctagaatattataaataaaaaagattcattatgaatctgatcatgattaggtccgatctctttcaattgaactgaatccccttttaccaactaaaaaatatgcataaatttcattgattttattgtacgtatagttttgtatatcaatgatttaaatttttgatgttgattatttgataacaaataaaattgatttgaatatataaattataatttgaatttcatcaatgagctgtaagtgaaaaaacgtcctcatggattttgcgatgaccgagaattttggaaatttataatacaataaaaaataataatttttgattaaaaacaaaattatttgttctaagaaacagaaagaaatgaattaatttatcttaaaattatagattttatcatattttcctagtctcttacaatatgaaattaattattttttcatatttttaaataattaaataatattgaattaaataaatttttgccaattcttaaaatacaaaactaagacaatg

SEQ ID NO: 104515 - DNA, 283 bp, Heterodera glycines
  Promoter: Source sequence=SeqID_569; Location=2718..3000; Strand=-; Gene=SeqID_56337
agtgagttggcggcactaatgttttatgccaaattggcactaacgtttacaccaaaaatgaaattttgggagtctttaaggaaacaatacaattctggtggagcagctcgttccaccccaattttccaaggaattcctctaatatattttttaatttcatacaatttttccaaaaaaaaaaaaaaaaaatcggagggcggggggaaaatgtctacactcttgcaatgctatgcacaattgtaacggaatttaaacaaatttttctagaaacattgaggagatg

SEQ ID NO: 104516 - DNA, 1003 bp, Heterodera glycines
  Promoter: Source sequence=SeqID_3807; Location=4647..5649; Strand=+; Gene=SeqID_51960
attttcttaatttttccgctcattttgtcacttaattaggtaattaggtgggctgactgattcttcattattctttcattatgctaacaattagtgatatttaatcgagacaaagcaataaatgcttcccaatttctcttccgcgaccatataaaaataaattagcattagtgtatttattgctttgtgttccatgtccgccgcgcctaattactctaattaccctcccccctcccctgcggcgattgttttgtgactgacgaataaaaataaaaataaattcaaaaataaattgagttccactttctcaaaaatgtggtttctttcatattcattttatttaatttcctgctttcctgtacatttcattgtgtgttcattttcttaattttccgcccattttgtcacttcattagttaattaggtgcactaattggtcattgttcatcattaagaagtgcctcaattagtgctgctgctatttacctcttgacaaagcattctgtccaaaaattaatttgatgccttttctcagcgccagcaattaatcatttcggtaattgacccgtgttactctgcccacttatgttcttatgtgtaaccccgtataaatacacatgtccaaaaaagaagtttcacttatgctatgaaccattgaatttttctttttttctttttcaaataataacaaaaaaaattttttttacaaattttacaagaaaaatttttatttccaacataaagttgaaaagctcattttgtttaagatttgccaatctaaaattagtcttaagttttgtatttattttttcattgccattgcgagtgtttccttaattaaaatgaaagaatttgacactatatgtaaataaatttgcaaaaaaaatattattttttattttaaaaattcattgtttttcaaattgccatagtttgtctatttttataactttaaaatataaattatatttatattataatttcagttaaaaagctaaaaatg

SEQ ID NO: 104517 - DNA, 865 bp, Heterodera glycines
  Promoter: Source sequence=SeqID_3892; Location=1..865; Strand=+; Gene= SeqID_52316
tttgccgcgacgacggcatgtcggcacattcaaaagccgaagaagcagcagcagcaacaacaacggcatgaactccagaagcagtattagacggaggcggacgaggagcaaacaacaacaatttcgacacagcggcgctcggctgatcacatcggctgctactgctgatcagaattacaatgctttttcgcgaaatatttatgatagatgaaaacttttaaatttattattgtttgtgcatttaatttagtttttcttgccgttattttttgtttgtttgtttttcatataaaattagttttaagtatttgaattttattttcatcaggaccgattctccaggctatgaagaataacgaaaaaaaacaagaaattcccaagaatgttgattgcataaaacggataacaaaattccgacctttactttatttaagtgcatgcatagacacagcggcccaattttgggctctcagtgcaaataggtttattatttatttagtaatcagaacgccaaaactttgcaaaacttaaaattttttggggattttcccttgtaaaaataaaagagccgatctcgagttaaaaactagacagctaaaaaataaatgagttggagaggcgcgtcgacgaatttaaatcttttttgtctgcccaggagcggatgcgcgggtttctctcaaagaagcccaaagcacatcttttgttgagccattttgttcccttcgctcgcgagcacaaatttcttggccttttagatgaacagggttgtggtgaaaaatgttttctatcccattaatctggattttaaggtgatgaggcgctccattccgtttggcgccgacttgagcaactgtggaagtgtatg

SEQ ID NO: 104518 - DNA, 316 bp, Heterodera glycines
  Promoter: Source sequence=SeqID_4953; Location=82..397; Strand=+; Gene=SeqID_56350
ggtgagtaaagttcataaaacgggggcgggggcattcgtggagggatggaacaaaaaaaggactgtcaacatttaaaaatggaaaatggcattttctgggaatgacgggggcgggagagatcggttaacggataagcgggtactgctccaccccgacctccattcgtccaccgcattcccccgctcccactcattcatttggacattttctaacggccaatctgcaccgctccccccccccccccattatttcatactcattttaaatgaaattttgaatttaatttttaaatttcagcacaaaattcacaaaatg

SEQ ID NO: 104519 - DNA, 590 bp, Heterodera glycines
  Promoter: Source sequence=SeqID_22286; Location=1..590; Strand=+; Gene=SeqID_52961
taggggcgaaaaagtccaaaataggacccaaataggggcaaaaaattcgcgaaataggggcgaaaaagttccaaattttgggatataattttttaaattgcagttttttatatgaaaataatttcaaattaaggcaaacaattttattcactgattgcagttacatataagatatattttcgaaagttttttcatttcttatgggtctatttttgaaaaatttagtgtcgattcttaggggtatatttttctgaaaattttttggtcgattctttggggtatattttttcaaaattttttggatcgattcttaggggtgtatttttcgtttttattgcatttttgtatttttatccttggatatcatttgagcttctctcgccataactaagccgcaaaaaaaatatgtaaaaacataaaaatccggtctctattgatgatatatggaactgcgtttttcatgcttattatcaacttcttacttttgattttttttaattgtagtaaagttttccaaaatactgttttttgtcggccaattgctgatttttaaattttcatctaatcagcagaaaatatttgtaaagatg

SEQ ID NO: 104520 - DNA, 620 bp, Heterodera glycines
  Promoter: Source sequence=SeqID_24557; Location=467..1086; Strand=-; Gene=SeqID_55281
aaaaaaggaaaaaaatttgcagtcaaaaaattattcgaatttctccaaatttgtttccatatttccgaaagttattcggtatcataatgccaaaacaaaacgaaatcgtttaaaatattcctttctggacttgacttggtttcttgatatcgaagctgttttctacgctatttctaaaacggttataccaaaccccagatttttgaatccggttttcagaaaaaatgccttgtggtgaaaacaatatttcacatttcactccataactttgtgagttcggcacggatcgagaccgggataagaccattggaaagagcagctcgagctctacaagaaggtatggaaagaaaaaatagttatttctgggactttttcagaaatcagaattaattctccaatgtggcccaaattttaggcccccagccacagccccttgcttctcccagttttaagtcttggatttgtcaaataaattcaagacttcaaattaataatcaaaaattctcttaaaatttttttgaacccaattcaaaaaaggaaaaaaatttgcagtcaaaaaattattcgaatttctccaattttgtttccataatttccgaaagttattcggtatcataatg

SEQ ID NO: 104521 - DNA, 908 bp, Heterodera glycines
  Promoter: Source sequence=SeqID_8688; Location=928..1835; Strand=-; Gene=SeqID_68856
gttttcttgagtgtaaaatgctctaaatttcagtgaaaattttgttaaaaatggtcaacatttctatttttcctccggcggcgtctatcggcaccgccgggccttccaaaacttattctttcataaaaattgaccaaaaattgtcatattttgaataaatttttcaaaatgctgattttttgtccgccaaatgctgattttgaaaattttcagttggcagccctggtttttccgctaataaaatattgttttaagtcgatttttcatatttttattgcgtttccttcacgctactattagttttagaaaaatcttatttttggggtccgaattttagtttttgagccattttgtcttattttgaaaaaaaaaacatggaaactctgttttatttacctgctgaattttcctctaaccctccccctgcggtctaaatttttttgttgtgtatcgattatttttaatgctttcgatgtgaactgtctgacttctcgctgtctccactcctacacaaacacaaaaacaaaacgaaacaaatattcataaaacaaatattgctgataatttcgcaacttttaaaaaaatcattgttttgtttttcatttttttgaccggcaccaccggggaaaaaactcataaaaatagagggaaaaattggcatagatccataaatttggcaaatacctttttaaacaatatggaagtttcagcaaatttttggccaacgatttttcaaaatttgaaaaggctttcaaaaaatatgtatcaaaaattatggtaaaactaaaattcgtttttttaaatttatatttttatcccttttataaatgcgcctcatttcagagctaattaccgaagacaaaaattttgatcaaatttccgagtgcaatttttttttatataaaatg

SEQ ID NO: 104522 - DNA, 188 bp, Heterodera glycines
  misc_feature (60)..(60): n is a, c, g, or t
  Promoter: Source sequence=SeqID_36419; Location=1..188; Strand=+; Gene=SeqID_65722
taaattttttatagatttttaaatgtttgattttttttggcttaccaaaacttcatcgancctggttctttctattctctttcaaatcgccccaaatttttttacagcttaactaggccctattaagcttatttccagaaaatctcgcatgaattctcatttttaaattttttatagatttttaaatg

SEQ ID NO: 104523 - DNA, 1003 bp, Heterodera glycines
  Promoter: Source sequence=SeqID_13534; Location=291..1293; Strand=+; Gene=SeqID_77435
tatattttcttcttttagacatataaatttaaatttattttcattttattattattttttgttcttctgacgatttttatattgctgaaatcttaaaaagtttatttattttttctcatatatttaaattattaaaaattcgaaatattactcaatttttttatataatcctgggcaggattatttaaattttctcatttcgtttaattataataaaaaggaacaccaaaacattttttagataaaattatttaattaataaattttccttcatcaaatacatgctataataatataatttttttgttcaaaatataagaaattttattttacatctgaaactgtcatttcctaactatattttaaagtttacgtatataattatttttaattttctaacaattaattttaaatgtttatgatccttttgattaactttttactattttgttctaaggccataaatattatttttaagtaggaaatatgtaactaaaagcgcgagttattaaaattttaatttctcaattttcgtaattatatgtaaatatgaattcatttttgtataaaaaatttaataactttaaaaaaataaaatattttttttattatttcatttctttttttaatagatattaattatatcatattttcattatatctttgattaatggttgaaaataaattgtatttatttattatttaatcaattttattttccatttcgaaatatacatattttaattttgagtaaagaattatttcatttaattttcttgtaaaaatttattctcataaatgcatttttattcaagtaggtaattagtttataatttgttgctttatcgtgacgtctttctaaataataattttgctcaattttaatctattactacttaagataaaaaattatagtattcgatttttgaaacattgtttttttattttattatgtaattaacttcataaaaaagtgaatatttttattttttagattataatg

SEQ ID NO: 104524 - DNA, 116 bp, Heterodera glycines
  Promoter: Source sequence=SeqID_4399; Location=1590..1705; Strand=-; Gene=SeqID_54312
taattaatttaatacttaattttaaaataacaaagtatgggttcgaaaacttcaaaaaaaccaaaaattaatttctccttagtgatgggtccctatttccttgtttcagggtcatg

SEQ ID NO: 104525 - DNA, 236 bp, Heterodera glycines
  Promoter: Source sequence=SeqID_29829; Location=55..290; Strand=+; Gene=SeqID_60296
gatgagaaggggagcaattaaaaatattattgcactaattagtatgcaatattactttcaagaaaaaacactcatttaacatatttaaatatgaaacccaagttattttttgatttatttacatattctcctcgtcagagtgtgacaatgaaagatggcagatcgttgatgagcgcttctcatgaagatgacattcctccggatgttcccacgtgcggcttcgatggcaacggatg

SEQ ID NO: 104526 - DNA, 240 bp, Heterodera glycines
  Promoter: Source sequence=SeqID_40358; Location=918..1157; Strand=-; Gene=SeqID_68720
taacggaccccgaaaattgagctttcttgaattcgaacagaaaaatcagccggcccctcaagaagcaattattagcataatcaaattatatttcctaaatcatcccaaaagtcctcaagaaaatctcattaattttccctaccttttttttgccgcaccgctcactattaagcattgtcccaaccaattaacaatttcctaccccccttcaggtagaaagctttgcaaaaaaaaaaaatg

SEQ ID NO: 104527 - DNA, 235 bp, Heterodera glycines
  Promoter: Source sequence=SeqID_22143; Location=638..872; Strand=+; Gene=SeqID_52796
tacgtaagtctttttcgtgtcaattgtccatttattagtttcgttattagctgcggacgaaaaaaggcaatgcttttgaaagtgagattaccaaaattggacatttcggcgataaatgcgcgagggaaaatggcagaattgcgcggcatttcgatcgatttggacatcagcaagggcgggtggtgagcatcttatattggtcgactaatagtgccttcttgatataagggacatg

SEQ ID NO: 104528 - DNA, 60 bp, Heterodera glycines
  Promoter: Source sequence=SeqID_26857; Location=609..668; Strand=+; Gene=SeqID_57603
agtttataaatttatttttaaatgctttcaagttttagtgatgtttatctcggggaaatg

SEQ ID NO: 104529 - DNA, 737 bp, Heterodera glycines
  Promoter: Source sequence=SeqID_2146; Location=2241..2977; Strand=+; Gene=SeqID_78074
aacaattttactattcttttgaaaattaagtaatttttcttaaatataaaagaaaactcagaaaaatgctaggggtcttttcttacagattttttatgttttgatttaaaaaaattaaatctctcggcgggacagcgtgcaccccaatcacgccgccgaaatcacgccgctcaattttttaaaaatttttcaaacagaaaattttttatacgaaaatgtcaagaaaaaaaatttaaaaattttctgcgattttttttggaattttatgataaattactaaaatttttttcagaaaatttgccaatttttttttaaattttcgtataaaaaaatttctaagaattttttctagaaaaaattccaggttcgaaaatttttttaaacatttctagtgacgtgatttcggcggcgggattttgtcctgttcctgaaaaacatttgggggaaggaaattatctgttctgcttcataagcgcagcaggtcctcccccccccccctttcacgaaagaaaaaaataaatgtacagtaaatttcaagaaaaaatcgaattattttcagcgatttttagaaaaaattttttgaattttttctaaaaattatcttcttttttttttgaaattctgttatttacggcttcatcccttccgattttctcaaggtgaaaattccactggacgaaagcaacattttatgcttcaacaatgccccgtttgaagcactttgtctgatcaaaatg

SEQ ID NO: 104530 - DNA, 94 bp, Heterodera glycines
  Promoter: Source sequence=SeqID_480; Location=2489..2582; Strand=+; Gene=SeqID_53918
aggttgctcacaagctccttcgctgtaaccgcttcgggttacatcaccgaccatgttcgcccgttccgccggggcaccatttccttcacacatg

SEQ ID NO: 104531 - DNA, 252 bp, Heterodera glycines
  misc_feature (18)..(18): n is a, c, g, or t
  misc_feature (27)..(28): n is a, c, g, or t
  misc_feature (65)..(65): n is a, c, g, or t
  Promoter: Source sequence=SeqID_19267; Location=1..252; Strand=+; Gene=SeqID_84012
tttataatgaatgctcancctcttttnntattatcgagtcaaaattcggacttcagcagcacgcncaataatggtctgttttgttcaggttattattacatgagtgttggaggcgagcggaaggacggctccgcgggcgttgtgctgttgtacagaaacgaaagtaaagagcgggaccgactcgacaatgactgggcttatcaggtggcggagggggggaggagtggaaatagaggaaaagcattgaaaatg

SEQ ID NO: 104532 - DNA, 1003 bp, Heterodera glycines
  Promoter: Source sequence=SeqID_13841; Location=1262..2264; Strand=-; Gene=SeqID_77781
tattctttttgcagcatggaattattggacaaaagaagaacaacaagacgaatttgatgattttccagaatacccaccgccttattaatgaaataaattttttgttgaaatgtgtcatgaaaaactttgtttaattcatgcacattttttcagctttaacatttccatttcaaatatcaaagcttttaacattgaaaagtgttcgactcatccttttttgctgatgtgaaagaactagggcgtattccagcaccaaaggggaaatttagtgagaagaaaaatgaaacacaatttatcaaaatatttaggtatattttatgcacttgagttcgctaagctttatcaaacggtttgacgtgaaaaccgacatattatgaaaacagggaaaaacaacacgaattgggatggtttaaaatctgttactcaatttttcgccgtcaaaaatttttgtgtaagctgtgaggtgacattttgaccaaagaccgtcaccaaatggaatgtagggagcgctgcaaaaagtgttgccggatggggttcgggttcccctgtttggatgtttgtgaggcgatacactgtggagaatgcaatcggaatttctacaacaatgattgtttcgagtctcacaaaaagacagcttgtagggagtacaagaaatgcaacaaatgtggggaaacacacaatacgcgaaacaaacacacgtgcggggagaaattctgtagaatttgcaaagtctatcatccgggtcggcaatgtttcattaaaaaaatcaaactccgacagaagaaagcataccgaattgtggcttatgacctcgagacgacggttgaagggggcgaacacaaaccaaatcttgttagtgccgcgcacacagaaattaaccagaaagaaaatatcgaaaaaataattggattcgttttgattttagtcatttttcgttttagtttttttgtttctgtgccgctatagtaagagaatgccaccgtgtcttttttagctaacaatg

SEQ ID NO: 104533 - DNA, 112 bp, Heterodera glycines
  Promoter: Source sequence=SeqID_1952; Location=1..112; Strand=+; Gene= SeqID_77000
atcatcactcaatgctgcggcggtggacagaaggtagcgatgcttctgtcgtgactgattttttaaaataatttccctttttcattttcagaacacggaagagccgcaaatg

SEQ ID NO: 104534 - DNA, 106 bp, Heterodera glycines
  Promoter: Source sequence=SeqID_28716; Location=391..496; Strand=+; Gene=SeqID_59293
gaaactcatccaacactgacaataatcaatgatcggaaatcaattcctctcttttccctcataggtttcggcacagaatggcgcgccaccgctgatgcccgccatg

SEQ ID NO: 104535 - DNA, 414 bp, Heterodera glycines
  misc_feature (85)..(85): n is a, c, g, or t
  Promoter: Source sequence=SeqID_1318; Location=2460..2873; Strand=-; Gene=SeqID_46798
ctttgcagcacgagtgagacggtcaccagactcaccgacgcaaatgtgagacagagttttgatctttaatctctcatgggtttcncaactcttctccttttttccgcagcttgttcggctttagtcattcttgcgaatagtcaagcgatctctaagtgtaacaaaaggaaatgcttaaagaaccaaaaggaaagttaaaacaaaagatggaaaccactttccaactgaaaaattaataaaaaataaaaatttggcaaaatgttcattccaaaataaaacaaaaaaaaatatgtgtgttgtgctgttgagttgtgttttctgtggagcgtttgggagcgtttgtccatcatctattccaacattatctattgtcaaactttcgtttataattttttttaggtttttcgagaaatg

SEQ ID NO: 104536 - DNA, 156 bp, Heterodera glycines
  misc_feature (13)..(13): n is a, c, g, or t
  Promoter: Source sequence=SeqID_30001; Location=638..793; Strand=-; Gene=SeqID_60458
tatgaatgttctntcatatccaaacaaaattattacttattatttccgttcataaatttgtcgagaaaaatgaattcatttgttatttaatatacgtaaatatttaaacatttctttatttttttattaattatttttttaataaaatattaaatg

SEQ ID NO: 104537 - DNA, 65 bp, Heterodera glycines
  Promoter: Source sequence=SeqID_42260; Location=1038..1102; Strand=-; Gene=SeqID_70195
tgtgttgacgcttctactccaaccaaacccatcaaaaatggccaatttacattgactatgtgatg

SEQ ID NO: 104538 - DNA, 72 bp, Heterodera glycines
  Promoter: Source sequence=SeqID_16528; Location=2601..2672; Strand=-; Gene=SeqID_80934
aagaacactgacaaatgaagcgaagagcggcggagcgcttctaaagaaaggcgaacggagaaattattaatg

SEQ ID NO: 104539 - DNA, 84 bp, Heterodera glycines
  Promoter: Source sequence=SeqID_18882; Location=790..873; Strand=-; Gene=SeqID_83583
tctctgtaccggatccaccgagatatccggcacaaattcgcgcactacacgccaaagaagggcaaggagcggaaggaggggatg

SEQ ID NO: 104540 - DNA, 1003 bp, Heterodera glycines
  Promoter: Source sequence=SeqID_1274; Location=683..1685; Strand=+; Gene=SeqID_71244
aaaatattccctttttcattacaaataaaataaaattgaatttttattgttaaaaataactaagaaagaaatggtgtaatatgaattaattactgtaacttttctcggacttttgtaagaattttaatgacataaatccaaaagaaatccctctcaatcggtctcactgaatctgaatttcaagcctcagagtcgtttaaagataaacgaaaactaaattcaaattcatatttacgcaattttgctgaacaacttcccacagaaaaaaactttcaactaatttatttatcaaatatcattctcttgattatagcctttcaaatggtttaataatttcatgatgtaaaagtttcaaaaatttaataaacaatcaacttttgcaatttggctttatccatctctaagtgtcatacataggtatcagtgctaatgattgaattattttcattttccattaagaagcttttcttcttgacagagtgaaaaattaatttggaatttgcggctaagacaatttaatttacacatacctatttattaatgaaataaaaagccagagaaaaatttttcggtcgtacaaagtcctaataaatttaattaatagtaattcggagaatggagcatttgtgccgtccctttttcggcatcagttcgctcctaatcaaacaaatttaattattggacaacgaatatatgcaaagcatttggcgaaacacttcatttccaaggtgattaggtggggcgtgtattctcaatttcacgtaaaatgtggggtctttgctgtgttgtgatgctcctcgagaccgagcgagacagcaaaatcgagagattctcgacttaaggccggcctttgttttattgaacaccaaacttagatcataatttctcttgcctttgttcatctcattgttttcccgttgattatcttcagctgagacggcgaaactttgaacttcgactgttaagccgatcttcgcccgtccttgcttcagttcactcaatg

SEQ ID NO: 104541 - DNA, 875 bp, Heterodera glycines
  Promoter: Source sequence=SeqID_5827; Location=1..875; Strand=+; Gene= SeqID_59354
ttctctccattaacttttttaccatcattaccaattcgttaaattttgcatataaatagagaaaattaaacttctgaatacttttccattttgtggctacacctcaaaaatttaaaaaaaggcaaacaaaaggatgtgcaaaaaaaatttttttttcatttatataaattaatttgcaaaaaaaaatattttctcatatatgaagaatcaacaaaatgtacaattcagatccacagaagcctacagtaccttggccttttttcgaaatgcttacagcaatcatactgtagattgattaagttgaaagtgagcgccgactcttcttggaaatttaactgaatctgaggttattagtaacttctccatgctctaaatagtaggaaaaacgatgattttttaagaaaatttttattaaatatccccaaaaaaatcccaaaatttcgcaattttttcgtacatattttcattttttttttgttacaaaaatttttttgaaaaattaaaaatttttttgaaaatgtatgcctaaaaataggttttttcaaataaaaaaataccaaaaattatttttaaaatattaaaatatgattctaagcctatttttgtacctatttcagcatttacgaagaattttttttacaaaaaataaccattaaaaaattttatttacatatttggtatatattttgaccacttgtacatatttttgatttccttagtattacataatcccttatgtttgattatttattcaaaatttcaaactgaaaattcacccgcttcggggttggaacttaagtttttgcgtgacggccctaccggattaatcctattaaatttcattcaatcacgcaaatcccgcaattctaaaaatg

SEQ ID NO: 104542 - DNA, 767 bp, Heterodera glycines
  Promoter: Source sequence=SeqID_2554; Location=444..1210; Strand=+; Gene=SeqID_80395
atcaaatttttaaaattgtgataataattgttaattccataatcaataaattgtgattagcatttaacctgtgataaaacaattctgttaattccttttttgagtaataaaatgttcatttcattaattattttaaattacggtatttaacaaaatttcaaactgtgtcctaaaaatataatcgatttaaattcaattgacttgtcaaatcaacccgatcagttaaatcagatcgagaatattgaaatattaccggaatttgaggaaccaataattatagagaacgaaaatcagaatatcgaaatctttgaacctaacgaaattgaacaaataacaaatcaagacgatttaatttttggaaatttctacggggctttaatcactgaaccattgtcaaattattttaccattaatcaagacaatattaccaaagtcaaaaaatttaaatttaatccttctaaatatatatttaaaattactattgctctcactgtgcatgtacacaaaaatttgtcacaccgtaatatagaaattttctgtcaaacaatttctgaagaagtaacaaatagcatactatcagactttttacacacaacagaacaaaccataattgactcaatcgaaacggaccaaagaaaaatcaaattaacaaaatttctcaagagaatagaaaatcgaatatctaagcagattaaaaaacagtggggtccatattgctatcatccaattcttgtactttcaactcataagtatattttttaaatatg

SEQ ID NO: 104543 - DNA, 1003 bp, Heterodera glycines
  Promoter: Source sequence=SeqID_20335; Location=1412..2414; Strand=+; Gene=SeqID_50852
gggtttgctttgaatttgctccaaaaaatctcacaaaaaatgaatttttatgaatgatgtgttgtttctcttaactttgacctcgtcatcattattttcgtcatccttttcctcttcagccaggggccttatgctcgtctcgcggtttagagctaaaccacggttaacggcgttaaccgtggttaaaaatccttaaccggtatgctcgtccttccctttttaaccgtggttaaggataaaccacggttgagttaaccgtggtttactcccttcttaaccacggttaacgcaagttaaccgtggtttatttccaaccggtatgctcatctaaccgtagtttaatctttcttaaggaatcttaaccacaactcgagttgtggttaacgtaaatttatttaataatttaaatagtaaaataaataaataaattttttctagggtaattttacatgcagaaaaagaatctgacttttatttttgtctatgatataaattattgacggattagtgttatttcatcaaaaaatttgcacacgcccaaaccgctaaaatagctttttaaaaaaggtgacaaaatttaggtacaggccattttttgaaacaggtacaactacggttttgaatctggtaaatcattttctcagatttggccccaccatattaaaacatttgataaaacaaaacagatagaaggcctgatctaatatgttcaaaaattgtatttcatttaaatcgagtccgggcttcgcaattgtcaagatgaatacaatattcgtgattagcgactcagaaaactgacgaatacatattttcatttattcaaacatagacaaaatttaaaaacctgaccctggcgccaaaacgtgggcgccaaaacgttggcgccaaaacgaccttggcgccaaaacgtgggcgccaaaacgtcggcgccaaaacgaccccgaatcttcgctatttacaccttttttggggcgcgcaaatcgaaattccgaccccaaaaatg

SEQ ID NO: 104544 - DNA, 288 bp, Heterodera glycines
  Promoter: Source sequence=SeqID_37529; Location=1..288; Strand=+; Gene=SeqID_66577
ggtcatttaatttaatttataaaaaaaatatccggcacgtaaaatattgaaaattacgattttttttaggtaatttttggtcttcgcaaaatgtcggcaaaaattcgtgccgaaatgaagcgcaatgggccaaatgcaattgacttaattgagccaataaatgtgctggtcggctcatcaataaaccttcttttgtatgggaattcattggaagaggcaaataaaaaaatattattttttaaattattaaatgtaattacattaattaattgttttcaggggaatatg

SEQ ID NO: 104545 - DNA, 87 bp, Heterodera glycines
  misc_feature (16)..(17): n is a, c, g, or t
  Promoter: Source sequence=SeqID_9266; Location=1..87; Strand=+; Gene =SeqID_70802
ggggggggcaacgaanncggcggttttgttagtcatccaaacattttctgtacgggcagcgcatcgtttgtcgtgttgaaatgtatg

SEQ ID NO: 104546 - DNA, 191 bp, Heterodera glycines
  Promoter: Source sequence=SeqID_25062; Location=1429..1619; Strand=+; Gene=SeqID_55794
tggcttcagatacgaaggggaattaaaatgattaaaatatgaattaattggacgacattttttggaatttttttaacatgtttaacaaaccagctctgaaaaatttgaagtagattatattttcccattttaggttattatcataaatttctaattttaaaaatcaattttttcagaaaccctaagaaatg

SEQ ID NO: 104547 - DNA, 271 bp, Heterodera glycines
  Promoter: Source sequence=SeqID_14084; Location=1084..1354; Strand=-; Gene=SeqID_78058
ggctgtccacttcactccgacattattttttcggcttggtgcattaaaacatgttccatcggcatttgttgcccgaaaaagcagctgatttattgcatatttgccacataaatgtcgcatatctcctcctccattccactcatcccaatcactgctccttctgatcacttttctcatccatttgatgatcgctgttcctttaatttttgaatttcgttttgttcgttcatttgttccaaattgtcaattgatttcattcgctctcagaatg

SEQ ID NO: 104548 - DNA, 524 bp, Heterodera glycines
  Promoter: Source sequence=SeqID_7462; Location=522..1045; Strand=+; Gene=SeqID_64893
attgggatgggcaaagggcgaacagaaaaattgttccgagactccatgcaaacgaaatttttgaacaatttaagccggattcataggttcaaatcagcgaaacattgaaaaataaaaaataaataaaattaatccggtccgtcttttgcctcgggttttttgctcacctggttaatctgggcatatttattttgggaaaatattattgttcttactgtaatttgcacagttccatcgctaccgtaaaccgctggatgagcgacagctgaaccgttttattaacatccatcgtccatttttggtggtctacacagaggaattagcatcagcgaaaaatggagggaatgaagacaaatttgcaggaagacgtgcaaagcgcgacattcgcgcaacactgactgattacggtaggactactgtaggatttatgacaaaaatttaaaatcttttaaaatttcataatacaaaattataagacaaaaaaaaatttcatgctctttttagataactttcggcatcaaatg

SEQ ID NO: 104549 - DNA, 329 bp, Heterodera glycines
  Promoter: Source sequence=SeqID_27996; Location=957..1285; Strand=-; Gene=SeqID_58660
atattgtaaggattgggccagcggacgattaaactctttaaaacaagaggcatacagaacgaaagggaagggtttgggtgataagccaatagctgttgaacagaaaggtctagggttcgattccatctcaagtctaaaaatttttaaaaaattaaaaaccgatatttcttcctgggatttaaaaagcctttatcttgaaaaattactaaattattttatgattgaatttaccagattttaattttgtaaattaagattgttttaaaaggttttaaatttaaatgttatttttgttttttcttctaatttcacttattttttgaaaaatg

SEQ ID NO: 104550 - DNA, 231 bp, Heterodera glycines
  Promoter: Source sequence=SeqID_11418; Location=1..231; Strand=+; Gene=SeqID_74812
atgttattttcctgaatttttcgttgaaaaaatatttttctccaattttttgaattttcggtgggaaaaaaataaacaaattaattgactcttaacacggagactgaacttgttaataaattatgattttttatttcccaaaaaagtgacgggtctgtatttttccccttaaattttacattttttacaattcgctttttttaaattgcccctcccctccctttgccaatg

SEQ ID NO: 104551 - DNA, 1003 bp, Heterodera glycines
  Promoter: Source sequence=SeqID_8189; Location=467..1469; Strand=+; Gene=SeqID_67259
aggtgcgaaaataggtattaaaaattggaaaaatcaagtatatttatgcaaaaaatcttatttaagtcccattcgttattcatttcgcccttacaattgcaagttatcaagaacaaaaattttggaaacgaatttttggggaaaattttcatttcttaggggaatattttctgaaattttggtcaatttttagggtatattttttgaaattttttagatcgattcttggggtgcatttttcgtttttattgcatgtttgctatgaaatttctggaaaaaggccaaaataggtgctaaaactcgaaaaatgccaaaataggtgctattgaccgaaaatccagttttaggtaattttaggtgctaaaaagtcgctctaaatcgaaaattgttcggagaaaatgctatttttgggcttctctcatcataacaaagccgcaaaaaaaataggtaaaaaacctaaaaatcccagctctataaataacccattgaatgtaaaaaaagcaatttttattaaataaatttaacattttcaatttatgttaaatttctgctagataatatagtttttccgggcttggaaaatataaatatatttattttgttcatcttactttgttaatatattttaattggtggaaaagatcaaaaaatatgtaatgaggagtgtcaattactaatgaaccttgttacgtaacaggtggttaacaactaattaagaacaagcaaaaaataaacaaaaccaaagcatttaatataaatgatattaattagttattaagttcgctcagcagcagataattattactaatcgttgcactaagaatgttgattaacatttaacattagtaattataaaacgaccgcgaacaggtgatcaagaaatgattgaatagagaatattttgcatataaaagaccctcaaatttgtctgtaaaaccattcagtttcaaatcgtattttaattccaaaaatcaacaaattcacctcccatttttacaaaatg

SEQ ID NO: 104552 - DNA, 357 bp, Heterodera glycines
  Promoter: Source sequence=SeqID_11011; Location=1138..1494; Strand=+; Gene=SeqID_46918
ggtttcattttttaataatcaatatgcggtaatactggaaaaaataaattaaaattgtttcttttccaaaagtcgttaaaatatatttatgagggttttcggttcgctgatcacgaatctgacattaattttgaccaatttcgaatctctgatccagactcgaacaatagtcgaaattcaaaattctcacacataaaaacaagtttgaattttcgactttttgtcttagttcgggtcctggattcggaattggccaaaactaaggtcatattcgtgatcagcgatagaaaactcgaaaagaaaaattttaaatttatttttcgcaggggcaccaattctccagtattacctaatatg

SEQ ID NO: 104553 - DNA, 115 bp, Heterodera glycines
  Promoter: Source sequence=SeqID_8810; Location=1941..2055; Strand=-; Gene=SeqID_69290
cgaaaagaatgtgccgtggataatcggcgtgtgcctttcttccgttgcgctcggctgtattgcgtacaaattgttgcagcaaaaaaactcccagaaagaacttctagacgaaatg

SEQ ID NO: 104554 - DNA, 108 bp, Heterodera glycines
  Promoter: Source sequence=SeqID_20576; Location=1606..1713; Strand=-; Gene=SeqID_51131
taatgatgggggtttaaactttaaatcaatttaaggccttctaatgtgaacaatcatggcggcagcactggtgccgatccttccggtgctttgcagttggaacacatg

SEQ ID NO: 104555 - DNA, 371 bp, Heterodera glycines
  Promoter: Source sequence=SeqID_31585; Location=1..371; Strand=+; Gene=SeqID_61914
ttttttcctcatccatacccaaaaatttttcggaaaaatgcgccaaaaaaaatgttaaaaatatgttttttattttaaatgcactgaatttaccaattgcttaaacccgggatgtcaattgattggactcataaagtgcattagagcccaaaaagcatattgagcatggaaaatcgaaaattaagcagtttctttttaggccttattaaaacagttgcatttcccgcttgtgtcacataaatcgcttgccaatttgataagatgagcgaatttgtgagcattgtgtgtggacaccctcgacgattgttgctcattggtgtcggagttggcgtttctgtgttcgctatccaagcattttggaggtgaaaatg

SEQ ID NO: 104556 - DNA, 185 bp, Heterodera glycines
  Promoter: Source sequence=SeqID_4399; Location=548..732; Strand=-; Gene=SeqID_54313
aaagccattcaccattcgaacatcttttcgttacgcttttcccaccacacggagcgcatttactcggccggcaatgaccaccgaatgcacgtgcatgacatcaaaacgcgggaaagactgcgttcgtacagggccagctcaaccatttattacatagcgacccatgtaatttgaattaggcgatg

SEQ ID NO: 104557 - DNA, 431 bp, Heterodera glycines
  Promoter: Source sequence=SeqID_9647; Location=279..709; Strand=+; Gene=SeqID_72189
ttcactccttagcccagtcgcctccgctcactctttcggccaatgcttcttcccccgccccttccgacttttcctccactctctcacgcctctccccccagtggggcccctggtccccctggtcaaattgcacttccacttgtggtttttccctccggcgaaggtttcgcttctgcgaattgtctcacgaatcgcaactgtcagagcagaaatgtgaagggattgcccaaatgacggcgatgtgcgacacgcctttttcttgtccgaatggtgccaacagaagccaaaattgaaacactgacaaagaaacgaactaacaaagcacagatactgcggtgacggacggacgatggtcggaatggggcgaatggtcgaacaattgcgaatgggacacctgtaaagagagtgagccgaaggaaggcgacggaatg

SEQ ID NO: 104558 - DNA, 849 bp, Heterodera glycines
  Promoter: Source sequence=SeqID_722; Location=1..849; Strand=+; Gene =SeqID_59825
ttcctaacttgattacattttctatgcttttaaattagatggttgcaattcatagccaattaaaaatatttttattttttaactctttaagttggtgcccaaacttcccggtgcccaaatttctggtgcccaaacttcccggtgcctccgccccccaattaatgagggggaagggagtgataaacaaagtgctgccgacaggtcaaaaaaaaacggaaccaaaatttcttgaaatttttgcgaatttttaaaaggaatttaaatacaattttattataaaaataggtaatagaaataaaaaatattttggcgctactgtaaaggttaccgattttgaaacaaaaggggggacccttttgttttgcaaaattttttaagataaaaaaccacggactgggacagtttagtctggccggtttagtctgaaccaagtttagagcatcataactcttttctttgttgaccaaatccaacaatattggtatcattcgacagctcttaacaagctctatcggcttcccaaaaaccacaaggatataccgacatatgcaaaaattctgactttttggtagtattcatcttgcaacttttttataggtttttcaatcgcttagaaatagcttatcaaaagcttctaaacatatagggctttagaatgatgccaaatttataaaatttggccagctgagaaaaaagttatgatactttaaacttggctcagactataactgccagacttggtgtcccccacccttctttttcacctcctccccccccccccgttcagttgaacttttgtctgtgaatgacgaactcaacaccaccttcgaaaagtacgaccgatgcatg

SEQ ID NO: 104559 - DNA, 147 bp, Heterodera glycines
  Promoter: Source sequence=SeqID_15655; Location=874..1020; Strand=-; Gene=SeqID_79958
tttacggtcattagaccttcaaattaatatttgttagatattgatttatttaaaaaaataaattttaattttaaagcgaaatgtaaaaaaattgcccttcaatattttattttataataattcttgccaatttctcctgaaaaaatg

SEQ ID NO: 104560 - DNA, 58 bp, Heterodera glycines
  Promoter: Source sequence=SeqID_3777; Location=1..58; Strand=+; Gene =SeqID_51840
ataaatataatttgtaaaagcataaaaaaatatataataaaaattaaattgcaaaatg

SEQ ID NO: 104561 - DNA, 1003 bp, Heterodera glycines
  Promoter: Source sequence=SeqID_7744; Location=706..1708; Strand=-; Gene=SeqID_65799
tctaccccctctctctcgcttctcttatttttatctctctctttctcttatttgtctctgtctcattcactcccatactttctctctcttttttcctgtttctctaatcatttctctctcctttactctccgctctttgttcctaactgtcttcatctctctctcttcttcactctttcttacaatacaacttatctctattatctctgttttttcaccatttcttccatccaaataaaaacaatcgcgtcaaaactttatttaaattttttgtttactttgtgacatacattacgaaaattaactgcataagtgacccaaaagtccttatttgttagcgaaatattcgtgagtacatcttataggtatgtcagcctttctggctgttttgttgttttcgatttttccaataatgaagaaatatgtgctcgctcataacacaaaaaagacgtaaacaacaaacagaaaagaaaaaaagactgaactattttccaaaaggaattcgtttcgataaattgtttacttttaaatgtattagttacagcacaaaattaatatatagattattcattttttgtcaaattgaattaggaaaattagaaaattcaatcttctgtttcgatgacataaattaagtattcctgaattgaattacatgtaccaaaatatcaaaaatttcgtcaatttggcctagattacatgttttaatcccaaaaaaacgagcagcaaccccgaaaatctattaactgtttttttttgaaaaatgcaaaaaatgtggggctaaacggaataagagccccctggcggcccgctaaaggcccgtccgggctctaattttaatggcttttcctttattgatttaacacagtttttaattttctttctcaaattgcatgttctgtttcaatttaattccttctttaacagatctttctcagatttttcacatgaaactgtaaatttttcaaaatttctattttttaaaatttcaattatcgacatg

SEQ ID NO: 104562 - DNA, 1003 bp, Heterodera glycines
  Promoter: Source sequence=SeqID_10370; Location=1828..2830; Strand=+; Gene=SeqID_73556
ttttaatttttgagtttcgatttggggttcggaattgaactgattttaatgccgtgttcatgattaaaaatccatgagaaccaaaaaaaaccttggaaacttttgaaaggaaaacaaaatcaaacatttagttgaaaaattcgaccaaaatatggtactaccaattttttagttaaacttcaaattgcacagatgcataaattggattttttacgaaatttaaaataattttttttttcggttgtcggcactttgatgtaggccacgtgcgcttgactgccacgtgtggtatttgcctccgatgaccaaagaggtgggcaaaaaaattaaagaaatttttttcagcgattgatgtgtgttttttcgaaataggaatttcccccggtgggggtcgactggggccctggcgaatcggccatcgagtttggccaatcgggtgaagaaggcaatcgctgtgcggggcggactcgtcgacttggactgggacgggcagctgaagcggtacaaagtgccggcacggatggttgacgaacagcgggaaaggtggtgggtagaaaaaatttaataaaaaattttttcctcccagaaacttaaaaaaaaattcggagaaggtcgtttccatccgaaaaatttttaaaaaaatttcaaactagtattattattcaataaaaattttttgaaaaatcgctgaaaaaaatttcttcaaaaataccaagtttggaaaattttaaaaaaccatttcagtggaaaccatgcgtgggataatgaaccgggaagttttatttgaatttttttttctatgtttttcgattagattgttttcctacccccaggtactaccagaggtatcagcggtacacctccgacccgccttcctctgcctcatcggcgcccatccgcagcacaatgatggcggacggggacgaggaggagtacaaccacagccagcaggaccaccaccaccacaatcatcatcatcatcatcatttgggtgccaatgatg

SEQ ID NO: 104563 - DNA, 247 bp, Heterodera glycines
  Promoter: Source sequence=SeqID_20119; Location=1873..2119; Strand=-; Gene=SeqID_84908
ctacaaaaccgccatcaaaaaaaacggagcctatgtcccgtcgtgccaaagtgtttcggggaatgccaaaatttgatttggttttaattttgtgttgcccctttaattatgcttaattaagtgtgaagacagcgagaatacagatgttaaggaccagtcgctcaaaaacaaaaaccatgatgtaataaataatcttcgtcttcaaataaattttggattttaaaatgtaaaaattaagaaaacgatg

SEQ ID NO: 104564 - DNA, 198 bp, Heterodera glycines
  Promoter: Source sequence=SeqID_21765; Location=1165..1362; Strand=+; Gene=SeqID_52368
atatttaaataaaaatatgaaaaacgatgattgataatgtgataaattcaataaaaaaacgaaagataaaaagacaaataaataaataatggttttgttattatttacaaaatttaaatttcattttaagcactccatccgtttatttccttctcacccatttaatctcaaaaactgaattaatccaattttgtcatg

SEQ ID NO: 104565 - DNA, 803 bp, Heterodera glycines
  Promoter: Source sequence=SeqID_7601; Location=3223..4025; Strand=-; Gene=SeqID_65365
attgcacttatgcatctgacaaacaacactaagacatgacaatcattgtttaagcatatgaaaaaaactatacgattttttgcctcgcgtccaattcagtcccattttattttaatgcctcatgaaatgaggctaggtaatatataaacaaacttcaaaagaaaaatattgtaataaatttttttttaaaaatcaacaatttaagcattaaaaaataaaatagaaatgagaaatttttataaaaaattaaaaaataagaatatataaaaataaaatcaattttcgatacaagagaactgattttttgcgattcttaaatttaaattgaaatttatccgtcggtgattagggatcgagatcaaattttaaattatgcaaaaatacccaaatattttaaaagttaaaaccagatccattcgccttaatataatattttttatataatcaccatactcaagtcccgagattacaagtgaaattgagtgcataaaaaagtatataaacattgttaattccccttattaacaagtatagatttagtaattaattagtgattaatttgtggttgacagctattagttggtgcagatttatcggtgattaaatgaaatgtgaatggatttgtgttggttatgtgtgaatagtgactggagtagaaatggaaggtacaaattgagggttaaatatggtacaaaatgagggggcgaggggcacaatcatatggaaaattgttagtaaataagagtgattaatcgttaaataagccaaaaattggcacaaataatggtgattaataaaaaatg

SEQ ID NO: 104566 - DNA, 588 bp, Heterodera glycines
  Promoter: Source sequence=SeqID_33837; Location=1012..1599; Strand=-; Gene=SeqID_63785
atgtaacaaattgcaaattttcaaaaaaaaaattttcctcttgggtcctaacaccaccgccgctcatcccctctttgttccccaaattttttatttgaaaaagagcgccgcaaaaaatggtggtaaaattccgtgctgggacatttcgtaaaattcgccaccttcgggcgtttcgtaaaattcgacatttttgcaatttttacaattaaatatctaatctgttcacatttattccgattgatttattcaattaataaaattattttcactttaaaaataacaagaaatatcttattaaaaatgttgccaagaagatcaatgccgattcggtcgtcaattacttatgtagtaattaatgagttaattttgttaattttatagtatgaactatggccccgaacaccaaaatttaatatattaattgattttttagttattgattaaaaaattctctactttttaaaaaacttatttaattctggtcagcactttggaacaaaagaataaatatctaaatctgcatcaagttaataattgttttaaattaatggaaaaaaaacaattttacacttttacagcctacacatg

SEQ ID NO: 104567 - DNA, 1003 bp, Heterodera glycines
  Promoter: Source sequence=SeqID_8513; Location=1092..2094; Strand=+; Gene=SeqID_68348
aagagatattaactcaaattgtggcagttaggtatgcctccgaaataattttggtgcgtagttttagtaattctacgcgccaaatgttgatttaaaaaaaaaaaaattttaaactttgaccccaaaatggaaaagtacccaagcaaacattccatgatttgatccgctttttctttttcttcttccgctggtggcgacaatggcataaaattaagtgcaatttgaattgagtatatcattttttacactcacccaatccaattattgtcataaagcacaaaatagactttgttcaaattggcatccaaattttcgcccttttcccatttaactgccccttttcaatgcaaaattcattctgtagctgactgaagcggtgcatggataaacttctaaacaaaaggaaacgcaaattaaaggcattaaatcagccagtcatttaggctctattgcatgcagtttacgcatcttaacgatttatgcatccaaaataaaaagtttacgcttctaaatcaatgcaagggcctcgctccctattctgggcaaaaataaattgtccaaaaacgaatcatccttttaccagaaaattttcggctcgaatcagaatggcaacaaaatgattttgtcccacaaaaatttttcacgctgatcacgaattccggcatccatttcgacccatttcaaactccgagcccgaattcgaacaaaaagtcaaagactcaatttccaactaaattcactttgttggacaaattagaattaccccaactaataaacggctccaaatcgtattaagatacacatgactaatttgtaacaaattgcgcaacggattaggcgtttgcgagaggcattttatgccgaattgcgccttgttgtgcttggcgcagataacagggcccggacctgtctccacggagccgggcacatcggcaaagcccacttcgacccggattttccggacgaattcatccctgtactatttgggcttaatacaattatg

SEQ ID NO: 104568 - DNA, 67 bp, Heterodera glycines
  Promoter: Source sequence=SeqID_9073; Location=2393..2459; Strand=+; Gene=SeqID_70161
gtacggaaaattgtaaaattaatattaatcggatttattttaaaaaagttcagtttctcaaccgatg

SEQ ID NO: 104569 - DNA, 314 bp, Heterodera glycines
  misc_feature (5)..(5): n is a, c, g, or t
  Promoter: Source sequence=SeqID_22919; Location=1..314; Strand=+; Gene=SeqID_53615
aattntcggttaaatcttcgtaactttttgaaaaaaacttgagtgagggggagaggaatttgaggaattctctcatctctccaaaatgaaaaaatgaacatttctaaaattaaaaaaatggaaaattgttcccgacgatgtcccaaattccttaaaatttattattttttcgtcaaaatttgatgcaaagcccattcaaaaagcggttttttttcctttcgctaaaattccatttttttgggccacaaattttcttaattttttttttcaaaaatgactcaaaagtcgccttttcaaaactttatgaatacatg

SEQ ID NO: 104570 - DNA, 208 bp, Heterodera glycines
  Promoter: Source sequence=SeqID_31728; Location=432..639; Strand=+; Gene=SeqID_62039
attaacttaagggtttttaaactcaaaattgtattcccaatttctgttctttttaccaaacttttcacgtaaatgcaattctttactttttcaaaaacgagttcagttttccaatctacattggtggggcaacactattgtcacttcacgactttggattggccgactgccgcccaactgtggcgagcagtatttgatgagcaaaatg

SEQ ID NO: 104571 - DNA, 104 bp, Heterodera glycines
  Promoter: Source sequence=SeqID_25129; Location=1014..1117; Strand=-; Gene=SeqID_55857
agtgagtgacgacgataaaacagagaaaaaacgacaagccatcggacagtctatgaaatgctaattgtaaatgattccgcacccattttcaggctgttcacatg

SEQ ID NO: 104572 - DNA, 109 bp, Heterodera glycines
  Promoter: Source sequence=SeqID_17498; Location=1020..1128; Strand=+; Gene=SeqID_82005
aatcacttacaaaaacacaaaaataaaaaatttttggcactaatattttaatgttttagaaaatagattgctttttgcaaaaagaaaaatctgttaatttcagcagatg

SEQ ID NO: 104573 - DNA, 92 bp, Heterodera glycines
  Promoter: Source sequence=SeqID_30865; Location=508..599; Strand=-; Gene=SeqID_61254
ttttcaggtcacgtcacttatttgtgggaattgtaagtgctgttaaaataattaaatctctttttaaatttgtatattttttgaaacgaatg

SEQ ID NO: 104574 - DNA, 603 bp, Heterodera glycines
  Promoter: Source sequence=SeqID_3371; Location=4124..4726; Strand=-; Gene=SeqID_84419
atcacataaaaattttgcaaagcaaaagggtccccccttttgaaaaaattttcaaaactggtcacttttaatatagcgccaaatgcgtccttagtttgttcccaattttgttatttttgttaaatttttgaatttttatatcgctgacaaattattaaagaaggtaccagcctcaggaaataaaaaaacaaaaaaagtaaagaaaattttcgaattcgggttcgggattcgaaaaatggatgtttggaacatatccgaccaatttcagtcgtaaacaggcactcacgcgaaaacgaccacgcgaaacgtcctggcccgcttaaatctcaccaaatcattggcattttatcggtactcaaatgtacgctaatattttagtataaaattgccattttttctccttttcggtaatttcaaagtttttaatgtgaaattactgtttttcacttttcatgtaccttctctaaattttgtgttctttttgcgctctctcatttttcctaattgtctatgctttaagttaacacagtttttttgccctttgtgacacacaaattaaattgaaaaaattggtgagacctgtgctgattgaaccacaaaatg

SEQ ID NO: 104575 - DNA, 1003 bp, Heterodera glycines
  Promoter: Source sequence=SeqID_660; Location=1406..2408; Strand=+; Gene=SeqID_58387
tatttattttataaaatctaaaagttaaagctaaattaaattaatgaaatttttaaacgaatttacttcagttatttcaaacaattaatcattttggactaaatgatcgaataatcttagaaatccagaattgcttttcacataatttttcggcgcgttttttccaaaaaactttttgggaagaaaggggtccggcggtgcagttaggcgccgccggggaaaaattttgaaaatttgagtgagatttgtttacgaatttcaacaaaaaggctggttttttggactactgggctcaatttgtatggattttctttaaaaaaattataaaatatgcgcaattaaaaaaaagtatgaggaagcatagcttgtcgatatgtaggaacccatgaacaaaaagaaaatcaaaatatttgaatttctgcagagtgattgaaccaagggaaagaagtagaaaatcaagaggattccatattcgtgatcattgatcagcgacctcggaaacccccggcggatacttgttttctgaactttttaaaccaaaaaaagaatttgaaaaaatgttgaccaaaaatgtggatacaaactcctgtagtaccatttttataattagagaacaaagcggaaaacaatgaaaacaaaatttgagaagctcgaaaaacagaaaaagggaacgcaacagaagaggagaggaggaccaccaaagagaatattttgcaaaatgatgaccatttgccgggcgttttaccttatccccccacccacaaatcaatcgatcaaataatcaattggacggatagagggaaaggatgaaaatagcagtggggaaggaggagagacggaagagaaagagaggaaaaggaaaaattcgacggaagaaggagggggagaaagaggaggaaaaggatgaaaatagcattggggaaggaggagagacggaagagaaagagaggaaaaggaaaaattcgacggaagaaggagggggagaaagaggaggaaaaggatg

SEQ ID NO: 104576 - DNA, 490 bp, Heterodera glycines
  Promoter: Source sequence=SeqID_4199; Location=2914..3403; Strand=-; Gene=SeqID_53567
tggcactccaaattttatttattttcattaaaataaattatttttcataaaattattagtaattttccttagctttttattcaaatatttatttgtttacacatctttgttgttttacacatgtaaacaaattcatctaataaacaacgatttctgacataaaaatatgtattgatcatggggtcgtagcatttgcactttctaaaaatgttttccacattttctaaggtttttccatttttacacctgacaaaaaattcttttattttttattttatttttttgattttgcatttttgacaaaaaattttccaaaatttatcagggtccacccgtgatttattcgaaatgaattcataaatttgtctttttacgactttgtacaaataagtcactaaatgtccaatgcaattaatatttgttgccaaaatatgtatttgtttatatttaaatagtttttaatagaattaaattaaaagcacattcaatg

SEQ ID NO: 104577 - DNA, 1003 bp, Heterodera glycines
  Promoter: Source sequence=SeqID_8462; Location=7..1009; Strand=+; Gene=SeqID_68154
aaaattccaaacttaacaatccatagcttgtcttggtagcgaagctcccaaagcgcgaagcgcttttttccagctaaatagccgacggttcacgcacccgctagttaaattgtatagttactattaattaccaaaaaaattcttggaaagattgcgtaaaattcgccattttaagtgggtttattaaatgtttttttctcagtcttgagtctcatgccttggaaaattctcgatctcgaggcacgaatattcatttttttgtccttccgtttcaccggcgccagtttttctaaattgtggggaaaaaagatttttaatttgtaatttccaaagcgatttcccaaattctcatgctatttgaaagcaagggctcattatttgtattcattcattgacgcaatggcaaaagttttaataaaaatttttgttaatgagcacaaaaagaaatttagagaaaataattcatttaacaaatatttctcttggttttaaacataatgacatcaattaataccagctcagaacatccggtatgaataaagtgcaaaatatcattttattaattttgtaatattttggaattgttcgagttcatttttaaactttaaattggttttttattaaataaatatgcttttgagatttaaaaaattataattagctctcatgttttgcattaattatataattttttagatttttttttgctaattttccactggccttattaaacgcccaatttattagcaaattaagccctgaataatgaattttgcgagacatatttaaaagtaatacaattttggctagatggaaaatcgtactaaatttagaaaaatcactcaacaatgttcattaaaaatttccatttcattaatcaaatgaaaaatgtaacaatgccaaatttctgtgtaaatttaacaagacacaaaagcatttgttagccattcatcataaacccggcggaaatttcacaaatttagccaaattaagcacaaaaatg

SEQ ID NO: 104578 - DNA, 143 bp, Heterodera glycines
  Promoter: Source sequence=SeqID_21954; Location=238..380; Strand=+; Gene=SeqID_52590
tggattgatccgccctgcgcttgattgccgagatcgctcgaaagagattccattcaaactgcacttgttgcacactgcaaagtgaccaagccgatctgatcgattcggagatgcagacggagacagaagagaagaccaaaatg

SEQ ID NO: 104579 - DNA, 299 bp, Heterodera glycines
  Promoter: Source sequence=SeqID_13124; Location=270..568; Strand=-; Gene=SeqID_76920
ttggtacagttacttttttttgtcaaagaccaaaattgtggaagcaaaaacatttcagggcccaaattttttaactgttcgtaattcaaccaaataaaaattttacgggtaatgcccaacaattgcaacaatataaaattcctttttctgaacagaccgagttcgattggttttaaatttccttttccaattgctttgtctcccccattttccattcggttacacctcgaagttgatgccatttgtgcagtgctttcatcgcaaattgcatagaacacggagtttccctctcgccgatg

SEQ ID NO: 104580 - DNA, 110 bp, Heterodera glycines; identical to SEQ ID NO: 98226
  Promoter: Source sequence=SeqID_32905; Location=245..354; Strand=+; Gene=SeqID_63130

SEQ ID NO: 104581 - DNA, 820 bp, Heterodera glycines
  Promoter: Source sequence=SeqID_19169; Location=626..1445; Strand=-; Gene=SeqID_83916
ttttttctttttccgttattattttcggctaatgccaaattgcttcttccattttttaattgtggcataacttaaaaaatcagtaaatttcggctttataattgcatttaaaaatgtgcttgttttaacacaatttttttagtgggaaaagttgggaaaagaaaatttttatggaaatttatgtatatgccttttaccgtatattttctaattatccccatgggggattattgttcaacctcctcagaactcaaaattgcaaaatttggccattttttggacaaaatctattaacaaacctcattaaattacaaaaatttttcccggcggcgcctatcggcacgccggccccctcttgttccccaagttttttggaaaaagcaccgcaaaaaaaaaatcaacttcgatttttcatgctcaaatgatcagtgaaaacaaaaaaaaatgttggaaaaaatccattgcgttcaatgaaatgttcacgttgtggtgattggaccgcggcgcctagcaaaagcacgagcagtttatgtattccatggcccgacacttctgccaaaaatgaaaagaaaatttttggatttttgggttttttccgaatttaaattttttgaaatctgctggtgaaaatagaatttgaaaccgtacaaaaatttgtacaaaaacagccaaattttgaaaaagccaataaacaggcgaaaatttttctaattaacgtcatcaaatttatggattatttttaataatatattcaaaacattaaacaaattctgtcaaattgagcattttatttgaaaattagtaatattttaaaagaatg

SEQ ID NO: 104582 - DNA, 1003 bp, Heterodera glycines
  Promoter: Source sequence=SeqID_12114; Location=1259..2261; Strand=+; Gene=SeqID_47014
gttgagctcgctatcgacttcaacagcgccttcagccatacattttttcacgaatgtcgtttatattaaaaatttcaatggactggaggcaacccatctgcattttatggttgttttttaatttactacaggcaaatttaaaaaaatatgtttgaaaggtctctgccaccaccctgccctcccggacttcatctgtaaaattaatgaaaacaccgactgatggatggacgctgcccgatctgagctgctcgccatttcattcgcatgtgacaaaagggatacaccatacaggacgccgtcattatgcgaattttgccggacgagtaatgcaacaacaatggtgaaatccatggccaggtgacgccgatcggtcttcaaattgaaggacattcaagaaaattgaaggatttcgagaattttgaggattcgattgtccatgttccgttataaattttattgtatttttaataaatttatttattttaacttgtgaagtttgtctagggatagaattcggatcacttgcgaactcaaaaacttgttcgaattttggtcgccatcgtgtatagaattcttagtttattttggtattttatatttatatttgggtccagggttaggcaaggggcgatatgaaggtcgtattcgtattcggcgaccccgaaaaccctaaattagactccttttccgggtttttatgagctttttcgagttttggacatttcgtgttttttacccttatggacatttcgaggcttggacatttcgtggcttggacatttcgtggcttggacatttcgtggcttggacatttcgaggcttggacatttcgttggtcagcgatcaaaagggccattcctctcttaggtttttaacaaattcaaaaataacatcttagcaactaccgtcgttttatccatttttatcaaaatcttatgaacgtgacataatggcctattcatctagctgattttcttcagttttcttatccgcgcatataatg

SEQ ID NO: 104583 - DNA, 574 bp, Heterodera glycines
  Promoter: Source sequence=SeqID_1121; Location=1..574; Strand=+; Gene= SeqID_68216
ctaaaaactaccaaaataattagtttttagtttctaaaatacccccccaaaatagttgctaaaaatgggtaaatagttgctaaaaactttcaatttagtgatgtaaaatgacaaaatttattcaaaaaagtaaaaaaattaggccaaatcattattgagctaaataatttttaaaatcacaattttttgtcaagaaataaatatttaaattttggagattgatttttgaaaaatttcatttattagggatgcatttttgaaaattttcgcgtcgattcttaagggtgtatattaaaaccgccacctctattacagcgcccttttgaccaataatgactgaaaaattttcaaaaaatttcagttttttaggtattttctcgattaataaaaatgaaactttttaaaaaattggaaatttatgccaaaaataatttcaacaatggaaaatttttgatattttactccaaaatcaatttttattttgtattttttcttcaaaatgcttttttaaaccatatttaactattttcgaaagcataaattgctaaaaataaaaaactttaagcccacaatg

SEQ ID NO: 104584 - DNA, 493 bp, Heterodera glycines
  Promoter: Source sequence=SeqID_23035; Location=1799..2291; Strand=-; Gene=SeqID_53740
tttatcaattcgacgaatgttccgttcttcgcagattttttccattttttgtatttttgtgatctgattcatttccttttctagaacattgttattgtatttttaaaatttattttattttattttttgctgatttggtattatgcgatgttttgtgacagtcaaatgttttatcatgttaaaaagattatgtaatccttagagaaaatatcatgtgaatgccgtcatctaatagattcatcatcatcatcatgagatttcggtcccgaaaattttggaatatacgagatgcttttgctgcgtgccatctgaacagttaatgtttatgtgcttttagagttttggtttcgggtcacaccaaaattttggtcgaacagaaaacggattttctgaaattttaaatatccattttaaataaaattcacaggatttggttgtgacattgcaccgcttgtgcgatgaaaatgcgcgtgccaatgccgagtggacaatg

SEQ ID NO: 104585 - DNA, 877 bp, Heterodera glycines
  Promoter: Source sequence=SeqID_17117; Location=1..877; Strand=+; Gene=SeqID_81556
ttttcgacaaaattttgctaaaaaatgtctttttcagaaattttttcggtccttaggagtcaaaaaggccaatttatctcatgggggccgttctaaaggggttttttggaaaaatgccaaaatatggacataaaatatggataaaaatgccaaaatatggacaaatatggaaatatggacataaatcgcgaaatatggaaaaaatggatatagaaatccatcctagaagcttcaaaccaagctaaaaagatgttttccatgcatttcaggcctcccacagtccaggaaaaaatatggattcccatataattggactccctaatgatgatcaatttatataaattaaatcatcaaatgaatgttctttttatgtccataatttctgtccgtttaaaattctctaatcctttttagaatctctgatgcaatttacatatttttaatagtgtaaatgttcttaatctttgtgtgactgttcacatatttttggtttcatttttttccattttttgtgatttttgcaaaaaaaaaaaaagaaaattaatttgacaataaaattactaattgtaagcaaattgttttttttcgtaattcgttattcgttttgcatttcttccgcaagatctgtcttttgacgaacaaataatcaatttgctcacctaattgctaaattattgcatttgtaaaaagaaaaaatcaaaacttaacaaaaaaaactccgcaattttcctcactattacaaacatcaaaacccgaaatttgaatcctaaaaactgtaagtaccaaaaatattttttcctttctatgtttataaagaaaggccaatctaacgttttaaatgcaatttttatgccattttatttgtgtcgtcaaaatg

SEQ ID NO: 104586 - DNA, 275 bp, Heterodera glycines
  Promoter: Source sequence=SeqID_45505; Location=306..580; Strand=+; Gene=SeqID_72790
ttgtgcaacagccgtaaaacaaaaatattggcggaaaaggagggaaatgcctttcagagaatatcatttttatgttcccagcacttcgttttggtattatcacataatgtcattcgcttgtcttgtcagataatttcaatgaaatatgtgattaaaattaataaacacaaaatgctttgaaacctccaagggttttaaatgatgacaaattttacaacttcttgaacattttcaaaataatgcaattaagtgaatgttgtaaaggataagaaatg

SEQ ID NO: 104587 - DNA, 348 bp, Heterodera glycines
  Promoter: Source sequence=SeqID_6752; Location=1..348; Strand=+; Gene= SeqID_62739
aatcagggctcggatctgttctgatttatcagaaatgttctgatttggagggtccaaatctgataaaataaaaaagttctgatttgtcagaaatgttctgattttgggctattgttcttattttgttctgatttgtcgcttctccgaaaaatctgtcaatgtttctttataaatttggattggcatactgtttaagaaaaatattttcaattttggccttataatttatttcttgctgttaatttggctaattatttttgtatttattgctttattgtatttctcttttctttttaatttagcacctgcactattactaacaaatggcaccgcctaagcgcaaaaatg

SEQ ID NO: 104588 - DNA, 187 bp, Heterodera glycines
  Promoter: Source sequence=SeqID_26297; Location=1501..1687; Strand=-; Gene=SeqID_57043
ttaatgaatatttttaataattttcaaaaaaattgcccttcacttgattgaaatttacaaaattgttctttatttatactctattttctctattttaaataggtatatttagattttaaaaattgggattgaaatgttcggtgccattttctttttttcaatttcttccattgttttgttcaatatg

SEQ ID NO: 104589 - DNA, 302 bp, Heterodera glycines
  Promoter: Source sequence=SeqID_35524; Location=765..1066; Strand=-; Gene=SeqID_65071
ttttgcacctttttccttaccaaaatggccatccgattttatacaaccaaattttatcggaagacagagttttcaggtgcgtatctccataagatataaccatttattcggtgtgagttattccctttacccagctcattcatcagtttcaatgtaattttttgcttcttagggctccctttgcatcgttcttaccacgtttttctcaactcaacttttaattggttaactttcgctcgtctgtgaccttgcaatcgttctcaacagctcattaacactaggccaaatgggcttcaaaaatg

SEQ ID NO: 104590 - DNA, 206 bp, Heterodera glycines
  Promoter: Source sequence=SeqID_44681; Location=795..1000; Strand=-; Gene=SeqID_72129
atgtgtattttctaaattattttaaaagatggttttctttttcgtttttggctaatttttcaggactgtatttttcgcaaccaaatgaaattctcacaaggaaaataaataaatttcccgctaattgagtgcggacagaaaagcattacttgagcatgaattaaggtgccaattaataaattgtttaattcacactaaaaataatg

SEQ ID NO: 104591 - DNA, 260 bp, Heterodera glycines
  Promoter: Source sequence=SeqID_7229; Location=894..1153; Strand=+; Gene=SeqID_64203
ggttaccgagagaatgaaacattccttaaattacatattttgaatttcctttttctttgactttctccatttagctgatcctgccctatctcgacatcgacatcaaatattacgacttgagcatcgaaaatcgagacgccactgacgatgaagtgacagtggacgcagcggaagccatcaaaaaatacaatgtgggcataaaatgtgcgacaattacggcggacgaggcgcgcgtgaaagaatttggccttaaaaaaatg

SEQ ID NO: 104592 - DNA, 201 bp, Heterodera glycines
  Promoter: Source sequence=SeqID_21765; Location=1160..1360; Strand=-; Gene=SeqID_52369
tgacaaaattggattaattcagtttttgagattaaatgggtgagaaggaaataaacggatggagtgcttaaaatgaaatttaaattttgtaaataataacaaaaccattatttatttatttgtctttttatctttcgtttttttattgaatttatcacattatcaatcatcgtttttcatatttttatttaaatatcaatg

SEQ ID NO: 104593 - DNA, 514 bp, Heterodera glycines
  Promoter: Source sequence=SeqID_40774; Location=1..514; Strand=+; Gene=SeqID_69018
gcttaaatctcaaggggaaattgatagccaatactttacataaaatttaaatgacaccaaactttgaataattggaccagtaaaaaaggcacttaacaatttgtaggttaattatgtcccaataaatattaataataactgtttaatttttaaataattttattattttatttcatacatatatgtatctttttttcttttttctgctctgaattaattttttcttttattgctttctctcgcactttttcttcatcattaaatcacatttttcagatgcttattcttgaataaatttaatgatttttataaataaaaaagcaaataaccaaaaatattttaatatttccacttcacgttaagattaattaaataaatttataaaattcatattttattttttaattgatgttggctgtttttaataaagacttggaaatatgagcatataactacaattttataaaatcacaaaattcttatttcaaatatttttaataattttttcaagatg

SEQ ID NO: 104594 - DNA, 494 bp, Heterodera glycines
  Promoter: Source sequence=SeqID_41709; Location=1..494; Strand=+; Gene=SeqID_69780
tttgcacttttccttcccatcatttccaaatgactcccaaaatgcccttttcctctcttttctctccctttttcttttcctcttcctttttgtcctcctcctcttccttcttcctcttttcctcctctttttttctcgttttcctttccttttctgtcgctgtgttttccgcttgccaagtgatgaccaaaattgagaaagtgtacgcaatggtggacgaatatcagagaacttttgcgggcagtgaaagacaatttgagtgagttaaatgggcaaaaacattcattggattaaggcctaattaattagtccattttggtaaatccaattcaaaccccccgcccccccccccccccctctttttgttacccctcactttctctcgttttcccttcgccgctctctcagcgtggccatcgcctcactgcgacctcaacgccgccggagaatcgcttcaaggcccggaagccaagttggacaaaattggaacaatg

SEQ ID NO: 104595 - DNA, 88 bp, Heterodera glycines
  Promoter: Source sequence=SeqID_6450; Location=163..250; Strand=+; Gene=SeqID_61625
ggtaatgttaattttactttttgttgtttatcgtacatttatttccttttagcgccaagtttgcatgttgcaaatattagcccaaatg

SEQ ID NO: 104596 - DNA, 172 bp, Heterodera glycines
  Promoter: Source sequence=SeqID_22298; Location=1092..1263; Strand=-; Gene=SeqID_52970
ggaaaagctcaacaacctgcaactggctattgagggttcgactggaaatttgggcgtgcaagtcagcgatctgaacgcgagagttcagagctcgcaaacgctttcttcaattgcggtaaagttgtatatattatttatgataattacatgacttatttagactgaggacatg

SEQ ID NO: 104597 - DNA, 1003 bp, Heterodera glycines
  Promoter: Source sequence=SeqID_18960; Location=1565..2567; Strand=-; Gene=SeqID_83692
caactcaaatttttaggttttttgattccgtttcctttaacaaaatgattttaatagttatttttaatggtttttcgaatgtgtacaataattaaaaaaaattatttgtgtaccctaaaaagatttttaaactctaatcccctctttgtaaaaagccttttctcattaattgattttacattagggtggggttgcgtttctcctgcagttttttcaatcaacttttaggtgaccaatcataattttcgcgatcaatcaaaagcttttgtcgatttagtatcattttaacaaaaatcacttaaatgataaaatctctgaagtaatttatttcatggttagttcactggacttgctgccgaattttttttggaatggagtgtttttttttattaccggtttgattttttcaagtattgtaatgatttccaattgatcgaaaacaattataaaagtaattaattctattttttaaaatttttactcccatttaaaaatcctttctcatttattaggattcatttgcagttctgctacagttttagtctccaatcaatttttacgacgttcaaccacaatttgcgcgattaattaaaaacgtttttgtgtgtgattattacggttaacacctttttaataattttttattcattaagaactaaaaattttatgttaattggacgaccaattgtaaatttggttatagtttttataaacgaaaattaatacgaaaaatatggtgggcatgtaaattgcagtagaaccaaatgtgtagggttttgtttaccatatctttgtgagtcgacaattttttttgagttaaaaatccataacagcaagtcgtgaaaaaatcgatcagtcattttttaattgcgattattttttattgttttgtttaccctccccccattctttatttttcttattacatttttattcactttttttaactttttacctattttctaagctcggttttttaaaaaatatttttttagataaaatg

SEQ ID NO: 104598 - DNA, 105 bp, Heterodera glycines
  Promoter: Source sequence=SeqID_9490; Location=683..787; Strand=-; Gene=SeqID_71613
tccccccacccacaattcctacatcttcccgtccaaacattctttcgtcacaaataatgaaaatgaatgaatgtgcgggggggggggaagttgggggaaagaatg

SEQ ID NO: 104599 - DNA, 250 bp, Heterodera glycines
  Promoter: Source sequence=SeqID_12470; Location=1424..1673; Strand=-; Gene=SeqID_76097
ttggcataggcacttcccaaagcatggatttggtgtttagttctaacatttccgcccttttcgggcccatttgctctgatggtatttccccccccccaattttcccattttttaataattcactttttattccatagatttgttgctgactgatcgaatcacttcttcattggacatttttcagtgcaacttttggcgcgaaagttgggccaacagagtgtcggacaatcttttggatctgtccacaatg

SEQ ID NO: 104600 - DNA, 220 bp, Heterodera glycines
  Promoter: Source sequence=SeqID_32147; Location=1..220; Strand=+; Gene=SeqID_62478
agaaaggctaaatcgttcgataattgaaatgttacggaaaacgatcaccagtccttgggaatgggacaaacgaattccttatgttgtattttcatataatgcaaccccaaatgagtcaacgggacattccccttttactatttttttcggacgtactattcagtttccaaccacgttaacagcaccaaaaagagttaatcctgcttatacagtagatatg

SEQ ID NO: 104601 - DNA, 132 bp, Heterodera glycines
  Promoter: Source sequence=SeqID_10336; Location=2345..2476; Strand=-; Gene=SeqID_73520
attaatttattcgcctatcggttttgtttcattttagcctcactcaaagacatttcgatgccgcaggctatggaacgtctcaaagaaattggggagttggaaccggaatacatcaattatttgcaggaaatg

SEQ ID NO: 104602 - DNA, 249 bp, Heterodera glycines
  Promoter: Source sequence=SeqID_15297; Location=1505..1753; Strand=-; Gene=SeqID_79523
ggcccggcgatttttggaaaatccgggttgaccgggttttgagaggccgggcccggaacccggttacttctggaaaagtcagcccggcccggcatttttggaaatcctctcgaattctagtttttttcattccacgcattgtaagatttttaagaaaaaacaaattatttttttatccatgaaaaaatctaaaattgaaaaatttctgcaaaaatgaaaaaataaaattgttttcagttcgagaatatg

SEQ ID NO: 104603 - DNA, 288 bp, Heterodera glycines
  Promoter: Source sequence=SeqID_4119; Location=2272..2559; Strand=-; Gene=SeqID_53253
atgaaatcattaggattctaaatatttaattttgtttatggatttggattatctttgccaaataaattcatattttttttttgaaatttaatcataaataaattcgctttgcttttatgctaagaataaagatcagaacatttatttttggcttcttctctgcaaaagaattttgatttgattaatgcattttcaatgtagtaaaatttatttatgttcccgctccccgcgtcatctttgaattccaattgaattccaattgccccgcccccgacaatataaaaaatg

SEQ ID NO: 104604 - DNA, 82 bp, Heterodera glycines
  Promoter: Source sequence=SeqID_17650; Location=99..180; Strand=+; Gene=SeqID_47467
tctttgtctgtctcccccctccaaaaggaattatccctccgaaatttccgcgctttctcatcgtcttcacatccccgacatg

SEQ ID NO: 104605 - DNA, 1003 bp, Heterodera glycines
  misc_feature (840)..(840): n is a, c, g, or t
  Promoter: Source sequence=SeqID_2715; Location=592..1594; Strand=-; Gene=SeqID_81223
taagtttaaaaaaaaatttttctttttgtaaaacagtttaaaaagctggaaaaataaccaaggaaatgttgaattgaaaaattttcagcaaaaattttatcctaaattaccatttttatcggcagtggtgaaaatttgttacggacttattttttgaacaaaaatttttagtccattcaataaaaactatttaaattgaagttgattattaagattttcactgagaacaataattaaattatataatttggaaattcaattttttccttaaaaaattttggtacttgtctgtcatctaccccagattttttgtacaaatttcaaaagtcgagaattcatttttcaccaaaattcacatttttaccaaaatcgctaaaatgcttaatacaatgtgactgattattcccttcatgccatagtcaattgtttaaaaaattaaagcgattatgtgcaataaatttggattttggtaaacaaaaaaatgtttttgactttgttcggctccgggttcatggttcgaattggcacaatatggatggttttctcgactctgaaaaccctaaatgagtttatttagttccgttcctgtccctaaattcaaatatttatttaaatatttctatattttctcttttatttttaatgttaaaaatatgtcagatccgccatgggcgttcgcagcagcacaatgaaaacattgacttggacccaatgcagccgtcgaccagtaccgccgcagcaaaaaatggtgcgttatgtcagaatttttccaagagattttataacatcattttcagtgcatatttcagatttttttttcattcttcaaattttagaatntagtaaacaaaaacataaataaaacattgcgcttgtaaatccaacttttacaaattcacaaaaatcccatccccataaaaaatgaaatgactattttttgtaaaataaaacattaaataacactttaaaaacaacctaatttgaggtttttgtacttaaaatg

SEQ ID NO: 104606 - DNA, 896 bp, Heterodera glycines
  Promoter: Source sequence=SeqID_16271; Location=557..1452; Strand=-; Gene=SeqID_80655
ttttcaagcaatatagtttctggactttcaatcacaattttttcaaagctctatttttctctttacggtgaaggtaccggcattggttacatatgagataaatatcattatttttttcattatcttgtgaatatattttaaaattgtcttcagttccaattatatagattgattctgtaggatctctcgattgacacttttcaactattaattgcgaatcgggcactttgttttcaacctttgtattttgttttcttgttacaacagttaatttaacatttcataaaatatcattaaatataattatttgcccaattcggacttcgtccagcacggctgtacataattagtagggccttgatttttagtgattcaacttttttttttttttttttgcttaattattttgaagaaaagcgctcaaaaaacacatttatttcagaaaaacatacccctaagaatgaccataaaattttcaaaaatagacccctaagaaatgaaaaatttttgcggacaagaatttttgattttaaaaattattttatctcaatactgattttgcttgatttagttactttttgaatacatttttacactcctaaaggttgaaattatgtcactattcgtcactgtttcggactttttgtcactgttttggcatttttcctcactcttttagttaattatttcgagatttttcgtaacaaaaaaccacggccctaataattaaggttcgagactgaaaatttctcgatttttcggactcgggacagctaatggcgcataaactcgagaccgtaattcttcgaatcggagaattcgtttgttaaatgatcagagggcccgggactcttggccataacaaagcatgtttcggtacattgaaattgaacatg

SEQ ID NO: 104607 - DNA, 610 bp, Heterodera glycines
  Promoter: Source sequence=SeqID_9875; Location=2453..3062; Strand=-; Gene=SeqID_72899
aattgatcgaaatgctgctggtttcaacaatgatgactagggctgggaattatatgcacataaaatcgcaaaatatgcgcataaaatatgcaccaaaaattgcgaaatatgcacataaaaactagagatcggaccggtcggtttttttttcggtttttttcggtattttttggtttcggtttttgaccgaaaaaaaccgaccgagaaatttatgagttttcggtttttttcggtttttaaccgaaaccgttcgaccgaccctcttgtccggtctctaatttaaactagggttaagccctcctaatcctcgggagagaaaagtcggggaagaaattccccgacaaaatttgatcaaaataaaatttatataaggaaattcttgaaaaaataaaataataataaatatgcaattctatgggatttaatgcgttctaacaatctgtaaaattaagcgaattcaaattaatttccaagttaattttttaattaaatgaaaaattaaatatcatttttcaaaaattaggcttaataaatttaggaaaaatagtcattgggttaattgcgccaatgccaaacaaattaaagtaattagagaaataaatttaaaatg

SEQ ID NO: 104608 - DNA, 417 bp, Heterodera glycines
  Promoter: Source sequence=SeqID_7524; Location=642..1058; Strand=-; Gene=SeqID_65114
ttgctaaaataataattattattttttgttaaataaaagagaaattattcacaaaattacgaaataatgaaaatataaaaaattcaattttatttaggtcggccacagtcaccaaatttgctcatctgttaattcatcattcattaacaatgaaattttccaaaaaatcctccccccccccccccaaaatcccaattttaattatttgcatttgaacagatgaaccattattttttaaacacgaaatttgcgaattggtttataaaattttgattttaatgtgtgtataaatcgttaataagaataaaggaaaaaatgacaaaatttgattggaataaaaaagtaaatattgatcaaaaacacaatttaaattatatttaattttgtaatacctaaatattattttacttaaatatg

SEQ ID NO: 104609 - DNA, 104 bp, Heterodera glycines; identical to SEQ ID NO: 98209
  Promoter: Source sequence=SeqID_7322; Location=1606..1709; Strand=-; Gene=SeqID_64468

SEQ ID NO: 104610 - DNA, 145 bp, Heterodera glycines
  Promoter: Source sequence=SeqID_34976; Location=1..145; Strand=+; Gene=SeqID_64653
ccaccaccaccaccacaacgcgacgagttaataataattaataaaaaaattaaattttgtggcatttggtcccatgcccccttaaactctcaaactgattaaaaaaactcagatgctaagccccgaggaatgggaggtgcgcatg

SEQ ID NO: 104611 - DNA, 343 bp, Heterodera glycines
  Promoter: Source sequence=SeqID_15082; Location=1500..1842; Strand=+; Gene=SeqID_79255
actgcgatactagaattggtttaagaattaaaaaaaaatagtagatgctttaaaaggcttaaaccccatgccaaatgacaaataaatttatacttgaaatattttcaattgataatccatcaatcaatgctccttattttgaagattcaaaactgaaaaccaccaagagattagaaaaacatcataaataagggattaatctcgcttttttaaattgttttttcgagcctgtgacaatattttttcaatttcttggtgtatattattcatttgccaattttttgttttctaagagattaaaatacataaaaacatacggcagaacaacagcaacattcacatg

SEQ ID NO: 104612 - DNA, 581 bp, Heterodera glycines
  Promoter: Source sequence=SeqID_14056; Location=2389..2969; Strand=+; Gene=SeqID_78029
aatgccgaaaggggaaggcgcgtccaatttatggccaaatgttggcactcgcatttgcttttttctcacattttgcccagaattttttgcttataattttctaattagcatattaggcactttcagctgatcaatccctccccgccactccctaacattgattgtccttgataatttgatcattttccatcttttccccccattgatcgcttccttttgttgtgttcaaagtgtctcatctccgacgattcattcgttcggcgcatattggaaaagcgccgtctcgcaaaaaaggaggtcatcagccgcccgccaaatcgtctcaactgtcatcatttatttgtccatctttgctccgtcgtcggcggaagggatcgatcggtcgttttcgccaatcccagcaaaaatccatcgccaatttttgatccattatggaagtgtttgttgtttcttctcattcccttttcggttggtcattctcggcttggttcttcaccgattgctcaatcatttacgacccaatttttaattattttgcaattaatttaattggctttaaaattttgtctcaaatttaaatg

SEQ ID NO: 104613 - DNA, 802 bp, Heterodera glycines
  Promoter: Source sequence=SeqID_9755; Location=1..802; Strand=+; Gene= SeqID_46809
gaaataatgtaccttcataagctagcttctcaatttttggttttgatttagcataattttcgttaagccatttaaatgtgaatttttctctttcgagtttgacactaaaacgaaaaaaaaatataggtatacacgcactcaaacaaatatttcttacaaatgtattccatcaatgccataaactttgcaatatataaatgaagccatcaggtaatccgattgaaaattctgaaactttaggttctcttatgctaaagtcattcgtaagacagttcttatagatagacacggaaaaaacgaatgggggtaaaaatgaatttgataaaaaggatttttttctaactgttttaattggtaagtgatcttcaaatcataattttaattggttacttctagaatattaggtgattttttcaattgtgatttatgagaaaattgtatttttcaaatactttttaaatttgaatttttatttattaacaaaaagccaaatttttcttttttttttacttcaaaatctgagatctataaaattttaaaatacaaaaaaaaaattttacccgctgtcttaatttttccgatttatgatgcttgaaaatccatgcgcatatatattttacagcttaagcttctctttgcagaaccaatgaaaataaataataaacctatcaatttttgtctttcgactcgcttgaaacttctaatttattaaaaatatacattgttcagattacactcacaatcttatctacctagttattttttcatttgatcaactacacgattaaaagcgtcaatcatg

SEQ ID NO: 104614 - DNA, 111 bp, Heterodera glycines
  Promoter: Source sequence=SeqID_3341; Location=1252..1362; Strand=+; Gene=SeqID_84282
ttattttttaaaaaaattctgaaaccgaggggtctggcggggaagataggcgcctccggcaaaattttgaaaaatttgttcgtcttttgaacagatttggtcaaaaaaatg

SEQ ID NO: 104615 - DNA, 1003 bp, Heterodera glycines
  Promoter: Source sequence=SeqID_21108; Location=570..1572; Strand=+; Gene=SeqID_51699
aaataattcacttttatatttcgtagctgtacacactgagttaattttgggctcccagttcaaaaagtaaatgtgtgtgtggcaaagtggtttttgtaagatagtaaaggaacaaagggcggaggttcgagtccgttgtgcaacacgactatttttatttatttttgtccaaatattaaaaaatgacgatttttgggaattgtttttgaagctttttcccaaccaaattggacaatcttggtattattcgaaagctcttgggaaggagaagctttttctaagccaatgctaagcaatttgatagttaggaaaaagatatgagtcttcgaaaaattgttttccttataactcatgaaataatgtataagccaaaaaatggctgtattactgaatgtattatatttttctctatctttatgcaaaatttgaagcgcatttaacataggacaaaaaaactaaacatagaaatgtaaattccgtttttctctattaacagagataaagaaaaagtacgccaaaataagagatgtttttttctctgcactctctatttattgacacatgtctctttttttgactcgctgtgtgtacagaatgaccattctttgatattccaatggtttgtgaccaaatttagtatgttttaatcaatttaggaactaaagtgagaattttggagttttagactttttgttcgaattcgggtccgggattcgaaatttgtccaatgaaggtcatattcgtgatcagcgaccctgaaaaccccccataaacatgtttccaagacttttcagaacaaaaaaactcttcgtcacaagggggggggggggtaccatctatagtattacccgcttttcttcttcttaagaattgattagaaagtatgtgattacgccataaaaaaagttttccttttctttgtagaggctttatttccgtttatcaaaacgaaatgcgccacacgcaaagcggcgggccaacgcaaccgccgaacggcacaatg

SEQ ID NO: 104616 - DNA, 205 bp, Heterodera glycines
  Promoter: Source sequence=SeqID_924; Location=2705..2909; Strand=-; Gene=SeqID_64147
atattgagacaaattaatactcattcatattggaagacgattaatgtttagaccaaattattttggagttgattgatattgggacagtttttcattgttggccaattggtgttggaacaattctttgtaatggttctaatccatgttaaatattgacgcgttaataagtgttctttatatcattttaaaacgactaaaagagatg

SEQ ID NO: 104617 - DNA, 143 bp, Heterodera glycines
  Promoter: Source sequence=SeqID_18205; Location=1..143; Strand=+; Gene=SeqID_82800
ttaaaaatttaagcaattaacgagagaaaaccccttttaattaacatatgtttttataaaataaaataaaaatttaaacaactcaacaaaagagaataatgaaactgacaacaaaaattaaaagaaacagattctttaaaatg

SEQ ID NO: 104618 - DNA, 290 bp, Heterodera glycines
  Promoter: Source sequence=SeqID_27273; Location=945..1234; Strand=-; Gene=SeqID_57960
tgcttgttgctcaacatgaactagagaagaagagaactcatagggttttcagctgatctatcaatagtaaaattgcaatacctgatccatttgttttggccgggtcaattgagctgtatttgacatattcaacctaatatttggcgctacaatggtgagggaaacaaacgctcattgagaacttttaggctttcaaattttacgacgcattggctgaacggtccgtgaaaaatgggcatgccattgacattttctcgtgcgcccttgaccaaaccgggctttacgaaatg

SEQ ID NO: 104619 - DNA, 295 bp, Heterodera glycines
  misc_feature (7)..(7): n is a, c, g, or t
  Promoter: Source sequence=SeqID_37225; Location=1..295; Strand=+; Gene=SeqID_66349
agttttntggaggcacttttgacattgactgaaaattgtcccattcaaatggcctttgtgacgcgaaacggacgttcattggccgaaattttccgttacagcggtactcacaatggacaatacgtaaatcaaaccgggattttgactgacgcgggaatcaaggccgtccttatctggttgtataatgtggcaaatttcccgggagagcgagatatgggacgaaggcgttcagtgattgggaatgtgccttcggggtctcataaccgtctaggcgacggtagtgggcgagaaaatg

SEQ ID NO: 104620 - DNA, 1003 bp, Heterodera glycines
  Promoter: Source sequence=SeqID_20307; Location=770..1772; Strand=-; Gene=SeqID_50815
ttggactgccaaacggcggcacaaaatccaatggacaatttaatgccaacctaaaatccctacttggcactttttttttacgatttaaacacctaaaaaatagtttttcgttctttttatttaaaattttctatttttcattttttatattcagaagtttacacaaatattttgaattattgcaacttcatttctgcaaattcgcgctacgaaggaggctgtaatatggaacgtaattcaaattgtggcattttaaaagcgcgggaaaattaatcgtcggagacggggcatttgaaataagtgataaatctgatgaacgctgagattaatgaacccattaaaatatttgtttattaataattgtgaattaattatgttttattttcttattgttttaattccatttcattttaatcatttgcattttgtcgtacttggtccatagcaccggatttattttgcacatttgctgttaaaagcaggcttttgtttttaacgagtaaaaagtaaaactaatattaaaaaattaaaaaacttttgttctaaattgatcaaaataagctgaatttagtcaaaaattattgcagcatcaaaaaatggtcattctatacagatacggacataagagtgaattttgaaaattttaatttcgacttttttgttcgggtccaggattcgaaattggtcaaaataaatgttggattcgggttcctcgaccctgaaaaccaccataaacatgttttcacgacttattaaaaccaaaaaattttatccaaaaagggggctcacccaccatctatagtattaccaaaatttcttatggaagtatttcttttccgtcattttttttctaaaaccaaattagacttaaaacctcatagatatccaatgatcaaagaagatttaatttggatgcttctattgtacataaatattgtttaataaacatatacatatgtacttaataccacaaaattttatagtagcggaattacaaagaatg

SEQ ID NO: 104621 - DNA, 334 bp, Heterodera glycines
  Promoter: Source sequence=SeqID_28555; Location=545..878; Strand=-; Gene=SeqID_59157
aaaagatataaaaaattatatttaattgtttataatgataaaaataatttgaaattggaaaaaaaattaatattttaaattgaaattaaaattaaaattgtaattattgttcaaaatcatgtacaaaaattaattttcttttcatttaatcatttataaaaaaataatttattcatttatttaaaagaaaattaacaaaaactaatattatttaaatatcaaaaatcattttcaaatttatttttcttcttattttttaattttttcccctaaaaggataaaattggcaaaatcattaaatgatcatttccatttttagattttgccaaaaatg

SEQ ID NO: 104622 - DNA, 323 bp, Heterodera glycines
  Promoter: Source sequence=SeqID_73; Location=1217..1539; Strand=+; Gene=SeqID_62111
tatgtactgtatgtataattgtaaattgttcatactgtatgtgccaatcactttgtttactcggttttatgtgaggtgcagacaataaaggtatgaaatttgatgtcttaaaattagtaaaataggcaactcaactcgtacacaaaattttttatattttttaaaccaaaatttttaaaacaaaatttttcaacataaaaattatataggaattgcaaagaaattcaaatacatggcaagttataatattaagctaccacttattgatttttctatacatatttcgacaaatagcctttatttattgcttacatccacggatg

SEQ ID NO: 104623 - DNA, 141 bp, Heterodera glycines
  Promoter: Source sequence=SeqID_14642; Location=1708..1848; Strand=-; Gene=SeqID_78736
tatttttcggttgcgtcgctttagttttatgttaattacaataagctttttgctttcaatgtgttatttatttcatgttaaatcattctctcctttcgcagttcgtcctcaaacgtcggttgtttttccgccgttaaaatg

SEQ ID NO: 104624 - DNA, 129 bp, Heterodera glycines
  Promoter: Source sequence=SeqID_769; Location=667..795; Strand=+; Gene=SeqID_60826
ggtaattttgaatttgttttttggattttgcaaatatctatcttgacaggaaatcgtccacaggatgaaaattgtttgggttttccacaaatatcttgtctgattttttccattttagggcggcagatg

SEQ ID NO: 104625 - DNA, 58 bp, Heterodera glycines
  Promoter: Source sequence=SeqID_12074; Location=775..832; Strand=-; Gene=SeqID_75622
tgtgtgttgacttttataaatgtcatttccaatccgtacaatattcgtttagggaatg

SEQ ID NO: 104626 - DNA, 490 bp, Heterodera glycines
  Promoter: Source sequence=SeqID_12017; Location=3396..3885; Strand=-; Gene=SeqID_75543
tttcttctcccttttctcctctttttgtgatagaattacgcaaaacaaatttttgcactaaaattggcttcaaccgaaatggacaaagccaacggcaaataacgtcaacaaacgaaagcgtcgttcgccccactcgaccgacttccgtccgcaaaacttcatttgctcataatcagcgatgcttctggccaattgagtgggaattgtcaaaggcgacgggggagaaaagcaaaggaaagggagggaaaagcgagcgaatttggcagaagggccaatggcacaattaattatggcggaacgtgctaaacagttgcaacaaacaaaactgatcagcaacggcggagcaaatttctctggggaatttttaaggcaaacgaacacattttgtgaagtaaaaaatatgacaagggattaagaagagacagaaaaaggcgaaaattggacgagtcacatggcaaaataatggaaatgataagagaagagaaaaatg

SEQ ID NO: 104627 - DNA, 56 bp, Heterodera glycines
  Promoter: Source sequence=SeqID_25555; Location=1354..1409; Strand=+; Gene=SeqID_56298
agtactaaaatattgaaatttaccgggaaaattaatatttttagtcaaatgatatg

SEQ ID NO: 104628 - DNA, 125 bp, Heterodera glycines
  misc_feature (38)..(38): n is a, c, g, or t
  misc_feature (62)..(62): n is a, c, g, or t
  Promoter: Source sequence=SeqID_10818; Location=1..125; Strand=+; Gene=SeqID_74087
tgaaagttgaaggttcggtgggcagtcaaattaaaagnccatttgcccctctcacaaaaatnggattcatttcggacgattgtgctgcttcttcggccgtgaagaattcgtcgaggtcgaaaatg

SEQ ID NO: 104629 - DNA, 343 bp, Heterodera glycines
  Promoter: Source sequence=SeqID_5955; Location=1..343; Strand=+; Gene= SeqID_59803
taactgaattaatttctcaccgtttgttgtccaatggccgttaaatgagttggcttcacagaaggattggctatgacttttcactggaaatgataatttatgatgaattagctatttgtagagagagagaaatccaattcaaatggaatgttttgctgaatcataatgggaaatgaaaagaaaacggacaaaaaagcactgatcacttctctgttaaatcagtaaagcagcagataacttcagcacaacattaataattttgggctgctttttccaaaaaataaatatacaaaaataaatttatttatttatttatttttttgtttgttaggtaatttcaatg

SEQ ID NO: 104630 - DNA, 226 bp, Heterodera glycines
  Promoter: Source sequence=SeqID_19845; Location=2160..2385; Strand=-; Gene=SeqID_84600
agaaggggaacgatcagaaggggagtgatcaacggggcctttgagggaagggattaatcacaagtggaagtgatcagtgactgctcatgagcacaggggtaaattatgagaggcagcagaaggggagggcggacggactccagagcaaaccgggatatgatgttaataaaattgtttttgtttcaccgtttccgggacagaaatcagttccgccactgtcggaatg

SEQ ID NO: 104631 - DNA, 467 bp, Heterodera glycines
  Promoter: Source sequence=SeqID_5390; Location=1..467; Strand=+; Gene= SeqID_57868
ggacattcgttcgctgcacgtcttcaggacgggccattcgcggcagttattatattctatgggggatattcggccgcttcgcggcctcaggacgggcgcttcgcgctctttttaaattttgtgggggacattcggccgcttcgcggcctcaggacgggcgcttcgcgctctttttaaattttatgggggatattcggccgcttcgcggcctcaggacgggcgcttcgcgcttaaaaatcgaatgcattttagtttaaattttttttataataaaatactcgttttattaattaaaaacaacgtcgaaaattaataattgaatatttgtttaatttgaaatgaaattaatttttttgcaaattcaaaaaataaataatgaaaatttttaattaaaaaaaattaatttaaataatttacatcaaaactattttaatttattaaatgcagtgaaaattacccaaaaaatg

SEQ ID NO: 104632 - DNA, 167 bp, Heterodera glycines
  Promoter: Source sequence=SeqID_2263; Location=3505..3671; Strand=+; Gene=SeqID_78781
atgcagcaatcttaaatattaaaattagacaacaaataaaactgcgtttaactgcttcacatttttgcaccgaaattcttttttataagtataatgttttgtcgacgaaaaataagaaaaaaattgcaaaatttggccaattaggaggagaggcgctcacaaaaatg

SEQ ID NO: 104633 - DNA, 420 bp, Heterodera glycines
  Promoter: Source sequence=SeqID_4029; Location=6676..7095; Strand=-; Gene=SeqID_52888
tttggccaattggtgggttggcttattcataggacaattttactttgcattcttgcattcctttaagccacttcgcaaactgaaaatttagaaaagcgcaactttttacaattttatggaaaaatgccatttaattttgcgataacgagttttttagctttaggtctcaattccatttgaaagagtcacataaatctgctgttttgtctattcattctttgcaaaatttgcatttgaatggattttggggaatataagttaattaggttaataataagtttttaatagtgctttccgatcccttggcaatttttaatttatttcaaattatgtctgaattgaattaccaaattaattgctttgtccattcgctttaggtcgctgttctgcttggacttctgtgccctggtggtgccaatg

SEQ ID NO: 104634 - DNA, 161 bp, Heterodera glycines
  Promoter: Source sequence=SeqID_12407; Location=5325..5485; Strand=-; Gene=SeqID_76013
caatgatactcctcagcgcaagacacttctggcaattcttccaagggaagagagaagtgtctcccgggctgtttgtgatcaacacatcgtttggcccgatgataaatggcgagtccaacattggaccgccgaactcaaatcaaaaagctctctcaatgatg

SEQ ID NO: 104635 - DNA, 98 bp, Heterodera glycines
  misc_feature (46)..(46): n is a, c, g, or t
  Promoter: Source sequence=SeqID_21503; Location=1..98; Strand=+; Gene= SeqID_52114
ttgtttagccatttctccgttcgaccactctttctgcctgctacanaattcgacttgaactttttgagtcaacggaaattgcgccctttgaattgatg

SEQ ID NO: 104636 - DNA, 178 bp, Heterodera glycines
  misc_feature (23)..(23): n is a, c, g, or t
  Promoter: Source sequence=SeqID_28412; Location=1..178; Strand=+; Gene=SeqID_59033
tttattggggattatgccaccantttttgcatcaccattattatatcaacattattgtgctttagccccccatacacgggcggaaaaatgttcggacaatccgccgcctggcttccctggcattgaattcatgctcccattactgctccaagcggtggcggacggtcggctgaccatg

SEQ ID NO: 104637 - DNA, 392 bp, Heterodera glycines
  Promoter: Source sequence=SeqID_27835; Location=401..792; Strand=+; Gene=SeqID_58514
ttcccacttcgattatgcgctttaggtgaaacttgggtaattaaatatttaattatgcttttacccttaatccatgccaaacgaatagcaattgccacataaaatgaggacgaaacacccagataagtcaaataagtccacgaatactgtgaaagaactaaacccaaaaaacttttgtattggataataaatcaaattaaaaaatgatttaatatcttacaaatgtaaaaaggagtcaaaatgaaggacaacaaatgcaaaagcaaacgttggagcagaatgcatcttaaaataataaatgtgaatgtgattcaattgttattggcctaaattcaaattgatatgtaaattaaattaaatatttttttaggtgatcgaaatcgagttcgatg

SEQ ID NO: 104638 - DNA, 77 bp, Heterodera glycines
  Promoter: Source sequence=SeqID_1986; Location=769..845; Strand=+; Gene=SeqID_77204
aaattggcattcattttggcaaattgttgcgtcacagagagtgccaaaatttaattgcaaaataatttgaaaaaatg

SEQ ID NO: 104639 - DNA, 108 bp, Heterodera glycines
  misc_feature (64)..(65): n is a, c, g, or t
  Promoter: Source sequence=SeqID_15448; Location=3237..3344; Strand=-; Gene=SeqID_79710
cctgggtttttgtccagaaaatctaagtatgcttccttgttttgctatcctcaccctcgaaaanntttaaaaatttcaaaaaaatcattagacattttgttaaaaatg

SEQ ID NO: 104640 - DNA, 245 bp, Heterodera glycines
  Promoter: Source sequence=SeqID_26481; Location=566..810; Strand=+; Gene=SeqID_45994
acaaatgagcagacaaacacttttttttatttatttatttattaagcatttaaatttgaattttaaatgaattatatacaattaacatttgcattgtgtgtgttttattcgtatgctttccttcccctttcaatccaacgaaaatcaatgtttactttttctatgttctccaccaaatactcttttttaattttattgttgcaatttgtctcaattttttaaaatgttttttgagatacaaaatg

SEQ ID NO: 104641 - DNA, 54 bp, Heterodera glycines
  Promoter: Source sequence=SeqID_5690; Location=1888..1941; Strand=+; Gene=SeqID_58919
aaaaaaattcatggagggaaatccaaacaccggtttttgttctatccgcaaatg

SEQ ID NO: 104642 - DNA, 210 bp, Heterodera glycines
  Promoter: Source sequence=SeqID_12132; Location=2572..2781; Strand=+; Gene=SeqID_75709
ttgcttaaagaccgggaataacgccgacgacggagctcaaagactgaggctgcaaataaaagaaaatttagtcgagaatttgtcgaagttgctcaaagactgaggataacttcgccatttgagtgatttgctcaaagactgagaagcgaatttgttgaaattgcagacattgttggatttgaattgaaccaagacggttaccgaaaaatg

SEQ ID NO: 104643 - DNA, 1003 bp, Heterodera glycines
  Promoter: Source sequence=SeqID_8218; Location=1703..2705; Strand=+; Gene=SeqID_67338
aatattataaaattaaaaagagaaaaacttttatcaaatttctcgccctttgagaacaaaaacagtgttgcgggggacatgaaacattctcaaataaaagagaaaaaatgcagcgaaaaattgtttatacaaaaatttaaaaacaaaaagttgatttaatggttaattatcataaatagggttataagttgtatgcttttgcatattttttctgcgcatatgctatgaagaaaggggctcaaaaatagcatttctgcgttaaaattttttgatttggtgaaggtttttagtgcatataaaagcatattttgggggtttcgagaataaatgcatatttggccatttttgcgtttttgagagcatatttcggtcatttttggcattttttaaaaagttaaaagccaattttgacagtttttaaggcatattttagtgcatatttgggcatttttagggtttttagggcatatttgggggatttttagtgcatattttatgcgcatattttgcatttttttagtgcatacaacttataaccctaatcataaataataaaataattaggtaatagaataatttttaaatcaaaaagaaatattttactcaattcaaataaaataattatttatatgacctttttaaattaatttgtacataattaaaatattaacatttataaataaaacttattattagtgatgtaaattctatgtaaattcttaattttttttcatggatttccccatggtctaattagtaggaaaaacattttctttttttgttgtagaaaaggtagcactataaagttgaagttgaattagtgctaataaaaacttgctggcgttatgtctttgtcaaataaaaaaacagcaaaaaatgatgattttttcatttatattatttttccattttttcttcaataaacagaattttgcaccttttttgccaccttttaagcctaataattaacaaatagcacgacaatttaaagagttgcaaaatg

SEQ ID NO: 104644 - DNA, 522 bp, Heterodera glycines
  Promoter: Source sequence=SeqID_4449; Location=1245..1766; Strand=+; Gene=SeqID_54490
ataacttttctcttaattttgtctttttcgtcattttttgtttgttactcaaaatttattttttatcaataatgcgtttttttgttattttgaagctaagtgtaataatttattaacttcgtaaacggtctcttccagtttttgcattttttagcacaacattgagtcagacaatgcaaaacggcgaatttgattgtactacaatatgttgttggtcgacactcagaaatgattttatgcgttcaatgctaataaacaaatgctttgtttaattgcgtctcccttaaattgcacaatctttttaattttaattgtttagagcgttattttatgcgcttttatttttcattttaatgattttttttttgcttattttataattgtttaagcctgttatttgctgccttttgccttgctttaaagagctaccaaattttattggtaagaattcatttcccaaaaagagtgtgcctatacactttaactttattacagactttgtcctcaaactgttacaaaatg

SEQ ID NO: 104645 - DNA, 390 bp, Heterodera glycines
  Promoter: Source sequence=SeqID_11032; Location=2905..3294; Strand=-; Gene=SeqID_74360
aattttattcaaagtagtactccacctagcatatttttatgcagttatttaaattttctataatgttatttcatagagaattgtttgctaatcattttaaaataagtttgcttgctctatcattttttttgaattttttatgaacttttaaaattttgtcttttttattgatttttcgaaactttgatcactttttcttatcatttttggcgccagagccaataaagccgaaaattggcaatagcaaatcgactatgctctacacgataaaagcggttttaaaacgctctgagtggtgacagttcggaatgttcccttgttaacagggtggaggcgcagagtcatacatttaaaaaagggagggggattaaccaaaatttttgcaaaatg

SEQ ID NO: 104646 - DNA, 1003 bp, Heterodera glycines
  Promoter: Source sequence=SeqID_2415; Location=878..1880; Strand=-; Gene=SeqID_79609
gaatggaacagtcggcgaagaaggaattgagattgactgaggaattccttttgttattttctatatttaaatgaaaatggtagcaacaaaaagttttgtttagaaattgtaactcaaaaatgaaaattgagtataaatattgcgattttcccaccttttttcatcctcatcattcctcaattacaaattatttaattccctgcgatgctcgtcgacgtcctcttcaccgcgtccctttcacttcaactgctgcccctgcactatgggtcaactccactgtgcagagaaaagcctagtactatctcgtcgtttctctttttctttgtaatttctctcactttggcgtactatctcttcattttaattatgtaaaaagtaacatttacttcgctacgtttaactttttttctatacgttaaacctacaccaaattttgcatatcgatagagaaaagaattctgcatctttctatagtgaatttaattttgtctatggtcaaactcaaaagttgtaaataataataaaaacgtatttctttttcctctcattttggcgtactattttcaagtctctaacacatgaaaaaacatcaaattcgcaaattcctataattttggttatacgggtacaaattcactttggacatttagaaccaatagaaaaatgattagttttcgcattttggttgaaatcagcagtttaggacttgagttataacgtgataaaaatttgaaagtatcacaacttttttctgagatgtcaaattgcttagcattcgcttagaaaaagattcaccttttcaaaaactttttttaaataccaaatttgttcagtttagttgggaatgaagcgagttatggcagatcaaaataaaaaatacaaaaaagacattttccagtgtaaattttgaattaacgcgcaaaaatttacgccaaatacgctatttggcgttatgagcaattttgtctaacactgggcttgacccatagtgcccctgctgatg

SEQ ID NO: 104647 - DNA, 1003 bp, Heterodera glycines
  Promoter: Source sequence=SeqID_15673; Location=1530..2532; Strand=-; Gene=SeqID_79979
tggatatggtataatattctagcactaccttcgtattatttctgttcaaatttctaggtggtataattgcggggctgttaacgctttgaataataaagttatattatattttttatttatcattatttttttttgtcattgaattttttgtaaaatattaaatgcttgttttaaaatttattttgagtttttctttatttttaatataaataaatatgattaaataaaaaattaataaatgaaactgatcaaaacccaataacaactcgaattgtcaatggactcgataatatatattgctttaataacataattaatcattaaatgatgagtattattgaaaacgataaaatgttaatatgcggtcttttgagtaccatttaaaaatttgaattttttaaaattgcatttaagttttcattattgacgaccaaatcatattgccaaaatttaaatatcaaataaaaataataaatgatataaaaataaaattaattttaaaaaatataaataaaatattcagttgttaaatataattaataaatttaaaatagttcctaattgttaaaataggcataaaaaaattctctccggacattttgaattaatttatacataatgaatgcattttcaatcgcctattgtgtatgattgtgaataatgaaaatgaaaaaaaacaaaccaagacgcggacctacatagggtgtaacataagtttccgcacaattttttttgacaaattcaaaaattcataactccgtaatttctgcagttattttaataattctttttttattttgttcgtcagaaagtcttctttcatttcatgccattgtttcattttttatttgcttattcaattttttagtattttttcccgaccatgcaaaaattgaaaattggcccactaatttttctcgatttttttatggtcaaaaaagtaacctgatataacaaaaaagaaggttttctgtacaaattagaccagtagaatccgaatatg

SEQ ID NO: 104648 - DNA, 392 bp, Heterodera glycines
  Promoter: Source sequence=SeqID_24151; Location=1127..1518; Strand=-; Gene=SeqID_54850
catgttttttaaaacatgcaattaaaaaaaatctcttaacggaattgaatgcttttcatacttaatagaaaaaaaaattaaattaacataatatcattacaaattaaacgataaaattcactatcagagcatatctgagcaactttttcattggagttacgatagattaacttttttttttgctctttacatgcgtattttgaaattgtagtgaaaattaataaaaaaaaaatttaagctccaacaataattaaaattatacttaaaataactcttataagaatacaataaatgaaaactctaatcaaatactaaatacaacacatgtaaaacaattaatgtaataaacattcttattctttactacttttatttaaataattcttaccatg

SEQ ID NO: 104649 - DNA, 894 bp, Heterodera glycines
  misc_feature (13)..(14): n is a, c, g, or t
  Promoter: Source sequence=SeqID_35535; Location=258..1151; Strand=-; Gene=SeqID_65078
ctctagagtcaanncggacacttgaaaaaatcgatttatttttgttttcgcgtcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgagccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataaatgtttgagtaccccaaacggacacttgaaaaaatcgatttttttgtttcataaatatttttttcagaaagtcatg

SEQ ID NO: 104650 - DNA, 122 bp, Heterodera glycines
  Promoter: Source sequence=SeqID_16651; Location=1206..1327; Strand=-; Gene=SeqID_81063
aaatgccaaagtgatttgggaaaattcagattttaatataattaggtagatatgtttttgggaaagaattatttacgacggacaacggcggcaaaagcgatgatcaaagacagcatttaatg

SEQ ID NO: 104651 - DNA, 1003 bp, Heterodera glycines
  Promoter: Source sequence=SeqID_1728; Location=735..1737; Strand=-; Gene=SeqID_75527
gacagtgctgtggggcagagaaaagaaaagagtgaggagatggaggagagggatggtgcgggggcaagggaggaagagagagatagaggagagagagagagattgcggggcaagggaggaagagagaaagagacagattgtggggcaaggggggaagagcggatagagagagagcaaattgtgaagtggcagacagacagagaaaattggggtgcggataagcgaatggggggggtcatttttcggtggagatgaccacgccaataaggcgtcgttttctctgcttcttttgcccatacgctctctaactgggaaaggtcattggaccgaagagggcaggggggggggacgaatgaatggcattcattcattcactttagcgacgccaaacacccaactctccaaaacaatttaagcaaatatttattgtaattttagatttgttttccaattttttattaaaaaatgaaacgtcaatttgctaaaaggtcgggtggggcgccatcccacctcagacgggcagcggcaaatgtggccactgaccttatgaaaaatgtaaaattttttaccttttttccaaaaaataaaataaaaataaattttgtttagtattttactccatctggtattgaacggggggtatgaatttctttttaaatttaataattaaattcaaataaattttcatgtgttgagcgcgcgttgctgggacaatgaaattgggggcacaacgacaaatggccagcaagtaaaaattttttcaaattttttccccatttaataattcttttttctattttcatgtgtggggggttgatttttatgaattaatttctaaattttaccccaatccctaaaggcggcggcggcgacgaacaccggtgacaaacgacgagcacccgacgatgccgaacaaaggcgtaatgaggtctgttgaatatttaaaatttttttttcaaaattcattttttctttttgtttcaggaagcaccgacaactgatg

SEQ ID NO: 104652 - DNA, 867 bp, Heterodera glycines
  Promoter: Source sequence=SeqID_10393; Location=3069..3935; Strand=-; Gene=SeqID_73587
ataaaagctataattcatgcacccactattattttttggattaatacaatgcttcaaagtgttaatcggatataaatgcgcggtttttgccaaaatttgaccgattttaacttatatttttgaaaaaaaaatttcaacttttttgttagaattcgggtccgggtttcggaattgggcaaatccgagttcagattcgtaatcagcatcctagaaaacccccggaaactaattttgagccaaaaataaaaacgttaaattagggacacccattcttccagggattgcggattttgtgcatccaatcaatgactatcctcagtttattaggccataatagtctttacatcattggtaccaaagaaagcttaaagtctctagaatataaatacaagaaaataacaacaaaaaaaaagtaaaaacccatcgcactgccccgactcgtactgttggcataggcactaaatcaaagagaataactacatttcttcccgtcatgcaaaaattttgagtttcaattccgccgcgcatccgtaaatttgattttggtgcgggctcccgcgggatccgtgtattctttgaaaatcgcaatgacaaaatgccaaaattaagttttggacaaaatttgttaggaaatcggtaaagggtttcaaggcgtcaccaccgccccagttcaccaaaagttccttggaaaaagcacgccgcaaaaaagtgatttaatcccgcaaattcctgcaaattataaatgcgggattgatctcgcggcatcccgaaaattattacaaatatatgtgtatcgcttcatcatttctaaattttcagtgttagtgttacatttatcttctcttgcaattagcaaattttaaaatg

SEQ ID NO: 104653 - DNA, 391 bp, Heterodera glycines
  misc_feature (166)..(166): n is a, c, g, or t
  Promoter: Source sequence=SeqID_8097; Location=1..391; Strand=+; Gene= SeqID_66967
tgtacagtccaaatctctgatgctacaataagcccacagacggagaaagaattgtgaatgggacaatattagaaaataaaaataaaaatttgtgatttaaatttattttagcattgtgttaagaattttatttatttatttttatttataatgcaagaaaaaaccnccatttggcaaattgactttagcaaattgtctcggcaatttccaactgcgttttatggggtgcatttgttatttatggaaaaggcattcatgaaaaatgtttcttttctcatcagtgcgattgcctttttaaaaataattattttttaatatttattattttattttttgaattattactcttactgtatgtaataccgtatcaaccgaccgaccgttcgacatg

SEQ ID NO: 104654 - DNA, 1003 bp, Heterodera glycines
  Promoter: Source sequence=SeqID_12840; Location=515..1517; Strand=-; Gene=SeqID_76567
tcattttttttgtttttatggaaagttttatttgaaaattgaatttacttttggttttatactaattttcaaaaaaaacatttaatactccgatatttatttaattttcaaaaatttccataatccgccgtaccgcatgggatcccaaattattgaatggatatctctattaaagtggcccctgacattaaaagacagttgaaaatttcacaaaaaattttacttagctaatttcacgatgattttgtaaaaatttgtaagttctctaaaaatcatacactctctgagaaattttacccataaattgccaaatttttttttatacatatttttacaattttatttgcaattttacgatttcatctgtatatatattgtatgatgaaaaaagatgaataatattataattgaaaatatgagttaaaatgcattgttatcgattttataaattttttttttcttcaacaatagcgaataaaatttcatttttatattataatttttataaaaaatgtataatattagtttttcgcattagaattaatattaaaattataatatttttacttttctatattaaacccctttcaataaaattaatataaaatttattttgacaaaatataataaattttctgagcttaatttcctggtaaagtggtatgatttaaaatagtgtgaaaataatttcattcaaaacttgaagcattccccaatttattgtaagttgtatgaattgggtcaaatttcttttttgaactttgtcaaaccctcgaaaaataataacaatcttagaaataaggacttacattggcatggcaaaataaaatataaatatataaaattgagttgttcttgaaaaacgaaatcccgaccttccccggctcactctcgactttttacccgaaagtgtgttgtgggtcggggaggtaccgtaatttaaaaaataaaataaaatttacggctaaattatttttagagaatttgaaaattttttaccatg

SEQ ID NO: 104655 - DNA, 106 bp, Heterodera glycines
  misc_feature (33)..(33): n is a, c, g, or t
  Promoter: Source sequence=SeqID_10928; Location=1..106; Strand=+; Gene=SeqID_74231
ttttgtgatttttgttttccaatcaaattgttnagcatttctcgtgccaaatgccatttcttccgtcacttacgaaattcatttttctgttcatgtgccgtcaatg

SEQ ID NO: 104656 - DNA, 205 bp, Heterodera glycines
  Promoter: Source sequence=SeqID_21777; Location=453..657; Strand=-; Gene=SeqID_52383
acagtccgagaaagacgctcgcacaattggcaatgattttggagggaagcaagctgaaattgccaaggtgacacacccaaagccaaggggcgggtcaaaaggtcaatgttttcgttgtggttcaacaaatcattgggccaataaatgtcaaaatcagaaggacaaatgcagcaagtgcggaatgattgggcattgggcaaaaatg

SEQ ID NO: 104657 - DNA, 817 bp, Heterodera glycines
  misc_feature (93)..(95): n is a, c, g, or t
  misc_feature (98)..(99): n is a, c, g, or t
  misc_feature (106)..(106): n is a, c, g, or t
  misc_feature (110)..(112): n is a, c, g, or t
  misc_feature (115)..(115): n is a, c, g, or t
  Promoter: Source sequence=SeqID_242; Location=1..817; Strand=+; Gene =SeqID_79584
agtttctgaatgctgctgatctggccaaattgcggtgcccttaaaagccgccaagtctcaccgagcacaacaggaaacccctaaaaaaggctnnnggnntggggangggnnnaangttgatcaaaataatcaaccaaaaaaaactgcaactgctggccaagcgttgtccaattggttgcacacgccgaccgccgatggccaacccaagcaattgtttttttattcgcctattaatggcccagaaaaaaaagaatgggtcgacagattcaaagaggtgtgacagggagggagcagcagctcgtccccccccccctcaacgcccccgattttttaaaattttttggaaagttttcaaaatgaaaaatcagtaattcaccatgaaaaaaaattctttttttacttattcaaaaaactcagaggtgtgccaggaagcgcatgtttaagcgagttttggaaaaagattttagaaaaatgaaaaatcggtagtgattcacgatgaaaaaaaatttttgtttgaattttattaaaaaactaagatttttcttgaaaaaattctacattagcgagtcttttttaacatagtgcacattttcataaatattattcaattgattgttgccaatttgtgttggttttcattttcacaaatttgtttagcaatttcgccgtgccaccactgccgtcagctacaaaattcagtttactgcttatgcgccggcgtcaacatcatggtgccatttgaattggtgaacgaaagaacccgggaaaagctgacattgaccaagccagcaaacaaccgatggataattaaacgatg

SEQ ID NO: 104658 - DNA, 221 bp, Heterodera glycines
  Promoter: Source sequence=SeqID_33848; Location=222..442; Strand=+; Gene=SeqID_63793
agtaaaaagaaaaaaagagccttttaaatcactcctattttaattaaactcaatttttcactggctttaaggttttggctgatattgtcaaagtgtctctggaacagctctttggccaactttcgaaagtggatttgtcttccacggagcgcaccacccaaaccatcgttgatctaactgcttttgaggaagcctttcaggaattcatcacaaccgaaatg

SEQ ID NO: 104659 - DNA, 645 bp, Heterodera glycines
  Promoter: Source sequence=SeqID_15951; Location=2496..3140; Strand=-; Gene=SeqID_80304
ttggcccaaggaacttacttttacattggactcggaagacgaggggccctcgctgggtgaacgagggctgaccacattcgttgcccggcgggaggaaacccccgaagcgtcgacagaacggactgactggctactcaatcggtccggcgatggacgaaggcagtgcgggtcatggcgtggatgcgacggttcatcgcaaggacacatcgcaaaattaatgatggcacgggcgacccgcggtgccaaagcgcgagtcacgggcgatgcccgcccgtcctaagcaacgaagaattggcgcgagcaaaatggcagctcctccgttcagcacagagcgaatgccaaacacgggaaggcatgcggaccgaggtggacggccacggagtaaccaggctgatcagtcggatcggctggtgcgcggaggccgaagtcagtaggccagtcatactcccgaaacactcaagggcgggagcactcatcattggcgacatccatgggcggcttcatcatctcggcgtagacggaacgctggccgaatttttgagggactggtggtccccgagcgcacggcagcaggtgcgaaaggtactcggccaatgcaggcagtgccgacgactccgggggatgccctaccccctaccgactatg

SEQ ID NO: 104660 - DNA, 611 bp, Heterodera glycines
  Promoter: Source sequence=SeqID_25140; Location=433..1043; Strand=-; Gene=SeqID_55864
aataaaaagtcatcagaagggcaaaaaaccacttactctgacgactgttcagatagtatgtcgtagagtaagtgatataatatatatggatgatcaaaaaataaaatcaaaatatatgaataaaatgaggtcaaagtcaattgagatcgataacacaaatgtcaaatcacttaaaaaattaattctgtgtttgcttttccggttattaccctaatgaatttttaagttttgttttaaattgatttaaagaatttgtttcaaaactggggtaaaagatttactaatcgattcctctcgaggagctaattgtaagaggggtgggtcgcggacagaaaaatcccgcggtcgcggatagcggattcaaactgccgcggatcgcgaatttaaaaattcaaaaatttcaattttttaaacatcaatgctttgagtgtaatttgctaacagattttgtccaaaaaatggactgatttttcttagcatctcataagccgcgaatcccggtcgcatcttttgacattgtcattatatttctatctatattgtatcttttgttttgttttcaaattctttagataattttattttcacagattctgtactttcaatcaatg

SEQ ID NO: 104661 - DNA, 203 bp, Heterodera glycines
  Promoter: Source sequence=SeqID_9983; Location=860..1062; Strand=+; Gene=SeqID_73025
tgttcgtaaagatttactcaatttcaaacagaaatttcacccgaaaactgctggaataataataatgccatttgaattgaaccgttttcaagtggtagaaaatacggtttgactaattttgagggcaaaataagaccctaagaccgaagaatactttcttacaataaaacgaaactgcttattttctttgtctttttagcatg

SEQ ID NO: 104662 - DNA, 622 bp, Heterodera glycines
  Promoter: Source sequence=SeqID_7817; Location=1..622; Strand=+; Gene= SeqID_46475
aaacatggaacggaaagtgatttttggctcgtccctccattattgacaacaaaacaaacaccaaatagcaaatacaaaaacaaccaaattcaatggaccattcgaatttaattcattccgaccggttggaaagggtgggagagattaagagattaacagcgaaagaaaagggtggcacaacagcgaattggagagaaaaagaaaaacagagaacggaaatagacatagagagagaaaaagagagagagggctaaaggaacgcgcaaaaaaagagcgaaaaatgccgaaccaacggagaaggaatgaacgaaggaaaagagggagcgaatgccgtggcatgacaacgaaatgaacgaacgaacgaacgaacgactaactgaatgtgactgactgttgttgcttgttgctattgccaatttgtgcattcgttacatttttaaattatactttatggcgaaatatttattttaaatgcattaggtaaatttgaatttcgctaacaaatcaaacaatccatccattcggtcggactttttcattaaatgctttaaattttcagaagattttaccaatttagatcaaaaaattttcccaatctttatatattatttttttcaaaatg

SEQ ID NO: 104663 - DNA, 577 bp, Heterodera glycines
  Promoter: Source sequence=SeqID_21967; Location=635..1211; Strand=-; Gene=SeqID_52598
ttttgtaacaattagcatgcaattaattaattgttcccaaattacataatgaagttaaattacacacctttttaattgacacagatcactacgacaaatttgctgttgccatatgccagataaacatcgagtttgttttttacgcaaaaaatatttaaaagtgccgcgaaatttggcacgtcaaattggcattgatttcagctgccggatcagcaatgatcagacggcactgatgacgaaatatttttattcgattaaattttgtaaaaaaattaacatattaaaaagataactaattttttttaaatgtgtgttgtgttttttatgtttgtcctaaggaaatgaaaatctttgtaatatttaatcataaattgtcctattttacatatttttgtcctgcagatttggtaataaatccaaggcttttaattttttaatacgtaattattagcgttggaaaacatttcctattaatcgaaaaaatattaattctataaaatttatttcgttaaattattaaattagtaatttttttttgtgaatttataattttgtcaagcattatcattgaaatatg

SEQ ID NO: 104664 - DNA, 280 bp, Heterodera glycines
  Promoter: Source sequence=SeqID_13141; Location=1..280; Strand=+; Gene=SeqID_76946
tcgcccaatccgccgatgtctctttcttttccttctttctttgttaattgattttgccgttctttttcaataataaatttcgtccttttgagattatcacgcgagaaaatcacagagaaatggcagcaaatgttgcggaattgaggccaaatgagtcggtgtttctttttccctttttctgccctttacaaattcaaattgttttcgtccggcattcctttcctttctctcccttttcagtgtcagtgttggcgaacggcgacaacaaacggcggaaatg

SEQ ID NO: 104665 - DNA, 423 bp, Heterodera glycines
  Promoter: Source sequence=SeqID_8794; Location=1..423; Strand=+; Gene= SeqID_69249
tcccctctctctctctctaaatatctctctctctctaaatctctctctctctctaaatctctatctctctctaaatctctatctaaatctctcctctctctctaaatctctctctctctctctctaaatctctctcactctctaaatctctctctctctctctctctcccctctctctctctaaatctctctctctctctctcccctctctctctctaaatctctctctctctctaaatctctatctctctctaaatctctatctaaatctctgctctctctctaaatctctctctctctctctaaatctctctctctctctctagatctctctctctctctctctcccctctctctctctaaatctctctctctctctctcgcccctctctctctctaaatcgctctctctctctcgcgatg

SEQ ID NO: 104666 - DNA, 1003 bp, Heterodera glycines
  Promoter: Source sequence=SeqID_19187; Location=213..1215; Strand=+; Gene=SeqID_83933
tctacggtttagccctacaaatggtcggtttgaaatttgcattgtaggtaagaataggtattctcagaaaatggttatcccttttttctacatcattagacatgtgggtttcagccaaatcgcattactatctacggttgagccctacaaatggtcggtttgaaatttgcattgtaggtaagaataggtattctcagaaaatggctatcccttttttctacatcatgggtttacagccaaatcgcattactatctacggtttagccctacaaatggtcggtttgaaatttgcattgtaggtaagaataggtattctcagaaaatggttatcccttttttctacatcatttgacatttgggtttcagccaaatcgcattactatctacggttgagccctacaaatggtcggtttgaaatttgcattgtaggtaagaataggtattctcagaaaatggctatcccttttttctacatcatttgacatttgggtttcagccaaatcgcattactatctacggttgcctacaaatggtcggtttgaaatttgcattgtaggtaagaataggtattctcagaaaatggttatcccttttttctacatcattagacatgtgggtttcagccaaatcgcattactatctacggttgagccctacaaatggtcggtttgaaatttgcattgtaggtaagaataggtattcggagctcgctgacacggcagtttaaaattttggcgattttttccgtaagaagcaccattttgagaatttggaagctacaattttggaaaaattaacgaaaggaagagtgcaatttatagaggaaaaatgcaatattaatgagatgaagacaacaaaatgtaaaaattaagcaagtatacatgctatttatattgatttcgaatgagccaaatttattttatgggttaaataaacattgaaaggtataaaatgcaaaatttttagttctttgtattattattcttccattttcctaaaaatg

SEQ ID NO: 104667 - DNA, 538 bp, Heterodera glycines
  Promoter: Source sequence=SeqID_6962; Location=1537..2074; Strand=+; Gene=SeqID_63410
aacattttattaatcatgtaaaattacaaagataatttatttattttttaaattaaggttctttggttaatgtttaatcatgaaacttgttctcgaggggtttttgacgacctctgatcatgaaaatgacatctattttggccaacttctaactaacccgaactcggacaaaagtttaaaattccaattgtccatttatgattttttgttcaaatttaagccatttttaaagtagcgcaacaaattccattgatttaaagatgaatttaaaatctttaaataattccaaaaaaaaaacaaatgcaatttctttttttgctaagaatttcatacagtccatgattagaatcaatcaatatagccgcattgattgatcagcttcaatcaataatgattgttggttgaccaaaaccaatcaatcctcattattcagaacgaaattccgcgttcatcggatgccgatttgcgctgggccaaaccggagtgccataaggcggaggtggcccaagcggcagtgagcaaattattgggccaaatg

SEQ ID NO: 104668 - DNA, 570 bp, Heterodera glycines
  Promoter: Source sequence=SeqID_36674; Location=1..570; Strand=+; Gene=SeqID_65933
gacatgagtaataaacattttgattattacaattaaaataagcttttattattatacatttataaaaaaaatggctaacaattaaaaaatatattcatatttaataatctcaataatgtcagtatctaaaaaataatataaacgcttttcattaattgttaaaataatgaaaatcttgcttaaattatttcatttaatgtgcatgaaaataggcctaaacaggtcaagcaactgcgataacaagactactttcgtttttaaattttaattattttgttattccaaataaaaaaatactatttatttaaaataagttttaatacatataatagcccgtcctcaacacttgcagggcgttttcatgcatttttggcaggtcatatctgttactgtcatttaaaaacaatataactttctgattataatattagcataaattattgtttttaaatactgaaaaatagaaaattttttgctctttaatgctttttatggtaatttaatattttatttttctttgtggtaattatgattttcatcaattccagataatggcagttaaacaatatg

SEQ ID NO: 104669 - DNA, 1003 bp, Heterodera glycines
  Promoter: Source sequence=SeqID_11896; Location=193..1195; Strand=-; Gene=SeqID_75408
atttctgaaaaaaaattaatttaattaaaatgtgtttttcgtgcttatctctgcaataagtgcgcagaattttaagcatttgactaaaaatcgcatccctactaataaatcgaccatttatttagaaatattttatactttatatcacaaatctgatagtatattttaataaataaacgattttttttaaatcattttattttactttatataataattatgcataaattcttcctaaatatttttgtggtagcgatggttcaatgtgaaagtggataaaattgtccgttttgtccacataaaatgaaaaaaaggcatttgaatcgcttctctcccaaacactgcactgatttgtgaatatggaatggacaaaattccgatcagcagaaagataaagccaataaacgatgagtcaccgtttctattggcttttttggctttttaagcgtttgcaaagccagctaaacccactaatttaccaatcattttacccattttcagcaaatttattcctttcccaaaatcaaaatgaatttaatttgcttttcgctcttttttgttgttctggcgacaaatgccatcggtgaagggtaattaaatgaatgcaaatcaattttcaaatgctttctgtttctttagaattgccgaggacaaatggaaaaagtgcgaattgaacggaatgatcagaatgggaaaggacgttaaaaagtaatttgcaaataattttggtgataattaattaattttccctcattaattagtctgctgatctgctaccagagcaaattggccgataattttggatggaaagtgggaaaagtgttcaaaaggcgcaatttgaataagcaattggctgaaagatgtgttggcacagacggcacgaagggatggcacgcgctaatgatcgaacagaaggaaaacgggcaaaatggtctgatccttaagtcctcttttgggtgagtgatttaattttaaattaaaaacaaatttaattttagaaatg

SEQ ID NO: 104670 - DNA, 68 bp, Heterodera glycines
  Promoter: Source sequence=SeqID_12578; Location=1280..1347; Strand=+; Gene=SeqID_76241
atgatccagtgggaccacaggagtgggaagaaaatgaggaagaaacgacgaaaaagggcgaagaaatg

SEQ ID NO: 104671 - DNA, 110 bp, Heterodera glycines; identical to SEQ ID NO: 98226
  Promoter: Source sequence=SeqID_10216; Location=640..749; Strand=-; Gene=SeqID_73346

SEQ ID NO: 104672 - DNA, 187 bp, Heterodera glycines
  Promoter: Source sequence=SeqID_8081; Location=2432..2618; Strand=+; Gene=SeqID_66924
attggcaccaatttttgtggggtgtccgtggcattttcctcctcttttttgtcggctgtccccgcattcgcatggagaagcgtttggcaattcaaaatgtcaacagtgagcaaaacatattgtggcattttcatatttaaaatacaattttggcacgcttttttgcataggtgggactcaaatgatg

SEQ ID NO: 104673 - DNA, 776 bp, Heterodera glycines
  Promoter: Source sequence=SeqID_3039; Location=1078..1853; Strand=-; Gene=SeqID_82905
agtggtcatttttgttcaatgttacattataagcataagaaattacctgtaaacccaggttctttgttctacataagcaatattttttatttcttagtgagcatgtccgtgaacaattcgtcttttattcaaaccatcgctgccaatttgtgcttttcttcgcgcccgggaaggagtcagcccatcctggtgacgtgcaccatgtgttcaaactgcaggaagtcgaacatggcaagcacaactttttctccatttcatcccatttttctctctcaacgatcttttgaataataattggttgataaaggtgttctgactcaacatgtctcgcctaaaatcgtggacaaggccactgggcgccagggtgccatcatggtcttagacaacatcatgttgaagatgaacttgaaaatgggcggtgccaattacgaaatttatgccgcacaggcattcaaacaggccaacgggatccgccatgacattctgtaagtggtcggccggcgagaatcgcgagtattcaatcttttgacttatttgtaccaaccaaattgttaagcgccgaacaatggctgggcagcaaacggatgtttttcggcttagaaatgtcccacgcgccgccacagactttgttcgaacggcgtacgggaaaggcgccggccattccgacgattgttggcgtaagtgatgctcttctgcgaagggttccccatttgggcaaggggttgaccccaccttctccattatgcacctgatcatgggcctgccttccccagatg

SEQ ID NO: 104674 - DNA, 183 bp, Heterodera glycines
  Promoter: Source sequence=SeqID_2545; Location=2746..2928; Strand=-; Gene=SeqID_80311
ttatgccgtttagctcttgtcccaaaatataaactaaaaagacattttactcattatatatatatatatatatatatatatattaaaaagcaacttatccttccccctcccccctcccgcacatttcgcatattgacatatataaagtttttagcttccgaatttttgaataatcattcaatg

SEQ ID NO: 104675 - DNA, 956 bp, Heterodera glycines
  Promoter: Source sequence=SeqID_11374; Location=2774..3729; Strand=-; Gene=SeqID_74765
tactgtacccactgcaatttccgtgccatgtacgaatttcacctcatgggacaattgtgatggacattgaaaaattttccgaatttgcgggtgaagctgtggggagtcgccgattgagcaaaacagtgcaaataatgggatttggatggagaattatggcacaaaaaagaataaatataaaaaacagagaaaagtttttggcctttcacctttggtacatagcaacaaaagaaggtaaaaaaaattttcactttcctagtttttatcggacatatttcacataaacattttttaaatgccaataaatgtacaaatgttactagagaccgcaaaaaaggcatcacaaatcgcgaaaaaggcactaaaataggtaccaaaaaatttaaaaattaaaaggcacaaaaatcccgaaaaaggcatgaaaaaaggcctttaaaaaaaatttttaaggttttttagtgagcaaaacacgtaaaacttaaccaaaaacttaattttggtcattaaaatgattattaaatattttataatgtttttcgaataaggaaaatttttaaacctaaaattttttatcaagaaaaaaatgaaattttggcggtcaatttttgagaaaacttttcttaggggtgtattttcggaaaatttttcaagtcatttcttaggggtgtgttttcccgatttaattccatttttaactcgactcgagtaaattctcgagtttctttttttttggtctcggcctctagatattcggtctcgggaaattttaggaattcaataaacttcgatatatgccataaattaatctaatatttgtacatttattggaaatatacggtaaaaattaggaaaataccaaaaaatttaaattactaaaaagatcattttattgttttaagattcgaatttgtgctgcgtttgttcggcaacctttcgaattgttccgcaaaagaatg

SEQ ID NO: 104676 - DNA, 401 bp, Heterodera glycines
  misc_feature (23)..(23): n is a, c, g, or t
  Promoter: Source sequence=SeqID_12224; Location=1..401; Strand=+; Gene=SeqID_75798
gtttttgacacatcattcagcanaagctgtgcaaattaagtgaatgtgtttggcaggaggattaatgcgaaggaaattaaaattttcaactatcaagaacgtggcataatactcaaaagttggaaatccaatagcaccacggcagaataaacaaaaaaaattgcaatattgattttaaattaactattttcatgccaaaaaattttaaaaaatttaaacaaaaaaaggatttactaataatttcaaaataatgaacaaaattgatttaaataaatcaaatgccgtcaaattcaaacgcccattttttacttgtttggacttttggccatttgttaattaggctctttttttcatttgttgtagctaaagaattgtcctttatgctgtgacattagaaaatg

SEQ ID NO: 104677 - DNA, 102 bp, Heterodera glycines
  Promoter: Source sequence=SeqID_32015; Location=389..490; Strand=+; Gene=SeqID_62329
tttgttaagcacgcaaattgcacaaactaacccaataatcattctttttcatttaattattattcagaacaaatattgattagctaaaaattttaaaaaatg

SEQ ID NO: 104678 - DNA, 1003 bp, Heterodera glycines
  Promoter: Source sequence=SeqID_7259; Location=77..1079; Strand=+; Gene=SeqID_64281
aatatgtgttaaaaatgcaaaaatatgtgctaaaaattggaaaaaccaagtgtatttacgcaaaaaaatcatatttaatatcagtctttatcacttttcgcccgacctccaattaaaattttggcgatatcaatcaatttgtaaagtcccggattaatttttccatcagttgaataagttccttctgggaactttgaaatccagtgacgatttaacacagcgttcgatttggctgctttaggcgcatttaaatatataaagaaattttctaaatgcttaagaaacgtaaagtagtcaacttttagggtgcattttcagattttcttgtattttttttacgatttttctcaaaaatgccaaaatatgtgcaaaatatgtgccaaaaccccgaaatatgtgccatatgtttttatgtgccaaaacgccaaaatatgtgtttttatgtttttataagtcgctctaaatcaaaaattgtttgagaaaatgctatttttgggcttctctcgccataactaagccgcaaaaaaaatatgttaaaacataaaaatcccagctctaatttttaaatgccaattttcaaagattataaattttaaattatttgaccaaattattttttaatggaaaagcaatgaatgaatgctatgacaaaaaaacaaaggctaacgaagctaatggcattttgttgaatatttaatgaaatccaactttaaaatatttttcataagaacgtgtatgcgttttaaaattatttagccaaattattttagcggaaaagcaataaatgctatcaaaagtacaaggaaaccaacaaaaaaaaagctgcccgttgaggtagttaaaatcgataaaaaatatatttttattataaacaagcaaaataatttattccttcttaattatataaaaaaattccaagatgctggcttattagaaataattgatcacttatttttctaatcaaatttattttaattcgaatttgttttctgcgataaaaatg

SEQ ID NO: 104679 - DNA, 215 bp, Heterodera glycines
  Promoter: Source sequence=SeqID_34921; Location=109..323; Strand=+; Gene=SeqID_64602
gttaaaatttgcgttagagaccatctgaaatagaaactaggtaatcctatgttaatcaaaagtaatcttgtgttaattaaaaattgtttctaaaattaaaaaaaaaatttgaaataaaacagtaaattaaatgccaatggcataatttaaaattaaaaactaaaattttttttaataaaaatattttctcggaaattaaaatcccctcgattatg

SEQ ID NO: 104680 - DNA, 160 bp, Heterodera glycines
  Promoter: Source sequence=SeqID_7555; Location=5380..5539; Strand=-; Gene=SeqID_65198
aaaattgcggcgcagcgattgaaaggaatggggcgagacgaaaagaaatggcgcacaacaaagcccaaaacgaacaacagcagaagaagacgaaaatgtcatcggtgaaaattgtaccgaaaacggcggaggacaaaacgggcgaagtgaagcgaaaatg

SEQ ID NO: 104681 - DNA, 132 bp, Heterodera glycines
  Promoter: Source sequence=SeqID_4332; Location=2272..2403; Strand=+; Gene=SeqID_54086
attcagccaacaattaagattttggaataatttttcgattaatttggtgcttgtctcagtttcatcttcgtaaacccttaagccagcccatttagcaattttagcagaaaaatgaatgttttcagcataatg

SEQ ID NO: 104682 - DNA, 69 bp, Heterodera glycines
  Promoter: Source sequence=SeqID_18977; Location=806..874; Strand=+; Gene=SeqID_83715
aaacagcaacacaccagtacacgctttgacggaaaaaaacacatcgtctgataagcggtggcgaacatg

SEQ ID NO: 104683 - DNA, 153 bp, Heterodera glycines
  Promoter: Source sequence=SeqID_11226; Location=694..846; Strand=-; Gene=SeqID_74591
gttcgcttccctccattttcccttccctccctttttcgtcttccgtcttcttcccttccccttcactttctcctcggctaatcagagcgcgtcagctgagggtcgaagaagaagaggcgatgacgaatttaaggagacaaaacaccaaaaatg

SEQ ID NO: 104684 - DNA, 341 bp, Heterodera glycines
  Promoter: Source sequence=SeqID_27284; Location=523..863; Strand=+; Gene=SeqID_57967
ttgagtatcgaggcaattgtccccgtcccccctgtccatttcagtacattatggtcggaattcctctctttctgatcattttgacggaaattggtcgccttttgtcgcgcggacttcggaagctctacaaaaaattgcacgctgcgcggaaaaagctgccggaagcatcgcgaaaaatgagcgaaccgatgcgcgtaagttggaaattttagaaattaataatttgcccttgggtaatttaatggcttaacaatgggcatacattgtcgacaattattgcccattttccccaaatgcatcaaattgctccttaggccatttaccatctgacggccgcaatg

SEQ ID NO: 104685 - DNA, 677 bp, Heterodera glycines
  misc_feature (11)..(11): n is a, c, g, or t
  Promoter: Source sequence=SeqID_21032; Location=2086..2762; Strand=-; Gene=SeqID_51615
agcttataacnttggtgaatactagagcaaataaaaccattttatgctcattttgaagggaaaattctggagaatattgtaaattttatttggtttgaccttaaattgtggacttggctaaaaaagaattaaaattattgaaatttttacccttgtaaaaaattttttcctattgtttaattttcttaatattttgcataggccaatattttgacctcctctagcgattccaagtttattttatggaacttaagtttttaactcgagatcggctcttctaattttacaagggaaaatcccaaaaaaaattttaagttttgcaaagttttggcgttctgattactaaataaataataaacctatttgcactgagagcccaaaattgggccgctgtgtcaacccatagaaaaaattttcgaccataactatatcagttgcgccattttttctgggggtttgacgaatgttcagccaaatttttttggattttgttcgaatttgggcccgatgttcaaatagggtcgaaaaccgttgcttgccggatcttgataaatgatcccgaaagcttattaatttggcttttttattttgaaatgtgaaaaaaaattatgggacttaaactgtaaaagaagaaactaaattaatttattaattcatatttttaagaaaacaaaatg

SEQ ID NO: 104686 - DNA, 133 bp, Heterodera glycines
  misc_feature (54)..(54): n is a, c, g, or t
  Promoter: Source sequence=SeqID_35130; Location=820..952; Strand=-; Gene=SeqID_64761
aatcacatagagcgaattttctgttcaaatggctgcgtgatttttaaaaaattngaaaaagttccgtacagcgaagcaaaaattaatatttgaatcactacgaaatcggagagaacaattcgaaaaaaagatg

SEQ ID NO: 104687 - DNA, 470 bp, Heterodera glycines
  misc_feature (47)..(47): n is a, c, g, or t
  Promoter: Source sequence=SeqID_39098; Location=1..470; Strand=+; Gene=SeqID_67743
ccatattttttttcaaaatttcatgaaattctatgctatttttgatncatatttgggcgcaaatctgtgtacaattacgctcaaatttttaatgtttttccggcgccacttaacggcaccgacggcggatcaataaaaacaaatttcttaacaaatcgcacctaaattcctagcgtaaccatcataattttttggataggaaaataataattagagggtttattgaaaaaatttttttgaaaaccctcataggatccgggtcctaaaagttgaacaggacccggaatcctgttaaaacaggaagttttgtacggagtcttgttctggtccgattttcgagtttttcttcaaaactccgggatcgttggagttaccaaaaaaaatagttatacgtttaatgggtttttcatccttttttctttcataacatttttattgctaaattttaaagatttgtattgacattgatg

SEQ ID NO: 104688 - DNA, 1003 bp, Heterodera glycines
  Promoter: Source sequence=SeqID_488; Location=2095..3097; Strand=-; Gene=SeqID_54224
ctacctgcacggcacctacacactcctccaatttcgaacaaaatcggcaacccttttaggcggaggagtctcggagatcatgttcaccaggaccagcattgggcatgtgcaggatgagcaagagtggttgaaagtggcaggtgaaaaaattttaaattaaaattggtacggtgggaacaaaggagtttaacaaaatgaaaaagtgccaaaaccggttttgccgtaattatccaaatatgtaaatagacaagtggtggatcaaaataaaaaatttcctattttgaattacatatacattccaatttgagtccagggtcggatttttcgcttcttagcacacaaatttaaaaaaatggtagcgaatgatttgcgacgacgaatggcgaattggcgtcgtcaatttaacgaagagttgcgccaaacgattcgcgctccgcggcaacaccgtgtgcgcgtctcctgccacgaagtcgggcactgggcgatcaattggtggtcggctgacagcatagaccatctgcgatgggtaatttttttgaaaatctatttttttcaaaatacgatcatagttacagtatttatttggtaaaacaattaatttgttaaactgattacaaattatgttttcaattctccattttatattgtgctttgaccccctccccttttccctaaatttttttatgttttcaaaagtcatttaaacatttttacaaggattttggggtctctgatcacgaatccggcacccgaaaatagcatttctaacattaaaattttaaataaatatattgaccattttttgataactttttgttgagcatatttttttactttggcaaattgaaggttttgttcgcttcagacattcacctgaagcttcaaaaagcgtattcggcaatgggtttttgggtgcaccttttgtggacaaaaataatttattgggaaaaatgtttaaggtttcaagatgcagcgctaattttttttttttgaaaaacagatg

SEQ ID NO: 104689 - DNA, 55 bp, Heterodera glycines
  Promoter: Source sequence=SeqID_26456; Location=1150..1204; Strand=-; Gene=SeqID_57186
ttagaacatttaaaattacataaatactaataggttaaactgtagattaaaaatg

SEQ ID NO: 104690 - DNA, 121 bp, Heterodera glycines
  Promoter: Source sequence=SeqID_8002; Location=2405..2525; Strand=-; Gene=SeqID_66648
tttttcaagttcgttggcatccatcgatcatcttgttcccctttgtttccattttattggattttttattatttataccattttaattttttagggtcgaataaaaagtctgtacgcgatg

SEQ ID NO: 104691 - DNA, 1003 bp, Heterodera glycines
  Promoter: Source sequence=SeqID_12488; Location=202..1204; Strand=-; Gene=SeqID_76118
gtattgaacatcattttcttttattctgttcatttggtgatctaaagttcgcgtcacatcgcgtcaattggtgagaagttggaatctaaatttatataaatacatattttttctggcttctccatgctctaaatagtaggaaaaacactttcttattttggcttgtgaacaaaaaccgggacttttatatatttcgtgattttttgcatatttggtgtatattatggacttttttctgacatattttcatttttttgcacaaataatttttaaaatactaaaaaatgattgattataagcatattaacaaaagaaaataacaatttaaaaaatattttacttatttagtaaaaatattttggttttttgtacatatatgtatatattttgaacctttttgtacatatttttgacatccatagtgagaagattctttttttataagtaaaatagtgatggaagtaatttattttttaaaacagctggtgaggaggccgagataatgtttttcggtcaaggcactcctcctgaggaccttaaaaccgaccgagacgaaatgaacaacatggctcaagcatgggtagttcaataagaaaattttaaaatagtaagtaatataatttagtaacatcaattgatgttaattcccatgccttagcagcatttttgtcactgttctctacagaacaacacccaatgtacaattggtgatatcccaactaattgcaaaggcacgaaggacatttcgggagaattttgacacagaggaaatgcgtcagtgattaagaatggtaaaattgctaattaacattaattttatcttaactcattttggtgcagtattttgagagaattattgattggaaggggtacagtagttcatataaacacgataaaattttaaattatttaatttattttgattacgtttgcggaagaacttgaaagaagaagaactttatcttacaatgacattttccagtaagccctcgtgtaaacaatg

SEQ ID NO: 104692 - DNA, 1003 bp, Heterodera glycines
  Promoter: Source sequence=SeqID_1936; Location=1849..2851; Strand=+; Gene=SeqID_47103
gtagcgatgaaatggatgaaaacgggagggagagacgaccatttgacgaaatagtgcaacgtatgcacacgaatagaaagaaaccaccacaaaatgggaggagggaggggaatgaatgaaaattatgtgtatgtgtagagctgacgtgttggaagaataagcattaagtgaagggaagggagggaaaattggtggaaggaatgaaaacagtgggaaaagcaatcgcagaaactcacaatcaaatcatttatttgtcagcagccgaaggaggagggtaatccaacgctgacgtggcgctgattgtgcctctattagtatttctttgctggtgctgtgattgattatcccagggcaaattgatttcagataatattgtcgtcatgtcatgtcatgcacacaaaattgaaaatttgtaaccctaagctatgagtcatcgcaaaaaaatttttttgggctttttttgattttccgtgtaagtgtaacaaatgttaaataaacgacgactactaatttggaaatgattatgattacgttgcattaggcaattaaagagttttagcaattgaaaatgcaggattaactaattgtttgttggatgaatttttcattatgtaattaaattttggtgtcaaacattttttgagttttcggtttacaaatttcacaaaatctcatttgtttcagtgtttcaaagtggtgacagatttaaaaattctggatgaagatgcaaccgaactaagattaggatatatatacatacagaattaaatctatttgcttaaattttaatcaaaattctggatcagaaatcctagtaaatccgttccatcttttctctgtctgtgatatctttagtttcaactttcaacccaaataaaacatatttattcttttgatttcatatgcattttaatcaaaatcgcatttctattctattccattgcaggaattaaaacactacttcattttgttttaaaaatctgtcaattttctccaaaaaatg

SEQ ID NO: 104693 - DNA, 796 bp, Heterodera glycines
  Promoter: Source sequence=SeqID_5979; Location=1..796; Strand=+; Gene= SeqID_59894
gcattgacttgagcccctcactaaatttgtcgcttattccctccagcaaatcctcaaacattccgccggcatttgaacggtcgacagcgcaaaggaaaaaaaggcaaaacgccaaaatgacaaagggacgaaacatttagcgcaattgaaatgatttaaaatataaaagattcaaatataaactaaaatatacaaaaaattgccaaaaatggataaacccacaaaaaatgaaaaaacatatacgaaatacaaaaacaaaaccaacaaatggctaagtaattttcggaaatgtaaaattgtcggggagtaattctatttgaatttttttacgtgattttaaattgttaggacacttaacgcaattaaaataatttagggaaatgataattaatgctaattagagaattggacacttttgcattgtttcttttctttgtttgttgtgagttattattctccactgttgtgttctttgcttattcttttttttgctaatgagtgtttttgcattcttattttgctaatgacggagtgctcaaacaaaacaacacattactgcgccggaagggcacttaatgatcggctaattgcaacagaaaaacgggacagacatttttacaatgtccaacagaagagaagaaagaagaagggcaattagaatttgtaatgaaaggtcggcaatcacttatttgtataataaaagtgaaggactttgaactggcaaaagtgaagcattttggacccattagccggcgggaaatggccatcattagagggaaaaggccggcggattatg

SEQ ID NO: 104694 - DNA, 669 bp, Heterodera glycines
  Promoter: Source sequence=SeqID_31843; Location=1..669; Strand=+; Gene=SeqID_62154
tctgacgaaatcacatgttaccctccttaatgttgatctacactagagatcaacattttgaaaaaaccgtagttgtacctgtttcaaaaaatggcctgtacctattttttctgtacataagtacaggaaaataaatgtacaggaaaaatccaggttgccgaaaaatggcctgtacctggatccaggaaaaatacagggctggatccaggtacatgttgatctctaatctacacccataaaacacagtcaaaatcgggaagtttgaaaaaaaattctagggggttgtgaattttttgaaaatttgaaaaacccattggaaggtaaaagtttttcacttttttttataaaatttttgatcaaatttttaccttttttaatttttggcttcgcgccaaaacgtgtgcgccaaaacgaccctggcgccaaaacgtgggcgccaaatcgtcggcgccaaaacgtgggcgccaaaacgacccagtcccttcgggggggggggggggggggaagaaatgctgatgtcgacattgtgttactgatttgggccatttgatgaaatgatcctaatgcaatctcacgcatttcttgcgcagtaaaggcctccgtaacattgtcacgattgaatacgtcaagaaagagtgtgcctgttgcaaaagcctaaaataacgcatg

SEQ ID NO: 104695 - DNA, 511 bp, Heterodera glycines
  Promoter: Source sequence=SeqID_9683; Location=665..1175; Strand=+; Gene=SeqID_46795
gaagctaatgatcttatcttagagaatgactaaagaaagggagaaggaaacgaaatgttcgatcgacgacaaagctcctataatttgatattcccaaaggaaaggggcaaaagcgcattgaacggaaggctaacggacggagaattttagtgaatggagggagagagagagagaagcacttcctgcagctgctgccgttgatcattctctgtgagggcgacaggcgcacgctaaataggagggaaaagggaggggacaagcgaaggaggagggagaaaacaacggggagacagacaaagaaagcgaagcaaaacgcatttctcaaggatcgctgagagtggcgggtggacaaacgctttgtgggattccctttccctctgtcccttcatttattcatcatcgacttcttccactcaaagaaacggatggatcgactggggtggggtggaccgataagttgagatttcaaaccgccgaagggacaaacagaaggaggaggcgatgacaaatg

SEQ ID NO: 104696 - DNA, 74 bp, Heterodera glycines
  Promoter: Source sequence=SeqID_6438; Location=884..957; Strand=-; Gene=SeqID_61572
gctgggacgaaattaaaatgtggccaattttcaaaagtgccaagaaaattcttagaccggtttgagtcaaaatg

SEQ ID NO: 104697 - DNA, 225 bp, Heterodera glycines
  Promoter: Source sequence=SeqID_11502; Location=1..225; Strand=+; Gene=SeqID_74928
agggcaaaacggacagggagcaccagcaaaggacgggcacataaatggccacgaaaaagtgggcaattaaaaaagcaaaaaattaattttgtacgatggacaacatacatatgtcgcataaaatttatttaattttggttaatattaatctgggtcaccaaactcaattttgctcaaaaacgatcggaatcgatttagaagtgcagaaaacgatgagaaaaaatg

SEQ ID NO: 104698 - DNA, 209 bp, Heterodera glycines
  Promoter: Source sequence=SeqID_18010; Location=1096..1304; Strand=-; Gene=SeqID_82584
gctaaaaataaaattatataaaacataatcataaaacgtaaaatgtaaacggagaattatctccgcaatttattgaagttgtaaaggaatttgcggatcgatttgtgcgcaattggattggtaggagtacgaccaagggggacaagaagagcgaagcgggcgaacgaagggagatggtgagggagggctgtcaattactgcgcggaatg

SEQ ID NO: 104699 - DNA, 256 bp, Heterodera glycines
  Promoter: Source sequence=SeqID_23046; Location=869..1124; Strand=-; Gene=SeqID_45754
tttcaaaattccgggctctaatgaaatccttaggccatattcagcttttcgaaaaaagttatggccaaagaaactgaggatgatcatttatgggacgcattacataaatgtcatgggaaaaaatagtcattcaatgcaggttcgagcttaaaaatattttgaaaaatttgtttcggacgtgttgattcgggcccccaaagagaatgccataatctgcaatgttactttattttctaacaaaacacttaagcaaatg

SEQ ID NO: 104700 - DNA, 175 bp, Heterodera glycines
  Promoter: Source sequence=SeqID_19438; Location=1629..1803; Strand=+; Gene=SeqID_84161
tgtgaattatgaaatgccaaatttaattcaccgtcttttgcagtattgccaaattgccccccccccctctaaattaattaattaattatatttaagcaaattgtaaattcacttttggccataattgagacagtttactttataataacataaagcagaagcttgaaaaatcatg

SEQ ID NO: 104701 - DNA, 474 bp, Heterodera glycines
  Promoter: Source sequence=SeqID_37093; Location=1..474; Strand=+; Gene=SeqID_66256
caaattggacgaagggctcacaaaaaagctaatcgaatctttcagagaaaacaatctaacagaagtgggtgattaattaaataattaatagggactccatttttaggcataaaggcacctataagtctgaaaaaaattgcaagatatgcattaaataagcacaaaaataggcaaaaaaattctttataacttttttgggcagcaaaacacataaaaacttaatcaaaatatttaaatttggttatatttcattgtaaataaaataatttaaatatttcaaattttcgaataaggccaaattttaaagacaaatttttatagagaaaaaaaatatattaaattttaaaggatcaatttttgggaaatttttttcaattcttgtgggtgtattttctgaattttttggtcgcttcatatggggtaattttttgtaagcataaaaaccccgaaatagacaaaacttgcctaaaaatg

SEQ ID NO: 104702 - DNA, 85 bp, Heterodera glycines
  Promoter: Source sequence=SeqID_30571; Location=886..970; Strand=-; Gene=SeqID_60983
aaatttgattttctcaattaatacagttaaaaaagcatacatatcttttacctgtcaagatcaatattttcaataatttacaatg

SEQ ID NO: 104703 - DNA, 75 bp, Heterodera glycines
  Promoter: Source sequence=SeqID_22756; Location=1103..1177; Strand=-; Gene=SeqID_53448
tgcgttgcgtcccctcccttccccgtgtccccgtccccccgctttccccccgttaattgtccccccaatgcaatg

SEQ ID NO: 104704 - DNA, 210 bp, Heterodera glycines
  Promoter: Source sequence=SeqID_9782; Location=952..1161; Strand=-; Gene=SeqID_46813
ttctgtaaattttttttttctaaatgctaaaataatgatgaaaacaagacgaaaacactaaataaaacaatatattacatttgatgaattattcatttcattcttgtttccttatttgctcgaatcaatgaagcacaatttgattttcaatcacatcagagaattcagaaaataatttatttcttttaagtgaatacgtaactgaagatg

SEQ ID NO: 104705 - DNA, 154 bp, Heterodera glycines
  Promoter: Source sequence=SeqID_21120; Location=2459..2612; Strand=-; Gene=SeqID_51712
gccatcacaaagcagaaaaccgaccaaaggcccgatagttaaggtcacgctttttaaaggcctcccgagaacgggctttggaaattttcctagacctggattatctgattttttttacaagaaatccagcccagtcccatggttttttcaaatg

SEQ ID NO: 104706 - DNA, 534 bp, Heterodera glycines
  Promoter: Source sequence=SeqID_27599; Location=272..805; Strand=-; Gene=SeqID_58281
atcaagatcagagcagattttggcacgaagatcagagcagattttggcacgggaaaattttccttcgcgaaaaacttgcaattttcctcggaaaattctcgcttaatgaataaacagtgaacctgttcccagtcaacttataattagagaaataatttctgtgttttcccatttccggagaaaatttatgaaaaatattctcatgagatttttaatatattttatgaaatatatgtttttttgaaatttttataaaatcctctggagattattaattatttttttattaattattttataatttttaattatttgactgacggggagagaaaaacagtttaacacactctctctcattgattgagtgaggcgattgtttgatgattaaattttgttgtaaaagccaaaattggccgcaatcttcagtcttttcttaatcatttctttacttactttactgataaataattaaataatatttatgattttaaatttaaataatttttttcaaaatttatttaaaaggaaaaaatg

SEQ ID NO: 104707 - DNA, 115 bp, Heterodera glycines
  misc_feature (29)..(29): n is a, c, g, or t
  Promoter: Source sequence=SeqID_336; Location=6892..7006; Strand=-; Gene=SeqID_83073
tgacacttctacaacaagtccacagcaancaaagtgacttttcactctcaaacagcggcaaattgcggacgaagcggttcaagaccatgagcgtcggcgaagcgttgtcgtaatg

SEQ ID NO: 104708 - DNA, 73 bp, Heterodera glycines
  Promoter: Source sequence=SeqID_9596; Location=638..710; Strand=+; Gene=SeqID_72015
acagacaagcacagctacgaattgttttgtgcaaccagcaaccatattcatcaaacggcagactctacaaatg

SEQ ID NO: 104709 - DNA, 140 bp, Heterodera glycines
  misc_feature (23)..(23): n is a, c, g, or t
  Promoter: Source sequence=SeqID_14492; Location=1..140; Strand=+; Gene=SeqID_78534
tgagactgaattggttttttatnagggaagaaaatttagaaaatttgtcggacgaaaatccgacgacggaaagagcgcggaaaagggcacgaattaatggagatgatggcacagcaagagcagaatttgaggaaaaaatg

SEQ ID NO: 104710 - DNA, 374 bp, Heterodera glycines
  Promoter: Source sequence=SeqID_5079; Location=3671..4044; Strand=+; Gene=SeqID_56816
tgcctgcaattagcgctacctagaagatgtatattaatgtctaattgaaaaaaataaatgataaagtgcgggagaggaatgtaaaacgttatgaatttatacgaagtcaagttgtccatccagttgtaagtgtattaggctgcgagatcgcgaaaatgttaatgagcaacaaataaatgagcggatttgaagacggaatgaaaaaatttctatgtgacttcatttctctctaccccttcgttaattttactacactctactcgattggtaaaccaatgtacatgtgctgaatgataagtcgagttaaatacccggaagataaacactaccccttgacaatactcaaagttttggatgattcctccacgaaaatg

SEQ ID NO: 104711 - DNA, 81 bp, Heterodera glycines
  Promoter: Source sequence=SeqID_16601; Location=2637..2717; Strand=-; Gene=SeqID_81017
ggtcagaaaatattaaatgcgacgactcgctatcatttatcaatccttttgcaagttttcagtcttattcaattggacatg

SEQ ID NO: 104712 - DNA, 341 bp, Heterodera glycines
  Promoter: Source sequence=SeqID_6070; Location=1787..2127; Strand=+; Gene=SeqID_60209
ttatattgctaaaaatatttggataaattttgtttccctaaaaattgcgaatatggaacaaatatggacgaaaaagtgaaatatggaaaaatatggattatatggaaaatatggacaaaaaaaagttgtcctagaagtttcaaacatggcgaaatatggaaatatggattatatggaaaatatggacaaaaaaaagttgtcctagaagtttcaaacatagcgaaatatgggaaaaatataaataaaaagtgaaatatggaaaaatatggattatatggaaaatatggacaaaaaaaagttgtcctataagtttcaaacatggcgaaatatggaaaaatatg

SEQ ID NO: 104713 - DNA, 793 bp, Heterodera glycines
  Promoter: Source sequence=SeqID_13572; Location=697..1489; Strand=-; Gene=SeqID_77473
ggtgggtgcatagagcacccatgggttcttaagaaaagtgattttattttctgcgaaatgaatactagtgccgagatatgacgtgtcaattatttaattgtgaaaatattattttattacggtgcgcctattgtgaaatgtatctctgtttccatcatttttataatgactaccatatgtgcgaaaacgaataaaaaattgtggaacgaaaaataaatttttgggtgtgagtgggattgattttttggccattcaattgcataaaagcaaaaataagatgggggaaattaatttgcataagagggattcgaacctgtgggggcaaaaacaaacgccaaacgcacaacctccgcaccaccgaacaacacaaaacgatgcaaatgtttattcgatttattgggatagaaaaaagtttggcacgtcatatctcggcactcgtactcatttcgcagaaaataaaaccacttttcttaagaacccatgggtgctctatgcacccaccaaatttcattccgaaactccacggacacctccagaccttcctttgttagctaaactgctgttttctgattacgttaataatatatctatatcacctcggcagagttttatgaccggtcccgacattgatatgttgattaaagattataaaaccgtgatccttttttacagttcatgaaaaatgcacatggcacttttcggcaagatgaagctgaatttttttcgaaatcagtaaaaatgtgcctcaagcaatcacaatcaaataataatttaggcaattaaagagtgtatg

SEQ ID NO: 104714 - DNA, 136 bp, Heterodera glycines
  Promoter: Source sequence=SeqID_27224; Location=2040..2175; Strand=-; Gene=SeqID_57919
tccttttaaaaattccgtttgcgcaatttgaaacttaaaatggacggggtttcacagacggctggctgtatataagcagatggtcaatctgccgtcctccatttcattctcaaaaattttctccaaaataaaaatg

SEQ ID NO: 104715 - DNA, 92 bp, Heterodera glycines
  Promoter: Source sequence=SeqID_16030; Location=775..866; Strand=-; Gene=SeqID_80389
actaaaaaataatattttttgagcttttggtccaaaatatattatttattactacaatttttcatctttttcagacaacggaagtaaaaatg

SEQ ID NO: 104716 - DNA, 929 bp, Heterodera glycines
  Promoter: Source sequence=SeqID_6606; Location=1..929; Strand=+; Gene= SeqID_62173
gagtcaaaatggtcaccatggacggtaaaaaagaaaaaaaagcgacaataaatctttttatggataattatgggaaaaaattggcgttctgtcacatttactttttatctttatttctctcacttttacgtactatctcttcattttaattatgtaaaaaacaacatttacttctctccatataacttttttcctatgcatacaatttgcaccaaattttgcaaacctatagagaaaagaattctgcatctttctatagtgaatttaattttgtctatggtcaaactcaaaagttaagaagttcctaataaaatgtatttcttttcctctccttttggcgtactattttcatgtctctaacacattaaaaatcatgaaattcgcaaattctaataattttggttataagggtacaaaatcactttgaacatttagaatcaatagaaaaaagaataaatttagcattttggttagaaagagctggctaggacttgagttataacatgataaaagtttgaaattccgacaacttttttctgagatgtcaaattgcttagcattcacttagaaaaagattctccttttcaaaatctttttttagataccaaatttgttcatttttgttgggaatgaagcgtattatggctgatcaaaataaaaaatacaaaaaaggcatttaccagtgtaagtgcatatactttgtttttgcgtgtgttggcgttttgttttacgccaattattttttggcaatttttttcgttttttaccgtccatggaataaaccggtcgataattccaatataaatttttggaaatttgtaaacattttcacttccgacatccaacattttcgggctcggaaatagtgttcataactaaactaatttaataatctgcatatttaagaagcaattataattttaaaaatg

SEQ ID NO: 104717 - DNA, 729 bp, Heterodera glycines
  misc_feature (41)..(41): n is a, c, g, or t
  Promoter: Source sequence=SeqID_18452; Location=788..1516; Strand=-; Gene=SeqID_83050
tttttaaaataattaaattttttttttgcgattttcaaatntctccaaataatcatttggatccttcaccgttcgctcattcgtgtttattggcctggatatgtatgatgattaacctgctgctggattagtctagtaaaccaaagtaagaaattaattcatttaattagtcgtcattaaattttaattggttttcggcactcggttgggccgattcgaagtgccgtgaaaatggcattgaatgcacggcagagaattgtcgttctatgcttggtccggcacttttcaacatacgttttccgcttttgtcaaacgtggaatttgcgaaggatattgataaaaaaaagagattaaaaccaagtttaaactcattcaacaacgagtgtcaactttttaaaataattaatttaaataaataaaataaaaatttaatatgcttttcttatattttcagtgcattcaaaatgaaatataattttttaaaaattgtattccattttttatccatggagaatattggcacaaattaaaaggaaatggggaagcactgatcagaattgtttgggctttaacctttttcgatgctccaaaagaaggtgcgaattaactgttaattaatgctaattacaacgatgattaatttccatttagacgaaaattggagttgcaaatgtcctgcaacttttcgaattgtctctcaaaagaacgatgggtcggatttgaagaatg

SEQ ID NO: 104718 - DNA, 929 bp, Heterodera glycines
  Promoter: Source sequence=SeqID_9912; Location=1104..2032; Strand=+; Gene=SeqID_72940
aagtcacgataatttttcaaaaaatctccattttttaaattaagatcttgaattttaaattaaaaaatattgtcatttgctaatttttcttaaaaaatcccttaaaaatcccaaaaaattttacaggtctccaaaattccactaaaattttcaaaatttgacgcaaaagttggccattttgtgacttttatttcttcataaaaagaattattttttttaatttctaaaacattagtctaaatcttattaggtagttttatggcacaacgatttctaagaattttgtccaataatcagaataaaaattgttgtctacgcatttttccttcggtgccaatcggacatcaccagacccaagaacccattattttcttataaattagttcaaaatcacaaaatatggacagtttttgtataaattctgttaacaaattacatttcaaattttcaaaattttcccggcggcgcctatcggcaccgccgacctcccccccggttcccctaaagtttttgaaaaaatttgcagcaaaaaaaaatcttaaaaatctgattttttgattccgtttctcaaaattattaaaaatgatcatttgaggcgaaaatacaaaaattgatattaatttattaaaggctatgttgttaaatgttctcatttttgaaaatctgattttttaggcatgatattccaattttgaaaaacttctataaaaatctgatataattcacatcccttttttttcttcaatcgaattgatcaattataaatattagataaacatttgaacaaaacttggcacaaaatgtaaaaaaaaattgcgttagagcaaatcccgataagcccgcgggatcccgaaaaaaaatcttcggggttgatcgggattcggtcgggatcccgacccgggatccgtcccgatcgtttttccaaaatg

SEQ ID NO: 104719 - DNA, 1003 bp, Heterodera glycines
  Promoter: Source sequence=SeqID_13454; Location=1048..2050; Strand=+; Gene=SeqID_77343
gctttaaggttttgtctttgactttgcttttttttccatttatttcaatcggctagtgctttaaggttttgtctttgactttgcttttttttccatttatttcaatcggctagtgctttaaggttttgtgttttgactttgcttttttttccatttattccaatcgaccacgttaattcattctctatacatttagtgtcttatttcatgaaattatattaatttaattttaaataaagaggcaaatttttacagaaaataaatagacgctgactaattagctaacatttataaagaaagtagaaatttgattaaatgcatatacaatatacaaaatattacttttttaaatttgtataaagttcctattttgtctttgactttgcttttttttccatttatttcaatcggctagtgctttaaggttttgtctttgactttgcttttttttccatttatttcaatcggctagtgctttaaggttttgtctttgactttgcttttttttccatttatttcaatcggctagtgctttaaggttttgtctttgactttgcttttttttccatttatttcaatcggctagtgctttaaggttttgtgttttgactttgcttttttttccatttattccaatcgaccacgttaattcattctctatacatttagtgtcttatttcatgaaattatattaatttaattttaaataaagaggcaaatttttacagaaaataaatagacgctgactaattagctaacatttataaagaaagtagaaatttgattaaatgcatatacaatatacaaaatattacttttttaaatttgtataaagttcctagtcgtatgtgctttgcgttggttaattggcgtgggtgagtgtggtggttgggccgtttttgcgatattgtggctggaaaaaagaagcgatttcgctgtggggagcgcggccgtctgggtttaagtgcttgcttgcgcttgtgctcggcattgaacggtgatg

SEQ ID NO: 104720 - DNA, 129 bp, Heterodera glycines
  misc_feature (16)..(16): n is a, c, g, or t
  misc_feature (24)..(24): n is a, c, g, or t
  misc_feature (34)..(34): n is a, c, g, or t
  Promoter: Source sequence=SeqID_37408; Location=1292..1420; Strand=-; Gene=SeqID_66488
atacgtgttaaacccntgaaatantgtgcgatantttttcttttgccaaaacgccaaaatatattttttttttttttgtttttataagtcgctctaaatcgataaatcgaaaattgttaggagaaaatg

SEQ ID NO: 104721 - DNA, 1003 bp, Heterodera glycines
  Promoter: Source sequence=SeqID_15530; Location=1796..2798; Strand=-; Gene=SeqID_79811
aaatggaggtggaggggagcaattagtactaatgaatagcaaattaatgagcggaaatacaattaaacaatcgcatgcgttaactcattaagagaagggaccaacaaaaaatgttgacaatcacttagaaaatggaaaaagcgaaaacgcccagcgaacggacggaacgaacgacgtggaagaaagcaatagaaagcgatcagagaagacagaacaacgacgagggcttagtgatcagacgaatacattggcatcaatcactgagaaaaaggcgaatttggcacaaaaaagaaaaactgtaagtaaaagcagagagatggaaaacggggaagggacaacgccggtgaggtgatgcggcattctgacactttcggcacagacattgggagagaatgaggaaatgagaaatggctgagaaaaggggggagagagagagaaatagagggggatgagagttggagtaaagggagaaagtgggaagatagagagggaattaccattaattgatgcgaaattcggttaacaatgtggattaatctttgctgttgtgtgccggacaaaagtcgctgcccaactttgtcatctgtgtccccctgttgaaggccgacaaacttttgcggcattgtttgtgccgatttaggcacggagggctgaccagaacaagcagacagaaggaggagatggaagcgaaaacagacgaggcaaggggataaaaagcgatgaaacggaagcggaaaatggtagaattgagaaggacgcggaagcggacgaaggcattacggaaggggacgcggaagacgggacaacgaagagggaaggggaaactatgaaggagtcacgacaactaatggcgcaggaggagggcgaggtgggcaaattaaacggctaataatgtttttcggcactcgttgggacacaaagaacgcttgccatggctaaatccgagaatggctttgaacgttctactagtccaaataatctccccatttttgagtcttagatg

SEQ ID NO: 104722 - DNA, 361 bp, Heterodera glycines
  Promoter: Source sequence=SeqID_43106; Location=1..361; Strand=+; Gene=SeqID_70865
cgaaacaacaaagatgctgttttgaacgaataaagggcataggttattttgaagaagtgtcaaagaacatgcagcaataagcctgcaaaatctaataagtggaaaatacctgagtatagaatttattttcagaaagtgtcaacagacttttggaaaaatatatttgcaatttatcaacaattttgagaagtgagttagaaatgataaacttcacgattcaaaccagttttcggtgctctaattaaccgcgataaaaacatccgaatcaattaaatagcttctgagataataaggtttatcataaaatttcatttaaaaataaaccctcaattattggtatgaacgatactttccaaacatg

SEQ ID NO: 104723 - DNA, 131 bp, Heterodera glycines
  Promoter: Source sequence=SeqID_6438; Location=886..1016; Strand=+; Gene=SeqID_61573
ttttgactcaaaccggtctaagaattttcttggcacttttgaaaattggccacattttaatttcgtcccagcaaaccgttccctttggcacttccgtgctcgagtcggcggacggcgttcggttgggcatg

SEQ ID NO: 104724 - DNA, 425 bp, Heterodera glycines
  Promoter: Source sequence=SeqID_29533; Location=1..425; Strand=+; Gene=SeqID_60025
gcttttggaattttaatgagtaaatcagtaaccgtaaatgacattctatgcttctcttgttggatacaccgggaagaaataatagttagtccttttgttgaatttttagaaattctatccgtccaatcggcttttggaattttaatgagtaaatcaggaaccgtaaatgaaattctctgcttctcttgttggatacacgggaagaaataattgttagtccttttgttgaatttttagaaattctatccgtcatatcggcttttggaattttaatgagtaaatcaggaaccgtaaatgaaattctctgcttctcttgttggatacacgggaagaaataattgttagtccttttgttgaatttttagaaattctatccgtcatatcggcttttggaattttaatgagtaaatcagtaaccgtaaatg

SEQ ID NO: 104725 - DNA, 547 bp, Heterodera glycines
  misc_feature (34)..(34): n is a, c, g, or t
  misc_feature (87)..(87): n is a, c, g, or t
  misc_feature (90)..(91): n is a, c, g, or t
  misc_feature (93)..(93): n is a, c, g, or t
  Promoter: Source sequence=SeqID_15587; Location=1809..2355; Strand=-; Gene=SeqID_79877
ttcccgatatttccaaaaatcgtatttctgaccncagtattaatccccaaaagctgcattaggtcggaattcccccatgttggaccncanncnaatattcttctttctttacctttacgctatttatttttaaacatttttgaaaataataaaagaaaaatatgagtttctcacgattaaaactgctttacttttgtatattttttttcgtgttgttactgatacttatgtttttgtatggttttggcggaatggattctattttatattttattattgttattgttttccaagcctttaaaatataaattttatttttattaataaaaatcatttcatttttcgagtataatgaagaataatttataaaattattgttttaatatttagcattcatcagttttggctagagttgagcgggaccgggccggggcgggaaaacccggtttttttcaggtcccggtcccggtttttggaaaaagataaatccggtcccggttttgccagtcccggtcccggcgggactaaataaggactggtaagaatg

SEQ ID NO: 104726 - DNA, 77 bp, Heterodera glycines
  Promoter: Source sequence=SeqID_6878; Location=3799..3875; Strand=+; Gene=SeqID_63188
ggttagtcaactccactttttcctccagtttaagtttaatttagcaacatcttctctaaactctctgaacaacaatg

SEQ ID NO: 104727 - DNA, 163 bp, Heterodera glycines
  Promoter: Source sequence=SeqID_12672; Location=191..353; Strand=+; Gene=SeqID_76351
ttgtcccctctgttaagtccactgggaattggtgcttctccacggctcttctttctgttgttctgtccaaccgcaccttcccaccccaaaaagtcctttcattcacaaaaattcactcatccaaatgacaaaaacgcatttttgttcaaaagttgccaaaatg

SEQ ID NO: 104728 - DNA, 500 bp, Heterodera glycines
  Promoter: Source sequence=SeqID_38375; Location=1..500; Strand=+; Gene=SeqID_67206
aaaaaagtaattttaaacacgaaaaaataatagaattcattttataaataattaattacacaagaaaattaaaaacaaaacgaaaaataaagcataaaaagaatagttctaatgaattttttagaaatgtataattaaaaaaagaaggatttgataatgaaaaaattaaaataatatttctacaaagctcaattcatatgtcggataacatttgaaaatgataaataatttaagaagccgcgaaccaaacttacagaattcagacaccatgataatttgattaatataatttaaactgaattattatttttaaatactaataatgcaattatccacaaattaaataaattcatttcaaagtttcatgtctaaggcatataaaagcaaaaaaagttaatacatacctagataaataacaattaatcttattacttaaaaaaactttgttaaaggaatgaaggaatgataattagatatttcgctatttcgcatcaaacatg

SEQ ID NO: 104729 - DNA, 1003 bp, Heterodera glycines
  Promoter: Source sequence=SeqID_7847; Location=1276..2278; Strand=-; Gene=SeqID_66144
aattttttttaatttaaagcaaattttttaaaaatgacttttggcggaaaataaaatggggagaaagataacgcaaaaatgagagggtataaaaatcagccccagtcatacaaaagcatttttggtgaagaagaataaagaaaaattaattaaaaagagagtgttatgggaagagatttaagaccgagagagaacagagaatatagtgaggaatctgcgtctattaccaaaagaatcagcgaagaagagaagtgaattatcttcccattgcactctctattggaaatattttctctaccctccttcatcaaaaatgtcttgtatgactgggactgagatccagcactccctcatttttgcgttatctctcgcactaaaattattacccgttgaaacaaattttaaaaaattatcgtaatttttaaaaaatacgttgatatttgcgttgatggcataatgttagttgatttaaataaatatcaacatttaaattgatactccgcaaaaagcaataaaaaggttgatttgtcattctctaggcctgagccaaacttccagcttcatgcatcgaaaacattttttcaatcaattaaattttctaatttcaataaaatatatttggtggaattatcaattatttttaaattgcgtttaataatttgtaatgcagtgtttgagctttttctaatctccattatttttttatctatttaaaattttcttattttccggcggtaacacaaaaattataaccaaattgtcacttccgattgtcgtggccacgtaatttagggatgtgttttttcaataactgttcaataaaatataaacaacaagaagtctttcttcaaaataatatattttttaatcatttcatagaaatgcatttatttgttttattattgctgagtttgttaagcatttgccaagcacaaagcggtagcttttaatttagagttccgtctccgattgtttaattttagatgcaaaatctgtggaaatg

SEQ ID NO: 104730 - DNA, 95 bp, Heterodera glycines
  Promoter: Source sequence=SeqID_15465; Location=1315..1409; Strand=-; Gene=SeqID_79736
tcttcaataatgtaccatccataaacaaagtagaatatgatattctattattttaagtttttagtcaaattttccgattgaaattctgcaaaatg

SEQ ID NO: 104731 - DNA, 91 bp, Heterodera glycines; identical to SEQ ID NO: 100405
  Promoter: Source sequence=SeqID_32193; Location=1493..1583; Strand=+; Gene=SeqID_62520

SEQ ID NO: 104732 - DNA, 233 bp, Heterodera glycines
  Promoter: Source sequence=SeqID_14120; Location=1..233; Strand=+; Gene=SeqID_78109
aatttaaatcttcaaacaagcaaattacatttcttctgctttgtaagatgcacactttaattttgtttatgagaaaaaccgaatattattagttgttcttaaaaccaaattgctatcaaaaagaataataaactgaaaatataagcaataaaacaattttcttttgacttgtccatttcaggtgccggcagcaacatcagcaactctgtaagaccttttttctgttgaaaatg

SEQ ID NO: 104733 - DNA, 112 bp, Heterodera glycines
  Promoter: Source sequence=SeqID_42145; Location=831..942; Strand=-; Gene=SeqID_70110
tttaaaattaatccaataatttatagttgatgctctctcaccaattaatgatgaattgttatccgagcctgaggattatgaccctactgaaaagagtgcatttgatgaaatg

SEQ ID NO: 104734 - DNA, 581 bp, Heterodera glycines
  Promoter: Source sequence=SeqID_23986; Location=156..736; Strand=-; Gene=SeqID_54689
ttttgcacttttttatttatttatttaagtaaaaaccatttttgttattcgttaatttttaattaaaatttttgactggaaaatgcaaatgcctatagaaattttcgtttccttcattgttcaatttaaattaaaaataaaattgcttattcatcatttttcaattaaaaatatgaaaattcgtcttgtatttaagcggagaaaaagaaataaataaataattattatttttaatttcttttattaaaaaacctaggcctttctaactattggggaattgaatgaaattttaaatacggagccttaaatcctatattttgggagggagcatttcatccgaaatcctaaaaaagcaaaactttatttcttttaattttccaaaccaaatttggcatttttccgatcaaaactttgagaaaattttttaattttttcaggtataacaaagtccgaaataacaaaattaaatttttaaattttcatttttttccaaaaatttttaattttccatcaaacacttttccattccatttaattccaatcgctgttggtcgatcaaaaaaaatattttactaaaaatg

SEQ ID NO: 104735 - DNA, 349 bp, Heterodera glycines
  Promoter: Source sequence=SeqID_7386; Location=1665..2013; Strand=-; Gene=SeqID_64675
gttattaattgttctgaattctgtgaataagcctttgtgtcaaagctaattttatgggaaattcgttcaaagcccaaaaaaaaaactaaaattacaaaaacacaatcagatgacatgcttttaatcattctttagttatttttttatatttaagttttataattcgtataaagttatgctctaagttagggcgcaaaaacaaattaatgaatttaaaagggatttataattcattattttagaaggaatttttataaattttaaaatgacctaaaaaatactttagaaggaatttttaaacctttttatatggctttgaggctttttgggcaaaatttttttatccatg

SEQ ID NO: 104736 - DNA, 323 bp, Heterodera glycines
  Promoter: Source sequence=SeqID_8242; Location=1788..2110; Strand=-; Gene=SeqID_67411
ggtaattgaaacattgtgaaaacctgttaaaaagttctcatgtaattgtcacggactaaaattaaaaaataactcattggatctaaatgtgggggaattaattaacactcctctcctgctgtgtaccgtacttactgaattagtacctccggtggttttatttcgaaaatagtggttttaatccagagggggtactaattcagtaagttcggtatttgtattagtgcataatagctttgttttcctttttgtcatctccttgcaaatgtcccctgcattctctgctccaatttttctgctcattggcgtgctcttcgccaatg

SEQ ID NO: 104737 - DNA, 356 bp, Heterodera glycines
  misc_feature (57)..(57): n is a, c, g, or t
  Promoter: Source sequence=SeqID_8870; Location=1704..2059; Strand=-; Gene=SeqID_69469
agaaaaataaaaatattttttttatgtggcgtaaagtgacaaaagtccgcgaaaatntttggttttgtgattctgttagctgtgattggttgatgaagcacaaaaagattaattacctattttggcaacaactgatggaacactgtgggattggctgatgaaaatgcatccttatatactgtataaattaaagaattggtggtcattacaatacctcaaaactcaatttgcctttgtctttggtaacttttcctgagtatataaactccgctttcctacatttctcatctcattcgtttggcgctttctctttcctttgtatattcgacctccttaattgccttgttcgtcaaatg

SEQ ID NO: 104738 - DNA, 145 bp, Heterodera glycines
  Promoter: Source sequence=SeqID_7509; Location=1349..1493; Strand=-; Gene=SeqID_65068
aatggatgtttggcacgagctaaagattcaaccaattgaacaattgccaagcggcttcacaatttgtcaatcaaaaattggcaatattatcagcggaaagggtcgaatcgaactcagccaaccatccaacgtctctttcgtgatg

SEQ ID NO: 104739 - DNA, 192 bp, Heterodera glycines
  Promoter: Source sequence=SeqID_43421; Location=1062..1253; Strand=-; Gene=SeqID_71088
tgtttgaagcatcaaacgaaggtaaaaacatgttttttcctcccacattccaggaaaaaatttatggattaccatattatttatgattttgaataaattttcgaaaatttagcctaaatcggaaaattgtccatttgagaggcgaataaaatttttatttgttgcccttttcatgctcaggtgtcagaaatg

SEQ ID NO: 104740 - DNA, 391 bp, Heterodera glycines
  Promoter: Source sequence=SeqID_12091; Location=1..391; Strand=+; Gene=SeqID_75645
aaacagtggaaggaagaaatagcgcaggaaagcaaagaaaagaaaggggagagtggagagagcgaggaggaggagagacggagacagaattggtcggagagcaaaacgacagatctgatcagaaaacaattggcagagatcgaacgagagattgccaggaggatgcagaacaaaaatgtgaagaaggtcgagcggggagacgccgcaattcactttttagggtttttgaatgaatgtctttctttctctcgtcacatcccttgtctctctccatcactctctttctcttgctttccctcttttatttctccgttctatttcctctgtcctttttgttttcttccgcacgggtttcggttcggttcgcctcgctaaatggccctttcagatg

SEQ ID NO: 104741 - DNA, 1003 bp, Heterodera glycines
  Promoter: Source sequence=SeqID_15689; Location=36..1038; Strand=+; Gene=SeqID_79998
gccttttttgattaaaattggttaatatgttataaattttcaaataaatttttgtccgctatgaaagaactttccgaacaccccaataattagttcaattttaatgacaatgagtagggttgtaaattatatggactaaaaaacgcgaaatatggacattaaatatggactaaaaaagcccgaaatatggactaaaaaggccaaaaatggccaaatatggaccaaaatatggataaaaaatgccaaaatatatgttgtaaacccccaaaaatcccaaaaaaggtgtgcatatttaatatttgcttaaataaacctaaaaagtacaataaacaaccaaaaaatggggtttaaaacttaaaaatgcatattttttattgttgttcgttgtatcaaaaacacctccaagtttgccaaatttcgaaaaaattctcattaaaaaaaaagaaatgttcgcaaaaaaatgacgaaaatatttattgaaaatgccaaaatgacgacgaaaactcaaatttttcgtgttttgtggggtgtaatttttaaaaatttccaaaaagttgatctttaggggtgtatttttcgtttttttttcatttttcttgtgaaaatttccaaaaaatggccaaaatatggactaaaaacccaaaaatggcgaaatatggatttattcccgaaaacccccaaaatatggatttatatggactaaaaaccttcaccaaatcaaaaaattttaacgcagaaatgctatttttaagcccctttcttcatagcatatgcgcagaaaaaatatgttaatccatataatttacaaccctaacaatgagtctctgcatttttttgcggcgcgctttttcagaaaacttttttgagttacggcggtgcagatcgtgataaaatttgaagcaattgtaacagattttgcccaaaatacttaccaaatttttaagccagtcaaatccttttgcgaattgttgatcatttttatcacatctcaacaatacaaatg

SEQ ID NO: 104742 - DNA, 600 bp, Heterodera glycines
  Promoter: Source sequence=SeqID_3067; Location=2686..3285; Strand=-; Gene=SeqID_83053
aggccaaaaggggaagtttcccgccaggcaaattattattatatttgtgtaattttgtcgccttttctcacactttcccaccattggcaccgcattacccctttttcataacaaagtttcaaaaatgagaaaaataaaaatgagactaaatttttaaaaaattattattattaaattgagagacgagacgagacgaacaaacatttatttagacgcaacttaaattggcactttaaaaaaaaggtaaaaatggtcaaatgcgaagaacgctttttgccggtgccgtcgaaggaaataaaattaatttgaatttcccatttattcgtactctttttacacattgtcacatgagcaacaaacaaacataggtaagtgagttccaatttccataaaagtgcaccttttacgtcaatcgaaaaacaatggcattcgtttggtgacattggcactgatagtccacggcaataaggaaaataaatgccaaatttggcaaggaaaagagggaactgcaaattagggttgagcggtaccggtactggccggtaattaccggtttttttggtaccggtaccggtaccggtaccggttttttcaaaaatg

SEQ ID NO: 104743 - DNA, 140 bp, Heterodera glycines
  Promoter: Source sequence=SeqID_17633; Location=2422..2561; Strand=-; Gene=SeqID_82159
aataaaaaaaaatttgttttttttttcatcttttcaccccaaataaaaaagtgtccaaatatgtatgaaaatcagaaaattaagcagcctctttttaattttcagctgaatcaaaattctgtaatattattgtaaaaatg

SEQ ID NO: 104744 - DNA, 76 bp, Heterodera glycines
  Promoter: Source sequence=SeqID_26879; Location=317..392; Strand=-; Gene=SeqID_57623
ttgccccaaattacccacccaatcaaccgatttatccgttctttgctcccttttagggtacagtgaccctgagatg

SEQ ID NO: 104745 - DNA, 821 bp, Heterodera glycines
  Promoter: Source sequence=SeqID_28985; Location=1089..1909; Strand=-; Gene=SeqID_59552
gcaatccgtaatccctttagaattgcgatctcggcgaaataaatcacttttctgggacaaaaaaaggctaattagggggtcattctgacaaatgagctcagaatttggaaattcattaattttcagagctttaattaagttgtactcttttgctcctgacaatgagccttttcagttccttgatcacaaatatttacatttaatattttcaattttttgctcgaattctctgaagtgctcatatgtaagagtgattagctcagaaaaaagttaaggatacgccggtaccgcaattcttaaggagtaccgaaaaaatggatgttaaaaaaggagttacgcagattaaaaatttatttgctggtcaaccacaaaaaacatgttaagagtgtgataaaaaaaaacgattgtgataattataattaaatatatggtgggaggaggcggagaatgaggaggagttaacaacacaacgtggaggaggccactcgcaaaaatggaccaaacaaatgaccattttcgtcgtgtacaatttgatgccgcagatcaacggtctgatcagagaaacaaaaggagaagaaaaaaggcagtgcatcgccaagcgcaaaacaaaatttggaggaatcatataaattgatttaaaaaaataaaaaatggaccaaaaaattggacaacaacaaaaaagaatggaggagggcagaaaattgaaaaacaacagaagcagcagatgaaggaagcatggttatgcaccaccaaaaacagacacaaacaaatgcaaaatgtaaaaggtatgattttcgtgtgaaaattttggcaccaaaatg

SEQ ID NO: 104746 - DNA, 82 bp, Heterodera glycines
  Promoter: Source sequence=SeqID_35546; Location=1..82; Strand=+; Gene= SeqID_65088
atggggcaaaaaggcactcaagatattttttacaattttaaattctcagttttatttgggcactaccgtcgctgcctcaatg

SEQ ID NO: 104747 - DNA, 281 bp, Heterodera glycines
  Promoter: Source sequence=SeqID_12863; Location=908..1188; Strand=-; Gene=SeqID_76592
agaatgagatttcaaaaatctaattgtgagacagaaaaattattggagagcgagacggacgtaaaagatttcaaatttcgagattcgggaaaatttgtcgttagtattcgagaatttattggaaaaattatttatgaatttaattaaggtcatttggtgacttcaatgagtgccattcagcaggccaatgccaattcgaatgagtacacttttttacacaatttcattttttcgatgggtaaaaaattattttcctttagccagcgaaatgtttacaaatg

SEQ ID NO: 104748 - DNA, 260 bp, Heterodera glycines
  Promoter: Source sequence=SeqID_21789; Location=786..1045; Strand=-; Gene=SeqID_52400
tatttaaatttccctatgattccaaagcgtaaagcgtaacaatggggtaactatgacgtaaataaagcagtaagaaaatcatttgaataaattacatttataaaaacaattgcaataaaaggcagaaacaattttgaatattttactttatctttacttattatatattattattaaatttccttctgctctcaaatagtaatttttcaaaattttattggttcgcaatcactcaaatagaaagatattgcaaccaaatg

SEQ ID NO: 104749 - DNA, 332 bp, Heterodera glycines
  Promoter: Source sequence=SeqID_28161; Location=421..752; Strand=-; Gene=SeqID_58810
tttttcaatatgtcgagctctaattttttttaataatttacataattaattacttttgtgtgcgtcgtattcaactgaaatgactttgacaaaattcaacaaatcttcttggaaatacttttcaaattcaaaatgttccctaaaacaacaatttcagggcgctgtgattctgtgtgaaactcattaaaggattttgttagaattaatttatttaaattttaatgggcactatgcctaagagaggtaattgactagtgatagtccaattaagacaattaattgtccaaataagatcgcaaaaaacaaatattcctttctaattattcgacatg

SEQ ID NO: 104750 - DNA, 670 bp, Heterodera glycines
  misc_feature (145)..(145): n is a, c, g, or t
  misc_feature (192)..(193): n is a, c, g, or t
  misc_feature (195)..(195): n is a, c, g, or t
  misc_feature (202)..(202): n is a, c, g, or t
  misc_feature (215)..(215): n is a, c, g, or t
  misc_feature (246)..(246): n is a, c, g, or t
  misc_feature (256)..(256): n is a, c, g, or t
  misc_feature (273)..(275): n is a, c, g, or t
  misc_feature (299)..(299): n is a, c, g, or t
  misc_feature (309)..(310): n is a, c, g, or t
  misc_feature (321)..(321): n is a, c, g, or t
  misc_feature (326)..(326): n is a, c, g, or t
  misc_feature (369)..(370): n is a, c, g, or t
  misc_feature (407)..(407): n is a, c, g, or t
  misc_feature (413)..(413): n is a, c, g, or t
  misc_feature (429)..(429): n is a, c, g, or t
  misc_feature (443)..(443): n is a, c, g, or t
  misc_feature (449)..(449): n is a, c, g, or t
  misc_feature (454)..(454): n is a, c, g, or t
  misc_feature (489)..(489): n is a, c, g, or t
  misc_feature (502)..(502): n is a, c, g, or t
  misc_feature (514)..(514): n is a, c, g, or t
  misc_feature (524)..(524): n is a, c, g, or t
  misc_feature (529)..(529): n is a, c, g, or t
  misc_feature (539)..(539): n is a, c, g, or t
  misc_feature (546)..(548): n is a, c, g, or t
  misc_feature (556)..(556): n is a, c, g, or t
  misc_feature (566)..(566): n is a, c, g, or t
  misc_feature (570)..(570): n is a, c, g, or t
  misc_feature (572)..(573): n is a, c, g, or t
  misc_feature (576)..(576): n is a, c, g, or t
  misc_feature (591)..(591): n is a, c, g, or t
  misc_feature (606)..(606): n is a, c, g, or t
  misc_feature (609)..(610): n is a, c, g, or t
  misc_feature (644)..(644): n is a, c, g, or t
  misc_feature (652)..(654): n is a, c, g, or t
  misc_feature (659)..(659): n is a, c, g, or t
  Promoter: Source sequence=SeqID_17477; Location=1..670; Strand=+; Gene=SeqID_81983
ggatagcagttaattgtataaaaaaggggtatttcatttagtttcagaaaaatccagaaaaattctaaaaagaactcttagagctgctatctaatgatcccaaaatgttggatgcttctagaaccggttgtggggcgttggtttnttttatgatgttgggcgccgcgccgttttctcttttggggcgtagcnngnccttcgnccaggggttcccngttccgctggtcgctggtccggttgtctcgngcctctctgntgttctcgcgcccgcgnnntttcccggtgttttggcgctggtncttggtccgnncccggccctcntggcnctcggtggtgttcccgcggccctttggggggtggtcttgtccnncgcttcgccttgcgtttcgtggttttccgcttggttnggggtngggctgctcgctcttncctgcctgctcggnctgcgntgccntcgggttgggtctcctccggggtgtggttgctcgntctggtcgtgcgngtgcgctgggtntttgcttccntcggntgggcgtgcntgtgctnnngctcccgncgcgtgctcntcgncnnttntttttttccctttcngtgccgacaatttgngcnncctgcggtggtcttccctgctttttcttctcttncctttttnnnttctncgtgtagcatg

SEQ ID NO: 104751 - DNA, 969 bp, Heterodera glycines
  Promoter: Source sequence=SeqID_8561; Location=460..1428; Strand=-; Gene=SeqID_68533
gctatgaatatttatttcaaaagataatcaatgtggtctacgtcagttgggccctcacgttcaatgcgaccaaattttgcgattttgagcaaatttttgtttgtaaattaaggatttttacggtccggcggtgccgataggcgccgccgggggaaaaattaagaattttgaccatatttttagcatattttcattaaaaaaattctttattttgcggtttttctcaaaaaaccacaaaaagcctcaaagcctcattttgaaaatttagcctcattgacctgtcaaaaaaccaaaaatgaggctaaagcctcagatctgccatccctgcatagaaagtttttagcaactattcccatttttggcatgtaacctaaaaacgaactattttggctgtttttagcaactaaaaatcgtatccctaattatgtgaaaggaaaaaaattaaattttttaatatgtcaatatatcttaaaattttgtgacattcaatcatcgcgtgagtctcaattaagataaaacaaaaaaaattaataatttttattttgcatttacacgatatgacaaaagtttcatcatttaaacaattttaaatcggtccggtacttagaaaatcattgcgtgacttcgtgtaaatctttttaaaagttggctgtgcgcatgtgaaaaatgaaattaattttgttttattcataatttttattcgcatgctcacaaacaaatcccaattaaattaattttatttctaatggatgctttcgcagaattttaatattaaatgacaataattaaaaatgtcataattaaggtttgtaattatatggatgaaatatggccataaaatatggaccaaaaaagcccgaaatatggacataaaatggcgaaaatatggacataaattttccgttatgggtaaattttcaaaaaaaatttttcaaattcattaaattctagtaaaatacatctaaaatg

SEQ ID NO: 104752 - DNA, 110 bp, Heterodera glycines
  Promoter: Source sequence=SeqID_2893; Location=1158..1267; Strand=-; Gene=SeqID_82217
gtaaataatttttattaaattcatttaaattattaattttaacaatgccacttttaaattaaatggatttttaaattaaatattattaaaatgatttaagcccggcaatg

SEQ ID NO: 104753 - DNA, 357 bp, Heterodera glycines
  Promoter: Source sequence=SeqID_31750; Location=166..522; Strand=-; Gene=SeqID_62056
cctgaaacctaaactttgatggacaatcaatccatttcttgaaatgtccaccccgtttctcgatcaactccctcccaagggccggacttagcttattattattttttttaattttttttttatttagaagctggaattatataagccgttttgtaggattgaaattctatctttacatgttaacacaattaatttcatatcaattccctttttttcatttccgtgtgagggaggagtcccgagattatatttttttctgttttatccaataatttatgctcattttcaatttaattaattattttcttgaaataaaagcaataaatttttttatctttaagaataaacaaaggaatg

SEQ ID NO: 104754 - DNA, 366 bp, Heterodera glycines
  Promoter: Source sequence=SeqID_2549; Location=8154..8519; Strand=-; Gene=SeqID_80351
gggtaatttaattaagaaccaattaatcattaaaatgcgggaaaattattaacaaagttttgatcgagatgttttacatttgtgttttggtatggtcgaatcccatggtaaaatactccaattgctgatagggtatgacatctgcattaattataattataaccaattattctttaatctttacaaactgaatatttctaggggaaagaagggttatgatggaacttaaattatgtgccacatttttgttgtaattcaatgaagcagaatacttgaagctgagacaaaggaaatgatgaacactaaatgagtatgataattgttgacagattaacttagttatggtattgatggctaggaaatatg

SEQ ID NO: 104755 - DNA, 269 bp, Heterodera glycines
  Promoter: Source sequence=SeqID_14180; Location=3854..4122; Strand=-; Gene=SeqID_78193
ccaagattatttagttttattaagcattaattaattttctttttggatttgaatttagggacctccaaaacatcaagtttcctcattacacagtcaaagttccaatttttgaagccctcagaaataacaaattcacactaagtaaatgtaaaatttgtaaaaaaacggttaaaaatttcgcgaatcttcaaagaaaaatcgtcgtattcaaccggccgctgctgtcattgtcattgtcattagcattttctcacctgtccaagcgaatg

SEQ ID NO: 104756 - DNA, 164 bp, Heterodera glycines
  misc_feature (71)..(71): n is a, c, g, or t
  Promoter: Source sequence=SeqID_3518; Location=1..164; Strand=+; Gene= SeqID_84989
cgggcattaaatcgtttattttaaaaatatttttaattaatttgctaatcgaaggtgaaaccaaatcgacntcccgacaattggcttctttggtcaatgaattccttctccgttcggcagacattctgaacagattttgtgctcaatttgaaaatcggatgatg

SEQ ID NO: 104757 - DNA, 123 bp, Heterodera glycines
  Promoter: Source sequence=SeqID_29128; Location=1158..1280; Strand=-; Gene=SeqID_59678
cccctccaaatgtctttcgttttgtggctccatcagctcaattcgctgttttgccttttattcggtgtccctttgaattcgcttttgctttggcttctcctccgccgcacttccaacgaaatg

SEQ ID NO: 104758 - DNA, 832 bp, Heterodera glycines
  misc_feature (26)..(26): n is a, c, g, or t
  Promoter: Source sequence=SeqID_19978; Location=721..1552; Strand=-; Gene=SeqID_84747
ttggcattttttagtgcatacaactntcgaacactaatcatcgtatatttgtgttttgtatgtcttaaggataaatgattaaatttgttatttaagcgtcggcacagtcggactccattttaccattatttttcggctttacggaaattagacaccaaaaattgaaaaaaaattgtgtcatttttgacacaaagttggaattcctttcttgtttagcctgatcatttctgatcaataattagtgtgatatctcccccccccccccccccgatcagaatgtcattttactcagaatgccattaaactccattcattttcctcatttgatcactccttttccttttttgaatgattggactcatggagtgccattggactcctaaatatttgattggactcataaagtgcaatagagccaaaaaaggctaaattctgacttttctgcagttttcaagcccatctttatgggttaattaggtgcttagaaaaaagacatacctattaaatatctttgaaactttagagtattcggagacacaaaggttattttgctttttacgaacaaaaaaattatgctttattaaagttgtcttcatacactgttaaaaaaagtgagtgaatgaaaaaaatgggggagggagggagggcttttatagtcgagaaaaaattggaaaatgcaaaagcgtacaaatgaacataaaaattagtataaaagtggttgctcctcatcctccaccttccattattattcattcgccatttatttgttttcgtctctctctctcttcgactgtttctctctgacaataccttcaaagttccttcaaaaatg

SEQ ID NO: 104759 - DNA, 184 bp, Heterodera glycines
  Promoter: Source sequence=SeqID_79; Location=3102..3285; Strand=-; Gene=SeqID_63058
aataatctctaagctaaataaaaaagggagccgattgtatcaaatttattttaatatattttcagctgattttttgacaatttgaaaaataaaggccccgggctctattttaggaaacacaatatatatatatatatattataaaaacactaaaacatatgttaaaactcaaaaagccaagatg

SEQ ID NO: 104760 - DNA, 745 bp, Heterodera glycines
  misc_feature (73)..(73): n is a, c, g, or t
  Promoter: Source sequence=SeqID_5286; Location=4803..5547; Strand=+; Gene=SeqID_57561
acaacccttgggcaaaaagatttcaacaacaatgacacggaactccaacaagccaattcgaaacatcgattgntctcaaagcaacagacaaatttcaaaatccattaattttcttcacccgcggatcaatttttgaatctgagcaggcccgcctggaacagaatctcaaggaattgacgagaaggatcactcggcctgaattgaacttccctgacatagggacagtcgacattaatcagactgaaattcacggaagcacggtcacagacatattttccatcggcgaaatactggcggaaaagatgcagaaagagagcgaaaatctcagaaaaaaggcggaagaaacgattgaaaaaggaaaggcatggatggaagacccaattggaatcatcaaatacatcaaatggatactaatcacaatcgcattcattctaattgtgattggatgcaccgttcttttgtggaaaatcaaaatttattccactttgcttttggcgccaattcatttgctacaatctctggtcaacaccataatgaactgtttaaattctggaagaagacttgccgaacaagtgcgatatccgatcgtgatggaagtcgaactccaggaccgagccaagccatcggcaccacccgaggaaccgttacttgaccaaaaggcttacgtgctaattatcttcctaacatttgccaaattgaacaaacaagacgaaaaaagaaaagatgttacgtcaattttttcatg

SEQ ID NO: 104761 - DNA, 237 bp, Heterodera glycines
  Promoter: Source sequence=SeqID_1864; Location=4645..4881; Strand=+; Gene=SeqID_76442
attaggacgatcaatattatccgaagaatatttggaaaatttcagacataaaaaatattcaattttttacaaatgtttttataaataattttttttcggtttataaaattattaatcctttttcatcgcttataaaaaatatttgataaaaatcgttgattatgctaataacatttttaattggtttagttgaaaaaccaaattaatttttcatatttatttttattttgaaaaatg

SEQ ID NO: 104762 - DNA, 213 bp, Heterodera glycines
  Promoter: Source sequence=SeqID_8824; Location=1151..1363; Strand=-; Gene=SeqID_69333
tcattaatttaccaattggcaattattttgtcattaagataaaattattattattatttctttgaaaataaaacaggatttccttattttattaagtaaaataatgatttattcagttttttatcagaaaaaaaatcatttaaatgcctcaaaaaatgaattgccatttaattgaagaaaaataaaataaatcatttcgagacgacaaaaatg

SEQ ID NO: 104763 - DNA, 902 bp, Heterodera glycines
  Promoter: Source sequence=SeqID_1975; Location=2056..2957; Strand=+; Gene=SeqID_77121
tgccatgcccagggggccgttacgcaataccccctccggctggctacatacaatccgacaaaaattagtttttaaatgcaaaatttctcggtctctagtcgtaggaccaagaaagcccatttcagacatttatgacaggagtctcgcgggcaatccgtaaatggacattgtatttgtggcgaaggagacaatccgtcatagaaagacaattagtctaagatggacaaagccaatccattaatgaaagacaaataaaattttctgacggattgtctccatttctaaatgattgtccactgaccgattgtccggatataggacaatggataaaaatttgaaaaattacataaataaaattgaataattttaacaaatttgatccgtcttttaattttcacaaatttattaattcatttcgacaacgaatacccaatttgaacttgttgaaggctacttgcttaaagaagcaagcgtgccatgccacatcacaattaaataagtctaaagtcaatttataatcgtagcgcggtttctgatcacttcccatgcttggtaatttgggcacttttattgcttcatcattaagaaattgtgcagctggttgaatcattcagcaagtcaaattagatattcgttgtcaaaatgaaaaaataaatttgtaaagaataaattaaaattattcaagtgatttttttttgaataatgatttttcatttaaaaatttcgtactttcgtaagtaatctcatatttttaggatgttcgtgtgtccgtgtctcataattattttttgtttcattatttcgtatttttattgttattttttaattacgcaatatccctggctacataaaaaccaacaaaaaaaaaaaaaaattcctatgaaacaggcggtggtgccatg

SEQ ID NO: 104764 - DNA, 103 bp, Heterodera glycines
  Promoter: Source sequence=SeqID_3469; Location=2390..2492; Strand=-; Gene=SeqID_84798
ttttagatagaaataccacgcatgctaatattttaataaattcaaataacaatgttaaatttactagcatttttcgcttttttactcgtatttattaggaatg

SEQ ID NO: 104765 - DNA, 741 bp, Heterodera glycines
  Promoter: Source sequence=SeqID_17414; Location=124..864; Strand=+; Gene=SeqID_81897
tttttgcgcagttttccagaaaaactggtaaggcctaggggttcggtcaagaaacaaaaaatgtgccaaacatccatacgaagctcctttacggagccgatttttcatttaggcctttaaaaaatttttgaatttcaaaaagtgcaaaaaaaattttgaaaaagccgtttcagcgccgttggcgctcagttggccctcggagcgaaaaacctatagttttaccagatgcgcctcaaaaagttgtccccaaggtcgaaatttcaaacccctcccggcaaaccgtaaggagattttgtttttggaaatgagttgccttgtttctttagtagtatataactagcgggtgcgtgaaccgtcggctctgggctgggaaaaagcgcttcgcgctttgggagcttcgctacctaggctgtaaagcgattcaaatttatcgaattggttggagaggtttttttgaatttttaaaaaattattaggggtttttagtccacatcgaggctcaagacgggcgcttcgcgcccgttttttagcttattaggccgcttcgcggcctcagtcgggcgcttcgcgaggtacaaaagtgattagaagaggtacaaatttgatgaagaggtacaaaagtgattagaagagtgattagaagtagtacaacagtgattagaagaggtacaaactgtgattagaagaggtacaacggtgattagaagaggtacaaaagtgattaaaagaggtacaaaaatg

SEQ ID NO: 104766 - DNA, 66 bp, Heterodera glycines
  Promoter: Source sequence=SeqID_18328; Location=421..486; Strand=+; Gene=SeqID_82932
tcgctttttcttttcctttcccctttaatttatttgtggttttcagctgcccttggccacttcatg

SEQ ID NO: 104767 - DNA, 1003 bp, Heterodera glycines
  Promoter: Source sequence=SeqID_12599; Location=619..1621; Strand=+; Gene=SeqID_76261
cttttttacttagaaattaaaaaaaaatttatgggggacaaactgaataagagccaacatttgtgccattcattcgcgaccaaattggtgattgttcgaatttgcgagtttggccagctgtcgctttgctgaactgttcctcccccccccccccccacaaaagggcctccccgccccatcactgactgataagcctttctcattcatttcataactcaaaaaagaaatggcaatcgatcgattgttgcgcttttcccttcttttccctccattctcgtcccaattccacgtattcattcattcatctgcccaaatgaatgaatgattgaatggatgggtcggccgattgttgacactgaggcaaaatggggggggggagaaaagggtgggggagggagcgttttgggagtttcgcccgaaaaggcaaacccaagcaaaaagtcatcatcctcttcctcctcctttctccattttctcataacctttgcgaaaatgaatgaatgatggccaattggccatttttattgcgatggtcgagagtcccgggcaatttcggcctaattatcatatttagggctcgacctctggaccttgttgatccaggcatgggttagtcgaggcctggattttttcagtgtatccggtctatgcttttttcggcaacctgggtttcttcctggattttggtctaggaaatccaggtccaactcatttttcaaaatgtcgaactcaaattatataattcgcccttttctgacccctccccaccttaaattctagcaaataatgtcacgcacaagcttaacagatttaaattacataaagagggaatttgggcagcttgcccctgaaaatttgtttaatttttatatttttgcattttcgataagcaaaaaaaaatagtcgcccgcaggggcaaaatgcgcacttttaaaaagcaaattttgccaaaaataaaccacctcttttgaagcaatagtcgctcatttgtcgccaaatcatg

SEQ ID NO: 104768 - DNA, 259 bp, Heterodera glycines
  Promoter: Source sequence=SeqID_6859; Location=424..682; Strand=+; Gene=SeqID_63127
ttattatctcttatgtgttcctttatttcgcattgattttcgccccgcggggaaattattttttatttttattaggaacagaaaatatttctaatattgtacattttgtcagtttaaacttgtgtcatatttggtcctaatttctattttgtgctttgggcgggacactttgacgcaaattctgtattaattcattagacggtaattaatgctaattagccttaatagttcattttttgttgattacagctggctaatg

SEQ ID NO: 104769 - DNA, 668 bp, Heterodera glycines
  Promoter: Source sequence=SeqID_11322; Location=1461..2128; Strand=-; Gene=SeqID_74704
tctcttctttgggtgaggttttctgattttagttttgtcaagaaatgcaattttggtccatttttgaactaaatcaaagttccatggcaaacaaaaaaatacgataaaaagtgataaattctaaaaaaaattttacaattagaaacattttaacaaatttgttttcctatttcaattagcgacattcaaagttgtctgaattcggttgaggagaccaaattcccaaatttttgaacatataaattcgaattttattttttattttgaaaaaataacctcacatcattaagctttggtttttataattagtaaaaagattattgctaatttaaattggaattccccattcagttcagtggtgcggaacatggtcaccgactttctgcaacgagccaccacattgtacggtccccctgcaccggttgaccccgaatttgcaacgccacaaattttgtcttaccgagattgacttttgtttgttgtttttttctaattttcaaatgcttgattcaaataaaaatgataaatcaagtgtgtgcattttgttttttgttggttatttcatgtaatatttaaacgcattttttttatgccacctattgtaaatttaaaattggcgacatttcgaattttagaggaaaatattttaaaatttttacttaaaaatg

SEQ ID NO: 104770 - DNA, 463 bp, Heterodera glycines
  Promoter: Source sequence=SeqID_34998; Location=599..1061; Strand=-; Gene=SeqID_64666
ttgaaaattaaatttttaaacaattatttattttcctatgtttataaaagcgtggtgattattagtgatggcattagggcgcaagagtttggtggcccaacctgacccaaggccatagaacgacccggtgtttcttgaccaagctcgcaaggtccgagggaaaaaaataaaataaaaatttcccactaatttttgtacacctcttttgtgggatatccgaatgttataaattaaaaaaaaaagaattaaaaataaataaaacgttatactcaaggcgttcaaaagcattttccaaaataagaataactaaaattttgggtttttctatcggctaaaaataataaaattatttttaatttatattaccgtaattttttttaacctattttactagtctcgtttctatgtcattttatcggtgtcagtaatttttaaaatttgtttcagaacactcgtgccaatg

SEQ ID NO: 104771 - DNA, 459 bp, Heterodera glycines
  Promoter: Source sequence=SeqID_9282; Location=478..936; Strand=-; Gene=SeqID_70856
tctgaaattttttttatttggaatggctggacaagtttaaaatgtctgggagaaattcttttgtcaaggggaaaattttattttaaaaagtttaaaaaagacaaaaaaaaagtttctatttcttaaaacaaaattcttagaatgatgtgttatgatgatgagcaaaaaaatttaaaaatgagaaaattagttaaatatttaatttaatttttgttgggttatttctttattttgttgaaataaattaattgattttgttaaattactaatattataataaacaaataagtgaaatttgttttttaattattctcaaacatacaaagaaataaatatgatgaaattaaatttttttatttttaattaaaaagtcgaatttttcaaaatattcatatttatgcatatgaaaagaacacacagaacgcaattgaaattttctttttttttagggtaattatg

SEQ ID NO: 104772 - DNA, 126 bp, Heterodera glycines
  Promoter: Source sequence=SeqID_17065; Location=1378..1503; Strand=+; Gene=SeqID_81494
tctgaacgaaacgaaaacggtggaaaaagcaaagtaattaatgaataattatttttgtatatttttaaaacactttcgattattgattgatcttgttaattaggcactctactattaatgaggatg

SEQ ID NO: 104773 - DNA, 504 bp, Heterodera glycines
  Promoter: Source sequence=SeqID_10414; Location=1947..2450; Strand=-; Gene=SeqID_73608
ttgaatgacaaattgcaaaacgataggggttgaggacggacacaaaaacgctgacatttttttctgaaatttttatttattcgacaaagtttaggcaatccattgactcgcatttgaaaattaacggaaatcatcgtttattttttgatttcgtgaaatctgaaaaaaccacacggatatatttcgaccaattctgaaactccggaccctaattccaataaaaagttgaacacctaaacccatcgaaatgcgaatttttgaattttaatttttgttattagctcatcaaaaaaggtaaactttgtggaatcttgttttatttatgttttcgttgtttttgatgacattctttgcgaccgtcatttctctcatttgaaatggttgattttaacatataaatgcttttaattggctaattgtaagggaggcatttctgacggatgacaacaccacggggaccacaacgacggacgacgaactgaacgtggccaggctggagacatg

SEQ ID NO: 104774 - DNA, 1003 bp, Heterodera glycines
  Promoter: Source sequence=SeqID_7630; Location=3383..4385; Strand=-; Gene=SeqID_65469
ccattgggccgaaggtgcgaggttttaaattggaggattttaggtaagaatttcttggcacggtgccagggttcaagttccgccgatccgaattgccgatttaatattttttgccgtttgcctaaatatccatggggaccgaacggtgtggcacagattttctgctttgtccttccttacttggccctcaactagttttgccgggatttgagtcccgacaccgaaattcgagtcccagttttgtcgggatctcgatcctcccgttttccaataaaaaaaaacggatcggcgtctcgggaaatcctaatgggatcccgatcccttcccgtctatagtctcgaattttcggaggtcaatctcggtccgagtcttgtcgagtctcaaattttccatgcctaattttctgggcctcaatgcgcggctggccagcagcagcccttttccaaaacagtggtgccaagtcttagcattcagaggtgccaattctttcataaatccgccaattatatcgaatttttcgacaaaacatgggataactttgcttaaatgcaataaaattgtatattcttggtatcattcgatagccgagctttttctctattagcccgcaaaataaaaataaaaattggtcaactttagaaaaagttgtatgaaaataagtactatttctgccataacttatgttaaatttggtaacttttttgaaattttccaagctaatagagaaaaagctgggctatcgaatggtaccaagaatctaaaatttgattgactttaagcaaagttatgccatgttttgtcgaaaaatttgctaaaattggcggatttatgaaacgatctggcacggcattcggagataaaagaaatattttaaaatgggataatgcatttttaagagcgatggatcactgctggcggcggcggtggtcgctccatttcgacagagtcacgaaatgagggggatgaagctgcttccgagccggacattgtgcaggacagaatg

SEQ ID NO: 104775 - DNA, 163 bp, Heterodera glycines
  Promoter: Source sequence=SeqID_42526; Location=542..704; Strand=-; Gene=SeqID_70399
tatcaaattttgctttaaaaagttcaagtggtgtaactcgggctttttcaaagctttcgtgggtttaaaagcagccgaacatttgctttcctaattgtgcttattgttagcgatctcgaaactcatccgaatacataaagctcagatctttttgtccgaaatg

SEQ ID NO: 104776 - DNA, 378 bp, Heterodera glycines
  Promoter: Source sequence=SeqID_6502; Location=466..843; Strand=+; Gene=SeqID_46261
ggttagattcaaaaaaaaaaaatttttttttaaatttcggcgtggaaattttttttttttgttacttttgtttaggtattaattttcttcgttattattattattttttaaatgggtttgactctgaaaaaagaaaaaattctcaaaaagtttggcttgagaaaataagaatgttttgccatcgttcaaaaatgccgagaaaaaattcttgaacatccaatagcttacaaaattagcttattgcatctataacacgcaaaagaccccacccaaaccgatcaattctttgatttttatgatttttttacacaaaaattctcatattttttttttaaatgccgactttctgatgaggattttcacaatttttgaaaaatg

SEQ ID NO: 104777 - DNA, 1003 bp, Heterodera glycines
  Promoter: Source sequence=SeqID_15061; Location=399..1401; Strand=-; Gene=SeqID_79231
attaaattaattgaagcagcatgtgcgaaggcattttcctaatttgtcaataaactaatcagtttggcaggtgatttttttcatcattctttttaattaatttgtcaaacaaaaatgaaattgaattttcacgttattctattttaatttaatattttttcacgacaatagttaggcgaaattcaaattttgcagtacaaaattacccattttacatattttagaaaaatttttaaaatcttaatatgttatttgtttctttaggcgtgcacctgaaaattttcgagaattttatgactgaaaaatggtggcaaaacgctgaacacaaatttggcactaatacagacataaatcgcgcaaatttttttttgttaaaacatttaaatggctaaaaggtgacggggctcccaaatgttgtccttaagttgtccgattttcggctaagtttagagttaagattttctgattttaattcatgactacctatatttattaaaattttcaatttcgaatttcgacaatttccaaaaattgttttctgttcgtttaaagtgcgttttggcccagcgtttcatgtgtccgtcccatgcggcatcactaattaagaaactttttttttcatttgattcgcatcacttaaatttttaacgcaaaccggaatataggggttctcataagataaatgttagctattccatggattttttctgcttagtttagcaaaaaacaatcattttttcgaataaaaaaatttcatcgatcttatgttcggatttagtaggaaattagggaattcttttcaaaaagttagtgaaaaaatataataaaaaggatctttaacatacgtattagcacaaccatcaaaccattgcataagtccacccaaatatgggagcgaaaatattaaattttttttaaaaaaaaatggacggggatttaagtaatttcctattgttgtctctctttttataatttgttttcagtttgatgttttcggcttatg

SEQ ID NO: 104778 - DNA, 687 bp, Heterodera glycines
  Promoter: Source sequence=SeqID_27295; Location=799..1485; Strand=+; Gene=SeqID_57976
tccgtgcatttctccctcatttcatttgttgtatttccaatattattgtgaccccgctttctcccctcgcttattatattatatttatttgtgttgaaataaatcaatatttatttcattgactgttgacggacacaacaaaattttttcactattacacaaattatttattatcaaaatttaacaaactgtctggcaaataattttgctttaatatgactatagacatataaaccataacaaaaaccccgccgtgcagattaaaatatttctttaaaaaaagtaatattaagcctagcattaaatatttaacaattttgcaaaaatttatttaaaataaaaaatgctaatcaataatcttcaatttagccaaaaatatatttttatttccttgttaatattgactgatttatttttacattatatgcaaaaaataatatgaatatggaatatgctgaaaattctcttttttatataaaatcatttatatatatatatctctttttattttatactttttatatttttgggtttacgcctctgaaaatattagttcgacttaatttcagctttaatactcctaaaatataaaaaatctatttttttttgaaagtgagtgaatttcatttattatttcattacagaagagtgaacaaaatagtagtcttgatgttgcttaaagccatg

SEQ ID NO: 104779 - DNA, 97 bp, Heterodera glycines
  misc_feature (8)..(8): n is a, c, g, or t
  Promoter: Source sequence=SeqID_2102; Location=1681..1777; Strand=+; Gene=SeqID_77857
agcaattntaagtgagcgggaaaacgggtcaaggcactgtttctgttaggccaccaaatgtgcgcacaaccacaccaggtaggataatttttgaatg

SEQ ID NO: 104780 - DNA, 224 bp, Heterodera glycines
  Promoter: Source sequence=SeqID_3408; Location=1..224; Strand=+; Gene= SeqID_84562
aaatctcagatttttcgggattttcacgacgccaagatttcacgttacctttacaaaatacaatgatcataatcagagaaacacgatctgacactacagatttgacataaatgatttttcaccaaaattcaaaattcgttgaacaaatctaaaattttaaaaacatttttattcaaaatttatttcattgcgaatggcattttgtaaataatctatttcagatg

SEQ ID NO: 104781 - DNA, 1003 bp, Heterodera glycines
  Promoter: Source sequence=SeqID_17783; Location=420..1422; Strand=-; Gene=SeqID_82323
ttttgtgagatttttggagctaattcaaagcaaacccccgcccccgcccccgcgggggcggaattatcgtgcccccgccaccgcccccgcgactctgacccccgccaacccccgtccccgcgaaaagattgacattttaaattaaaaattttgttacataaaaaaacaaataaatttttgggaaaaattttccaattcttaggggtgtattttttgattttattgcatttttgttaaggaattttctgaaaatccttaaataggtataataggtagaaaaactccaaaaaggtaaaaataggtattataaaagtcatcgtagacacccaaaaccaagtgtaaaatgcttttttcgtgcttatctgtacgtattaaatgcgcaaaattttaggtatttaactaaaaatcgcatccctaatgattagggctgctaattttatgtaaatacatattttttcctggcttctccatagcctaatcagtaggaaaacactttcttttttgtgtttgcaaacaaaagtttggacttttatttacatattttagtagatattttgcaaatttgaatatctgttagaaataaatttaaaattcgcttctatcggcacgccgccccccccccaaaaaaaaacctttttttcttaaaaaattacccaaaaatcgctaaatttgattatttttagacaaaatctgtgcaatttatgtcaaaataaatattatcaaggcgatcaacgaataaaagaatgtggagccaaagaaattattcataaaaaatattttttttgtgagatttttggagctaattcaaagcaaacccccgcccccgcccccgcgggggcggaattatcgtgcccccgccaccgcccccgcgactctgacccccgcccccgcgaaaagccacccccgcccacggggctcgaaccctatattttataatgagccgcaggtaattggaaaaaattccatcggagaattaaaagaaatttgtgaaaattggaaaatg

SEQ ID NO: 104782 - DNA, 130 bp, Heterodera glycines
  Promoter: Source sequence=SeqID_39230; Location=887..1016; Strand=+; Gene=SeqID_67849
cctcaaaaattttcttataaaaggccaaaatcgatataaccaaacacttattcttgaatgttaggtatttccattatttgtaaaactataattcattttcccataattttgttttaaaattcagcggatg

SEQ ID NO: 104783 - DNA, 85 bp, Heterodera glycines
  Promoter: Source sequence=SeqID_8026; Location=821..905; Strand=+; Gene=SeqID_66736
tgtaagtttttttttgatgatgaaaactccgccaaaatttgcagaaaattcgaaaaaaaaaaattttttttttcagtgacaaatg

SEQ ID NO: 104784 - DNA, 63 bp, Heterodera glycines
  misc_feature (12)..(12): n is a, c, g, or t
  Promoter: Source sequence=SeqID_5490; Location=1..63; Strand=+; Gene =SeqID_58233
gaacgaattatnttcaacgacccgcgaagacaaatgaaaaagcacaacagcagcagagaaatg

SEQ ID NO: 104785 - DNA, 288 bp, Heterodera glycines
  Promoter: Source sequence=SeqID_42698; Location=1..288; Strand=+; Gene=SeqID_70521
aaaggtatatgagttgccaaacttttctacctttggtctcccaaaattgcgattgctggcacgtggtgggatgggaatgcgaagaacctgtgaaaaaacgcaataaattgctaattcttgctataaattgaggaaaaagtgatcagcagcatattataaaatatgataaaccgatcagaaaatagagaaaaaagtgagatggttaatgatcaaaaatttttataggcaattaaagaggaaaaatgaattaactaattgctattttttttttataaattactcaaaatg

SEQ ID NO: 104786 - DNA, 92 bp, Heterodera glycines
  Promoter: Source sequence=SeqID_11525; Location=1193..1284; Strand=-; Gene=SeqID_74951
aatgtgcgggcgaagtgcgacgtgacaaaggtgagaaaatgcccaaataaaaatgaatttcaatgcaccaatttctaatttccacaggaatg

SEQ ID NO: 104787 - DNA, 332 bp, Heterodera glycines
  Promoter: Source sequence=SeqID_27438; Location=382..713; Strand=-; Gene=SeqID_58134
ttattattaatctctaagaaaactctaatccccccacccctctcccccctcgcccaaagatctctccagacaaagcgtgttttttgttaaacaaattttccaaaaaatttggctaaattttttcgaaaatccacaaaattggcaatttttgttgaaaagtatccgtatccccatcacccttctagtagttcatcttaaaattatgaaataatcggttgagaaattttcaaaagaattttttttttgaaattttctaggttgaaaattttaaaaaaaaatttggggggaaggaagtgtacccgacattaaatattccttttaatttcaaaatg

SEQ ID NO: 104788 - DNA, 78 bp, Heterodera glycines
  Promoter: Source sequence=SeqID_12255; Location=513..590; Strand=+; Gene=SeqID_75843
ggttagaaatttgatcccccattcatttgaatgactcagtttattcagaggtgtactatgacaggggtaatcagcatg

SEQ ID NO: 104789 - DNA, 398 bp, Heterodera glycines
  Promoter: Source sequence=SeqID_44950; Location=1003..1400; Strand=-; Gene=SeqID_72355
aaaatatcgattttcaagtttacaggtaataatttattttataattgtctaattgccaagcaatagcttagaaaaaacttctaaacatattaggcttgctatgaaaatcgtttgatttggttggcaatggaaaaattatagtcaaaaaattggttggggccgaactgatcgagtccgtccgggccacaagcccaaaagaaaattttaaaaactgacaaaaattatagctagatgagatttttctagtaaaattatgcaaagatgttttgaataaatatattttacacatttaaaatcattgctttttgaattcgaaaaactacccattcgttaaaagcaaaaatattattgtttctttttctatacttttttttttgaaaaatggcactttaggtatg

SEQ ID NO: 104790 - DNA, 169 bp, Heterodera glycines
  Promoter: Source sequence=SeqID_934; Location=577..745; Strand=-; Gene=SeqID_64510
ttgtgagtgttcataattattctcatcaatttatgcaatgtttctaattggtattttagaaggttcgtaaacaaaaaatatttgataaaactacgtaggaggcaacatcgtctgcttgttttccagtcttatattaattttgatcatgtaaagattatctttgcagatg

SEQ ID NO: 104791 - DNA, 139 bp, Heterodera glycines
  Promoter: Source sequence=SeqID_6800; Location=746..884; Strand=-; Gene=SeqID_62946
ttctctgttggcattttgcatatttaattattctcggcacttcccgggaaagaaatgttattaaaatggtaaatgataggtcatgggaatgatgatggccatcctttgggcaaaaagagcattttgacaaaattaaatg

SEQ ID NO: 104792 - DNA, 792 bp, Heterodera glycines
  Promoter: Source sequence=SeqID_24416; Location=1100..1891; Strand=-; Gene=SeqID_55143
ataccggatggtgggcggccttaaattttgggaaaaaattgaaatttgattttttttccagttggcttgggtgttacctctgcaaaacagattcattatgggaagtgagtagataattggaagagaagctcggctggtaatcgcttgggcattatattggtcatgaaatttgaaagaatgaatgaagagtgaattaaaatatttttgtgcccggttctcatgggctcattaattattcaataattaatatggacttcaaaagacatttgaatttgccgacaatagtgaaggagatgacttcaaaggaaatttgaatttgccgacactacgaaggagttcgagaaaattaattggtattcggatggggacaccccgcccccaatcttcataaattccccagtccaaatcacatttcatttacatctgctcatatctttactcactttaataataataatattttaaatagttaatttattgctgttaaccagggcggttgctccaattattgggctccgtttatcctggcagcacttgtgtgtcttttagggcttggggttgtgcgcgtgacctttactaattatccgagccgtttatgtgccctgtcgtgttatgcttcatgggtggcagtgcgctgctcttcagggcatagttggttaaaaaattttaaaattattattattatccattaatttgcattcacaacgacaatttccatgcctcaaaaatatgtgtcaagattgttcattttattcattcaattcattattttccctgaaaaattagataatg

SEQ ID NO: 104793 - DNA, 1003 bp, Heterodera glycines
  misc_feature (386)..(386): n is a, c, g, or t
  Promoter: Source sequence=SeqID_1231; Location=1865..2867; Strand=+; Gene=SeqID_70243
ggtaactcgcccggtgggactcgaacccacgaccccagcaatccgtgccgtgctctaaccaactgagctacgggcgcctcttttagaggttctctcaggtcctttatcccactttctcccacactcctttccttctggcatcacaaccaaaatttaagggagggtcccaaatttctcttattttaacgcaaatcatggataaggtaagtcaaaaggacgtcgtctcccgctttgaaaaccgaatcatcgacataaatgaaaggaagtgaagtgttatggtgttgtttctctgcccattcacaaaattcatgaaaaaacccaaaaaaattttccagtcggcgccgccgtgccccaaaattcccctaagatttcaaaagtttacatanatttgccatgcaaaaattggccttttttggtgcaatctgttatctagtcagactaaaaatttacaaattttgcccggcgggcgctacccggcaccgcaggacccttttccctcgcacattcctcaaaattttttggaaaaggcacgccgcaaaaactcttaaaaaatgggtacttttgaagcggatttaattgggaaaaataaaaaatttaataaaggattattaaagggatttatttttgtaaaatgacgacatattaaatatttgtactgaggcaatacatattaaatatttataattaggcaagcacaaagtacatttttgtctcaaaaatttcaattacaaattgagtaataaacgaaaattgttgaaaaaatgttctgcgcctatttaaatgattttttttttattttgttcttcatggtgtcctcttttatatcttactatcgtttcactttatatttgattgatagatttttctgccttttttcccgaccatgccaaaattgaaaattggcccactaatttttctcgaattttttatggtcaaaaaccaaagctgatataacaaaatcttagtttttctatacaatttagaccagtagaatccgaatatg

SEQ ID NO: 104794 - DNA, 290 bp, Heterodera glycines
  Promoter: Source sequence=SeqID_15118; Location=1627..1916; Strand=-; Gene=SeqID_79302
cccatttttaacaaaccaaaaaatatattgggtataatatttctatatttgcttgaaaattttttagtgattttcatcaaaatcttttccagtgcaatttattaacagaaatttttctaagctattgcttcgctattagacaatttccaaaaaagttatacatgaaaattgcgaaaagtcgaaatttttgaagttttttcgtaataaaattttttccaggcttgaaaatcttttcgcttttggtaaggctaatagagcatgttaagagctttcgagtgataccaacaatg

SEQ ID NO: 104795 - DNA, 73 bp, Heterodera glycines
  Promoter: Source sequence=SeqID_41978; Location=1..73; Strand=+; Gene= SeqID_70000
gccggatgcaaaatcctctctgccgaaatggcttcttggccgaaaaccgcgcacaacgattgatctcctgatg

SEQ ID NO: 104796 - DNA, 294 bp, Heterodera glycines
  Promoter: Source sequence=SeqID_14506; Location=1..294; Strand=+; Gene=SeqID_78550
attaggcaattaattaattaattaatcaataagtaattaatttttcattgtattgtacttgtgtcgttgaaggattgatggagctcaaaaattgaataggcagcagaagacatttttttgtggataaatggtagaaaattccgattaaaaaatgaaagaagcgaaattcttaaaggaaaattaaattgaaaataataaaattgaaaaaatggggcaaataatttcagagaataaatgagtcattattttaggtaattcgaaatttactttttttgtaaaattatttgaataatg

SEQ ID NO: 104797 - DNA, 329 bp, Heterodera glycines
  Promoter: Source sequence=SeqID_21057; Location=2582..2910; Strand=-; Gene=SeqID_51648
aaattgattgggaccaaaacaatttctgaattaatgaggatgaattctaaatttcgaatggaatacaaagccaaaataggtcaaaaaacgggacgaaaccccaaatagaggcaaatctgaggggcgaaaattccaaaatagggatttctaggagagaataggtgcgatgaatcgaaggattctaaaatatgtttttcgcgcatctctcatagaaataaatctgcaaaaggaaaccggactctaataaaaactacggttgttgaaaggcgcgctgaatatacgaacggaaacttgtgaataatttcagactcaaaaaaaatttaaaaatg

SEQ ID NO: 104798 - DNA, 788 bp, Heterodera glycines
  Promoter: Source sequence=SeqID_5107; Location=1095..1882; Strand=+; Gene=SeqID_56927
atttgatgctatttactctttgaatgtgcttactttttcttttgtttaatggattttcattcaaaaattgcaataaatttcaaaaatttgatttttttttattgcggcgtcatctgaagaaaattcgcgttccgcgactctgaaaaccatcatatttttctcactaatttgtttcaattgcttttattttaagacgagattaatttttaatgacaccgcctgccgagaaaaagcaaaaacttttgtccgccgttgaaaatcagcagcaatcgtcgtcgtcggcttcttttgtgaaaccatttggaggacggaagaaaatgcgagtgctcagatttcgcggctaaatgttgatatttaataaaatcaacaaacattatgccatcaaaacaaataccaacgcaaatttttaaaatttatttaagtggcttataattttatgtagagcgataacgcaaaaatgagttctgctatctctctccccattttatttttgcgccaaaagtcatttgaaaaaaattgctttaaaatttcaaaaattatcgaaattttaaaaatgatgttgagcctttctctaccctcgagcccattggcaacaatttaaggcgaacagatttgaaaattgttttgatagaaaatgcgattctcgtgtttttctcatcaagtattatcgtaaaaaataggaaaatcctaaaaatccaggctttatccaacgcattaattcttctgctatatattgtgtgacatcattcagaatttggccaaattgtgcttatttctgccaaaaaatg

SEQ ID NO: 104799 - DNA, 347 bp, Heterodera glycines
  Promoter: Source sequence=SeqID_10507; Location=1064..1410; Strand=-; Gene=SeqID_73731
aaggaaatgtttttaattttatcataattttcataaacttaattcattttccataaaaataatgcaaaataacgaaaatattaacgaaagatatgttgtgacgctaataaagtaaatttttctttaaaatataatcaattccaaaatgatcatcttataaatcataaaaaaatatggcaaatgatatgggggaatttagttataatattatttaaataattttcttaaatttgtcaattaataaatattttaattaaataaatcttttttttaatttaaataaaataatacatatacttataattacttaataacaactgtagacaaaatatcattaaaaagagatg

SEQ ID NO: 104800 - DNA, 444 bp, Heterodera glycines
  Promoter: Source sequence=SeqID_13969; Location=1..444; Strand=+; Gene=SeqID_77928
ggaatattatcgcattgacgtttcttcacataatacacacatctatagaggaattgttatccgcaaaagtcggtccgcaaatgtcgcactcacggaactcacaggcccttaaccagaaaacaaaattcggaaagggggggggggcgggggcgtcagacccaacgagcttttttttcttttgctcttcgccccagaaaaattttctttccggatcccaatttagcccactttggagcgaaaattattttttcatccattcgagacaaaaaatgttttcatttcggagtagccctgcccctcctggttacggacgttcagctcttatcattcatgactccttttttaacaataatttttttagtttttcttttcttaaaaattatgttcttttaaaacagaaaaaaacagtttcttttggttaaatcttaaccaaaatttcagatg

SEQ ID NO: 104801 - DNA, 256 bp, Heterodera glycines
  misc_feature (27)..(27): n is a, c, g, or t
  misc_feature (40)..(41): n is a, c, g, or t
  misc_feature (49)..(50): n is a, c, g, or t
  misc_feature (92)..(92): n is a, c, g, or t
  Promoter: Source sequence=SeqID_13592; Location=1878..2133; Strand=-; Gene=SeqID_77492
gagtggagggtgacgaatcgcatgcgntgatacttcgacnnaatgtganncaacaaactttgaacgaggctgacttttcaacagtgacctgnagcgcggaaagaccaattttgggggagattgtctgtcaaagagaacataaccatctcccagcacctcagaaacaacaagtttgtttaaattaaaagaaatgttttgtattaaaggcagagtcaaagcggcagaaaataaaagaaagtgtcctggccgagccatg

SEQ ID NO: 104802 - DNA, 190 bp, Heterodera glycines
  Promoter: Source sequence=SeqID_42945; Location=706..895; Strand=-; Gene=SeqID_70736
cgccgctgtcaaaacgtacacatacaattaattagtaaaacgacagaattggaaaacccggaggttttattgcaatttataagtccaattaatcaaccaatgaattttttgggccgtaacttttgtcgtgtagaattatatagggattgttcgaatatgaaaaaaaagttatagtaaaaatccaattatg

SEQ ID NO: 104803 - DNA, 464 bp, Heterodera glycines
  Promoter: Source sequence=SeqID_1347; Location=5554..6017; Strand=+; Gene=SeqID_72953
ggcacaaatgccaacaaattcctatcccttttttcttttctttttctttcatttcatttctcactcagagagactgaataaaacattgtgcaatgtgacaacagttctttgtttttgttttttggatgaaattgtcaaatcattttttagttttcttttttaaattgcaatttattattttatattccccattttttgtcatatttttttgctggcaatgagcaggaacttcgccgctcttctccgtgtaacgtgtgaccggaagatggcacgtcgggccaacaaacagctgaaaagggtgtgcaagaaggcgcatgcgcaacacaaaaatgtaaatttaatgcttttgtgcacataactcgtacggtaatgaaattttgaaaacgaggcctatcccctaagctttgattcaaacaatcttttaaatttcgaaaattaagaaaacttatatacgagttgtcatg

SEQ ID NO: 104804 - DNA, 79 bp, Heterodera glycines
  Promoter: Source sequence=SeqID_12111; Location=1..79; Strand=+; Gene= SeqID_75672
ttaacaatttaattaataattttttaaaattggcgtttattaaacattgcatgagaatgcttctcaggtggccacaatg

SEQ ID NO: 104805 - DNA, 105 bp, Heterodera glycines
  Promoter: Source sequence=SeqID_10115; Location=593..697; Strand=-; Gene=SeqID_73197
ccttgaaaaattttttttttgcattaaatgacaagagttaagcattttttgtggcagcagtgaccattaaagggaaaatttttgaaaaaattttcagggaaaatg

SEQ ID NO: 104806 - DNA, 297 bp, Heterodera glycines
  Promoter: Source sequence=SeqID_4899; Location=1..297; Strand=+; Gene= SeqID_56139
taataaaatgatgtgatgaatgaagactgaatgtggaccagcaaaagtgagtgacaaaatgatggctatttatggacgatgctgagagatggtattgacacgaattgggtacagtaaatggcgtacatttgaatattgagtgatatacacaacatttacaaaaatttttttataagattttacaagttaaataagaacccatcattttgtctcagttttgattctccccccccccgcaaagacttgaccgatcccatcgttttctccataaatatccccgtgttcgcctcccatatg

SEQ ID NO: 104807 - DNA, 722 bp, Heterodera glycines
  misc_feature (11)..(11): n is a, c, g, or t
  Promoter: Source sequence=SeqID_21324; Location=817..1538; Strand=-; Gene=SeqID_51918
ccccccccccnactcactttcaattcaaccgctccaattttcttcttcgcttattttacaaaatgtccctacgggaattagatgaattaagaggaaaattaaaaataaacgaacatttcaatgatgactcatttaatgccattgctttccgcgtttagcccaattcgccgtttgacaaatattcccgcgacagttcgtcgcctcgccatgaccaaagtctgcatgacgcgccctttctgatgtcctcctccaccgctaatttccctcggtcctccgtccgcgacattcccatccaacgttccgcgtccgcgttcgccccaatgtttggcagagccgcgggcggcacggtgccgccgctgccctcctcgcggacgacaacggccgcaccaacggaatactaccgcaaagaggtgcggtggtttgccttggccctgttttcttgttgggtcacctcctccccatcgtaggtgctgacgcgcactctcgtcacgcgctcaaccgaggcgctcagtgcgccgcttccgcttggccgttcgtcccctgcggcgccttttctgacgttggaacagttgccaccgcagagggatgaaatgccagaggaatattggtaaggatgggggggatcgaggctggggcttaattagcaaagaatcaaaatttagatggggtaattatgcaaatgttggcactttttgtttccatgcgggtattttcctccaatg

SEQ ID NO: 104808 - DNA, 608 bp, Heterodera glycines
  Promoter: Source sequence=SeqID_18466; Location=1281..1888; Strand=-; Gene=SeqID_83066
ttaaaaaaatgtgatttatatggttggcaattaattatatggcagcaatccattattttttccctggacactgggagggtgtgaaaggcacgaaataaaaaaatagtttttatcttggttttaaatttaaaggattttatggccacatttttgcgattttatatccagatttttgccaaccctcgtggtatttaacaaaattttacaacgaaaaatgttaaaaaattgatcttctatttattaaaaaaataacgagtcaaaaaaaaaataaataacaattttttttagaggaagtgaaagatcaataaaatattttttaattttaatttttgtattgtttctttcttttgctgatttttttcaaaactctattttcatagatatacatttacatttccattaaaaattaattgaaatgttgatagaatgtcaagaaaaaataatgaattaattttaattatatttcaaaattttcaaattaatttttaaaataaaatcaaatatatacaacaacatataaacacacacttaccggttacatcatcaacacgcgacacgttggcactttcttggtgtccttggcccaaattggcggcggcggcaacatg

SEQ ID NO: 104809 - DNA, 986 bp, Heterodera glycines
  Promoter: Source sequence=SeqID_9934; Location=904..1889; Strand=+; Gene=SeqID_72969
tgattaagcatatcttcaaaatatttttttatatctaaaattagaagaaacgttctgatgagtcaaaattttgcattgcatttaaaaaaaaaatttttttataaaaattttttattttttcccgaaattgtccgcaaatgtccgtccgcaaatgtccgtccgcaaatgtcagtccgcaaatgtccgtccgcaaatgtctggacgcgctttattgtaggttttaagcagtcacaacgaaaatgaaattgataaaaggcatacaaaatataaaaataatttttaagaaaaaaaagctgatggagtgcgcttttctcatttttcttttctttctcgaaatgggcctaattcatagccaatgccacaattcatatgaattaaacatttaattcatgctttatttctatcgattatgattaattaccatgcttttttcatttttgaaaatttattctttttttttgtgtagtgtttggattaacattctattagtattaatattcataaatttaatgcaaattttaaaggctaaatggctcaaaatactttacgaaataagaaataatttaaaaaaatataatataaaatacaaatattaattttaagaaaattaatttgtatatgtaaaagtttagtatatttaaaaattattttttaaaatatttatatgaaatattttatattgcttttgttttcctttcctgcggttttggcagtattgccagtgattgaaagttcatctgcaacaattaactctacagaaccttcaaaaaaggaaaagcaaattttaaaaggtaaaaagaaagaaagatttaaaaatatatataaataagtttggctaaaaagtggcaacaaaattttaatggagtttagaattttaaaaataaactgccggtttttttggctattctccaacctcgggaattttctcagctcaaagcttttgtgatagtctctaattaattcataatttttaaaaattgaagatg

SEQ ID NO: 104810 - DNA, 272 bp, Heterodera glycines
  Promoter: Source sequence=SeqID_13473; Location=173..444; Strand=+; Gene=SeqID_77364
ttcgatgccgtttctttaattatcgctctttttatataattttacgattttcgctgctgcttttatggaattgactttccttgggcctattaattacctaattggggtgttgcgttctcaagtgtttttttgctcccatttttcaatttcccaattttttattggctgcgtttattgcataaatggtgccatgataatttgtccactgtttcaggttggacgtgcacaaatttcgcctctctcgcacccaaaagcgcgtgctgcgcacaatg

SEQ ID NO: 104811 - DNA, 1003 bp, Heterodera glycines
  Promoter: Source sequence=SeqID_2073; Location=2376..3378; Strand=-; Gene=SeqID_77688
agcgagagttaatgagagtagaacgaaagtggtcgtcggcgtgcgacgacatggcgaccacctgctgctgcctccccccactttctcccttcccatgtctgtggcacacactctctcctacgctttcctcttcaggaagcactctctctcgtccgtcttgtttctttcccccatttgtccctcccgttaaacgctatttccccaattttttcaatatctctgctcccacgatgtgcaattttggtcgcctaaaatgctacccatatgttttcgatggtgccggttccgtttccggaacccattttgctgttccggcatcgcttctcggccttttggctaagatcaaagtgtagtatctgttctttacggcttaatctccgtaacgacccctaccggggtcaaagagattaaccaatttttggaaaaaggtcgcagtagggggcttgccccctctcgaccgcgcgtcggcccggtattgcacttacctccgggagcggcgcatctcccccgcgggggagatcaaaagagcaaaagcattgggtgaagcaatgcaaatgccaggggattgattcttcacaattctgcctgacaattttcatttaaggggaaaacaaaatcccatcgatcgccaatcgtccatccgtcaaacttaaaagggaaaaccaaatcccatcgtccatccatccgtcgaaaaaccaaacactcgtgttgtgtgcggttccgctgggtgcggtttcatatccgacaaaaaaaccaaacactcgtgttgtgtgcggttccgctgtgtgcggtttatcttccaacaaattcatcaattcgttcgacactacgaaaaaaaagggtgactaaaaccccgaacttctctactttcttcaccgaaaactaattcggttttccatctcaatccgacttcacttcattaaggtctctctcggagagtcttatcttccaaaaaagggtagaatcccaattcatctatcggacgaaaaactaacccataatg

SEQ ID NO: 104812 - DNA, 54 bp, Heterodera glycines
  Promoter: Source sequence=SeqID_2589; Location=5602..5655; Strand=-; Gene=SeqID_80585
aaatcagaattgcgttttctgaattgcgtcttttccattttaggcattggcatg

SEQ ID NO: 104813 - DNA, 130 bp, Heterodera glycines
  Promoter: Source sequence=SeqID_9239; Location=1548..1677; Strand=+; Gene=SeqID_70718
ttgtcggcgcggtggcgcccaatgcgcgacgtcccaagagaaattcgtgcaaattatagcaaacgcggtactgaaatgggagaataacattgcttgttttgtcttgaaatcggttctcaaactttacatg

SEQ ID NO: 104814 - DNA, 77 bp, Heterodera glycines
  Promoter: Source sequence=SeqID_23850; Location=900..976; Strand=-; Gene=SeqID_54539
tgcaaggaaattcgagagtgctgctgaggacagcagaggtgaccatcttcaatccatgcaatccgaaaaaaatcatg

SEQ ID NO: 104815 - DNA, 430 bp, Heterodera glycines
  Promoter: Source sequence=SeqID_43665; Location=296..725; Strand=-; Gene=SeqID_71288
tcggtttcacgtcctctttaactctctcttcaaagtgctttgcaactttacctcacggtacttgttcgctatcggactcttggccgtatttagtcttagatgaagtttaccacctgatttgggctgcgatcccaaacaacccgactccaagacacgtaaagatgggtaggcaccgccagttggacaggtcttgcaccttctctggagccccggtcaagggaaacttgaacaagcgggccaacccaagctcacggtctatacgctacacctcgcaaccctagaggagctgcgattcagcgctggactcttcccagttcactcgccgttagtacgggaatcctcgttagtttcttttcctccgcttactgatatgcttaagttcagcgggtgttcacgtctgagttcaggtcgaaaaatcaaagcaggaatg

SEQ ID NO: 104816 - DNA, 519 bp, Heterodera glycines
  Promoter: Source sequence=SeqID_639; Location=1785..2303; Strand=-; Gene=SeqID_57914
cccccccaactcccaacattccatcgaatgtgtgcccccccccaggggagaatcgtccttctcctcctcctcctcctcttccttcgtcttcttcttcttccgctgctgcttcttcttcttctgctgttctcccgccgttttcacccgccccaacacattaaataataataattgatcatcatcatcatcatcatttagaattgtatttaatcattcgcatcacattttgcccactaaattaaaccacagcggaaattgcgtggcgtggcgctggcggggggggggggcgggaggggagaaacgggcccaaaattgggtgggaaagcaaagagttgaacccaggaaaaatctaaattcgtccgtccctatcaattaaaaaaagaataattaaaaggtaaatacactcactaattactaatgggtgacaattaaattttaggtaaaaaaaaactttatgttgcttatcggacaaagctgaaaaaacttagttaaactcgtcaatatttgtttttaattatg

SEQ ID NO: 104817 - DNA, 273 bp, Heterodera glycines
  Promoter: Source sequence=SeqID_26570; Location=1157..1429; Strand=-; Gene=SeqID_57308
aacatgtgaaatactaatgaatccgatttgttaaggttgaactgaacaaacacaaatttcatggccgcgatttatttctcaagcttgcaagaccgaaaactcgtggtggacctgccgagaaacgatttccgggtcatggtggcccccccaatatgttaggtcacgggtacggagctgcaggtggattcggtaaaaatgtcataattgaataaacgagatcaggcgcaattttctaaatacctagagcaaagaaatcatgcgccattgcaaatg

SEQ ID NO: 104818 - DNA, 732 bp, Heterodera glycines
  Promoter: Source sequence=SeqID_7871; Location=1..732; Strand=+; Gene= SeqID_66236
ttggcattgtgcttttacgcaacttttcgcaaattgggctttggaaaagtacgcgtggtggtgtgccctcgtcatcttcgccctttttgtggctgtttgtttgttgataattgttttccgcgaaatctcttcaccggatcctcaaatttgtcgttttcacaaaagtctgtgagtgttcaaactttggaagttttttcgcacttaaatctctcctcacttttcccataatatttacctaatttattttattatttatttttcatttttttattaaacattcaaatatccacataatatcacttcgtcttactttgctgatatttcaaaatctattttggtcccttttcgtgccttgattttattgtatacacgccattattgtattaaaattaaataaattccactgacaaatgatttatcttaattatctttccgtaaaatttatttaaaacatttttgggacggaagtggtcttgttttttggtcggcgggtggtaatttggcgaagttggttcccaaaaaagattgaaccaaccaatcataatttaaaaataattatatatggatgggaggccgggcatagaaaaataaaagctaaagcagagaaactggccaaacaccaaattttgttttgaaatgacgtgatttataaaaattctaacctttaaaaaggaccaaccgggctaatctttaatcttttaatagtcaactcatcaatttgcagtggttatg

SEQ ID NO: 104819 - DNA, 63 bp, Heterodera glycines
  Promoter: Source sequence=SeqID_398; Location=3290..3352; Strand=-; Gene=SeqID_51356
tagtggggaaaattcatgaaattcaaggacatttaaaatttttattatatgcaatgcaaaatg

SEQ ID NO: 104820 - DNA, 120 bp, Heterodera glycines
  misc_feature (28)..(28): n is a, c, g, or t
  Promoter: Source sequence=SeqID_30760; Location=1738..1857; Strand=-; Gene=SeqID_61155
atgattcagccacggtgatgatgcaccnacatgagggcagtgccgccgggggacggcccgtcgcggtgcttttgccgcaccagcaacaacagccacaactccacgacgacgaagacgatg

SEQ ID NO: 104821 - DNA, 192 bp, Heterodera glycines
  Promoter: Source sequence=SeqID_41112; Location=799..990; Strand=-; Gene=SeqID_69310
cctaaaaatatctcaatcaaatcaatttagcttaaatttgttaccaaattaaaaaaagttagtttggtatgctggtaacaaaagtacaataaaataaaaaataattaatgatagtgatccatacaaccataaataaataaatatgcaaaagtaaatgtggagtgacccataaaaccaaagtgatgagaaatg

SEQ ID NO: 104822 - DNA, 345 bp, Heterodera glycines
  Promoter: Source sequence=SeqID_22601; Location=1..345; Strand=+; Gene=SeqID_53267
gggtcataaaaagtttaaaaaataggtataaatccagcaaataaaattctaagtaaggatttagagtaatttaaaaatgtgggtgggcgctcgcgctatataaataagtgcgcgtgtccccatcggcccatttcaatttattcctgtcaaacatttggccatcagtttttcatgtcggataaaaaagcattgtttaagcgtgttatcgcagaggtggacctcactataagcacgggcggcataactttgagcggcccccgcctgtctgttccccgtttcattccgtttgaggaaaacgggcgttgccgagcatgtaaaggaactgaggctgaggtggacacaatg

SEQ ID NO: 104823 - DNA, 997 bp, Heterodera glycines
  Promoter: Source sequence=SeqID_21643; Location=651..1647; Strand=-; Gene=SeqID_52242
tttcggggtcgctgatcacgaatctgacatccatttctaccaaattcgaactccgaactcgtattcgagttattttcgcaccataaaagatatttttgaaaatttgaatttttgttcgaatatgggttattttggtctcccagtagaaaaatgcatgcttggcttatgtatagggttgtaaattatatggactaaaaaacccaaaatatggacataaaatatggactaaaaaagcacgaaatatggactaaaagctaaaaatagccaaatatggaccaaaatatggactaaaaactgccaaaatatgtgttttaaaccctcaaaaattccaaaaaaaggtgtatgaattcaatatttgcttaaataaatttaaaaaaaacaataaacaaccaaaaaatggatttaaaacataaaaatgcaaaaaaaaatttattgtcgtccattgtataaaaatattttcaagtttgccaaaattttaaaaaaattcttatttaaaaaaagaaaagttcgcaaaaaatgatgaaaagatttattaaaaatgccaaaatgacgacgaaaattcaaatttttcatattttttggactgtaatttttaaaatttccaaaaaatcaatctttagggggtgtatttttcccttttcttgcattttcttgtgaaattttgccaaaaatggccgaaatatggactaaaaacacaaaaatggctaaatatggatttattcccgaaaacccccaaaatatggatttatatggactaaaaaccttcagcaaaccaaaaaattttaacgcagaaatgccatttttgagcccctttctttatagcatatgcgcagaaaaaatatgttaatccatataatttacaaccctacttatgtatattgttttttgtaagatagtaaagggacaaagggtggattttttatattttctcgaccattatatgcataaacaaaattatgagtagtgatatttcagatgtccacgaataatcacaatg

SEQ ID NO: 104824 - DNA, 168 bp, Heterodera glycines
  Promoter: Source sequence=SeqID_23998; Location=248..415; Strand=-; Gene=SeqID_54699
accaaccaaccgatggcgcattccttttgaagacattggcactttccatttatttatttaaaaatattttgatatcacttataacatttgggttttatttagtttttacaaaatatatattatttttttaacaacttcgattaataattatttttaacagaaaaaatg

SEQ ID NO: 104825 - DNA, 255 bp, Heterodera glycines
  Promoter: Source sequence=SeqID_4511; Location=4259..4513; Strand=-; Gene=SeqID_54723
agtgcctattgaaaataaattttaaaaaaagaaaaagagaaaaagaaaattttgtaaaaattacgaccaaatttaactttaaattcaaaaaacttccattttttattatgaaattctgccaaaaaaattatcagtaaaaatacgattttttgcaaaattttatttacgaattttcttctaaaatttttctgaatagcgtagttttaactaaagcttacattgagattttgtgacccagtataaaggaaaacaatg

SEQ ID NO: 104826 - DNA, 199 bp, Heterodera glycines
  misc_feature (5)..(5): n is a, c, g, or t
  misc_feature (51)..(51): n is a, c, g, or t
  Promoter: Source sequence=SeqID_38529; Location=1..199; Strand=+; Gene=SeqID_67315
ttttntaattagttggtcatttgcgtttaatttatagttttattaaaattntgttgataattacctaatgttgaattttatttaaaatgtaattggaatggaagttttaattccgaatgctacattaactttaaacattaaaattgattgagaaaattatgctttaaataatcaaaattgggggggggcggcgcaaatg

SEQ ID NO: 104827 - DNA, 432 bp, Heterodera glycines
  Promoter: Source sequence=SeqID_23669; Location=1..432; Strand=+; Gene=SeqID_54365
tgttattttcttgtatttctaaatcccagagacattgcgctttcgtttgttaccaagaattttttttaattttaatcattttctcaacaaaaagcactaaaatttcaaaaatgtttcacgtcggcgcctatcggcaccgccgggtcaccattttagcatattttttttgaaatttggacataaaaatgacaaaataaaaaccgctagaaatgtctgtttttgctctacggcgctgaaatttttaaaataacactggacaagtaagaaaaaattatgtgccaagaaacttaggatggccactgattggacgcgtaattagaattgagccgaaatttgttaattttatatcaattagtgcactataattaattatcctcatagaaaattttcctttaatttgaaataatcaatttcaaagtgcaccccaaaatg

SEQ ID NO: 104828 - DNA, 750 bp, Heterodera glycines
  Promoter: Source sequence=SeqID_1981; Location=6777..7526; Strand=-; Gene=SeqID_77180
atttagcagaaaaaatgctgttctataattttctctttatttgattgtcatattttgtgcagaacaatccttgttaatttgaattcaatttaaaattgtttcgaatttaaaaattttggtcgagaaaaaagaaattttttgaaagattttcaaaaattttaaatcctaatgtatgcaacttttgttatatgggtatttttggaaatttctcagaaatacccaaatttggcttcaaattatgcttaaatttacttaatgaattttacatttaaatttattttttttattaactaaactttttctctaatttgtttagcctaatgcattgatagcttctaaaagaaattgcaaaaaaaattggagcaccaattttaagaaattaataatttaccttagaaacaaagtaataaaaaatgcttcccaaaaatgtattcaataaaaacaaatatagattttcgtcatttgtggcaccaaaaaatttaattcattttaacttcacaataataatttgaataatataaataatttaattttgcccataatcaattaactactttatttattttattaagtttgagtttattaaattattttagttgggaaataaatacaaatatttttattttcattcatttgtgaaggaaaaataaaattagcttaattggcaggttggagcttaattgacagtttgactttaaatcaaatttataattatcaaattacttctctttttctttcagaaaaagaatg

SEQ ID NO: 104829 - DNA, 782 bp, Heterodera glycines
  Promoter: Source sequence=SeqID_13246; Location=1142..1923; Strand=-; Gene=SeqID_77075
tccagagttcaggatcaaagataacctgcaaatttcatttgaaactggggatgacttttacaaatccaatttccagctttttttatatttgtgtcaaatttccccatttttttttgcagaggcaaaaaataaaatttgtgccaaaactgtcatatttttcaccattgaattaccaacaacaaattgttttcagtcactatcatcgggacaacgcacttcttttcgcgtctattttctgccagtcctcgagcagttcggcccgcaacgggaactgatcaaagtgcacacgtccgtcggcacatttgcccaccgcgtccagggcgagacgggcggaaacccgtaccggatacggtaacactaggattgagcagtattaactcattgcaaatatccgaatttggcttgagggtaacaaaaatttcttatccatccattcactttttgacacttttgctgtttggtcccccgaaaaatacataagaaaatgttcatgaatgaaaaatataccaaaatatgttgctttttaaatcataaaaaaacaaaagtgccattttttgttttgaatttttctttaggatttaaagtattttaaatttaaaaaattttcgaatttcccacaaaatggcttcttttcggtttatttggggctgaatttattgctagattacatatatccaccaaattgatgcccctaattaaggtcctttttgggcattcatcttcctctgaatgccactttttcggctccgctgagtctgcacaatccgcacacaaaaacgatg

SEQ ID NO: 104830 - DNA, 77 bp, Heterodera glycines
  Promoter: Source sequence=SeqID_24738; Location=861..937; Strand=-; Gene=SeqID_55480
tatgattccatttttaggcattaagctcaggctgaagaaggagaaaagggggtttttgtttttctcttccaaagatg

SEQ ID NO: 104831 - DNA, 239 bp, Heterodera glycines
  misc_feature (58)..(58): n is a, c, g, or t
  misc_feature (88)..(89): n is a, c, g, or t
  Promoter: Source sequence=SeqID_20159; Location=1874..2112; Strand=-; Gene=SeqID_84942
ttcggcccgaagtgtaccgaaacggcactcttttggcacagacaaatagaagacattncatgggcaagaaattttgccgatggtgttnnatgttacgatattacaaatgttatcctttaccatccttttacagaaattgtcttcgagcaaaaaaacttaataattgatttgcccgagttccaatcgatcaaacgcttaatgttcagctcattcaatgctgcgccgattccattaagatg

SEQ ID NO: 104832 - DNA, 186 bp, Heterodera glycines
  Promoter: Source sequence=SeqID_44161; Location=722..907; Strand=-; Gene=SeqID_71688
tcctgctcgaggaagagttcaccttctttcgggtctcgagcgcgatacgctctgtctccgccccatcgcgtgcgatcgagacgggactatgttgcgccccaacaccgcggtgccggggatcacacgtcgagctccgtaagaagccttcactttcattgcgcctttgggttttgaaccaccccaatg

SEQ ID NO: 104833 - DNA, 145 bp, Heterodera glycines
  Promoter: Source sequence=SeqID_38701; Location=1..145; Strand=+; Gene=SeqID_67432
aaaatgaatcaaaattaattttttatgatatttttttaaagttgaattaattaagaatgccacaaagtcagccgagtggaatgtgaccgaaagtcaaaaatcactccgacaaattcaaattggcgcaagtcgcagattggtcatg

SEQ ID NO: 104834 - DNA, 341 bp, Heterodera glycines
  Promoter: Source sequence=SeqID_343; Location=642..982; Strand=+; Gene=SeqID_83240
ttgacaaataaggcaaaaggcaaactaacagtcctccgaggctttagtttagccataaggcaaaaggcaaactaacagtcctccgaggctttagtttagccataaggcaaaaggcaaactaacagtcctccgaggctttagtttagccataaggcaaaaggcaaactaacagtcctccgaggctttagtttagccataaggcaaaaggcaaacaccttgtcctccgaggcaggtgtttagtcacaaaaggtccaggaccaaggccagactgatctcggaaaaagacacaaaacaacaagtgcaccacaacacacacacgcacaaccaaactgcacgcaatg

SEQ ID NO: 104835 - DNA, 690 bp, Heterodera glycines
  misc_feature (37)..(37): n is a, c, g, or t
  misc_feature (42)..(42): n is a, c, g, or t
  Promoter: Source sequence=SeqID_6132; Location=1..690; Strand=+; Gene= SeqID_60460
aaagacaaaaagcaaaagcagccgcacgtttttgatntaatntaaaaaataccaaaggaaaatgatactgtaggaaattcaaaataaaaatctgattttttcatactgtttttcgttaaattttggaaatctgtattgaaattacaaatggggatttaattcatggataaagttatattctttttattgtaatttttaaaatttgttcataaatttgtttacaaataaagagttctacctcacaaaaatatggatttgttttatacaatttaatacgaaaaatatttagtttttttgttattttctgtcgctctttaatttttaaagattaaatttaattttaaattaaaattaaaagaaaaaatgggggctactaaaaaccattaaaaaatttaatgttctctattatcctgaaaattaaggaagattatgaataattttttttcaaattttaaaaacttggaggcattccgacaactaggaactgaataagaaagtcactttttcaaatttcatgaaatatcctattatattttcccatctataaaaaatgggggtttaattttttatatatcttatataatttaatacaaaaaattgagttttaagttttgcttgttattttattttgcttttcatttttaagtttaaattaaaaaaagttgttactaaaagcgacaaaaaaagatg

SEQ ID NO: 104836 - DNA, 392 bp, Heterodera glycines
  Promoter: Source sequence=SeqID_17194; Location=1..392; Strand=+; Gene=SeqID_47423
gagagatgtttttttctctgcactctctatttattgtttcatgtctcgttttttgaaacggtgtgggtacctttacacacatcgattcaaaaaacaaagacgtatgtcaataaaaaagagggtgtgaagataaatacacctcagttgggtatttttttgtgatttttggataaaaaataaaaagatttatgccggggacgggctcgaacctccattccttttcctttactatacctatcttacaaaatccatcacgcagttatcttttttagtttgggggctgaaattaaataagtatgtatatgacggattataaaaccgaaaaaagtgattccagcttaattaaacaggataatcttatttatttttaatctctcatttgttctcgaatg

SEQ ID NO: 104837 - DNA, 1003 bp, Heterodera glycines
  Promoter: Source sequence=SeqID_19781; Location=567..1569; Strand=-; Gene=SeqID_84519
gcagcgccgcgggaaggtcatcaatcatccgtctgtcaccaaagtgacaggtgaaggaaattcaatttttcttttgcaaatttaaatcttttgatcccaaaccttttgggcggttttattttctcaaatcctgagatttttatgacggtttctctaatcctgaaattaaaaattcattattgaaaatgtgccaaaacagtgcggggtttttttgcatttcctccccgctcgccccgcgccgcgatgccgccgccgcgaaaaaaaaatcgataacggaatttggaagaagtgcaaattaattgaaatgactgcaaacaatatcaattataaattggacaataaaattaatcatttaaattgtgtttaaaaataaaaatcgaaaatgaataaataaatcgggatgaaaaaccttttcaaaagtaggtcacctgtcaaccaaaattgattgatgtgtttttatttctcttccattatttcgcaatctgcacgtgacttttgttccaattatttcgcagtgtggcccattaattaggtcaactgtcaataaaatgggattgattggtttcttattgaaatttctccatatttttagttttgggtccaactatttcgcaatatggcccgtaattttgcaaacctgtcaaaaaaaaaatgattgatgactttcgaaataaggaatatccaaacgatttttgcacggttttgaataaaatgagacagctgtctaccgaaatgattgatgaccccctaaattaaggcaaccccagacagtcacgtgactagatccctccccctttttgcctatttcgcacacccggcccaaatcgcaaatcattcaactaaatagttggatttcattaaactctcttcacgctctaattttatttctctccgctctatttttatttgcattaattaaatctattactatttacctacgtctttttcttttcaaatctctgctctctttaattcttctgtttcaatttcttgttttaaaatg

SEQ ID NO: 104838 - DNA, 100 bp, Heterodera glycines
  Promoter: Source sequence=SeqID_13563; Location=1393..1492; Strand=-; Gene=SeqID_77467
tttttgcaccatttccctgaattttaattcacatggattctttaccaaagcacatattattttgtcagacagcggccgaactttttacaaaggggctatg

SEQ ID NO: 104839 - DNA, 596 bp, Heterodera glycines
  Promoter: Source sequence=SeqID_2678; Location=2947..3542; Strand=+; Gene=SeqID_81040
actgggatcgggaggattgggggagaacgacgagggctgccaggaaaggaagggggtcaagacgtgaatgggcgcctccgtttggccccgcacgagaatttgccgaatgtgatggagtgtggagggtgcttttccctcctttccgaatcctccaagccgtttcagcacgaatttattaaagcaaaacgaataatgaataaaagcgacgaattgatcgaattgggcgatgggacgggggaattggaggaattggtcacaggcagaccgaatatgaagcgaaggggagtggaagcaagagaagagaagagaagagaagagagcgaccccttggccgggggcgcttaaatagacaattttcgaagggggcgggcaaaaggccatgcacttagacaaattgtgagagagacaaaaaatggacagaaaattctagaagcgaattgcgaacaaaggaaatgggcgcacaaaaattgaatgtgaaatggcagatgtaaaaagtgagaaattgtgaaaggaaatctgagcacaaagttggccgaagatgagccaaccgatgagaaaagatttgaattgtgaagggatgcgatggggcaaaaatg

SEQ ID NO: 104840 - DNA, 63 bp, Heterodera glycines
  Promoter: Source sequence=SeqID_36524; Location=1..63; Strand=+; Gene= SeqID_65811
aataaaaataatgaaagaaataattcggaaaattttggcaaaaatgttgaatatttagccatg

SEQ ID NO: 104841 - DNA, 416 bp, Heterodera glycines
  misc_feature (32)..(32): n is a, c, g, or t
  Promoter: Source sequence=SeqID_29963; Location=617..1032; Strand=-; Gene=SeqID_60431
ggcattcattctttttttaacggacaaattcnttcgccaaacattttttctgcacatttttttttgcgatggcttttcgtctcccatcatttttctcttcttcttttgctgcttctgatcaaatttttacatcattttttttatcacctctgtctgatcagcccgcttctttttgtttgatcacggataagtccagcacatcgccaaatgtgctatttttaaaacagccgttaacccctgtcccgcccgccgctttgttcctctttttccaagccgaagttggttggggcttcatcatttttaaaagcagcagagtgtgaaatgcaaacttaaaatttcaaaatcttcattttcaatatattttatgagaaagtttggaatttatatgatatattaataatttttagccaaaaatg

SEQ ID NO: 104842 - DNA, 645 bp, Heterodera glycines
  misc_feature (50)..(50): n is a, c, g, or t
  Promoter: Source sequence=SeqID_18099; Location=1..645; Strand=+; Gene=SeqID_82685
ggactaaaaaagcccgaaatatggactaaaaaggccaaaaatggaccaanatatggataaaaaatgccaaaatatatgttgtaacccccaaaaatcccaaaaaaggtgtgcatatttaatatttgcttaaataaacctaaaaagtacaataaacaaccaaaaaatggggtttaaaacttaaaaatgcatattttttattgttgttcgttgtatcaaaaacacctccaagtttgccaaatttcgaaaaaattctcattaaaaaaaagaaatgttcgcaaaaaaatgacgaaaatatttattgaaaatgccaaaatgacgacgaaaactcaaatttttcgtgttttgtggggtgtaatttttaaaaatttccaaaaagttgatctttaggggtgtatttttcgtttttttttcatttttcttgtgaaaatttccaaaaaatggccaaaatatggactaaaaacccaaaaatggcgaaatatggatttattcccgaaaacccccaaaatatggatttatatggactaaaaaccttcaccaaatcaaaaaattttaacgcagaaatgctatttttaagcccctttcttcatagcatatgcgcagaaaaaatatgttaatccatataatttacaacccttattaataatg

SEQ ID NO: 104843 - DNA, 150 bp, Heterodera glycines
  Promoter: Source sequence=SeqID_12313; Location=437..586; Strand=+; Gene=SeqID_75908
ttttagagggattacataaagttgcaaattggacactcattttatactcaaaaacttggccacgcccatccaaattcaaatttgactccacccatttttcaagcaaatttaaattaccatcccgaatcccaattcatttttgccaaaatg

SEQ ID NO: 104844 - DNA, 124 bp, Heterodera glycines
  Promoter: Source sequence=SeqID_13013; Location=2398..2521; Strand=-; Gene=SeqID_76788
acaactgattattaaaatgcaaatgttttcaagaatatatatgtatttatttttattatttttcaatattattaaaaattctaaattttctattttttcaatttttccgagtgccacctgtatg

SEQ ID NO: 104845 - DNA, 250 bp, Heterodera glycines
  Promoter: Source sequence=SeqID_15481; Location=1599..1848; Strand=-; Gene=SeqID_79756
ttgaagttgttgcgccgggcacgtccgcttcgtgtgtgatgaagtgttgtagacgatggacgataataataataatataatatgagggcgatgaagtgaattgtgaggaaaagtgaggaaatgtcgcccttttatacaactttttttcccttaatttcggaatttttttgcttgtctatataaaggcgagcattgcaaaattttctctcattcattgcgtccgttcacatttttaaattcttctattatg

SEQ ID NO: 104846 - DNA, 1003 bp, Heterodera glycines
  Promoter: Source sequence=SeqID_14566; Location=898..1900; Strand=+; Gene=SeqID_47215
taaaatatgcactaaaagtcccccaaataagccctaaaaacccgaaaaatgcccaaatatgcactaaaacatgccttaataaactgcaaaaatggcttttaaccctcaaaaaatgccaaaaattgtgtataaattaagaattgcttttaaaacaccaaaacaagggctaaggagcatttttttagacaattgcaaaaatatttaatttccaaatttataatatatgctaaaacaaaattacatttttatatacataaatttttttcccaaaagttctgacagtttaatttttttcgatttttaagggtgtatggacaaatatatatttattctcgaaaactccctaaatatgcttttatatgcactaaaaaccttcaccaaatcaaaaaatttttgatttccggctcctttacagccgagaaaaaatgaaaaaatttttcaagttattagtccaaatttacagaaaatttgctaattttactgaatattttgccaattttatttgattttggactgaattcttaaaaacatttatattagaattttaaaaaatatgcataaaataataaattttatcattttatgctgttttaaaaatgaaaaacaaaatttgaaagtgggggggggcgcctcacaaaattgggtcgtcgtcgcacagaagcagcgggcgaagatgcggtgggtgttgacgttgaaatagaataggtattggagaacagtggtgaaagtgatgaactcaaccaaataggcagaaggttgaaattagtgaggaatttgcggagatttgttgcttttatattgccttttttggaatgaatttctttaagtgaattcacctctataaaaggcgttgaattttgcaaaaactttcattgccttaccctaattaattaactattataattctctctatatcgtcgtcgccgtcaacctcaatttgaggtgttttcactccattcataattttttaatctccgtttttcttacagcagtcatcacgatg

SEQ ID NO: 104847 - DNA, 227 bp, Heterodera glycines
  Promoter: Source sequence=SeqID_1317; Location=3209..3435; Strand=-; Gene=SeqID_72420
tgcaggtcttgatgcagtcatatctcagggtttcaataggtgaggaacttatcattagttgcaatttgacatgtatcacatcgacagatgattttcttttcggctttccttgcctttcctccatcagaagagcgtcgacggcgactcaaatgggtcggttccttccctttgatgtcccatcccaaatattaaattttcgaagcaatttgacattttctttcaaaatg

SEQ ID NO: 104848 - DNA, 188 bp, Heterodera glycines
  misc_feature (135)..(135): n is a, c, g, or t
  Promoter: Source sequence=SeqID_29716; Location=1..188; Strand=+; Gene=SeqID_60186
ggaacagtccatcaaaaattcacagtacgactccccgagactttggaattggcacaaattggtcagtagctctctcatcaattatttacccctactcattcaccgcactcggtataacgggtcaagagtttatanaagtatgggaaaacgacagcagtgtcccgactcaagtttatttaccggacatg

SEQ ID NO: 104849 - DNA, 338 bp, Heterodera glycines
  misc_feature (14)..(14): n is a, c, g, or t
  Promoter: Source sequence=SeqID_34837; Location=809..1146; Strand=-; Gene=SeqID_64534
attccccccccccncccctcaacatgtgttgttcgttcatccatttccattctcccccaaatgccttatggcgctgaaacgaatgaaaccgaagggggcaaatggcgccattttttcactttgaagcatttcacacagtcaaacaaacacatgttataaaacagagaaggaaaggtgccaagatgggcgcttaaaatccaatccgaagaagaaaatttgccgatttgcgtttagccaaaaagtgaggagtcatttttcgacgatttgaattttcattgaatattatgccatcaatgcattcattttattttaatgttaagggaatatttcttgaaatg

SEQ ID NO: 104850 - DNA, 74 bp, Heterodera glycines
  Promoter: Source sequence=SeqID_10723; Location=1..74; Strand=+; Gene= SeqID_73970
tcagctcactgactagtccaacttaagcaatcagagattttttatggataaatttttgccagtttcagctcatg

SEQ ID NO: 104851 - DNA, 646 bp, Heterodera glycines
  Promoter: Source sequence=SeqID_16913; Location=725..1370; Strand=-; Gene=SeqID_81342
ttagcaaaaataaaataaacaaacgcttcaaaacccgggttccattaataacttaaacgttaatttttatattttatgaatatttacacaaaaaattactcgacaaaattcggatttgcttgtcaaatttagcactttcttccgaataaaatttgttcaaatatttttccattgtttcttcgctcaaaacatttggcaaatttttcctgtccggtatcgaaacgaaagaaatgtccacgtcaaagccaccaaatttcaatttgagcattggcactgtgccgtaattgatcttcactatgccactcacattttcattctaaattcttttttgtaattgatcatttggcattaagaatctttctagtatgtatatatgctcaataatgtggagagacgaagttacaaaaattatcatgaaagaaatattaaatttaattattattatttatgtgaaatattttacttaaaatatctttcttaataaaattattattttcaaaaagcattttatgcatttggcaagaactcaaaccaaatttacgctacttccaatttttgagtcaattttttgaatttctgacattctccgcaaaaattcggtactcaaattcgaatttcgttttcttttttcacctcacaaagaatg

SEQ ID NO: 104852 - DNA, 335 bp, Heterodera glycines
  Promoter: Source sequence=SeqID_6400; Location=918..1252; Strand=-; Gene=SeqID_61412
ccgtgactttgcctccaccatccgtttttcgtgtttccttcacttttgcatttttcctgtgccttttgggtactaattttcttggtagtaaaatttaatcgggaaagaatgacaagacgaacaacatggtttttatttttgaaaattttgcatttgaagctgacatcggtttttcatgtttcattttctttcctttttatatcttttacttttcgtgtttcattttctgtctttgtttcgttgcattttccctgtgccattttattataaaagcaccgccaactccactctttccctccattcacttctctttcattaacagtgccgctgaaatg

SEQ ID NO: 104853 - DNA, 1003 bp, Heterodera glycines
  Promoter: Source sequence=SeqID_11937; Location=554..1556; Strand=-; Gene=SeqID_75458
tcgttataaactaaatcccattgtatgaattaactttgtactaattgcgatgaattgccatgattgggtacggtactaaggaaatgtatttagtgctgctgatcaagtttgatttggaaaaggctctcggaagtccttttggttaatttaattttctattatcatacataaatggaaattaacaaaaaaaaataataataattagggatgtcaaaaatatgtacaaaaattggtcaaaatatgtacataaatatgtaaaaaaatcacgaaatatgtaagaaaatgtataaaaatccaaaatatgtacgaaaatatgtataagttggcacaaaatggcagaaaataacctaaataggtttagaatcaccttttaacatctaaaaaattatttttgatattttttagggtgcatttaaaaaaaaaaagtttttttattttttcacaagaaatttcgaaaaaattttcaaaaattctcaaaatatgtataaaaaaatataaaaatttgtcgaaattttggcttttttttgaggatcttcaaaattttcataaaaaaatcctcaaaatatgtaaaaaaaatgaaaatatgtaagaaaaagtccaaatatgtaccaaatatgtataaaatctcgaaatatgtaaaaaatgtataaaaccccgaaatatgtaaaaataagtaaataaaagtcccaacttttgttcgcaaacacaaaaaagaaagtgtttttcctactatttagcacatggagaagccaggaaaaaaatatgtatttacataaaattgacatccctaataataattcataattcgtatgaaaatcaattggcaaaaaccggatataatatatgcttcctgtttatggataatattaatattttatttttcatccataaacaaatgacgtcaattaattaattatccccaaggtatatttcccatataaaaagcaattaatttttgaaaagttatcacaaaaatttattctcatatttccgattaattatg

SEQ ID NO: 104854 - DNA, 189 bp, Heterodera glycines
  misc_feature (22)..(22): n is a, c, g, or t
  misc_feature (122)..(122): n is a, c, g, or t
  misc_feature (155)..(155): n is a, c, g, or t
  misc_feature (161)..(161): n is a, c, g, or t
  Promoter: Source sequence=SeqID_31865; Location=1..189; Strand=+; Gene=SeqID_62177
actgcgagagttggtcaacatnttcaaggcccagttcgatcggggcctagcggcgatcggggtcaaagcgccggaagctgcacgactacgttgtatgatgctttcaccgtgcccactcccgnccagcaacgagatgtttggggcttcgatcgcanccgccncccagccgaactgcttcaaatcgcgatg

SEQ ID NO: 104855 - DNA, 611 bp, Heterodera glycines
  Promoter: Source sequence=SeqID_10670; Location=1..611; Strand=+; Gene=SeqID_73917
aaagataaaaagttatggctcattgacagaatcgaggtttttaattatttccacaacaaagggtgggtgggaaagtgtgacaaaaatgactcagagaaattgaataacaaaaaccaatcgatatcttgtcgtacgtaaagaaatatttgatcgaaaaatgtaaaatttgttttttagttaataaagggaataatttattttaaatcttttgttttattttgtttttaaatgaattattattatatgcatccaatttttaaatctagttttgcttaaataaatctaaagaatttcttatttattatttaaactaaaaaaattaatttaaaaaatacatttagatattcattattaataaaacaaaaactattttaaattatttaaaacactgaaaataacacaaaaataaatagaaaaaaatgtacaccgtccggattcgaacttgcccctagcacataaaatagtgatgagaataggtacaaaagtgattagaagacgtacaaaagtgatgagaagagttaaatagtgatgagaagaggtacaaaagtgattagaaaaggtacaaaagtgatgagaagagttaaatagtgatgagaagtggtacaaaaatg

SEQ ID NO: 104856 - DNA, 599 bp, Heterodera glycines
  Promoter: Source sequence=SeqID_23069; Location=1808..2406; Strand=-; Gene=SeqID_53770
tgacctaattttaagccaaaaattaagcaaaaataaatttattcactggttgcagttgcaaatgagctacatttcctttataaagttctctttagcaaatattgacattttttaaatcaaaaattttgtcaagaaaaaaaatttgggggaaaaatttttgaaaaaattttccaattcttagtggtgtattttttttgaaattttttagatcgtttcttaggggtttatttttttgaaatttttttaaatcgattcttaggggtgtattttttgattttattgcatttttgctaataaaatctctgaaaaatgtcgaatagtgaaaaaaatagcgataaaatgccaaaatagtgaatttcaactattttagtgacgaaaggccaaaatagtgatttctagtgacccatagtgacatcagaatcaaaaaattttaatgcaaaaatgcgttttttgagctcctttcttcaaatcaattgagcaaaaaaaaaaaaatagtttttcactaaaaatagcggccctactcataactaagccgcaaaaaaatatgttaaaacataaaaatccgggctctactggtaaatgtttgccttttgcgaatg

SEQ ID NO: 104857 - DNA, 569 bp, Heterodera glycines
  Promoter: Source sequence=SeqID_45300; Location=341..909; Strand=+; Gene=SeqID_72626
ttcgaatgttttgtgttcaaggtttctgcagttcgcactaattatcgcagttggctgcgttcttcatcgatccacgagccgagtgatccaccgataagactagaattcattcttcaacagaagtgtaaaaaaaaataatgaaaaaaaaagaaaaagctggcggtgcccgagctgacactcattgagtcttaagccacgtgctaggccaagcacgggcactaccgcgtcgtctcatcacggccacggacgtagcagcaagcacaaacacaccgctagttacggcacgtaagaccgggaacgaaaccaccatccccagtcagtgtgttatgtgcctgccacaacaaccgctcaacgacgcacagacgccagcacagccgttaggtcgccccacgagcgtgcatcccacattggcgcagcgaaccagccaagcgaggcggcccgccaccgacacattgccacgcagcagccatacacaggctttcacatgtgcagcactgagcggtataccacagctccaacgtatggaagcaccccaaaagcatggctcgtgaggcagctgccccgtaatg

SEQ ID NO: 104858 - DNA, 582 bp, Heterodera glycines
  Promoter: Source sequence=SeqID_31041; Location=1..582; Strand=+; Gene=SeqID_61407
gcgcatcggctcggggggactgccccgaaaacaaaaaaatcgattttttcaagtgtccgtttggggtactcaagcaattatggggagcaaaaatccaacgcagaattaaagtacaggctatagggaagctattcccgaaggattcggtctccccataaatctgggcgcatcggttcagggggactgccccgaaaacccaaaaaaaaatttttttggataaaaattatttaaatgaactgactagataatatttaaaataggttattactcttcctttcagtatccctgcaaagtttggtgcgcttctgatcagtttctgaaaaaaaagttaagcctaaactttttggcctgtttaaaaaggaattaaaaattttattcatctccctttttgatagaaaaagcatcagagtgcctaaactaacctgtaaataaagttttgtgtgtttcagagcactttctgaaaaaatacttatgaattaattttgcaaaaaataaataattaatgaaaaagtcagaatttcgaaaaattttaaaaacaacaagcgttggcattttttcaggttaagttagtcctttacaatg

SEQ ID NO: 104859 - DNA, 761 bp, Heterodera glycines
  Promoter: Source sequence=SeqID_22152; Location=353..1113; Strand=+; Gene=SeqID_52806
aaaaaatcaaaaaattttcatattttcagtgatttttgtaaaaatttttgaaacttagtaatagtcataaaacttggtaaaattgttagagaaattgaaatcttataaaaaatttgttaaaaaaatttttttttttgaaaaatttttggtttttccaaatgttccggggatgaagaaacaatgatgtgggggggggggggggggggataaacgagctgctcccggtttttcagtacctaagagagtggagactgatcagtgatcattttcatttattgaccagaggttagtgactgatcagtacactgatcagatataattgccgaaaataatgctgtccggactaagtgaacgaaaacaaataaatttcaattggttatgtttgagaaacaaataaagtttaaattgattaggtcaaaaaaaaatcttattaaaactaaatcactatatatgcacattgatcagcagaaactttgcttgatcagggaactgaatttttgaattgtttgtgacagggctaaggtgccgaagagtccattaatgacatcatcttacaagcatcgcaaagtgtccaagagtcaggaacggcacatcacttcaaacaatcactatggactgatcgattttcgcaagagattggaaagggttggcatttttctaaaaaacaaagatgccaaaatttgcaagtgccaaaatgagtttttgggaagcaggtcaggaaactcgagcgaaccgaaggggacgagggaaagtcaaaaatg

SEQ ID NO: 104860 - DNA, 304 bp, Heterodera glycines
  Promoter: Source sequence=SeqID_8687; Location=4442..4745; Strand=-; Gene=SeqID_68855
agaaaatctctcatcagattttgggtcatcattttgctgaaataaaaatcaaatgggaatattgggggataagcaaaatccaattcaaatttgtttcttttttgggtcaccgttttgccgtgaattattattttatgtgctcgccgccgtccatcataaatataagtgaaccatcccatctttcttcatttaactcttctggtgcattttttacaaaataatacaataattattcttttatgaattcataaatttgacttttgtgattattagcccctaaaaggaacctcgggaatccaatatg

SEQ ID NO: 104861 - DNA, 177 bp, Heterodera glycines
  Promoter: Source sequence=SeqID_35557; Location=703..879; Strand=-; Gene=SeqID_65098
aaatttagctccggttagacctcgtttttccaaaattcccggttccgactaacaccaattttaacctttaaatatcattttaactttggatctatttatattttcattttatggtttcccatttttcttttccttaaataaatttcaatacttatttttagtactaaagaaaatatg

SEQ ID NO: 104862 - DNA, 225 bp, Heterodera glycines
  Promoter: Source sequence=SeqID_9514; Location=1..225; Strand=+; Gene= SeqID_46771
tctaattggtgggcgggcacctggataattttgaaatttaaaaattgagaaactcgctaatataaattttttgaaatttctattttcaaaaaaagggcccatcatctaagtattaccaaaactcaatttttttgactcttccaaactacaaaatgccttaaatattacatgtctcattaaataatattgcctctttaggtttattatttataaatttataaaatg

SEQ ID NO: 104863 - DNA, 187 bp, Heterodera glycines
  Promoter: Source sequence=SeqID_6089; Location=1..187; Strand=+; Gene= SeqID_60299
cctctagagtctttcaataaaaacaatttatttttttcattaaattactcatataaagctacgctgataaaggaagaaaaaaaagaaaaaactttaaaaaaaaaatgctttttctatatttaattctatgttcgattcataaattgttatgaattttaaattttcagataaattcagctgtttgatg

SEQ ID NO: 104864 - DNA, 215 bp, Heterodera glycines
  Promoter: Source sequence=SeqID_32; Location=2419..2633; Strand=+; Gene=SeqID_50795
agtgagtttaggaatgcatgcccaaccagggactaggatttcaatgtagggaggcataacgattttctcgtcctctgtttaattttataaaactaaactttgatcaggaagcggccattggacaggcaccagaaactgtggaactacagaacgtgaccattgggtcacaccttcccgcgcaacaaggcgaggaatgggaaattgggccacacatg

SEQ ID NO: 104865 - DNA, 73 bp, Heterodera glycines
  Promoter: Source sequence=SeqID_11265; Location=1..73; Strand=+; Gene= SeqID_74633
gcatatatttaaacatttatcttgattttctaacccaatttcagcccaattgaatctgaacgaaacaaaaatg

SEQ ID NO: 104866 - DNA, 132 bp, Heterodera glycines
  Promoter: Source sequence=SeqID_5585; Location=1132..1263; Strand=+; Gene=SeqID_58558
ttcttccgccaccacttcctcaaccattcaccacaatcatccgcttggttgctgttttgctgcggttgttccacatttattgtccatcattttctacctctacccccgcggctccctgaaaaacataaaatg

SEQ ID NO: 104867 - DNA, 69 bp, Heterodera glycines
  Promoter: Source sequence=SeqID_13986; Location=777..845; Strand=-; Gene=SeqID_77946
tggaactaattacggtaaatttgcttacgactgttctccacccttctgtcgtcctttgtccacacaatg

SEQ ID NO: 104868 - DNA, 78 bp, Heterodera glycines
  Promoter: Source sequence=SeqID_33004; Location=776..853; Strand=-; Gene=SeqID_63203
tcatagaatattcgattcacagaaattgacgacgctcgaaatccgactttgttccgcgagaaggtgtccaatgggatg

SEQ ID NO: 104869 - DNA, 91 bp, Heterodera glycines; identical to SEQ ID NO: 100405
  Promoter: Source sequence=SeqID_42222; Location=648..738; Strand=-; Gene=SeqID_70170

SEQ ID NO: 104870 - DNA, 175 bp, Heterodera glycines
  Promoter: Source sequence=SeqID_3445; Location=1..175; Strand=+; Gene= SeqID_84715
ttatgaatgaacacaataacaaaacgaattaaatcaggatcatcaacaaaataatacagtaaacgcattggacacacaaaatgatcagtacggtgttgtgaagaagcgcacacattcaattgatcttggaaccccccggaagaaatcaaacattttaagttgccaaaattacatg

SEQ ID NO: 104871 - DNA, 530 bp, Heterodera glycines
  misc_feature (155)..(155): n is a, c, g, or t
  Promoter: Source sequence=SeqID_7174; Location=1071..1600; Strand=-; Gene=SeqID_64043
aaaaaaaaacgaaaaaatacaccccctaaagatcaactttttggaaatttttaaaaattacaccccacaaaacacgaaaaatttgagttttcgtcgtcattttggcattttcaataaatattttcgtcatttttttgcgaacatttctttttttntaatgagaattttttcgaaatttggcaaacttggaggtgtttttgatacaacgaacaacaataaaaaatatgcatttttaagttttaaaccccattttttggttgtttattgtactttttaggtttatttaagcaaatattaaatatgcacaccttttttgggatttttgggggtttacaacatatattttggcattttttatccatattttggtccatatttggccatttttggcctttttagtccatatttcgggcttttttagtccatatttaatgtccatatttcgcgttttttagtccatataatttacaaccctattaattagttttttaacatactgtttggatggattatcatcaagaaagataatg

SEQ ID NO: 104872 - DNA, 1003 bp, Heterodera glycines
  Promoter: Source sequence=SeqID_6972; Location=1020..2022; Strand=-; Gene=SeqID_63444
aattactaatatcaatccacgtttttaaaataaagaaattaaattaagtagagttttcatctgcgttaatgctttgtttgaaatgcccaccttccttcccttcacgtgaaatcattgtcacccactcattttggcccatatttaagcccgtccgaattctccccaatcatcattcgcttatcaccatcatttgggaggaaaactcctaattcctctttcctctcccccaatcgatcattttgttgtaaaaattgtatttttacattttttgtttttgttgtaaatttggcttaattacccaagttggagcttgaccagttaattgtactgttgctgtgaattctttcaatttgtggtaattgacctacgccgagaaccaccgtcccgaccccactcaaaacaaaaactaccgtcttttggttattttcggcagcctcgctccccgacagtcataacttttttttctttgtcatccaaatccaacaatcttggcatgattctaaagcttaacatgtttagaagccatttctaagattgcttcgtgattagacaattgcttaaaaagttatagcatgaaaaatgcggaaactaataactttttgatattctagaaaatttttttgctttttgtaaggctaatatagcatgtgaagagctgtcgaatgatatgaacaatattggatttgaaggacaaagaaaaaagtttagccaaaaaattctatgtccaaccgtgagggcccaactgacgggttccgattgaaaagtttttaacaaacaaaaatataatacataggcataatttcaaaatttaggcaataaaattaattaataattatttttttttatttcaaaatatttcatttaattttttgaatttttttataaaaattccctcaccaaaaaggaatttttaatttaaattcagtgtttcttttttgacccttccattctttcattgttccttcactttcatttttgaaaatttaaaaataatagaaatatg

SEQ ID NO: 104873 - DNA, 144 bp, Heterodera glycines
  Promoter: Source sequence=SeqID_42709; Location=795..938; Strand=-; Gene=SeqID_70535
tcaagacttcaaattaataatcaaaaatctcttaaaatttttttaacccaattcaaaaaaggaaaaaaatttgcagtcaaaaaattattcgaatttctccaattttgtttccataatttccgaaagttattcggtatcataatg

SEQ ID NO: 104874 - DNA, 279 bp, Heterodera glycines
  Promoter: Source sequence=SeqID_19840; Location=438..716; Strand=-; Gene=SeqID_84594
ttccgtcctgcaaaaattttgaatttcaatcccgctgcgggattgcacatgtgaaatttccgtactctaatattaaccagttaattactccttttatttatgtgttttcccaaaaggaattatcccccccccctccctccacctctacacaatcatttaatttctacaaatatttgtcttttctatgataacacaacaatccccttttacattctaccaattaaattagattattaatatttattgtttaattgttattttaatatttatcaaaacatg

SEQ ID NO: 104875 - DNA, 403 bp, Heterodera glycines
  Promoter: Source sequence=SeqID_3996; Location=4668..5070; Strand=-; Gene=SeqID_52742
ttcgacataaaaatttgaccaaatcccacccatgaaaacggagaaaattactaaaatcccattactgaatttgaaacgttttttacttacattttgaaaattttggtaaaagttcattttgtcatacaaacaaggctcaatatttgctgttggaaatgctaaaaaaatattggaaatgtattaaatatttaactgttaataaacatgaaaacaattaattcaaaaaataaagagtaaaatgaacagtaaaaatgctttggcggtacacaaaatttgctttttatataaacacaattcgcaccgacaaaacacggtgagaaaaaattgtgttttagaagaaaaatgggatataaaaggcgatgcttccgacaaaacgaaacattcgcaactcaattctcaaatg

SEQ ID NO: 104876 - DNA, 119 bp, Heterodera glycines
  Promoter: Source sequence=SeqID_8280; Location=566..684; Strand=+; Gene=SeqID_67559
aatccaaacggggaatattctgtttacaaatgagactcactgttcttttttcgacttttcccgtttcttttgttttttatcactctctccccccattttaggtttatgagaaggaaatg

SEQ ID NO: 104877 - DNA, 94 bp, Heterodera glycines
  Promoter: Source sequence=SeqID_20278; Location=74..167; Strand=+; Gene=SeqID_85079
ggtgagggagaaaatggaaaaaaggagagattaattggaattatgatggtgccatctgtttcaggtagaacactcggaattccactcgattatg

SEQ ID NO: 104878 - DNA, 262 bp, Heterodera glycines
  misc_feature (57)..(57): n is a, c, g, or t
  Promoter: Source sequence=SeqID_7914; Location=3058..3319; Strand=-; Gene=SeqID_66361
aataatttatgcgatttctttcacattttgtcatttttctcgtgatgactccgccanataaaaggaataataattatatgatgattttaatactcacattataatatttctttataaatatttaacatttttcactttcatttggtcccattttttaaattccataaaaatattttgcctatttaatggttttgcttttcaattaattttcatttaattaatcattttttccctcctcattacgccttccttcttccctatg

SEQ ID NO: 104879 - DNA, 1003 bp, Heterodera glycines
  Promoter: Source sequence=SeqID_1273; Location=1974..2976; Strand=-; Gene=SeqID_71241
catttgataaaacaaaacagatagaaggcctgatctaatatgttcaaaaattgtatttcatttaaatcgagtccgggcttcgcaattgtcaagatgaatacaatattcgtgattagcgactcagaaaactgacgaatacatattttcatttattcaaacatagacaaaatttaaaaacctgaccctggcgccaaaacgtgggcgccaaaacgtcggcgccaaaacgaccttggcgccaaaacgtcggcgccaaaacgtgggcgccaaaacgaccccgactcaattgctgctgtttgtagcatgttgcataacaacgtaattgtttgtaatgcactattaccaagaaatgttggctccattgcagttcacacggccataaaaaaataatttgacaattttaatgcagcaaactttttcttgaagcatccaaattaaacattcttggtatcattctatagccccaagagtcctctattaatttgcaaaattaaaaaaaaaaattgctgtgtttaaaaaagttatggccaaaaatttttagaaaaccaattcttgatttaatagttttttcggggttttttaataaaatctatgctaatattgataatataaacaaaaaataattattataataatttaattatatttttttaatattaattatttttcaatttcaagataaattctcttaaccacggttgagttaaccatggttaaagacgagcataccggttaaggtcggtcgttaaccacggttaacgaaaccgtggttaatgcgttaaccgtggtttactaaaccgcgagacgagcataaggccccagatcattagatggacccaatctaaaaacttaattcttaacggtgtattattatcacccgcgcccctgcgagggtgaaggtcgcgggggcgggggtgaggccaaaaaagcagtcccgtccccggaggcggggcttgaaccttaattaatccttgaattttccactttttagttgagtggtcaaatg

SEQ ID NO: 104880 - DNA, 740 bp, Heterodera glycines
  Promoter: Source sequence=SeqID_68; Location=2846..3585; Strand=-; Gene=SeqID_60279
tcatggatttaggtagcattttaaaaaatgaaaattaaaaatatatctatttaattttatatgattttttatatttctatcacatattgtttgcattattttttgcgtaaaatgaaaaataattttttgcaattttgtgacggccaaaattaaatgtaaagacagcaaaaaccagtgcttttgcgcaaatttgggacggggaaaaaatgaaatgagtgaacaggtctaaaccagtgcttttgcgcacaatttgatggcaaaaataaatcgtttcctgtgaagaaaaatgtaataattttaacgatggtcgaagaaaaaaccaaaatgaacaaattgtcaacaaaatgattacaacaatcatattcttttgtgtaacaactcctatttggtttcatttggcctttgttgtgcctatttaaagcggtggaaattagtttttgtcacattcaactggcaaccgatcacttatattattcattaaacctaaccaagattttgccgtatgttattaagaaaattgtttaacttttgtcaaatgaaataaagtgccgagataaaaaatgtcaagcttttacaattttttggtccaaagttcaagtcccttacatcccaaattcattttctcttttaatttttacaaaattcctattgaaataccacggagcattttcccattttcgttgtttttctaatttttctcttttcatttaagtaaattcatttataacaaacgaccaatg

SEQ ID NO: 104881 - DNA, 355 bp, Heterodera glycines
  Promoter: Source sequence=SeqID_11544; Location=1861..2215; Strand=-; Gene=SeqID_74981
ttagctgataagagcgatattgattaattaggacggtgataataattgataaaatgatatatatatatatataacatatgggccgaagtgatcagagggaaacattgattgttcagagcgatatcgattgataagggtagtgatataattgattagtgatcagagggaaacattgattgataagagcgatatttgattgatgaggatggtgacgttgattgattaagtgaccggtaataacctaatcaatgcaagctaaaaaatatttgattgatcggtgaagtggtattgatcgggaataatcgattcaaaattttaatcaatgccaagctggaaataatgattgatcagaatg

SEQ ID NO: 104882 - DNA, 1003 bp, Heterodera glycines
  Promoter: Source sequence=SeqID_18041; Location=1426..2428; Strand=-; Gene=SeqID_82625
aaatattcaatcatttgtagtctaatatattcacatcggttcagaattcaatattaataacatcaacggtgagaaaaatggggtatgcaaagtttatgggggtaaagaaccctatccaaaataattcccctgggagaagggagtgggtgagcatgctgtgaatataagccaatacatttagtatcagtgactcaaaatgggcacgcaaacatcgatgtgtgggaaaaggcaaggggtgagaaaaagaaaagaaggaaatagtgcgctgtctgactgtctggatacgctttttaaaatttgaccagaaatatggggcgcccctacaaagtgtccaagcctcgaaatgtccaagcctcgaaatgtccaagccacgaaatgtccaagcctcgaaatgtccaagccacgaaatgtccaagcctcgaaatgtccataagggtaaaaaacacgaaatgtccaaaacgcgaaaagctcataaaaacccggaaggagtctaatttagggttttcggggtcgctgaatacgaacacgacctttatattgccccttgcctaaccttagacccagccgaataagaaaaatctgaaaattcggttaaaatatctgctgttttttgtcttcagattttgttattcattgatcgaacaaatgattcgtaataaacttgaaagtctacaaaaaaagtcggaagaagcgtttttgtcagacatttcaaacacaactgaggaggccgtgaattttggagtggaggttgacgaatcgcatgccgtgataacttccgacaatgttgaacaacaaactttgaacgaggctgaactttcaacagtgacctttgagcgcggaaagaccaagtttgggggagattgtctgtcaaagagaacataaccacctcccagcgcctcagaaacaacaagtttgtttaaatttaaaaccaaataattaatgctgtgttaaaggcggaatcaaggcgacagaaaatcaaagaaagtgtcctggccgagccatg

SEQ ID NO: 104883 - DNA, 804 bp, Heterodera glycines
  Promoter: Source sequence=SeqID_29311; Location=454..1257; Strand=-; Gene=SeqID_46153
gaaggaaggaattccttcgggccaaaaaaaacattattaatttttttttggcctaaaaatatggacaagaaaatactatttccccccgcggcgggggggggggccccttcggcaaattggggtcgtccgtccgttttgcccccggggtttttgctgtgcgctaatcgtagaaaagaaattgctgctggagacaattagggaactctaaggatcgcgcccccgatattgaaatgaaatgaaatgaaagttccacccctacggacaaaaagcggtcgccgcagccgccgctactccgtcggtaatggacacattaaactgaaattggcgccgcaacagtgccgggagaagcgagtgagtgtcgtctcataacacaacaacaaaataatggccggctaatcggtatttaaggggcccaaattggaacagagcgatcagttcccaaaattggggagtggaaagaggccagagcagaagcaaaacaccccaaaaggctgacactgtccaaggggaaaagcccagggaccagcaacagcagaagaagcagacacgggcctaatttaaaggcatatccccactaattagcaataattgggggtaggtcagtttgttacaaaaagcttcaacaactgttcaaatgatattccatgcccctcattatcctaattatattgaaaacagcaaaatatgtcatttacttctgtttatggcgatggtgtgatccaagcatgactcattttggctgtttcactcccacgcacaaaaatttgtttatctgctgatgaccatgcccttaatttgtagatg

SEQ ID NO: 104884 - DNA, 311 bp, Heterodera glycines
  Promoter: Source sequence=SeqID_43676; Location=480..790; Strand=+; Gene=SeqID_71296
cctataaataggatggtaccttttttgcatcttcaaacgaaacctgcaatgctgtgagccaatgggttggtaaagaaaacattattctgtgcaatagagaaagaattattcgtcatctgagttgttgtgcctttatgtttgtgattaaactcattagaaatttagtccaaaaaattcctgaaatttggtaaaattattattaccagtagcataacactgattgtgagacagaaagtttaaccctttagggaggaaggaaataaatctaaaataacagaagctcaatgtaagaagcataatgagtgggaatg

SEQ ID NO: 104885 - DNA, 117 bp, Heterodera glycines
  Promoter: Source sequence=SeqID_27134; Location=1289..1405; Strand=-; Gene=SeqID_57840
tttatgacattttatgcaaatagatattcattttttatgtgaatttttgaagaaaataaagccatttaagtgcaaaagtgccaataaccgtcttaataattcgacctcaacaaaatg

SEQ ID NO: 104886 - DNA, 167 bp, Heterodera glycines
  Promoter: Source sequence=SeqID_32832; Location=749..915; Strand=-; Gene=SeqID_63080
cccctagagacgtgttataacaggaaaaaatataaagaaaaaacttttcgggaccaataatttagaggattgccggtgttattaggttattatttgtaagtcatttcacaggtaaacatattgcctaccgagaacataagtcgttgactgggacagcccggtacatg

SEQ ID NO: 104887 - DNA, 82 bp, Heterodera glycines
  Promoter: Source sequence=SeqID_2647; Location=507..588; Strand=+; Gene=SeqID_80880
actaaacgaaaacataaaaaacaggataaagagtagttttaaatttttttagtttttattctcatcggtttggatcaaaatg

SEQ ID NO: 104888 - DNA, 132 bp, Heterodera glycines
  Promoter: Source sequence=SeqID_21150; Location=1165..1296; Strand=-; Gene=SeqID_51733
gctaaaataaaaaatcttgagaaaacgagataaatttaaataaaatgttaaattaaaactataaaaatataagaaaataaattttaaaaaatacaatcttaaaatgtctcttcaggcttaaaaataatcatg

SEQ ID NO: 104889 - DNA, 121 bp, Heterodera glycines
  Promoter: Source sequence=SeqID_44643; Location=769..889; Strand=-; Gene=SeqID_72107
gggacaacagcgacacaaggtcaactacctgtcagcacgcattacctgcacggagtgctgtgattctgaaaatggcgtgcgactcaattgcaaaatctgtttgacaacatacggtgcgatg

SEQ ID NO: 104890 - DNA, 892 bp, Heterodera glycines
  misc_feature (52)..(52): n is a, c, g, or t
  misc_feature (54)..(54): n is a, c, g, or t
  misc_feature (60)..(60): n is a, c, g, or t
  misc_feature (73)..(73): n is a, c, g, or t
  misc_feature (111)..(113): n is a, c, g, or t
  misc_feature (117)..(118): n is a, c, g, or t
  misc_feature (123)..(125): n is a, c, g, or t
  misc_feature (128)..(128): n is a, c, g, or t
  misc_feature (131)..(132): n is a, c, g, or t
  misc_feature (141)..(141): n is a, c, g, or t
  misc_feature (145)..(146): n is a, c, g, or t
  misc_feature (151)..(151): n is a, c, g, or t
  misc_feature (153)..(153): n is a, c, g, or t
  misc_feature (155)..(155): n is a, c, g, or t
  misc_feature (160)..(161): n is a, c, g, or t
  misc_feature (167)..(167): n is a, c, g, or t
  misc_feature (176)..(176): n is a, c, g, or t
  misc_feature (179)..(180): n is a, c, g, or t
  misc_feature (186)..(186): n is a, c, g, or t
  misc_feature (191)..(191): n is a, c, g, or t
  misc_feature (194)..(195): n is a, c, g, or t
  misc_feature (198)..(200): n is a, c, g, or t
  misc_feature (210)..(210): n is a, c, g, or t
  misc_feature (219)..(220): n is a, c, g, or t
  misc_feature (225)..(225): n is a, c, g, or t
  misc_feature (228)..(229): n is a, c, g, or t
  misc_feature (232)..(232): n is a, c, g, or t
  misc_feature (241)..(241): n is a, c, g, or t
  misc_feature (246)..(246): n is a, c, g, or t
  misc_feature (251)..(251): n is a, c, g, or t
  misc_feature (253)..(253): n is a, c, g, or t
  misc_feature (256)..(256): n is a, c, g, or t
  misc_feature (260)..(260): n is a, c, g, or t
  misc_feature (266)..(267): n is a, c, g, or t
  misc_feature (269)..(269): n is a, c, g, or t
  misc_feature (286)..(286): n is a, c, g, or t
  misc_feature (293)..(293): n is a, c, g, or t
  misc_feature (296)..(298): n is a, c, g, or t
  misc_feature (311)..(312): n is a, c, g, or t
  misc_feature (316)..(316): n is a, c, g, or t
  misc_feature (320)..(322): n is a, c, g, or t
  misc_feature (329)..(329): n is a, c, g, or t
  misc_feature (338)..(338): n is a, c, g, or t
  misc_feature (343)..(344): n is a, c, g, or t
  misc_feature (347)..(348): n is a, c, g, or t
  misc_feature (356)..(358): n is a, c, g, or t
  misc_feature (361)..(361): n is a, c, g, or t
  misc_feature (366)..(367): n is a, c, g, or t
  misc_feature (378)..(379): n is a, c, g, or t
  misc_feature (403)..(405): n is a, c, g, or t
  misc_feature (407)..(407): n is a, c, g, or t
  misc_feature (413)..(414): n is a, c, g, or t
  misc_feature (422)..(422): n is a, c, g, or t
  misc_feature (449)..(449): n is a, c, g, or t
  misc_feature (454)..(454): n is a, c, g, or t
  misc_feature (458)..(458): n is a, c, g, or t
  misc_feature (461)..(462): n is a, c, g, or t
  misc_feature (470)..(470): n is a, c, g, or t
  misc_feature (474)..(474): n is a, c, g, or t
  misc_feature (477)..(477): n is a, c, g, or t
  misc_feature (489)..(491): n is a, c, g, or t
  misc_feature (495)..(495): n is a, c, g, or t
  misc_feature (527)..(531): n is a, c, g, or t
  misc_feature (533)..(534): n is a, c, g, or t
  misc_feature (537)..(538): n is a, c, g, or t
  misc_feature (544)..(544): n is a, c, g, or t
  misc_feature (554)..(558): n is a, c, g, or t
  misc_feature (570)..(570): n is a, c, g, or t
  misc_feature (584)..(584): n is a, c, g, or t
  misc_feature (587)..(587): n is a, c, g, or t
  misc_feature (601)..(601): n is a, c, g, or t
  misc_feature (608)..(609): n is a, c, g, or t
  misc_feature (613)..(614): n is a, c, g, or t
  misc_feature (625)..(629): n is a, c, g, or t
  misc_feature (639)..(640): n is a, c, g, or t
  Promoter: Source sequence=SeqID_7129; Location=1855..2746; Strand=-; Gene=SeqID_63924
tgaagtcgaatcttttacgggtggaagagtaccagtgacctttaaactgaangngccganggaaaaaggaaangggcaaggctttaaaagcgcgcggccaccaaaaaaccnnncccnnacgannnagnacnnggacaaaangcgnnaagancncngggannaaacancggaaaggnaannacaaangaaanaannaannncggcgagagnccaaaacanncgaanaanncancgccaaacncgggncgaancnccncccnaaaaanngnaccgcgccccacacaancgagaancannnccaacgaagggannaaancaannnccccggncaaacgcanaaaanncanncaaaaggnnncanccaanncaaagaaggcnnccaacaaaaccgaacaaacccccnnngncaaacnncaaaaaanccccaaaaagaacccgagcccaccaancaaanaagncannaaggcaanccgncanaaaaaggaggannnggancaaaaacagaccaaacgggaacgacgacgggnnnnngnnaannccaagnacaaaaaggnnnnncgccaaccaagnaaaagccaaaaaanccncctcccaagccaanaatcaannaaanncccccgcccannnnngaacagaaanncgccaatccttgcaaatgcccccagttcgttattataagagtttaaaacgtggaaaagcggctcgcaatgacttaaatttacttattttgttattatttcttcagcttcggaccataatgttattctcatacatggcctattgcatttttattgttctttttatatttttctccaattggccaaaatccgttgccacaatcctgatcaccccccccccccacaatcattcccttttttattttttcagaatg

SEQ ID NO: 104891 - DNA, 366 bp, Heterodera glycines
  Promoter: Source sequence=SeqID_170; Location=8368..8733; Strand=-; Gene=SeqID_76058
taatctgtaaaaaaaatcaataaatcggctttgggattcactgtgtgtttgaattggcgcccttttgtatctttctctaaccactactctctcgtcaatgtgtttgtggatgggcgtggcctatcgattaagaagggacagcccgtctggaggtcgctgcgcgctaacacccctctcactatcaatcaataattacgtgtttttttcgcaggttcattttatgcttttaacaattataatcataaactatttcttaatagtaatggccccgagaaaaatcaatgatcaattggtgtttgagaacaaaagtaatcattttttgggttttttataataattttagatttttttaaatttaaagaaatg

SEQ ID NO: 104892 - DNA, 210 bp, Heterodera glycines
  Promoter: Source sequence=SeqID_18255; Location=300..509; Strand=+; Gene=SeqID_82846
tttttggggaggatttagtggcaatttgaaggcaaatgggagggtgtaattaggatgaatgtgcgggatgtgaagaactgttattcatcaatgtcaaaggcagccttttatggagcagaattctgctcaaacattgtattttgtagtatataaatgtagatgatcatatttgttcgtaaaatgaatgaattttaaggatttacatccatg

SEQ ID NO: 104893 - DNA, 218 bp, Heterodera glycines
  Promoter: Source sequence=SeqID_25412; Location=1736..1953; Strand=-; Gene=SeqID_56155
ccgcttttctcacatgtggaatttactgttcaaattggccaacagtggatttaatattaaaacaaagtaaataatgggatatcaattttaacataaattacctattaactatacagaaaagcaattagaatatcgtttaaaatttatagtttattagttagtaaaaatttataaaattagacattttaagggttgcttaaaattaattgcttagaatg

SEQ ID NO: 104894 - DNA, 167 bp, Heterodera glycines
  Promoter: Source sequence=SeqID_1980; Location=1149..1315; Strand=-; Gene=SeqID_77145
ttccttcgccgacccgaaacgatcgacaggtaaacaaaacaaataataggtaatataaaactaacaagattttttaaattagtaccaaaggatctgctcttgcagtgcaaacgatgggcctcctttcccgagcatttgttgggcactaacgcaacgatcagcgaatg

SEQ ID NO: 104895 - DNA, 801 bp, Heterodera glycines
  Promoter: Source sequence=SeqID_29412; Location=1..801; Strand=+; Gene=SeqID_59915
tctttttcgggattttgatgcctttttcttgccttttttcgggattttggtgcctttttcttgctttttttcggtattttcgtgtctttttcgggattttgatgcctttttcttgccttttttcgggattttcatgtctttttcgggattttgatgcctttttcttgccttttttcggtattttcatgtctttttcgggattttgatgcctttttcttgccttttttcgggattttggtgcctttttcttgccttttttcggtattttcacgtctttttcatgattttgatgcctttttcttgccttttttcgggattttggtgcctttttcttgccttttttcgggattttggtgcctttttcttgccttttttcggtattttcatgtctttttcgggattttgatgcctttttcttgccttttttcgggattttgatgcctttttcttgctttttttcggtattttcatgtctttttcttgctttttttcggtattttcgtggtgtctttttcgggattttgatgcctttttcttgccttttttcgggattttggtgcctttttcttgccttttttcgggattttcatgtctttttcgggattttgatgcctttttcttgccttttttcggtattttcatgtctttttcgggattttgatgccgttttctgccttttttcgtattttcatgcctttttcgggattttcgtgcctttttcatgtctttttcccgattttgcttgccttttttccgttctctactgataattgtctgtgaaaagcaacacactttaagatg

SEQ ID NO: 104896 - DNA, 811 bp, Heterodera glycines
  Promoter: Source sequence=SeqID_31142; Location=1..811; Strand=+; Gene=SeqID_61520
gattataaattgcaattttttttatgcggttcctaccccaccgcttttgacaccccccccccccccaattttcctgcgcctaagattttttttaatttgtaagaatagcttagtcaaaaagaataactttacaatttacagtttgattgataaatatgtaaattgaagcccaaacccgaaaaaagcttacaaatttgttatgaaaagctcaaaaattgattaattttaattggttttaagtgaacaagaaaattttattaaaaaactctcgggtcttcggtcccgtgtcacaattttttttttttgtttgcaattattgtcaattaaatttagtccgctttatctattgctgaccatcaaattggcactgaacatggagaagcatcaagccataaagatgaggacaatttggcaactgagaaaagtggcttattttttttttatcatttaaaatataatcataaaataattaattttatttatatttttccattttttagttgaaaatggatttaatttgtcattatttatttctctctttgttaaagcaaacaaatttttaaaatattgcacgataaaattggctaaccaattgacatgaaaattggtttctccggaagctatttatcatttttgttcatgacccgatttttaagtgcagtcgactataatatttttccccaaatggggctttagttataaaatcaatttaaaaatatcagaccattttcccataaattttgtaaattttaattaaaattaaaaattaattcattttcaagtgattgccgaatcggcaacggctgccatg

SEQ ID NO: 104897 - DNA, 476 bp, Heterodera glycines
  Promoter: Source sequence=SeqID_2250; Location=2917..3392; Strand=-; Gene=SeqID_78709
tgtcgcgagagcgactaagaaagtggagaaaaagaagaagtgatgggaaatggaaaaagagagagagagagaaagaaaatggaagaaaattgaggaagaataatttaattatgttaattggaatatttaatatttgtgattgattttattatttctatctaaattgtgatattttacattcaatgtgatttttgtgtttaatattagtcactctttttgttgttgatcgttccgcctaaaattgctccacctccgcttttcctatctatttaaacacgcacgtttttcacttcaacacattcctttcatctgacatcttattcatctttatattatatttattaaataaacttctttcttatttgggaattattttcccccttattccaccccgccctctctccctcgcgccttcccatttttgtccccatctcgccgtccgagccaacaagtggtgccgctagcaaacaaagatg

SEQ ID NO: 104898 - DNA, 419 bp, Heterodera glycines
  Promoter: Source sequence=SeqID_6336; Location=967..1385; Strand=+; Gene=SeqID_61180
tttctttttttacacaaaagtatttatgcaacagtttaagcaaaagcaaatggaaaaggggagaataatatgttttgatagattttatctgcacacatatttcgcgacatccttaacattgaaaaaagcgcaaaaattgcctcgactttgactacaaaagggatgtgtacagtatgccaaagaaaaaggtgctgggtcgaacctaaaaaagtatcagttataataaaaataattaatttaaatgttataaagtgactaaatcctataaaattctaatttttttgtgcatgtttcataaatattttggcatttttaatacatatttatttacatattttgcaatttttcttacatatacctaaattcattccctagtaataaactttttagcgtttttttgcagccattttagcattatg

SEQ ID NO: 104899 - DNA, 426 bp, Heterodera glycines
  Promoter: Source sequence=SeqID_20216; Location=473..898; Strand=-; Gene=SeqID_85013
ggcattcggggaatgagtctctattgggccgtgcactagcagctaccggcgcaaaggagcacgcgtggcatcccgcaggagtttcggttggccgtgcagtaacagctaccgaaacatcgcgtggcacccgtgagcagttggaacccgggggctttgccaacgatgagttcgcaaaggcgcatcgcgtggcatccggcaggagtttcggttggctcgtgcagtagcagctaccggaacatgcgtggcacccgtgcagcagttggaacccgggggctttgccaacgatcgtttcgctaaaggcgcatgcgtggcattcggggaatgagtctctattggctgtgcactagcagctaccggcgcaaaggagcatgcgtggcatccggcaggagtttcggttggctgtgcagtaacagctacagaaacatg

SEQ ID NO: 104900 - DNA, 212 bp, Heterodera glycines
  Promoter: Source sequence=SeqID_13609; Location=1..212; Strand=+; Gene=SeqID_77516
taagcactattattcgattgtttggatagattctcttttaaaaattcttaaattcattgacaaaaaaagtgaaaaatttttaattttttttaagatttcaccaaattttttatgtcactttttaaaaaatgctttttttaaattttcattcaagatttaacccccaaaacattgttcaattaaaaaaaatgctcattatgttcaggcccatg

SEQ ID NO: 104901 - DNA, 98 bp, Heterodera glycines
  misc_feature (9)..(9): n is a, c, g, or t
  Promoter: Source sequence=SeqID_9559; Location=1133..1230; Strand=-; Gene=SeqID_46778
cgtaaactntcattcataataaagaacaacaattttgctaattgcccattttagtatggccacgattttattggttttacgagggaaaattgtacatg

SEQ ID NO: 104902 - DNA, 181 bp, Heterodera glycines
  Promoter: Source sequence=SeqID_11608; Location=1951..2131; Strand=-; Gene=SeqID_75057
attcatcaaatttttcgcattatttggataattttgactaccaataaacatttttaaatttgaagtgcagaagcagatgtggggagtgggagggttcatgatcgcgcgcctcctcttccattggtcacgccattccgcataaactgctcatttcaattatattcccaaatccacaaaaatg

SEQ ID NO: 104903 - DNA, 144 bp, Heterodera glycines
  misc_feature (21)..(21): n is a, c, g, or t
  Promoter: Source sequence=SeqID_16063; Location=1..144; Strand=+; Gene=SeqID_80419
aaaaggagccgcctcacggcnggggcagcaccaaaagccccacattttaaaaaggaaacggccgatttcacataattttttcatctttgctaagccaattgaagtccgacgaaaactgtcttaattatttgcctcaataaaatg

SEQ ID NO: 104904 - DNA, 602 bp, Heterodera glycines
  Promoter: Source sequence=SeqID_2166; Location=1004..1605; Strand=-; Gene=SeqID_78212
attgacattgaaaaagtgtcagaatttgcacgagaggaggttgagagcagtcggtacagcgaaaaagtgtacataaatggattgccatggaatatatgggcaaaaataaaaacgaaaaatggaggcactgacaatgagaaatggttgggcattttcatttgttgcgatacttcgaaaaaaggtgcaaaattactaatagttaatatatatattaacaacaattaattgttaattagtactaattaacagcaataattaatactccattaagattcgctttggcgctgctgcgttcgttcggcaacttttcgaattatctcgcaaaaaaatgggacggagaattgcgttgggacacttagtaactttgtgttggacaataaattgaccaatttgggattccctaatttcgtttcgtttgcggtaagtgccaattcaaacaaatatttaaatttgacattcgtggaccagccaatattgaagttcatttatttatttgcctggtgtaaagaaatcataacaaaataaattaatttctaaaacataaccaattgaccacgcataaacaaaaattaaattagatgatttaaattaaggaattgatg

SEQ ID NO: 104905 - DNA, 1003 bp, Heterodera glycines
  Promoter: Source sequence=SeqID_1173; Location=6410..7412; Strand=+; Gene=SeqID_69320
attagtatttaaattatatgtaagaaattagaattggacaaaaaaaaacccgcagcaaccgaaaaaataaaatgtctttccgactattcagcgcctggagaaaacacgaaaaaaatgtgttgtattgtatttcttttttcttttattttgagcaatttgggatatgaaaaggcaatacatcaatttaagagcataatattttaagttcagctcgagaaaaggtcagttcaaatacgtaacatttaatctagtaaagaccgaatgtgattgatcgattggttcctttaaacagccgatcagctttgagaagatgagggcgggtcggcaacttctcaaagcgaggccataacaaataaaagaggaagaagctgttgtcccagaaaaaaagcctagtcaacagattgctataatttgtgtgtcataattagggagcgaattcataggtttatacacatgaaaaaggcacataattttccgatttttctcccctattttactatttttgcccttttttaccattttcgttcatattttacattttttttgtccctataaatcccgaaattgaaaattttcaccgctaagcatccgctccttagtcattccttacaatttatatatgtcatatttctatattttgccaaattttgagttatgtccacattttataaacatagtaaaaagttaactttcagctcttttgtgtcaaaaatagggcttaatattaaaatatttcatttttgttttcattttcccacgatattaataaatttcagtttatttttctatttaaaatgatttttatttttgagaaagaagaagatgctttcctaaaaagaagcttaattgattcatttaagcgacaattaaccttttttaagggtcggtagtcttcccaagctgattcattattcaataaaaattaaaatcttttattgctttttagctaatttataagcaaacaatcaatggctttaatttaaattctccggccttcacaatg

SEQ ID NO: 104906 - DNA, 141 bp, Heterodera glycines
  Promoter: Source sequence=SeqID_7561; Location=2840..2980; Strand=-; Gene=SeqID_65223
accatttccgcacacatgcgtgcgcgatcggtaagacattccattgttaaatttgtaaaacattttgctttttcgataggtttaatgagcgattgaacgatgatgtatgaatgaattccgtatggagagcctccaccaatg

SEQ ID NO: 104907 - DNA, 411 bp, Heterodera glycines
  Promoter: Source sequence=SeqID_21339; Location=91..501; Strand=+; Gene=SeqID_51939
ttgggccaatcgccactcacagcagggccaatcagaaacaaaaaacagtgtaaacagcaaaataaatgacaaaaaaattaatatagtaatagccatgtcaaaatcacggaatttactttccatcgcaatcaaaatcttgaaaaagctgcgaatattccgaaacgaaaatttaacaaaaattgaaaggaaaattagtgtgtttgtaagttttgagtgtaagatttcaggccttgaaccgcatttcattcaaaaattctcgaaaaacaataaatcaacttttttaaaaattttatttctttatacatttacttatctttacgcgagatttgcatattctaaaacaaaattacaaaatataataaaattttttgctcaaagaaattctttttatttcaatcaatgggaaaaatg

SEQ ID NO: 104908 - DNA, 1003 bp, Heterodera glycines
  Promoter: Source sequence=SeqID_19565; Location=1000..2002; Strand=+; Gene=SeqID_84301
acgtaaaacttaaccttaaaacttaatataggcgagaaataccttcgccggggaggaaccgaaattccccgcatttgtcggagaccaaccccattttgagaagacaaaaaatttgggaaacaaaatttttcattttgaaaaattccaaaatgctgatttttttactttaaattttgttttttgtcggttcaaatactgattttcaaatttttcagttggcagtcctgtttttacactaataaaatattgttttaaatagtttttcatgtttttattgcgtttccttcgcgctacattagtttttaaaaaatcttattttcgggttccgagttttcgtttttataaaataaaataattaattaagttttattttaaattaaatcattttcacattattaggtaaatataaaattttccgtttaaagaaaaatttgctgacggattattcagtgaaggattgtccatcactgacgaattgtccgtaagccgcccacacgtacgcatccaacacattgctgtggcacgcacaccgcacgcgtccgtccactgtctgcccctaggcaaattttcgttccttctccctcccccaactatttcctttgcctttcttctttttcacattatccttttcttttatgtatttattaatctctctctctctccacaacagattttgctttacgccaaatcaaatgaaggcacacagagagagagagagagagagagagacaagaagggacaaccaaattagtatagttaattgaaaaattaattttggaaagtttttcgtgggttaaatttttggattttaagtttagagcactaaagtgtcctggtttttcaatttatctgattttgaggtttagaaacaaaacagggaaattctgattttaattttgttgttaattttatgctattttggcttcacttacaggccttattcgtaatttccaattaatttcttatttgccaccaaattcatttatttcccccgcccgtaatg

SEQ ID NO: 104909 - DNA, 407 bp, Heterodera glycines
  Promoter: Source sequence=SeqID_25588; Location=1229..1635; Strand=-; Gene=SeqID_56327
gtccccgaatttctcgaaatggctcagtcccgggcagcgacgggcggtgtgtacaaagggcagggacgtattcagagcgagttgatgactcgcccctacaaggaattcctcgttcacggacaataattgcaatgtccgatcccaatcacggcaaattttcaccggtttaccaacccctttcggggaaggacaagcacgctgattttgccagtgtagcgcgcgtgcagccccggacatctaagggcatcacagacctgttattgctcaatttcgtgcggctgaacaccgaaaatccctctaagaagttgtgcccacagaagcaatgagccaactatttagtaggctagagtctcgctcgttatcggaataaaccagacaaatcgctccacgaactaagaacggccatg

SEQ ID NO: 104910 - DNA, 626 bp, Heterodera glycines
  Promoter: Source sequence=SeqID_2815; Location=712..1337; Strand=-; Gene=SeqID_81761
atcgtcggctgtgccttttgccctgtccaacttttctctaaatcggtgtctgtcattggtcagctcaacacggattttttgtcgacaaatatttacaattaaatttatttaatgcttttttgacctttgcttttgctttacgggtgccgataaatttgccagtttaattaagtaatttggcacggactctcataatttaaacatttttacacatgtttaaaatatttattaacgaattcgacaaatccatttaaatcttttattttcttttgaaattggaatgactgtcttacaaaacaaacagtttcttctctgcccatcactgtttttcaggtcgtttaatttgttattttcttaaaatggctccctttttgcaaatgttttgccttttcagggctgtccaactccgtcgaattaggggtcgtcctgtttcgcgtccgcgcatttcgccccctccgtccggcgaaggcattcaatgggcgcccgccaccaatgcttttcgcgtcagcaaagacggcgagccgaggccgttaccgtcggcattcattgtgaaaagaatatttgcagacattttagccttttataacccatttccgacattttggtaggacgacgacgaccaaatg

SEQ ID NO: 104911 - DNA, 252 bp, Heterodera glycines
  misc_feature (106)..(106): n is a, c, g, or t
  Promoter: Source sequence=SeqID_21546; Location=2019..2270; Strand=-; Gene=SeqID_52162
gcgatcagcagcattcttcggcggagagaatgtgcgagcgaatgtgcggggagattaatcagtgggaagaattcgctgatcaggtgccaccaaatcatttgttttntcatttcgtgaatggtgggtgacaaacaacaaacgacgtatccgccgttgacaaatttatcgtttatctttttgtcatttgtcggccgacggggaattgcctcaattaatcaaataaataaatcaaacggtaccgatttgcagatg

SEQ ID NO: 104912 - DNA, 295 bp, Heterodera glycines
  Promoter: Source sequence=SeqID_32358; Location=668..962; Strand=+; Gene=SeqID_62673
aagccctagtgatgaagtgtgaaaacatccaatgggacataattacgaaatggcatttgaaattatgatgaaattcatggctttaattattttaatattatttattaatattttattattaagaaaatctattgatgatcagtttcacttattgatcgcatttttggcaatgcttctccacattcattaaaatgaaataaaaaattattttccgaagaaattagcttaattttaatacaaatatatatattaaaaacttattaattaattatttattatactttttttagtgatg

SEQ ID NO: 104913 - DNA, 97 bp, Heterodera glycines
  Promoter: Source sequence=SeqID_43923; Location=585..681; Strand=-; Gene=SeqID_71491
attaaaatgcttaaatatttgcttaatttatgttaaataattaatttcaaaataataattaagggcgatagcggtgggcctttgttggccacaaatg

SEQ ID NO: 104914 - DNA, 223 bp, Heterodera glycines
  Promoter: Source sequence=SeqID_19288; Location=930..1152; Strand=-; Gene=SeqID_84029
aagatttttagcacatctaaatcccctctctaataatggtcagattagcatgatgaaacaaattctttgcttcattcatttcaataaaaactatcacacgtgccaaaaattaatgtagaataaaaattaaaaaatatattattaaggccaaaattattaatgttaaaaggtttaaaaactattttggatatgtaaaaaacaaaaaataattatctgcaggatg

SEQ ID NO: 104915 - DNA, 1003 bp, Heterodera glycines
  Promoter: Source sequence=SeqID_685; Location=408..1410; Strand=+; Gene=SeqID_58947
ctaattcggggaattggggactccgagctttgcaaaaatttaaaaagttaattcaaaacgaaggggggaaaggttgaaaatttatgaaattttgaagaatctccttaatattaattaattaaaaattccgaaaaacttttcggcgaagcttatggcaccgccggcccccaaaaactcaaatttttttttgcaaagaattgtcccaaaattgcaaaaattggtattttttaggaaatgtaacaaattgcaaattttcaaaaaaaaatttcctcgcggctcctaacaccaccgccgctcatcccctctttgttccccaaattttttatttgaaaaagagcgccgcaaaaaatggtggtcaaattccgtgctgggacatttcgtaaaattcgccaccttgggcgtttcgtaaaattcgacatttttgcaatttttacaattaaaaaatctaatctgttcacatttattccgattgatttattcaattaataaaattattttcactttaaaaataacaagaaatatcttattaaaaatgttgccaagaagatcaatcccgattcggtcgtcaattacttatgtagtaatttgagttaattttgttaattttatagatatgaactatggccctgaacaccaaaatttaatatattaatttgattttttagttattgattaaaaaattctctacttttttaaaaacttatttaattctggtcagcactttggaacaaaagaataaatatctaaatccgccatcaaaggtatattaaaattaaaagatgattaaaattataaatttttttaatttgagcaaatatgttagtcgagatttctctagttgtttgtcaagaaaattaattgggcgtttcgtaaaatccgccattttagcgaatttattttacattcttggtaccattcgatagccaagctttttctctattagcctgccaaattcaaactcatgtaattggagtcgttcgctgccgcaacaattttgaaaatg

SEQ ID NO: 104916 - DNA, 1003 bp, Heterodera glycines
  misc_feature (953)..(953): n is a, c, g, or t
  Promoter: Source sequence=SeqID_19797; Location=864..1866; Strand=+; Gene=SeqID_84534
ccaacccctaccaccagcaaacagcagaggatgcttattcctcggtccagttcttttaatgagagtgtacatcgatttatttatttgcaacccaaaccagcgaatcaaagttttgtaagcctgcaaaattcataaaaagggcaaggtcaaataaatttatggcctggaaggtgtaaaaacgagtttcatattcttttggtcataacttttttatctggctaattatttgaaattttgcaggcccatagaatttgttacatactgaaccaactcgtactgccccgtttcacctttttcagtaaaaaaattctcaacttttgtcaaaatcaaccaaattaaatataaacattttcttggtgtcattcaataggccttaagattcaatttactagcaaaattcaagaaaagcttcacatatttgaaaaataaattagaccaacaatcctaaaaaaaagtcgttcatcattttttttttaaatatgatcaaattttttgaaaattttcaaggaaattgagaacctcaagggctaattgtaagagtgaagcgaaactatttgatttgtttgactttgacagtacgagtcgaggcggtacgagttgggtttcatccatatacctatcttaataggcaatcgagcccggaattttgaaaagggtccagtttttatcccgatcccggctcttttttcaaaaaagccggaatcggaatcccggaaaaatccggcgggaccctctcgagatctaatcggtatgtcctatttctagcaaaaatgtcaaaattgtgtccccttttgcatcggatggagttgttgttgcgcaccggaaagggagcggatgtacactttttggttggccgggaagatcaaaaagaggcgagttgctaggggaaaaggctctaatgcactttatgagtccaattaattgacaatcccgcggtttttatacaataactnttgttcatattcataacaaaccctatctttgtggtttgctacgaaagatg

SEQ ID NO: 104917 - DNA, 127 bp, Heterodera glycines
  misc_feature (20)..(20): n is a, c, g, or t
  misc_feature (33)..(33): n is a, c, g, or t
  misc_feature (89)..(89): n is a, c, g, or t
  Promoter: Source sequence=SeqID_28731; Location=1..127; Strand=+; Gene=SeqID_59306
tttttaatattacaatgccncaggtcaaggccnaacttaattgatggctcattttatgaatgaattaattgtctaattaattatctatntaaatcaaacttcagtttcaactggtgtgttaacaatg

SEQ ID NO: 104918 - DNA, 875 bp, Heterodera glycines
  Promoter: Source sequence=SeqID_11877; Location=864..1738; Strand=-; Gene=SeqID_75387
tgcatgaaattcacaaataaattatttattttaaaggataaattaaaaaggcagctgatttgctcgttttatcctgattctcattttttaaccgttttattaataaatgttttcatctccctgcttcttttggaaaaagttatagaattaagtccacaaaaaaccacacaaaaattattcaaaggagtctctaatgacgagcttttctcagcaaatatattcatcattcatagctaattagaataaatttatacaataaaaggaatggagacaatttgaaaaagtagcaaaaaaaaaaaaacaaaatgaaaaaagaggttgggaaaatatacaacacaaaaagtgcggcgctatttaaaaagagtacccttttgaaattatcaaaaagcaaaaacaaaaggggggacccttttgtttgcaaaattttttaatatttagtcatgaaaaattattccctggggttctttgggtccaagacctcgaattagatgtcagattcgtgatcagcgacctctaaaaccctcggataacaaattttcatggatttttatctcaaaaaaattttgcaaaacaaaagggtccccccttttgtttttgatagaattcaaaaaggccctctttgcaagtagcgccaataacttggtattttctaatcaaatttttgagaattttttaaaattttctagtataataaagaccgaataaataacaaaattattattttttaaaattttatctttatcttccaaccaaatttgggatttttccaattaaatttttgagaattttcacaaaattttccagcaaaacacttttccattccatcccaatcacttctaattgatcaaacaaatataatttaaacaatcaaaatg

SEQ ID NO: 104919 - DNA, 288 bp, Heterodera glycines
  misc_feature (31)..(33): n is a, c, g, or t
  misc_feature (46)..(47): n is a, c, g, or t
  misc_feature (84)..(85): n is a, c, g, or t
  Promoter: Source sequence=SeqID_27868; Location=824..1111; Strand=-; Gene=SeqID_58539
ttgactcgatggatgatgatgcgcccacgcnnncagattgacttgnntcagtccataaattcatggctgttgttgacactcgtnncccacttgtgcagattggggtttgtgtgtgtacacaatgatgtgttgtgctctcaatatttctgtgcttttgttcatatagtcttcatttacaggtacaactccgagccaatttttttcaacaaaaatttcaacgggccctacaacaacaccaaggcgggtggcacgaatgtacggacaaagtcagtttaattgttcaaaatg

SEQ ID NO: 104920 - DNA, 399 bp, Heterodera glycines
  Promoter: Source sequence=SeqID_12711; Location=1138..1536; Strand=-; Gene=SeqID_76402
taatttatgtgccgttgggaggagaaaaattcggcattttcagattttttttgccttagaaaatgggccaagtttgagcggttttttaaacccaaaattcgttttatttttaaattttcaaaattcggagttttatcgtcagagaaatttattcgccttcgattacgacttatttttggcataacttttgaatgcgcgcacttttttttactctgaagaatgttcggttaattaaaaaaaaaattgacggaatttttttttttttttaattgacagaatttcaaaaaatgccctttttttgtccatccccgtgcctaattcattctctgtctgtcacagttcattgtgatcaccaacgacaaattcctgttgcgcaagggcacctaccgtgtggtgatg

SEQ ID NO: 104921 - DNA, 561 bp, Heterodera glycines
  Promoter: Source sequence=SeqID_2647; Location=2399..2959; Strand=-; Gene=SeqID_47368
tgttcgaactcattgcgctttttcgtcgtctcgttgagaatggactcgccaatttaaacaatgaaacgaattgtgaaagtgagccgaaggcgaaaaaacggaaaaaattggcgaatgattcgaatttggaagtgcggcggaccttgctaaatgcaaaactgcgcataaatgcgaataaggcagcattttcattataccaattttttatagaattgggtccctttttcagattgttgcgcatctccgttctgaccaacgaattgccgttgacagcgatttacaaaaacgagacgaacacattaattggctaaaaggcgaattttgtttttcattagaaacattttgaatttgtttcactttgctatctcatttttcttgtttttttgttgttgttgttgttgttgttattgttacatttgtttttgttatcgtttttatttggaaagcaacaaatatctttcggtttattctgtctttaccattttggacattccatccgttaaaatacttatttcatttgctctgaatttgtcctttaatctcctccagttgtttaaaatg

SEQ ID NO: 104922 - DNA, 1003 bp, Heterodera glycines
  Promoter: Source sequence=SeqID_14935; Location=259..1261; Strand=+; Gene=SeqID_79099
atcagaaatcacaaagatgcacgatcattggtaccaaaaaacagaaagaacgctcgagtatcctgtaaaaggcatcaaaaaagtcgctccagtttttttgaggttttatggagcaaaacacctacaaaatagccaaataacctcattttcgtcatttacatgcttatcaaatgcaatatagtgaggttctccaccaaatttggatcaccaaagaattcataccaagatataagtatgaaattttggcgatcatttttcaagaaaatattttagttattagggagttaatcttcatatattgtagtcagattgagtgctagtggatgtactttggatcagttcatccatactgtattgaaagtcatcgaaaatatacaccaatgagtccgcacggccccagtttttgggccgggaccgggacttttttcaaaaatttttgaaattttgattaaaaattcggaagaaatttcatagtcttcattttagcttagaaatatatcaagccatgtagatcatcgaccttttttgcttttcaaactccttttttagggccaattttttcaaaaaaattcgtcgtacaagggggagggggggtccggcggtgctgataggcgccgccggggaaaattttttgaaaatttgtttgtttttgttaacagagttgtccaaaaattgtccaaattttggaatattaatctttttttaacacggcgatgctgaggaaaaatttgaattttaataaatttattaaggaaatttgttgagtttttcatcaaatttggaaatgttttttggtaaaaaaaaagttgtgaaaatgttactcaatttcgtatggattttggggtctttttaacagttaaaattgcccaaattttcaagaaatccaaagttctatcttgaaaatttcgaattaaagacattttgccaaaatagttattaaatattttcaaatctgagttattttcactgatgaaatttagtcccgttagtcccggcccaaatg

SEQ ID NO: 104923 - DNA, 649 bp, Heterodera glycines
  Promoter: Source sequence=SeqID_20421; Location=1..649; Strand=+; Gene=SeqID_50956
ttttgtctaatcttcctgtcggggcacctagcaattcagaataaactagggtgggtcgggaccggtaattttgaggtaaaccgggaccgggactttttgggttgaaaacccgggactttttggctgcgaaaaccgggaaaaaacgggaattttccggtcccgctcaaaagtggtaaaacttcggtactcagttgtccgtgttttggtcccggtcccgacctaccctagaataaacacatgtaatttcgtaacaatacaaaatttgattgggagacgttcggccgcggaggtaaatgattcaccgatgaaaaagcatcagcaaaagcagcccattgtggatgagaaattgcgaattggaataaaaaaaaacaacaacaaaaaagatgggaagtctataggatggagaaatgtgatgaagaattgaataaaacgaaaattgttcatcatcatattcatccttttctccatttccttccctcaattcattggccacaaacatttctcggaagatttttatttgtttttaaattatctcttacattttgtaaccaattggacaaaaaaatggatcagggttggtacagtatctctatcataaagtaaaataaattttaaaattttcggttaataattaagtttttcagctatg

SEQ ID NO: 104924 - DNA, 397 bp, Heterodera glycines
  misc_feature (18)..(19): n is a, c, g, or t
  misc_feature (41)..(43): n is a, c, g, or t
  Promoter: Source sequence=SeqID_1917; Location=1..397; Strand=+; Gene= SeqID_76782
aaagtcaaagaaatatannatttaagcgagtccacttattnnntatcacaaatcccatttttattgcttactatccttaatatttctttttattacctacaaatacggttttccatatgaaaattcgtcgttatttaggtaatttaattgaaattgttcatatttggcctatttttgctaactaaaacttcaaaaaaaaaaattaattcacttatttctgagttttaattattaataatttagtttaatatagttaaaaaataattaatataataatgaatttttttttatagttttacctatacaaaaaacaacaacggagaattatcatcagaaaaatgcttcggtgaaaatgtatttaatttaataattttcaaacaattaaattattaagatg

SEQ ID NO: 104925 - DNA, 935 bp, Heterodera glycines
  misc_feature (552)..(552): n is a, c, g, or t
  Promoter: Source sequence=SeqID_6288; Location=2019..2953; Strand=-; Gene=SeqID_61029
tctttaacaaaaaaaaaaactttgaatattcaaaaataactaaaaagtcaccaaaattgaataaatgtgacgaatgaattttgaaaaaatctcatttagggatacattccacagtgttaagcaaaattttctggtaatcccggagtgaattcacttaaaaaatgacaaaattccaaaaaatcacaaaaacccaaaattacgaaaaagtaaaaaaaaagtcagtgatgccgataattgcgccgtcgacacttgcaaagctgacacttgcggctcaaaacgatatttgcattgcataattaaacgacgccaaaattattgcaacaatttactaaaacaaaatgcttatttgaataattattccaatttaagcgtgcttaatttaacattaattcaatgatcagctgatgagacttttcaaggttcattctcatggcccggttttcgttaaataaacattttcaagtactgaccttattttgattcttttatgactcattaattccttaagttacaaaataactgttcaattagtgaaattaatttttgagttangcctcccaatttcctttcatttatacccgtaaatacattaatgaagttcgttgcgatccccaccccatatcttttgaggctaatcctgcaagcacttatgggtgtgcatttacaaatttttaaaaaatcactttgacaactaattgacaatatcattgacaactaattgacaatatcatttcataataaaaaatatatattttcccttttgcaaaaaatgattatcgccatgccattagcaatataattaatacctttcaaacatcgtctttttcatttctaccaattagttttgtagaaaaattggtctacctaatggctatgtgcagaatgaggatttatgaaaacaattaggtcactctggcgccgcaaatgttgctatg

SEQ ID NO: 104926 - DNA, 153 bp, Heterodera glycines
  Promoter: Source sequence=SeqID_2597; Location=1055..1207; Strand=-; Gene=SeqID_80636
gcgaaaagactgcgagaaaaaggctacaacagggaagtggtgtagcattaggggcaatattagtgcctattcttggcgcactagctcaacacctggtcgagaaaattacgacctaacaggcgggagctaccaatgaaatatacaaaaaagatg

SEQ ID NO: 104927 - DNA, 1003 bp, Heterodera glycines
  Promoter: Source sequence=SeqID_5801; Location=1325..2327; Strand=+; Gene=SeqID_59270
tgccaaaaccgtgcggtttttatcacctctcccctccctccccgcccgtccggcgacgcgatgccgccgccgcgaaaaaaaaatcgataacggaatttggaagaagtgtgaattaattgatattagcagcaaataattttgattatgaattgcacaataaaattgattatttaaaaataaaaatcgaaaattgaataaataaattaaaaaactttttcaaaagtaggtcacctgtcaaccaaaattgattaatggatttttatttctcttccattatttcgcaatctgcagtgactttttgttcaaattatttcgcaatatctcccctaaattaggtcaactgtcaataaaatgtgattgattggtttcttatttaatgtctccattatttttgggtccaactatttcgcaatatggcccgtaattttgcaaacctgtcaagaaaaatgattgatgacattcgaaataaagaatatccagacgatttttttttgcagttttgaataaaatgtgacagttgtctacggaaatgattgattaccctcaaaattaaggcaaacccagacagtcacgtgactagacccctccccctttttgcctatttcgcacacccggcccaaatcgcaaatcattcaactaaatagttggatttcattaaactctcttcacgctctaattttatttctctccgctctatttttatttgcattaattaaatctattactatttacctacgtctttttcttttcaaatctctgctctctttaattcttctgtttcaatttttctttttaaaatgtcttttaaacgcgtgaactcctgccaacccgccgtgccaatggccaaaaaatgggatttccgatcaatcgggcaagtgatttttaataaattaaataaaaaaataatttcttaaacaattataaatacaattataagataataccctttaagaattatttcaaaaaaaattttttgttcagaaataattttgctgaagaaatg

SEQ ID NO: 104928 - DNA, 1003 bp, Heterodera glycines
  Promoter: Source sequence=SeqID_19963; Location=631..1633; Strand=-; Gene=SeqID_84726
taaagaatttattgaataaattgataaattgaaattatttgtcgaaaatggctggagaaatttaaaaaaatgtcgatagggtttttgtgaaatgttttgaaaattaaaattagcaaaaaaaaaagaaaaagtttttagcaattataatcattttgaattttttataagaaaaaaatgtaaatgagtaaaaatatttcttttttaatatttctttttttgggaaaccaaattgggttgctaaatatcctttggcatattttcgtgtcactatgccgaaatgaaaaaaacgaatcaacacactaagaatcatttcaaaaaagctgtgttgattttaggcttaatccgctgcaaaagtttttcggcatttcattctttgtgattctttccggaagtgctttcccaaatgactaaacatgcttcgccattttcttcggtaatatttatatgttaataattgagcacttgactaagcatgaaacgaaaaacccgagcagattaattaataattaattctgatttattaatggttttttccattcatttagatttcattggcacaaattcatgcaaaattttcaagtagttttcgaccaaaaaatggcgcttttaaaaaaataataatttcaatttttagctaatatattatttatttgcatgtacaaaaaatcttttaaattatttaaatcattattaaagcgattgagtcattcgtttgtaaaatatttaaacaaacaaataatcattttcacgatttggaccgtcttcgttttgtttgattattttttctaagcataaataattaaataattattccaataaataacattcataaaatccttttcgagcagttttatgttttcacaattcattataatggcgaaattaatgagactaattaattgagcagcaatataaaaagcggaagaagtccgcagaattcaacaatttattcaatcattttaattataaattattaaattaaaaaacctttaggagaagaatg

SEQ ID NO: 104929 - DNA, 307 bp, Heterodera glycines
  Promoter: Source sequence=SeqID_2530; Location=1..307; Strand=+; Gene= SeqID_80222
cttctcattcttgcgccaaacccggaattgctaacaaattaaatgtttattttacattaatgtggcttagaaacaaatcaaaagcatttattgttgctttgtttttggtaaattttgcgcggttcagactttgaagaaataaacatgaaattcagaatcggttttcttatttccctagaaaaatttctaatttaaactgatgccctttgacatgggagattaaattcattttccattttttttttttgtaatgacaagtttattgggactgtaatacatattttttagttggatttgacctgcaatg

SEQ ID NO: 104930 - DNA, 346 bp, Heterodera glycines
  Promoter: Source sequence=SeqID_25837; Location=449..794; Strand=-; Gene=SeqID_56606
tttaaaagatttttaacaaaaatattcaactttaaaataaatcaatcatttttttcgccggaattgcactgcttctatttagttaaatgttttcattaacgggtgatatttactcttattttttaattattttttaaatgtttgccaacaatacactcaatcctatgatttcccgctataatatcttagccgtcaatgcatatttttttatttaaaatattaattgagtgaattttccattatagttaaaagctgaatttttttattattcatattatttttttatattaacattataatatataaaataataattcaattattatttatttaggaaaacaaaatg

SEQ ID NO: 104931 - DNA, 294 bp, Heterodera glycines
  Promoter: Source sequence=SeqID_32424; Location=154..447; Strand=+; Gene=SeqID_62733
tcttagtgcataaggggccaactccgtctcagacaaaaaaaaatatttaaaaatttttttcgacgaatttttcaaaaaatatacccctaagaaattaaaaattttctcaaaaattcatctgcaaatctatttatttattttcatgttctgatttttaaaattattcatcaaaatatcgctttggcttaattttgttacttttaaaaataaatttaccgttatcatttattagtatatacttacctaacagtttaaagtaccattaattttttagccttgcgaaaatggaaaatg

SEQ ID NO: 104932 - DNA, 65 bp, Heterodera glycines
  Promoter: Source sequence=SeqID_11364; Location=1846..1910; Strand=-; Gene=SeqID_74756
ggtttgttggttgttatgtttactcataaaacaaaaaactatttttaggaaactgttgcaccatg

SEQ ID NO: 104933 - DNA, 64 bp, Heterodera glycines
  Promoter: Source sequence=SeqID_8152; Location=2498..2561; Strand=-; Gene=SeqID_67152
cggccaaagcgccgccggcgcatcggaaattgcggaccaagttgagcaaaaacacaatgctatg

SEQ ID NO: 104934 - DNA, 435 bp, Heterodera glycines
  Promoter: Source sequence=SeqID_519; Location=9603..10037; Strand=+; Gene=SeqID_55100
aattttgtttgagtcgattgaattcgataaaaaaaacattggtaaattcaataaattgttacgaaaggatgtatgggagggataaagtgatcaccaaattgtcaaaatgagcatattaaaatgccaccctgttgaataaaatgatcatccttaattatgactcatttgtcacaattactgtatttgagaaattttgtatttttaatatttcaaatccataagaaaaatttgggaaatttttgatgatttgttcacaaatcgtgtacgcctgctgctctttgcacccaaattaagaaattgagataattatacaaatcactgcaaatggtggatgatccctcgaaaactgatttttataccaaaaatgtgtagcgataaacagttagttacctgaatagaaatcgaaaaaatatgagtaaattaatttcaggaatg

SEQ ID NO: 104935 - DNA, 744 bp, Heterodera glycines
  Promoter: Source sequence=SeqID_29007; Location=167..910; Strand=-; Gene=SeqID_59575
ttcaatccaattttaataactccctttaaataggcagtgtgatttgctatatttttcattttaaataatttacttttactcaatttgacaaaaacccttaaaatgaaacaaaattgtattcattattttatacgggttgttcaggcttgcttcaagttagaaaattaattttctcattaatttaaaaaaatgtttctaacaaatatttttattccaatgttctgtaaaatattgattaaaaattatagttaattgaatttaaaaagttgtgaatgttatctaaaatccttaataaaaatgcgcgaaaaatttttagtaaaaaacagggatttacttctgtttcagctatctttgttaattttattgaaaattaaatttagaatttaatgattgggatttttcgcttctccattagaaactcactccccagtttaccagtgatggaattagtccctaagcatatcgtaagttggaattctgggttaggagcttggtttgaaatttttaaaaaattctaaatttatttattaatttgtatttaatattttaaataatgatgctgaactgatttaaagaaaattataaatttaaaaatataaaattaaatatattttggatttcgaatattatttcttccaaaaaagaattttcttaattttttatatttataaaataagactttttaggtgtaaaaataatcaaaaaccatattttaatatttcgtaattcataattccaaaaatg

SEQ ID NO: 104936 - DNA, 1003 bp, Heterodera glycines
  Promoter: Source sequence=SeqID_4319; Location=1903..2905; Strand=-; Gene=SeqID_54036
tcgaaaactaaagggacattaaaaacgaagagaaaagaggtgagaacatttgtccgggctagtgaaaagctaaagggattttaaaaatgcaaaaaaaagaagaacgaaatttgcccgggctagtctaaatgctaaaggggctgactgcatcgaaaattgacaaatttgacaattatttgtaggagagagagagaataagaaaagagagtgaaagaagccaaaaataaccaaaaaaaagtcctggtagcaaacgaataaggaccaatttataaaaatatcaacgattgagaagcaaaaaaaagagagagagagagaagaagtgagacaaaaaaaatagaacaatttttttttgaggagagcaaaaaggcccgggctgataaccaatcaaagggacattattttagctaattaaaaagagggaccaattaaaaaatgaaaattaggccctatcattttgcttacagtatgagttacagtttttacaagttccaaagttcattttatctctttgttttctctcggttttcacgccataagaatattcacgtaatcacgtgccgccgcatttttcattgggcgagatcattacaagttccaaagttcattttatctctttgttttctctcgttttcacgccataagaatattcacgtaatcacgtgccgccgcatttttcattgggcgagatcatccactttacacatttttgcggcgcctgagaattgttaattgttcttgttaggcgaagtttaaacggagatggagcagataagcccattcctggaaggcgttcgcatccattcgattacccgctatcattcattaatttttttttctctctcaattaatgcataatgggattaccaaataattttttttttttttagcaaaataaaacaaaatcttattacgaactgaacgacttcgaatgtctacatcagggggctcatcaaatgagttcccctttggtacatcccaagccttcgggcaggaaacaaagatg

SEQ ID NO: 104937 - DNA, 420 bp, Heterodera glycines
  Promoter: Source sequence=SeqID_41266; Location=1..420; Strand=+; Gene=SeqID_69434
acagatgaggctaaaactaagattcggaccccaaaaataagattttttctaaaactgatagtagcgcgaaggaaacgcaataaaaacatgaaaaaacgacttaaaacaactttttattagcataaaaacgaaggcctgtcaactgaaaattttgtaaatcagcattttgaaaaattttattcaaaatttaaaaattaataatgtttttgcggcgtgctttttccaaaaaacgtgccaaaataaggacaaatcttacaaataaggacacttggccgccctgttaaaacactattttggcgttttgtcactattttttcactatttcgacattttttggaaaattccttaacaaaaatgcaataagaacaactaaatatcgcaataattgttttttattcttaaatttagacttaaaatatg

SEQ ID NO: 104938 - DNA, 291 bp, Heterodera glycines
  Promoter: Source sequence=SeqID_15238; Location=2656..2946; Strand=-; Gene=SeqID_79448
taccaataagtgaaagaaaatttaaagtgcgaaattcctgagaaacttaaaataaaggatggagatggtattaaatgggaggatttattagaaatcgatttaaaaaatttattcaacccgtttaataattttaaaaatatgacatttttcattttaatgctattattagcaatgggtgccatttacattttcttacgatttctgccctattttatgggttaccgatttgtcataggaattttattgtacaaatttgtaagcatttcttgttctttgtccacgggagggatg

SEQ ID NO: 104939 - DNA, 856 bp, Heterodera glycines
  Promoter: Source sequence=SeqID_10996; Location=1..856; Strand=+; Gene=SeqID_74304
tagagagagagagagagagcgagagaaagtgagagagagagatagagaaagagagagagagagaaaaagagagagagagcgagagaaagtgagagagagagatagagaaagcgagagagagagagaaagcgagagagagagaaaaagagagagagcgagagaaagtgagagagagagatagagaaagcgagagaaagtgagagagagagagcgagagagaaagcgagagaaagagataaagcgagagagagagaaaaagagagagagagcgagagaaagtgagagagagagagagagagaaagcgagagagagagagcgagagtaagtatgcctttatgttccgtttttcatcgctttaaagaaagataattaggaattgattgatgtgtttgttatgatgttaaacagcaaacattggccaagtgaatcgttccttttactttgccagtaaattatgtatacctagttagttaatcattcgaattaattgtgtcttaattaaaaaccaaaatttaaattttctaacactcaagaggacaagacttattggtcatattgtaatattttttttttaatctatcgatggctctaaatgttatccaatagaattaataatttaaaaaaatttatgttgaaatagccaataaacaggcgaaaaaatgaacgtcatcaaatttataatattaaccaatttaataatatatttgacattaaacaaattctgtcagattgagcatattgatttggaaaatttgtaatattttttgctaaaattattataattcaaaaataagtcatttaattgtgtaaagtttgaaaatattttaaaatcttttagactgtcatataaaaatg

SEQ ID NO: 104940 - DNA, 103 bp, Heterodera glycines
  Promoter: Source sequence=SeqID_21812; Location=1..103; Strand=+; Gene=SeqID_52440
ggggatcctctacgagttaacataaaaaacgacccctttcatccaaaaaatatgttatcagaacaactcaaaaataccaatcataacaaaagcgatcaaaatg

SEQ ID NO: 104941 - DNA, 1003 bp, Heterodera glycines
  misc_feature (472)..(472): n is a, c, g, or t
  misc_feature (833)..(833): n is a, c, g, or t
  Promoter: Source sequence=SeqID_32596; Location=174..1176; Strand=+; Gene=SeqID_62901
cattttttactagtcaaaaactcattaagtttttttgaaaattcgagattttatttgaaactctaaaaagtttttttgtttttgtctacgagttgcctattattagctttgctttttgtatgagttgtcatgacatcgggccaaacgatattttcgtataatgtgttgttcattttccatctcctttcttggcaacgcattgacgtattaatgttaactgtttggggtttgtacctatttgttatccatgccgaagttactaatttgctaatatttattttatttttatgggaatttaaaatttttgagaaaattctttcaaaaaaatattaaaaaattaaagattttttattaattatacagaaaatttaaaacttgttattaaataatacagcttttacctcgttcgatgacattataataaatgtatggtaaattattttaaataatttatatatatttttgattgttntaaatgaagaattcacaaaagaaaagctgactttatgaaatcgccagagaataagccgccattattattaattttttctgtgcattgtgaataacctaattcaccaataattaagttaattgacacctttgcttttatcaaataaaaaaaatacagcatgtaaacaaaaagtgcaagaatattatttagcttccaatcaaatgcaagcccgtagccagaacaaaatttcggaggcggaaatccgaagaccttgttgttttttttgctcgccgggccaaaaaaattttgggactaaaatttcaaaaaataagatataataaggatggggggggggtggggggatctggcggttaaaaatccngattcctgtttttatcagtgatccaccaatcaatcacatattctatatttttgaacaaaaatccgtgtgtttttaaaatttgtaaaatttcacataaacattttcttcgaaagaaatgcaaatttaaaaaaaaatctacgttatcgcgaatttttaacttttacagaatg

SEQ ID NO: 104942 - DNA, 632 bp, Heterodera glycines
  Promoter: Source sequence=SeqID_375; Location=2269..2900; Strand=-; Gene=SeqID_84838
aaaaatatcagcgaaataaatcattaagcatcaaaaatttaaaaagttagtggaagcctgaaaataagaaaaatcttagaaataaggacattattgatctcgaagatctggcccctccaaataaggacaaattttagaaataaggacacttgggaacctggtgataaatagattggttatttggcggtttttagaaattcccagatgtcgactccccaagttacaaatccctataatcaattcttaaaagtgcaaagggatttttaaaaaattataaaagaagaatttttcttttctgagaaggtgaaacaatcaatttgtataagaaggcgagaataggaaaagcagaagaacaaatgttgcaaaacgaagaaaaataaagcaaaaaatgtgggatcaaaaaaaaatttaaaatgccaattttgtataaaaatcttagccatatgattcattttcgggcgttcaaaaaaatcaaatcttcagtttaattcgtcttgtccttcccggttgatgggctgatgatgttgtgcattgttggagcaacaacagcacagcaaacgcataagccgagcacgcaattctttttttttcaaaatataaaattttttctaaaattttataggcaatgaatg

SEQ ID NO: 104943 - DNA, 453 bp, Heterodera glycines
  Promoter: Source sequence=SeqID_13583; Location=804..1256; Strand=+; Gene=SeqID_77482
tcgtccatgctccgttttcaaggacgggtatggcgatttgcaaggacaaagtggaaatccaaggacatttaaaattttattctatgcaatgaaaaattgttaatatttatttaaatggcttgtatttttcaccggaatggattttttcaaacatttttttgttttcactgatttttcctcatttcaccgcatatgctcttttacggcgcgctttttccaaaaaatttccggggaacagggggggggccggcggtgccgttttaccaaatgctcattttcaaggacgtccttgcatccaaggacattttttattttcaagaaagagggcgcgatttcaaggacgtccttgccattcaaggacggatgacagccctgacttacatacctatttcaatttatttctgacgaaacattaacgattaattcttgatgcttttagaatttcatgtgatg

SEQ ID NO: 104944 - DNA, 1003 bp, Heterodera glycines
  Promoter: Source sequence=SeqID_2972; Location=171..1173; Strand=+; Gene=SeqID_82577
caattttttgttataattttatttttatgcatcattttgtgatatgttaagggttgtatttgtcaaaaaaaagattttttctcattggaataattcattttattttaaattaaattaaacaaccgagtcaataaatactgaattgtataaagcattgtttttcataaattaaatttttcgtctttttttttaaattaatagttttaaaattattcaacaatttttaagaagtattatccattttcgttcatacaatattttgtgtttttgcttacgtttcgagaccgagactgaaaaatatgaaatcgagcccaaaaaaaaaacccgagacttttctcgagtgagaccgagaggcacgagcatcacaactaagttatatattcataaaaaaatgataatcaaaatttcttgcatattttcaaaaaatgaacatttttttgtgtaaatcttatgcctaattatctttctgttcattatttttcactttttaaataaatttgttaaacataaattaattaacaataataaaaaaatttcatatgtttctttctcttatgcctaattatcttttctgttcattaattttcacttaatatagtttatacaataattatttaaatacatttattaaaacataaattaattagcactaataaaaaaaattacaaatttttatttccgtatttttttagtttccgtttaaacgcgtgacataaagcaggctaatattttaatgtgacaaaggtcaattaaaaataaaattcacttccgatatcatttcacgatatgatcaaatgattgttgttattaatttctacaatatataaataaatctcggaaatgaatgaatcacctttataaattcataaaaattctgcaatttatatttatattagagttaaagtcattagaatgacagtatttccatttttgtgtatttcttaacataatttatttaataaatttgtttttttaaggaaatattccacaaatctttcaaatg

SEQ ID NO: 104945 - DNA, 55 bp, Heterodera glycines
  Promoter: Source sequence=SeqID_3745; Location=2617..2671; Strand=-; Gene=SeqID_51710
agtgacggaaattttattgttttttcatttttggattttcatttccaggaagatg

SEQ ID NO: 104946 - DNA, 134 bp, Heterodera glycines
  Promoter: Source sequence=SeqID_11877; Location=2848..2981; Strand=-; Gene=SeqID_75388
tttgtggcttaaatgaaaattgaaatgctttgtctgttaaatctttggaagtcacgttttggctttagccgtgcacactggaattgggcggcaaaagcgcgtgtattgtgtttgaagacacggacgtggagatg

SEQ ID NO: 104947 - DNA, 693 bp, Heterodera glycines
  Promoter: Source sequence=SeqID_12335; Location=1675..2367; Strand=-; Gene=SeqID_75936
agaaaacaacagaatgaggagatttttgatggtttgttgggaaagtctgtcataataattgtaagatgagctatatcggagaaattcaggtgcattactttttcccccgagaaagttttaaaaaaaatttactatcttagtttctcaaggaaaaaatctttttcaaaaatttttcttatataaaactataagattttgtccttgagaaattttcaatttagtaagtttaaaaatttaactggggaaacggaaacccatttcataccgcactctgaaattattttcaaagaaagtcttgctaaatttttgattggaaataacggaaaactaaaaaagtttgtcttctcagccgactttgtgatcgagtcagacttaatgatcccgaaagtttttcgcctttaagtacatgcacaatttaaaaatataagactaaaatttttaattttgacacgagaaatatatttcacagaaaattaaccccccaaatcattagacgcaatcaccacctatcatcagcaacaacaacaggaatcttcgaaaccaccagacgaccccatcccaccggttgaccaccacctccctccacaccatcgatttagcgaccaaaatcagcagcatcgtcaccaccagcaatatgagtccagcattgattccgccattgattccgttgtccgtggtgacgcgttggtaatg

SEQ ID NO: 104948 - DNA, 265 bp, Heterodera glycines
  Promoter: Source sequence=SeqID_42233; Location=1233..1497; Strand=-; Gene=SeqID_70181
tgatgtttatgatgatcatttggcgacaattggaagcagatcccccgggggagaaaggccagaaaaacaaaaaaaaattccaattcaaattagccgcggtggcgagaggaaaaccgatcgctaatagcgataaaagcccagcacgggatggatgatttggatgtacaattcctttttatttgtgcaaatatttgtagacaaattataattaaaatagtaatatatttttttttggacttgaaattcatttgattgaagtaaaatg

SEQ ID NO: 104949 - DNA, 135 bp, Heterodera glycines
  Promoter: Source sequence=SeqID_6413; Location=7040..7174; Strand=-; Gene=SeqID_61466
aattcggagccatcgactagcgcatccctttgaccaataaaaaaaaatatatatttgttgtgcttttttttgagtgtttaataaattttttattgttacctttattcaatcttttctcccattaagaattaaatg

SEQ ID NO: 104950 - DNA, 169 bp, Heterodera glycines
  Promoter: Source sequence=SeqID_14586; Location=2134..2302; Strand=-; Gene=SeqID_78657
tttttctataaaaaaaattaatgggaaataaatttatgaaaatgatttaatgcaaattatcaagaaaaattgtaatcctataattcgcgttttgtataatactaaaataatcatttttcatttttcataaattatattattcatacaaattttttattaatataatatg

SEQ ID NO: 104951 - DNA, 183 bp, Heterodera glycines
  Promoter: Source sequence=SeqID_4733; Location=1608..1790; Strand=-; Gene=SeqID_55557
ccccccccgaaatgaaaattttaaatgggtacatttttgaattttacagtcaattttcgtaacaaataacactaaaattttcaaaaattttcccggcggcgcctatcggcaccgccggacctccattttacactattttttgctttaaaacggccaaaattgggttgtttttagtgaaaaatg

SEQ ID NO: 104952 - DNA, 611 bp, Heterodera glycines
  Promoter: Source sequence=SeqID_10744; Location=1..611; Strand=+; Gene=SeqID_73989
ttttctacattaatacttattttgacctgacatgtttcttttgtgcgccgattatatcctgtaaaatataaaattggctcttaaccataaaatggtcattttaggtaaatctgattctgatacttttagtccatataaattcatatttgggaatttttgggaatacatttttctatatgttggcactttttaattcatattatgatccataattgaccatttttgagctttttaatccatcgggcttttttagtccatttttatgtccatatttggcgatttttagtccatataatttacaaccctactgataacaaattcaagctaaaatccccaaaaattgtctcggcggtgtctgtaggcaccgaaggaggcaagtttaggctttataagcccgtgctttaaaaaaatgcttatttaattggaaaattttcgtgccatctcactgttaaataatccgggcaaaatgccatgaaaattacaatttatatgcttacagtgttcgtctccgaaacgcaacgtccgcgctggcaaatgccattgtagcacacttcttcgccgttgttaaagcctctgcaattgccgccctggcgcactttggccgcgcaatg

SEQ ID NO: 104953 - DNA, 552 bp, Heterodera glycines
  Promoter: Source sequence=SeqID_36707; Location=539..1090; Strand=-; Gene=SeqID_65958
tcagatccagcaaaattaatagagcttcctattatccgatagccctacgtgtcctctattagcttgcaaattttcaaaaaattttatagagtttaaaaaaagttatggccaaaaatctgtgaaaacatgttaccttgcgtacttttggccatagctttgctcaaacttgaccaaattttttgaaatttaaatgacttgtagagaaatgttagggctatcgaatgataccaagaatgtctaatttggttgacattgacaaaagttttgagcagttttttgttgaaaatttccatttgatggttttttatattgcgtgttgtgtgcgtggtaacgctcgtaatatgcagtcggccacacgccaattggataaggacaggcaatttttttcatttgtttttgaatggttccgtgttcccttttaagtttccagtgttgttgccattttttaaatttggttattcaagatgcgctcaaaaatcaatgcctttctgaaattatcttgaaggcaaaagagtggactaaagaatgccgaaaaccctaaattaagaaatg

SEQ ID NO: 104954 - DNA, 1003 bp, Heterodera glycines
  Promoter: Source sequence=SeqID_11963; Location=538..1540; Strand=+; Gene=SeqID_75482
tcttatgtcgctgtgcccaagcagattctgttagttttagtgccaccgttttcggaccaaattttcgagtttcgcacttttggctcaaaagcgatttaaacacaaggaaacgcctgaaagctaccaattttgcaataaaagataatttaggtaaaccgtttttagacggaatgaaagcttttgtttgtatttcttggttgcttaaataatacatacattaaaggattttttacaaatatgcttttttcccacaagaaaaaataatgaaatgatccaaaacagcgggggaaaattgtgtgtgaaggaggggacggtgaacagaaggaacatcattagtactgtaattagcgcaagattaaattcattatgaataacttcttctcaaacggattcacacccctaaaaatcgaatttttgaattcaccccccggggccgaagcaaagggttggtacgcccttgagagagaatcgaaaaaagaaaaattgctgaacatctttcaatttggacactttgcttatacataattttgacactccaacaacttcaagggctcaaaagacattcaaacaaaagcaaagttttttaatcattaaaaaaatattcggaataaattttccgtaggaatttaattaaagttaacaatttttcatatcaaatttcacaaatttgttaattgcctgacggcgcctttggtcccccggaccaacctccatccatttatcaactttttttaaaaatttacgcaaaaaagtgacatacatatgatcatttttggacaaaatctgataagaaacgaccaaacattttcaaaaatttatcgaatagcaatttgaaaaaatgatgcgcattatgaaaaattgtccttttatattagagttgtgagcaatctcctaaaacaaaatttcatcaccatttcctggctataaaagagccaattttctgtttttttttattattctcacatatcttatttggcgacactattgcctattctttactatg

SEQ ID NO: 104955 - DNA, 392 bp, Heterodera glycines
  Promoter: Source sequence=SeqID_17712; Location=290..681; Strand=+; Gene=SeqID_82244
tttttgatttttcgaattcttcctccaatttaatgaatttctcttccagaacaaaatcattaatttcttcgctagcacttagctcatccatcgatctctccaaatgtccaaattgggaactcgtacttgtagcatttacgttcaattcatttccgacttgccgaaattggctgcaaacagcagcttcaaacgatcgcagtcgtttcagcaaattccgaaataatttattttcctccgttgtgaaaaattcctcggcaaaatccgatcctttgtcctttcgtattttcggtcctattcgcagctgaaccaaacgaacaaaagcagtcgacaagcaattcggcacaagcacttcatcaacacaaagtacatcagcagcaacgttcagcaacatg

SEQ ID NO: 104956 - DNA, 152 bp, Heterodera glycines
  Promoter: Source sequence=SeqID_10692; Location=161..312; Strand=+; Gene=SeqID_73942
ggtgaacagtaaaaaaaattagatgaaatataatgaatttaaggagtttttttagatatttttcgatttttagagtaaattatcaatttttttaaattttatattgcaaatattatttaaagtaaaattttaaaaaacaggtaatttcaatg

SEQ ID NO: 104957 - DNA, 178 bp, Heterodera glycines
  Promoter: Source sequence=SeqID_4170; Location=1..178; Strand=+; Gene= SeqID_53443
accgaccgaccctcttgtccggtctctattgtttagaatcaaaaatttagtatcatctaccacgtgttggtgagccaaggatttgagcgcatggaaaacatttggtttgattgtgagccgatctgttgccaccgtgttaggcaattccatggcattaattttataatttttcgacatg

SEQ ID NO: 104958 - DNA, 633 bp, Heterodera glycines
  Promoter: Source sequence=SeqID_14875; Location=129..761; Strand=+; Gene=SeqID_79022
tttgccgaatttgacatcgatttacgcgccgggaatggctggtgtggatggacatggcagcgcatttgtataattttccaacaaaaaaaaaacttgggaaacttttctatagttttgggcagatttgcatcaaaaaattgctaatttgtgaatttttggaaaaattgaactaaattttttggaaaatttaggcgaagtagatttcggaggtggtaccaacaagcaaaatcaaaaattttaaataagaaactatttttgaaaaagtcggaccgcctagccctaaaaaagcttcaaaattattttaagcaaaagaaaataactgcaaaattacctcaccctcttcgattttttctttttctaaaaaatcacttgaaaaattttaagcgactttttctgaagtttttcctagaaaaaaattattaatgtttttataaggttttggatttttgtgctactttaaattaatacggtttatgaaatacagtgttttgtaacttgcagaaaaatttgaggtatacgaaaaaaatgtgattctcctcgctaataaaatattctctttttttgcattagtgcccaaaactcaaactttcctttgcaattttcgcattttattttttggcacttttgtctatg

SEQ ID NO: 104959 - DNA, 88 bp, Heterodera glycines
  Promoter: Source sequence=SeqID_3921; Location=2514..2601; Strand=+; Gene=SeqID_52457
tttcaacaaattttgttccagttttttaattggccaattaaaaacaataattttgacttaggacaaagagaattccctcggcgtaatg

SEQ ID NO: 104960 - DNA, 383 bp, Heterodera glycines
  Promoter: Source sequence=SeqID_15725; Location=1952..2334; Strand=-; Gene=SeqID_80047
aaagaaattgaaaaaattttatggaattcttattgaataattcgataaaattaatgacaacaaattcaaaagctgaaaaatgagtttatggttttaattggtattttattcaaaaatttaattaagctacttcggatcaactctcaaaaatagaaaatgatcagaagactctatttgaaaaagtcagtgaattggagaagcagcaaaaacagcagcacgaaaacacgaccaaaggcgggggaattttaagcgaagaataccaaaattatcaattattaaaaagttctttttatagaaggaatttatttgaattaagaatattaatttatgcccattatattttaaaattaattttagcaacttcggaccaattctcaaaaatg

SEQ ID NO: 104961 - DNA, 103 bp, Heterodera glycines
  Promoter: Source sequence=SeqID_1144; Location=833..935; Strand=-; Gene=SeqID_68548
tttttcaccaccgccccatttcagtccccacagtggctgctgcgaatttcttccgcctgccttgcgcgccgagcgcacggagcgtctacagcgcgagccgatg

SEQ ID NO: 104962 - DNA, 1003 bp, Heterodera glycines
  Promoter: Source sequence=SeqID_10961; Location=413..1415; Strand=-; Gene=SeqID_74269
tatattctacaattctattaaattattcaagagatttgatgtctgattaaatgtaatcaaaaagaaaaaattatagtttttgaattgaatcagtgccaatctctgttgtcgtgagtggaagtgtcgcacgagagaatgtcttctttccaatctctgtctgtacagctgatcagcatcagatcgttagtaaccttgatcaattaggaaaatgtcaaatatgtaattctcagtgtgaccaattctgcttctttttttgttgcttttttggcagttttagcaaatgctttatattttcacgttaatttgtcaattttcgtaattttactgataccgtatcctaaaaatacagttgaaaattctcaattaatttttaattatttttttttaccaaatcgtaaagtagacaaaaattatttttgtgcaatcgtttttaatttattccattttttgccacttccgttcatctctgggaaagcaaatttttctgatcactgttttgatggacaaattatccacaaatgggcaaaatgatgatgaatcaccgccacttttagctttgggaaaagcagaaaattccgatgctaatttgtgcttatgtgggcaaattggacagattgtgaggctatcagcagcagttggggatgggcataaaagtgattcatcacttttggcattggaattccaatgccaatttttgtgtaaaaagcggcggacaaatcgctgggaaattggggcggagccgccgctaacgtacggacgcgactgacggccatcgacggatcggtcggctttaagcccaaactccgcccaaaatgagctgcataaatagccgctgataggcccagcaaaatcataactgacttcaaatccctttaggaagatcactaaccgatttcaaatcccttatcaaaatcattaatagatttcaaatccctttaggaatatcaattaacctcttcaactcccttttaatccccaaagccgaccatcaaaactccaaatg

SEQ ID NO: 104963 - DNA, 436 bp, Heterodera glycines
  Promoter: Source sequence=SeqID_18793; Location=239..674; Strand=-; Gene=SeqID_83473
ttttctgaaggaaaattgcatttataagttattttcttcctctttatttatgcaataaaataacaaaactcaaataattgccgatggcctccagctgattttactgggttatgcactttggtacttgcttttcattttacgttgttacaattaacggaattgcaccctaaaaaacaacctcatattctgtcaaaaaaagatgtataaataattcagcgtctgacccgaaaactttattttgtcatcaaatgcagtcccgtttttggggcctaaaaaacaataattgaataaactccaacaattttctcattacatacaattctctttctcacaatcagaattttacagtaaaaaaaatacggcaatcgatcggtgtgttgcttctgctaattagtcatttacttatcattatcattcacaacgttcatttttaatg

SEQ ID NO: 104964 - DNA, 1003 bp, Heterodera glycines
  Promoter: Source sequence=SeqID_15474; Location=898..1900; Strand=+; Gene=SeqID_79748
tttgaatttatataaaaggatttgcatcccaccttaacattttagaattccgttttgttcttatttagatttagtccgaaaatgagcattttgtttttgggtgtgaccaacagcaaaagcaattcgattgggtagcctaaagaatcgggggcgcaataaccagaaaatatttcggcggaggaatccccccaagccctgcggcaattttgccttttacattatgctaaaaaaatttgttagccaaattatgacctaattaaatttctgggctttgtggcgggctcagaggctctcactcctccaaatggaaccatacaaaaaataaacaattttatttaaaaggtcatttggaattaatttatgttagatgtaaattggtgtttatttagttattgggatttttttatttcaaataatttctttttaaaggttttaatgcatagctttcctaattcatactaatcgggtcacacacaacgaaaaatgcggcctgcggccacacacacacacaacagatgttggccggtcacactttcatttctcaatgattatgtaatcataaatatggccacaaaatgttgctgtgctttcatttatgttgatcattctcattggagcattaaaatattttttattggcactaaaattcagcaaaaaatcctcatgagcttcaataatttcccgtttttaacttcgtattttgcgaacaaaagcaattttgtatgtatagttttaaatacgcaaatattctcattaaacttataaaaaccacaaaataagacaatttttataaatccgaaccctttaaatatgctaattcttttttaaaatcacttcgggtcagatcacaaaatcactttcatgttcatattttgcattgattaaaaccaatttgcaaaataatcaaaaatagctacctacgaaaatttttaactaattttgcgtttcatagtttcgtcaaattagtaacaaaatgacgattatttatatgtttcagaaaatg

SEQ ID NO: 104965 - DNA, 407 bp, Heterodera glycines
  Promoter: Source sequence=SeqID_13700; Location=593..999; Strand=-; Gene=SeqID_77615
ttaaaaattcggaccaaaacggtgcaaaatatggtgaaaaaggtgtcttagtaattagaaatggaaaatttcaaatttttaatttactttcatcccttactatggttcaaactaaagtgccacgggaccgggaattttgggcaaacccgggaccttttcggtttgaaaacccgggaatttttggctgggaaaaacccgggactggtcccagtcaaaaccgggaccttggtactcagttgtccgcttccaggtcctggtcccgtggcactctagttcaaaccccaaaaaatttttaagtggatggacgcataatgaataacgagcataatgagtaatagagaatttatgtctttatgcttagaaccaatatatttatttaaaacaatgtgaatcaatgagaaaaaatg

SEQ ID NO: 104966 - DNA, 236 bp, Heterodera glycines
  Promoter: Source sequence=SeqID_37674; Location=1..236; Strand=+; Gene=SeqID_66685
attttggcaatcgttgaaatttgtgcaaatatattgagttttagttttaaactaacgaacaaacaaaaaagaaggttggcacaatacgccgatttttatagagaaattgccaaatctcgttcagagaaaacggcaagaaaaaggatacaacaggggagtggtatagccctgggagctgtcttggtcccggtactgagtgttttagctcaacatttattagaaaaaataacatcatg

SEQ ID NO: 104967 - DNA, 213 bp, Heterodera glycines
  misc_feature (63)..(63): n is a, c, g, or t
  Promoter: Source sequence=SeqID_14333; Location=1..213; Strand=+; Gene=SeqID_78366
ggtaatttctgaaaaattttggctaatttctatcaaaattcataaaaattcttaaaattttcnccgtcggcgtttatcggcaccgccggcccccaaaaaacctattattttcttaaaaaattacccaaaaatccctaaattttggttatttttagacaaaatctgtgtaaatttatgtcaaaataaatagaatctaggcgatcaacgaatatg

SEQ ID NO: 104968 - DNA, 304 bp, Heterodera glycines
  Promoter: Source sequence=SeqID_16371; Location=1916..2219; Strand=-; Gene=SeqID_80760
ggtcaattttgggcgcaatgtgcttctttaagtcctgtgaaaatttaatagattttcttgttagaatacccgatgaaagggttcaattttccgaggtgtcagagtttcaaggccatagcctgacccttggatttgggggggggggggtaaataaaaaatttgattatttagggggaggagggtgtattttcttttttagaaatcccgaatagcaagaattttgcataaattgaagccgtttttcgccaaaaaatgactatttttgtcattttggtccacattttttcaaaaatatggtaaaatg

SEQ ID NO: 104969 - DNA, 282 bp, Heterodera glycines
  Promoter: Source sequence=SeqID_12901; Location=3250..3531; Strand=-; Gene=SeqID_47088
aaaaacgccgtcaaacaaaaaaaaaaaaaattttttttgttaaggggggtaccctttaagtttaaaaaaaaaatttttttttatcatgtttagtcatgaaatttgacccttggagttttggggattgctgattacaaatctatcatcttaaaaaaagttttggcaaactaaaagtggcccatgtggtttttaaaactgacattttctaaatagcggcaaaaattgctttttcaaaattctctatcgcataaatttttttattttttttttgcaacagtcatg

SEQ ID NO: 104970 - DNA, 776 bp, Heterodera glycines
  Promoter: Source sequence=SeqID_1083; Location=1837..2612; Strand=+; Gene=SeqID_67447
attaaatgaaaatttttttgaattatctggaactccttgcaatttccccccccccccccattcagtcttcccaaatttgtatgcatcggaattttaattaattttttatataagaaaaaataaaaaaagtgtaaaaaatggtttaaaaaataggaaaaaaatgcgcgaccgcgatccgcgattcgcggtaatttttttgcgcgatccgcgatccgcgaccgcggcaaattgaatccgcgacgcgcgatccgcgaccgcggcaatttgaatccgcgacgcgcgatccgcgaccgtgggatttttctgtgcgcgctccacccctgatgtagactctttcagaaaagaatttaatatttaaagcaaaaaatatttgtcgtttggatattttatttaatattgcaataattttttttaaatttcattaaaatagtatctatttcattcaaatattcatttattaattattacctataattatgaattagtatcaattaattcaaaataaacatttggaaccatgaaataaataatttataattatggaaaaaaatttatgttaaaaattcattggttatttatttcttattaaaaattaatagaaaaactagcttaatcaaaaatattatttatatttccaattaagcaatattttttattttacaggaaatcaattgaaaggcgattttaacatcaataactagccaaaataataatcaaaaattatattttacaagaaaaaataaaatttattatttttttaatttgtgaagaagatg

SEQ ID NO: 104971 - DNA, 57 bp, Heterodera glycines
  Promoter: Source sequence=SeqID_3485; Location=1..57; Strand=+; Gene =SeqID_84869
ttaaatttcaactggtgaatcatttaggaattaaatcatttacattcttttaaaatg

SEQ ID NO: 104972 - DNA, 738 bp, Heterodera glycines
  Promoter: Source sequence=SeqID_7202; Location=701..1438; Strand=-; Gene=SeqID_64124
agtaagaatgggggggggggagaaaggggtctgagagaaaaataagttttaaagaaaaataattttattgttctttttaggcgcaaaattgtttaacaaatttagcctaaattcctcaaatctctccaaaatctgccaaatttttaaaatttggtccataaatccacaaaaagggttattttttggacatattctgttaacaaatgcttatcggcaccgcggcttcctccaaccactagaaaattttgaaaaaacatgtgacagaaaaattatgtttgaaaacaaaaaataagggagaaaaactttaaaatttaaagtaaatgaaattccaatttaatttatgataaaaattgattatttttaattgatggatttttattcttttttgctttttacaaacaatttgggttttctttcttttcaccttaaaaataattaaattaaattatttgatttttttcttttggaaaaaattgaaataaagttccggcctcgatcactttttcgtaaaaaaaagtgccaaaaaaaatttgaatagttcttcagcaaaaaatctcctgtctcgtgttttaccccctcaaaaggtgggttttattttagggtgaggctctaattaatggggggggggctgtattttaggaaatacggtaaattaataaatgcattttgatagacaaaaaacaatttcgaagagagagcaaagacacaaattatgctgcgattgattgtgccaaaatg

SEQ ID NO: 104973 - DNA, 1003 bp, Heterodera glycines
  Promoter: Source sequence=SeqID_9591; Location=1201..2203; Strand=-; Gene=SeqID_71988
atccgttttgttagacgtcagacgcacaaaaagcagtgcaaaaatttgggttttctgctcccatttgtgacgtttaattcaataatttggatccatttttttattttccatttttaaatttcaaatttgtgcaaaaactttctaaaaatcataatttccattgatgaaaaattattaataaatttttatttctttatttttttaaaaccccgaaaaatctgaacaataaaaagtataagctaaattctctttttcgtcaaattcattatttgatgggttttcccataattttacctttaaattatttaaaggtttttttcaaaaaaaaacccttcaatttttaaaccgttttcgtaaattaaagtttattttaagtcttacacataaataaaatttgttgaattttttttagaaagttttaataaaaataaaaaataaataaaaaactcctttttaattaatattttaacatttatttatttaaaaatttacaaaatttaaatttattaatttcatatttcaaatacaaacatcttcctgcaaatttaatgccttttttacttttgccaattaatttgttccttttttggccctcattcttcggcctttcccatcccctaaaatcccctgggagaatttgcagtgaattccgccggcgccaagagcaaagaattggtatcttccccatttttgtgtgaccataagctaaaaaaagccgcaaaaaataccctaaaacttccattaagcgagtgccaaagttaggagaacgtgccatcctcatcgccgcattgcaaatgtgccaatgggagacaatggcattttattttcaattttttacatattttgaccccgaaaaattctttaaaataaatgattttcattttatttctttattgtattaaaaattagtgtaaaaataaatcatatttttacttaagatttaaattaatttatctattttttattatttgaatatttttgatttttgtccaatttctccatg

SEQ ID NO: 104974 - DNA, 184 bp, Heterodera glycines
  Promoter: Source sequence=SeqID_36954; Location=1..184; Strand=+; Gene=SeqID_66147
ggggagaagcatgcaaaacagacggagagagaagagaaaatgagacgatcagaaatggaagttatacacaaagcaatgaggacggagaaattggggtgatggtcgaacgaggacaatcactttgtataaattactgtatagtcactctgtattactgtaaatttgtagatagaagagaaaaatg

SEQ ID NO: 104975 - DNA, 908 bp, Heterodera glycines
  misc_feature (25)..(25): n is a, c, g, or t
  misc_feature (41)..(41): n is a, c, g, or t
  misc_feature (53)..(53): n is a, c, g, or t
  misc_feature (68)..(68): n is a, c, g, or t
  misc_feature (101)..(101): n is a, c, g, or t
  misc_feature (106)..(106): n is a, c, g, or t
  misc_feature (121)..(121): n is a, c, g, or t
  Promoter: Source sequence=SeqID_16597; Location=1..908; Strand=+; Gene=SeqID_81008
ttttggaaacaaaattttttttcgnactcaatgcatttttntggccaaattcntctcgggaatttttnggacataatttcattttttaaataattttaatntattntaggaattaaaaggngaatttattatatttttatataaatattcattaaaaataaaaaatgtcctcaattttaataaaataattcatttggctttgtttaaatgacaaatttctttaatcatttttatttaattttttggaaattctttttaattttcaatgaaatattttcaatcttttttcaatataatttttaatttaatttagcgttttcaattagctttaattttcgaaatatttttctttttatattattatatttaacccaaaattttatgattttgtttttttaacatttttttgctccatccaaatttatttttggcattttccgttttttttaaaatttcatgtttggcattatgtccattccttttttttaaatatttcctcaattagctgcccattcccaattttcatgccattctttcttcccccaccccacttttaaagtctttatatttccctggcgacctaaaagcatttaagtacccaggtaaattagccgtgccgtgccgtcttacagccgacggcacgaccattgattttgcgtttggcacaaatatttttttttgtgccatgccaaaatatggtgcttcaaattttccagatttatttatttttataaaaaattcaatccgaattcttcagagacaaaaaaaaaatgtcggaaaattataaaaattaaaaaaattaattttaaaaatgacacaaactttcacgccaatatttttcaaaaatcatcatggatattttgattattaattaatttttaattagataaatagattttgtggaaatg

SEQ ID NO: 104976 - DNA, 89 bp, Heterodera glycines
  Promoter: Source sequence=SeqID_20290; Location=2102..2190; Strand=-; Gene=SeqID_85093
catcacacctgcccccctcacggggaaaaggttttggcgttattgggggggggggggtacgatcatacggcgaggaagcttttaatatg

SEQ ID NO: 104977 - DNA, 1003 bp, Heterodera glycines
  Promoter: Source sequence=SeqID_2849; Location=705..1707; Strand=-; Gene=SeqID_81926
tccgtcgccaatgccgaaatatttactactgctagtgcagctgcggctgccaaatgaatggagaaatgccgatctctattttttagcgccttttaggcaattaaaaaaattctttggcgtttttgaaaatttagatacaccaaaaaatttctgataattttgaaaatcaatgattttcgaaatcaaagatccaagttctgatataagatcagctattttttgcccttgaaaaaatgtaaagaaaatttttatctttttttccgtcgggacctcgggacaccaatcaattccgaaggattaccgaaaatgaatgatgtcaactcgaagctacgggatttgaactcaatttttttgcggacgcggtcctgcgggattaatcccgcatttaattgaaagatatgtatggatttgtttactgcttcatatgtcatatcatcaacttgaccaaaagtacccacgacaaaatgttatttttctctaaaactttcctttaccccaatttctgtctctaatttttcacccattaatcagttcctcattctggccctgtgtgtttttgttgttcgctataatcttatggcttttctttcttttagcttatattttacgtaaatattcttaaacaatccttaaacaatcaccaaatgtcaacttggattcattgtatgaaccaaaacaaatttctgacttaaacatcacattacaacttaggcaaccaatgcttctcggtgccgacaaaaaactataacaaaacgcgactttggtttacttcgtgcggacatttgctttgtgcgaagtgtctgaaaacgaattgtacgatttttttatgaagaatatttcggcgctaaaaaagcgtttttgaaactaaaaaaagggggacaaaattttcggtaatgatgaaaaattgcggtttttccatgtgttttgaagggcatctactaattccgaaccttgcgctcttcttaaactagcgccaatattgctctgttacactttttcgatg

SEQ ID NO: 104978 - DNA, 1003 bp, Heterodera glycines
  Promoter: Source sequence=SeqID_15579; Location=1075..2077; Strand=-; Gene=SeqID_79869
tctttattatcatcgtttttattaacgcaatcttatcatagtaaatagtgtttgcttttgaattcttttttttttgacgtgtcttggactttctttagatatgtgtgacaaaaatttgttacaaggttaaggaaaatggccagttatcattaaattataaaatcaaatttgactgaaaattctctaaaattttgcttttaaataccggtagaaggggtgaaatcccaacataggggtttggaaatgcatggtcaacaagattagcgtttatgaaaaaaattttaaattattcctagtaaaacaatgtatttttttaaaaaaattttaattttttaaaacttttcatattttcaactatatccccatttttagttgaaaaatataatattcatttaaaatacactgggttattatttagtgttaactcgagagagaagggcccctgcggggattttgcggccgctcacccgtatttttggccaaaatagcaggaattggacccccgtaaacggcagtttttgcgtggccaagtcgctcctactaatcgccaacctccgcccccgtcctttatgttcaaactaaatgtaaacgcatttttccattttgttggctttttcttttattgaaataaataaataagtccgctctcaaatcataaatctttttttaagtattgattgctaaaattttgaaaagcaatttgtgtgaaaattaatttttataaaaattaaccaataactattttatcctttttaactaattcaataaaccaaattttcgaatagctttatttcctgtttttcatatttttttttactcccttctatttttgagaaagctgtgcactttcctatttgaaatccacaaaaaatgaattttgttttcaatggattttgtgatgcataatgaatcgtccatccattcttcgtcacaaatgtgggaacatttttggccaaaaagataataataataatgagaggtgccgaagcatttgaaaaagatg

SEQ ID NO: 104979 - DNA, 594 bp, Heterodera glycines
  Promoter: Source sequence=SeqID_3242; Location=1..594; Strand=+; Gene= SeqID_83860
gaagagaacgaaggttcttctctcgaaacgtccaccattagagcacttcaggtgatcggaagaagaaaaatggaatttactgatcaaaacccaatttgcctgatcatcgaaggcttttgaacaaattttcggttaatttggccattttaattggtttaaaaccggtttttttttgtttccattttatacctcgggactaaaagttatgggcattataaattaattagtaattaattacagattgattgggaatgactgattttgggggactatttgcggaccaacaaaaactttttcaaaatttttcctcaatttttaagttaattttctgggcagattttatagattatataactttttaaattaattttattttacctaatttatttatgattacactgaatttagctgctgatttggacaattaaatttacttaaaattctttaggacgccaaaatggagacatttatgatcgcggtaaggaaaattttcattatctttactaaaagataagtttaatttttggaccaatgaaaatgaaatattttttttataatttttccatttattttttacttaaatttaaacagatg

SEQ ID NO: 104980 - DNA, 314 bp, Heterodera glycines
  Promoter: Source sequence=SeqID_41828; Location=608..921; Strand=-; Gene=SeqID_69877
tttatggtatttggtacgctgaacgcgaatttgacctttttgctcaattctgaacgaaccccgaatttttgtaagacgaatagaacatgtgtaaggcttttgaatgataccaaaattgttagatttggttgataatgcaaaaaattatagctcaaaaactcgggccctgggaaaaaggcttgtccacaataatttttattaattactatatatttgatacataacaagtgtttaccaaatatcatcaaattaactagaaaattgaagtttaaaaaattttgacaaattttttttgaggttttgacagccatatg

SEQ ID NO: 104981 - DNA, 1003 bp, Heterodera glycines
  Promoter: Source sequence=SeqID_11559; Location=1305..2307; Strand=+; Gene=SeqID_75000
gttgataatgaaggacgaagaagcaccacggatttccattggatggaaatgtgcctgattttgacacgtcatatttttgctgtgaatggggcaattttctgacatttaaaaaaatttcaaatacacccctaaaaaccaacttcttgcattttcaaaaattttttttatttattaaaaatgccgaaagcatacaaactgaattcttcattaaattctgctggaatttattcaattgacagcttccaatttcaaaaaaattatcaaaaaaaggactatttcccccgaacacctcgaaatgtatttgatttgcaattgtgcgggcgaaaataataaaaaatgagatttttctgggatttgtatgcataaatacaacggatttttccaattttgagcacatattttattacatatttcagaatttttagcatataaaaatccggtctctattcatcaagtcctgggctttatcttgaaaaattcttaaattatttaccagtgaatatttaatcggccttttcaagatgtttggaataaaatttacaggaattcttaattgatgatagcattctcatcttctactcggcattgcttcaacgaggcggaacagaaattcaaatgttaaaagaaaattcttcgttggtgctaatatggtaaaatgatctcaccacaatttctggctaattattaattacataattaacccccagggcaattctgttgcaaaagatgtgttcaaaaatggcaaaaaatggccacaaaaatggcacaatcttttggcgtggcctcaaattgcgcacagtgccaatgcaaaaggaccaaaacaatgaaaatattattatttttgagtcatcaattgcctcaaagaaatagttagtttttttattaatgttaagcaaaagtgctaaactgctgagccattcactcgcttttctttggaagaaaatggtgagaatattattattttatatattttaaattgactttctcggcttttccaaaaatg

SEQ ID NO: 104982 - DNA, 146 bp, Heterodera glycines
  Promoter: Source sequence=SeqID_2662; Location=1226..1371; Strand=+; Gene=SeqID_80955
tattaaatttttcagaaatacttttggcattgctcagaagtaaaaaagattacaaaaaaattaataaaatcctgagttttaatgttggagtttaattaatactgaaattgtttttatttatattattattattgtattattaaatg

SEQ ID NO: 104983 - DNA, 232 bp, Heterodera glycines
  misc_feature (156)..(156): n is a, c, g, or t
  Promoter: Source sequence=SeqID_10259; Location=1..232; Strand=+; Gene=SeqID_73417
gagcattcattgcttgtcatgaaacttatggaacaaatttacggaaaaattggcacaaattggcattactgagaaaaagttagtgcaaatttgtcagttttaggggtatgatgacaaaatatttgatatacaaccaatcgacagtgatgtgaactntgggcttccggattggaaagaattttgcccaaaattaatggccaataaaattccaaaaaattcagtggttgtaatg

SEQ ID NO: 104984 - DNA, 395 bp, Heterodera glycines
  Promoter: Source sequence=SeqID_1776; Location=1..395; Strand=+; Gene= SeqID_75901
cgctcagtgctgcacgtgtgaaagcctgtgtatggctcgctgcgtggcaatgtgtcggtggcgggccgcctcgcttggctggttcgctgcgccaatgtgggatgcacgctcgtggggcgacctaacggctgtgctggcgtctgtgcgtcgttgagcggttgttgtggcaggcacataacacactgactggggatggtggtttcgttcccggtcttacgtgccgtaactagcggtgtgtttgtgcttgctgctacgtccgtggccgtgatgagacgacgcggtagtgcccgtgcttggcctagcacgtggcttaagactcaatgagtgtcagctcgggcaccgccagctttttctttttttttcattatttttttttacacttctgttgaagaatg

SEQ ID NO: 104985 - DNA, 472 bp, Heterodera glycines
  Promoter: Source sequence=SeqID_21850; Location=515..986; Strand=+; Gene=SeqID_52483
tggcgtgattacggtgataaaaaataagatgaaaaatggtcgatggaatgccttttataaagaaaaatgtgtcacaaaatgtcaaaaatttgggagaaaaacaatgagaaaaattgaaattatagcattataaaagaaaggaaatgaatgaagaaaatgcatagactgaaaatcatttattccaattaccatcatttacctattctaagcagaattttttttttctttaatttgaatgaattttcattcagccctcttaattcattctcattatttaatctttgtccatttgtaatttcaaaaaatttattttaagcgttaccgaacacatatacacatattatacaataatccatctctgcaaacacattgtttcaatggcccgcagatcgaatgccaccggcacgaggaagccgcaccgttaccgtccaggtacagtaacactgcactcatcatctgctgaccccaaatg

SEQ ID NO: 104986 - DNA, 223 bp, Heterodera glycines
  Promoter: Source sequence=SeqID_4625; Location=2126..2348; Strand=-; Gene=SeqID_55136
tttgaaaaaattagactatttctaaatttattcaaattttcaatgcttttcgtctttcttttcttccacgacaaacccttcaatttggaattttaaatagcactctatacactttgttttctttgttttaatgccattttttaaacaatgatatgattttttgaagaaaagtgacacggaattgcttgaccaagtggaggcctatgtgttcccgttcaaaatg

SEQ ID NO: 104987 - DNA, 160 bp, Heterodera glycines
  Promoter: Source sequence=SeqID_1018; Location=461..620; Strand=+; Gene=SeqID_66205
ttcaaatcattcatcctcattccatcatcggatcggactgccaatcaaaacatttcaaaccaaaagttgtggctgaaagtgcattttcatttggcatttattcattcatcattcggtcacttcttttcactctcatttcaattccatcatcataaaaatg

SEQ ID NO: 104988 - DNA, 52 bp, Heterodera glycines
  Promoter: Source sequence=SeqID_24438; Location=2044..2095; Strand=-; Gene=SeqID_55172
ttaagcacttttcaaaattattttctaaaatcaaaaagtcaattttcagatg

SEQ ID NO: 104989 - DNA, 389 bp, Heterodera glycines
  Promoter: Source sequence=SeqID_42000; Location=77..465; Strand=-; Gene=SeqID_70014
ttaatacaggtaaaaacataaataagcgaagtgcttttttaaatttaattaaaatttgtaaaatgacttttgtcaaagtgatctttggcgaataatttttatttaaattttttaaattacctaatttttttattcattaaaattatttattttttttaacaattaattattagattaacgcatatatgtaattgcctatttatgatgtgcctaatcagctgaattcgttttcccttcctttgcttttacccttttccattagttcatatacaaaaacacaaaactaaatttatcagcattaactaaaataattttcttattatgaatctcggacggtgtagcatttgcactttaagctttgacttaaacgatgtttcagctctaagatg

SEQ ID NO: 104990 - DNA, 788 bp, Heterodera glycines
  Promoter: Source sequence=SeqID_24112; Location=594..1381; Strand=-; Gene=SeqID_54814
ttctgattttgtctatatttccatattgtacattcatattacggcatttttacaaatctcaaagacaccactcaatattttttgtttttgtaaaatacgaccttaaaatagaaaaattttggaaaaccatcataaatgtaaattttttttctctctcactctaaaattcattttttaaatgaaaatgattttttaatttttgtaattttttgtaaattttttttctcttctttttctttttcctttttcttctctctctacgcataataattatagattttaattatggcattctataattcatgtattaaataattcatctttcttgacaattttttttttatgggttatgtattctttttccgaaaatgaaaaggaaacgaaaagaattgcagaaataaatcattgtagagaaatgattagaaaacaatggcagctttggcaataaaatgtgatactgaaaaaacatctgaactgagagatactaaaaaaagtgatgaaaagaatccaacagaacctattaataacatagactgcagggctgggacgcgaccgcgatccgcgaccgcggcaaattgaatccgcgatgcgcgatccgcgaccgcgggatttttctgtgcgcgccccacccctgatagactgtccttctagttctggaataggtttaagatgtactgatactattgcatgggcaatggttaaaccagaaagcgatgaataccaaataagacaaaaaaaaggataaaaacagagatgatcagctaaggatgattatttttcagagaatg

SEQ ID NO: 104991 - DNA, 662 bp, Heterodera glycines
  Promoter: Source sequence=SeqID_28427; Location=1..662; Strand=+; Gene=SeqID_59053
ttattgagatattctttttataatgcgcaaaaatataagctaaaaacaaaatatttgccttaagttttctcgaaccaaactacatttattttgcactcaaaaaaatattaaaatttcaaaaaaaagagcaaaaaatcccagtataaaaataaaaaataaagaagcgtttttcaaattaattaaaataatattttatacaaaaaatgtaatttatttattattccacaaaaataatttattcgtttttttccttttctttcggctgacattgggaaaagtcaaatcattttttcacaatttggatggtcatatttttttattcattccgatgctaataatattatttacataaaaatgaataacagaagggatagaaaaattatgtgtacagcgaatgaattttatttgtgtaatttatcattcataaggccaaacaaattattttattggaactaaaaaatttattatttcaacaaaacgaaatatttaattcattttagtcataattatttaaaaaactgaaactataaaaaatgaaaattattccggcattttttattgtgtttttctgtgctcttctgttgattgtcctttttgacggtctttaaaattaataattacactaatacaaaaattaaatgtttttgtttcctttagaaatg

SEQ ID NO: 104992 - DNA, 51 bp, Heterodera glycines
  Promoter: Source sequence=SeqID_10817; Location=3414..3464; Strand=-; Gene=SeqID_74086
gattcggtcggcactcaattcgatgctttcggtaagcttcgccaatggatg

SEQ ID NO: 104993 - DNA, 62 bp, Heterodera glycines
  Promoter: Source sequence=SeqID_31153; Location=909..970; Strand=-; Gene=SeqID_61527
tggcagtgttgttcggctttccgaacacaacgtaaattctctccaatatatggaagaaaatg

SEQ ID NO: 104994 - DNA, 211 bp, Heterodera glycines
  misc_feature (9)..(9): n is a, c, g, or t
  Promoter: Source sequence=SeqID_41682; Location=1..211; Strand=+; Gene=SeqID_69755
catttaatntcgtggtaataaaaaacaaataacaaacctgtctttctcaggaatcgcttcaactttattaaaaagtggaagaacaatacacaatcgatttaaatttccgctaaatttaaatgctcagactgtttccggtgttgtccaaggcacaaaggctgccgaagaaataataaacagtgatttttttgtgattgatgaagctcctatg

SEQ ID NO: 104995 - DNA, 661 bp, Heterodera glycines
  Promoter: Source sequence=SeqID_5030; Location=370..1030; Strand=-; Gene=SeqID_56638
ttgcaggaagaacagaaaaaacgaatgtggatggaattttttttaaatggacgaatgatttttatgtagaaaaactgtgattaaatagcaaaaaaaaatggggcgggacaaaagaaactaaaaggaaaaaaggcggagtcaacttcttagcaaagcaaacaaaaatcaatgggcgtgaccaacaagaaaaggggcggagtctttttactttccatgatgacgtcattttttttacaatttaatgaattgaatcttgctttgccaaaggcataaaatggccaattggttagtgcagcaatttgatatgggttcgagtccagccgggtgcaaaggttttttgctaatttatttaaagttttggatacgatacttgcaaaatgcatgggtatagcgattatttgggtacattcatacccttactgggagaacctttaataaaaatatcgattgataaatcaaaattaaattaaaattaaaatccatttcatttgccagagaaaacatagaatgtactctctccctaagagaccatccaataggtttgggtttgtggaagaggatgtcagaaaaaaaagtggaacccaatcaaataatcgatcaaaaatcaatcgataatttgattgggaatattatctactttcagcatcaaaacaagccaatg

SEQ ID NO: 104996 - DNA, 189 bp, Heterodera glycines
  Promoter: Source sequence=SeqID_42967; Location=1..189; Strand=+; Gene=SeqID_70750
ccgacaaaaccggcattcaatccctataacatatccctgcgattccggtctcgaatcctgaatctcggccccatactttttcaaaattccgggcttcaagagttataacgatttcaaacttcaatttttatttgtttatttataagtttgttggaattatgaaatgctttggcattttgtgtcttcatg

SEQ ID NO: 104997 - DNA, 1003 bp, Heterodera glycines
  Promoter: Source sequence=SeqID_22269; Location=1130..2132; Strand=-; Gene=SeqID_52941
tttatttttctttctctctctctttctctctcccagctcccaccctctctcgttttctctctctctctctctttcttttcctgtctctatatctctcccccccccctctctctcccagctcccatcctctcttattttctctctctcttcctctctttatttttctttctctctctctttctctctcccagctcccaccctctctcgttttctctctctctctctctttcttttcctgtctctatatctctccccccccctctctctcccagctcccatcctctcttattttctctctctcttcctctctttattttgttttctctctcccagctcccaccctctctcgttttctctctctctctttctttttctttgtctctcctctctctttctctgctgtgttcatgtctcctcctaaaaaagtactcgcatctcattataggtatatcatctggtttatctatgtgctgccctttttgcatttgcctcccttcctcaaagtttagtctctcccaacaattcttttatccaatcgttatcccccataacgcatatccatcgtttttctttgtaaaattgaaccctgtagatttttcgtgtctgctcgactcgagactcttgagcagggctgggatttagcagattaaaaagaattcacaagatggctggaattttttttagtcattctgacaatatttaagagagtatacacaaatccgactgatggtttgtgtactaaaaatcacgttttctcagaaatacacgaaatgtttaaattaatttcgtttccaatttaaatatcacccaaaaataaagttgtagttttttatacctaaaaagtctaaaaaaaaaatttgtttttttgcctaaaaatgccattcccattttaatcaagcatattttgtaatccataaaaaatagaaaaaataatttgctgttaatttattttccgccgctacacaaattctccagtattagccgaaaaaacgacctcaaaatg

SEQ ID NO: 104998 - DNA, 1003 bp, Heterodera glycines
  misc_feature (917)..(917): n is a, c, g, or t
  misc_feature (932)..(932): n is a, c, g, or t
  Promoter: Source sequence=SeqID_13631; Location=1071..2073; Strand=-; Gene=SeqID_77535
cggtttttgagaggccgggcccggaaaccggtcattttgaaaatgccaaaccggtccggtccggcacttttggaccggtttttaccggtttatgatatagccaaaaattcttcatttttatacaatttctgttaataaattgcatcgaaattttcaaaaaatttctcggcggcgcctatcggcatcgccggaccctaaaaatccttaattttctttaaaaatttgctcaaaatcgcaaatttttttttatttccaaacagaaattattgaagaggtcattattgacgcctgaagtgaagtagagccgaaattttacatctgggacgatttatggtcaattttgggtgaaatacatgtgaaaattaaaatttttaccaaaccagaaaccggttccgggcccggcaatttgaaaatcctgtttcaccggttttccggtttgaccggtttttgagaggccgggcccggaaaccggttgcttctgaaaatatcagaccggtccggtccggcacttttggaaaatccggtctctactaattatcaataaaacaattattgaatggaggcttgagattcactttgagcacacaaaaaaataatgaatgttacaggacagcgggggaaaattatgtgtgaaggaagggggggatggtgaacaaatgaacatcatcaatactgtacacagcggcccaattttgggctcccagtacaattatgcttattttttatttagtaatcagaacgccaaaactttgcaatgcttaaaaatttccggggattttcccttgtaaaaatagaagagccgatctcgagatagaaaagaaactttcagaaaacaaaagagaattcgatagagagggccaaaaaactagcctaggtaaaatttcaagaaaagttacccacaggaaaaaattttttcncatggcaacaaattnacaaaatcacctactttttaaggcaaaaaatggtacttacacgtaaaaaaattgataaattaaaaagaatg

SEQ ID NO: 104999 - DNA, 472 bp, Heterodera glycines
  Promoter: Source sequence=SeqID_10927; Location=694..1165; Strand=+; Gene=SeqID_74230
atttcaatcgattcatttggtctgttgcccgctgtaattggtgatggttttgatgtgccaaattcaacaatttctgctggccaagcattgtccaaatggttgcattctccgagaaaagatggccaacccaagctattgcattgcaaagacattaaagaacaagcgaacttcgattggatcaacaatttcaaggaggtgtgtggtccggggggggggagcttcaagttttttattttctgaaatcggaattccgaccccaaaaacgtcgtaagtcggaaatttttgaaaatttccgaattttatcaaaatttcggaaatccgaattctgtgccatccctgctggtgtggctccacatttttggcaaatgactgatttttgttttccaatcaaattgcttagcattttctccgtgccaatgccatttcttccgtcagttaccaaattcatttttatgttcgtgcgccgtcaatg

SEQ ID NO: 105000 - DNA, 73 bp, Heterodera glycines
  Promoter: Source sequence=SeqID_24584; Location=1..73; Strand=+; Gene= SeqID_55312
ccgtttctttcacccgtttaaacaggtcattcataatattccatttcccctgttgtcttcctcagttgccatg

SEQ ID NO: 105001 - DNA, 120 bp, Heterodera glycines
  Promoter: Source sequence=SeqID_6694; Location=1..120; Strand=+; Gene= SeqID_62517
tattctttttatatatttattttttaatttatatacttcaagggccatttgtttgttcttttcgtgatgaatgttcttttttgtcctttaggtgcccaggaatgcgctcgttgcataatg

SEQ ID NO: 105002 - DNA, 136 bp, Heterodera glycines
  Promoter: Source sequence=SeqID_36954; Location=834..969; Strand=-; Gene=SeqID_66148
ttttggtggtctgagcgccgaactcaccgaagggggacggaatttgtcctttggggagaggcaactgatttcgctgcttcggttggctttgtccaacccgcgaattattctcatcgacgaggccaccgcgcacatg

SEQ ID NO: 105003 - DNA, 1003 bp, Heterodera glycines
  Promoter: Source sequence=SeqID_39; Location=358..1360; Strand=+; Gene=SeqID_54448
tttatttctctttaaattcagatttgtttttgtataatgagcctgttgggcgtatcaattttgttgcaattttgctatttgcactataaatgtttttttgctaaatgaagtactgaattaaaattctaatacaattaaaggtagatcaataagcagaactggatcccgcgagagttttgcggtaaccaggccacaattataaatttcccgggattaatcccgctggatcccgtctggtaacattttgagtctcaatcccgcagaaggacacgcaaatttgctttttgtgcgtgaacccagcgggaccagtattgaatttttttttgttgagaaattcaaaggacattatgccaaatattttctattacaataaatcaaaattttgataaatgttaatattgaattatagaaataaatttatcataataattagggatgtcaaaaatatgtacaaaagatggtcaaaatatgtacataatatgtaaaaaaaatcccgaaatatgtaagaaaaacccaaaatatgtaccaaatatgtaaataaaatttttaaaatggttatttttttggaaaaaaaattcttcggaaagggtgaaataggcacaaaatgccatcccgaaatatgtaaaatatgtataaaaccccgaaatatgtaaataaaagtccaaacttttgtttgcaaacacaaaaaagaaaatgtttttcctactaattagagcatgtagaatccaggaaaaaaaatatgtatttacataaaattgacatccctaataataatatttctaaacgatggtcgaaaataaataaatatgccaacttccattctttaaattcataatcattatcaataaatttatttttaacaatattttatttaaaagtgtcttgtttcttttacattttttattattttaatgtaaacatgtaatttgtagtgtatacaaaaattttaggcataattttaatttcgtttatagatttttttaggattaaataaattattatg

SEQ ID NO: 105004 - DNA, 428 bp, Heterodera glycines
  Promoter: Source sequence=SeqID_14886; Location=2737..3164; Strand=-; Gene=SeqID_79045
tccaaaattagcccctcagggggtttttaattggactaattgttccctttggctaattagttgtgtttcgaaagaatatttattgccccttgtttacttcatggcgtaaaggttgcataacaaccagtgaccaaactctgtttgtatttaagcaaagtgaattgcctcaatcagcaacagttttcgcaacatttaaataattagtcaattgtcttgtccaactaataacagcaatttgccattttctttttaccattaagcttaaataatttaaattgattatttgcaaatgctaacaaattggcaattttgtttggttttgctcattagtaaaccaattaaatgttgtccattttaatgattattttattagaattttagcatcaaatatccataataatatatctcttctcccaatcaacaaaatg

SEQ ID NO: 105005 - DNA, 361 bp, Heterodera glycines
  Promoter: Source sequence=SeqID_38813; Location=1..361; Strand=+; Gene=SeqID_67523
taaaaaaaaataatgaaaaaaaagaaaaagctggcggtcctcgagctgacactcattgagtcttaagccacgtgctaggccaagcacgggccctaccacgtcgtctcatcacggccacggacgtagcagcaagcacaaacacaccgctagttacggcacgtaagaccgggaacgaaaccaccatccccagtcagtgtgttatgtgcctgccacaacaaccgctcaacgacgcacagacgccaacacagccgttaggtcgccccacgagcgtgcaccccacattggcgcagcgaaccaaccaagcgaggcagcccgccaccgacacattgccacgcagcagccatacacaggctttaacatg

SEQ ID NO: 105006 - DNA, 337 bp, Heterodera glycines
  Promoter: Source sequence=SeqID_15256; Location=456..792; Strand=-; Gene=SeqID_79469
ttaccccccccccctgaaaaaaaaatttttttttttttagttttttttgttgaattttctcccccctccccttaaaattttagttcgttttatagtttttttcgctccaatttccaacctttttttccgtcgctgattaattattggcgggccggtggaactacttctaactaaccacccccccccccccttcaattttagtgccatttttaattcggcaccgctcgtcccccccccccatttttaactcgctttactggcactaaaaatattcgaatttcatttttgcttcattttttttttaaatttttgttttcagttcccaagccttttcatg

SEQ ID NO: 105007 - DNA, 480 bp, Heterodera glycines
  Promoter: Source sequence=SeqID_27460; Location=846..1325; Strand=-; Gene=SeqID_58152
ttttcccgtcgtaattgcatactaaaatattaatgaatattgaactaattatttaatataaattataccggacagaagagaagtgtcatcattaataataaaatgtcagtcacacatatttgcaatagaatcttattaattaatattagaacaattaaatttaaaaatgcaattatttaaggtttttttagaaaataaaaattcaatatttggcgtattttagcaaatataaatacgggccctgttttttaatataagaattaataaattaaaaaattacataaattaaattttaaatttactttgctgtaaatgcgcaattgctttggagtgtgtcgaacaatcaaatgaatcaaaatgacatttaacaaaagtataaatcataatgaattgatgaaatctatagagataaaataatctaagcgtgcgaatgaaattttttgataataataatactgtaattttaagtgtataaatatg

SEQ ID NO: 105008 - DNA, 343 bp, Heterodera glycines
  misc_feature (60)..(60): n is a, c, g, or t
  misc_feature (189)..(189): n is a, c, g, or t
  misc_feature (254)..(254): n is a, c, g, or t
  misc_feature (265)..(265): n is a, c, g, or t
  misc_feature (300)..(300): n is a, c, g, or t
  misc_feature (327)..(327): n is a, c, g, or t
  Promoter: Source sequence=SeqID_29566; Location=1..343; Strand=+; Gene=SeqID_60044
gtttatttgcaaaatttaattatataaattttataaatgatattctattttgtataaatntaaaaatataaaattttaaatataaaaatttttaaaatttataatgtgtataaatttcaaattattagtgcatttttatcgcataacaagcttgaatacagtctttttgcacaagttcaactcaattanagcgaagattcatgattattttgcatatttttaattacaaatttcgcgttttttttagcattttntaactgatttntattaatttttcattaaatatttataattataatntaacaatgtttatattttaataaatanattttaaataaaaatg

SEQ ID NO: 105009 - DNA, 1003 bp, Heterodera glycines
  Promoter: Source sequence=SeqID_9293; Location=2578..3580; Strand=+; Gene=SeqID_70886
taatgtaaatatttatttctaacttttttgtaacctcatccctacaaaaatataaaaattaattttacttcatctttactttgtcaaccaaatctaacattattcacagatttttgttccattccagttgcacaaattggttgaattttttgggtcagatttttgcggccaccagccacaaaacaaatcgaatagttgatagagattggaccggtcggttttcgttatttttcgattttcggtttttgatcgaaaaaaaatcgaccgagaaatttttgagttttttgctttcggttttttgaccgaaaccgttcgaccgaatttatcaaaaaaccgaaacaaccgaccgacttatcaaaaatcgaaaaaaacaaacaaatggcgaattggagcgacataacctgttaataacaatattttagtgcttttttgtgctcatttaaatttttcttcgattttatcgattccgcttttttaaccaaaatcgttcgaccgaccctcttgtccgttctctacaaatcaagcattttatttaactttaaatgaaattatcccataactcacaaaaatttggaaaatttttccaacttaataaatcatatattagcatttattcgttttaatgtgcacaaataagcatcgcaactaaaattaatgtcaatcatggccttgacattttttgcgaactgatcagtcatttaccaatcgctgattaatcatccaaacacaccaattccttcccgcccggccccgctctatcatttctgcgagaataatatataatagaataaatatcttattatatgaaacgaagttgacgggactttagtaccaatctaaaataattagcttgtataaaaataaagaattattaataatttatttataaatttggcgtttgattgccattattttctggtttcctagggcctgattttctatatcacttaatggatttttgctaactcaacgataaattttgatacattgatttagaattatg

SEQ ID NO: 105010 - DNA, 1003 bp, Heterodera glycines
  Promoter: Source sequence=SeqID_8982; Location=1659..2661; Strand=+; Gene=SeqID_69909
ttttgccatttatttatgtgccagattggcattattatgccaccgtttttttgtgccattttgcctcaattttttggcattgttctgccccctttttttcattttcatttgccaattgtcgcaccttttcgtgccaaaactcctcaattatttcttgccagtttttggcattgttctgccccctttttttcattttcatttgccaattgtcgcaccttttcgtgccaaaactcctcaattatttcttgccagtttttggcattgttttgcccccttttttcacattttcatttgccaattgtcgcaccttttcgtgccaaaactcctcaattatttcttgccagtttttggcattctcttttttaaattttaataaattattcaatccttggcattctgttttttcaaatttaaaaattatttttcttttatttcaattcttggcattctgttttctcaaatttaaaaattattttaattcttggcattctgttttttcaaatttaaaaattattttcacatcttggtattctgttttctcaaattaaaaaattattttcacatcttggcattctgtttttctcaaatttaaaaattattttttattaattttccgcttttttcttccaaattttaattatttttgcttccccctttaaaatatgtttcgtttccactctttttttccttttttattcattttccccttgtttttttcatttttcattgatcgaaagtactttgtactgtcctttctcacctcattttgttattttgttggtttactcggtactaaaccctttaggatatttgttaagccttttcaaatatcctgggggccatccttaaaccgaggagtcctgccccggtactgggttacttcccagaggggtgggcacgggcgttcactgtccacggggcttattccgctggtatccagggctgcggcagtgactgaccgaaacccagtttccgtcatagcccgccgggtgtcacagcgatg

SEQ ID NO: 105011 - DNA, 241 bp, Heterodera glycines
  Promoter: Source sequence=SeqID_16233; Location=1098..1338; Strand=-; Gene=SeqID_80611
aaagcttcgaaccaaaactctcgagggtttgcagcaaagatcgtgttgtggcacgctattttttcattttatatttctaaagattttattgtggttttgtttagtttgacaatatttttcttaacaaatgttgaaggttgtattgaacataaataaatttcaaattttggttttcgttatggtattttttatttaaaaaatagtgtaccaatgacaaatacatatcagagataaattaatg

SEQ ID NO: 105012 - DNA, 492 bp, Heterodera glycines
  misc_feature (72)..(72): n is a, c, g, or t
  Promoter: Source sequence=SeqID_13889; Location=1..492; Strand=+; Gene=SeqID_77835
tgaatatagaaaaaaaaactaaaaatgtatcaattagtcctacgttaggggaaaatacagatttcttaaaanagcttgcggccaccaggtctgataacgaaaaaacgatctattgcagggacatccgcagaacaaatacttgcccttgtggaaatttgcgcaaatattttaaaatttaattttcgtctaaatccgagccagaggcgacggttgtcacaatacgcggactattacagggccatagcacgcgctcgcagtgagaactcagctcggcaaaaacttcaacaagggagcggaattgcccttggtgctattcttgtgcctgttctcagtgtcttagcccaaatattatttaaattatttaatttacattattctcataataaaattagggctttttggggttcgcttctcaattaaatcaatttatcgaattgaaaaattgatcatttaattaagcggctcatcaaaatccaacagttgacaataatg

SEQ ID NO: 105013 - DNA, 267 bp, Heterodera glycines
  Promoter: Source sequence=SeqID_9816; Location=429..695; Strand=+; Gene=SeqID_72802
ggagaacgtttggacgcacaaggaaatctcactgtcatttgccggaaaggcgcaaaaaatcaaggactgcggtcggacactcgtcacgacagaccagggatttgcagtggatgccggcaatgttcctcaacatgatcaacaatcgatggtcccagcggagtgcccaaaaaaggccaattaccgggaggcgctcaaaagcggtgctactaccggtggaccaattcagcatcgacactaacatgagactggagatgatgaagtaaaatg

SEQ ID NO: 105014 - DNA, 973 bp, Heterodera glycines
  Promoter: Source sequence=SeqID_14951; Location=1..973; Strand=+; Gene=SeqID_79112
tgaattgggcaggagatgaagaaacattggcaaatgccttttacataaagggattatatgagcaacttaaacaatttgggcttggttagcaacagggacacgttttattaaaccgtaattaaaaatgacgcaattaaaatggtgctcaggaagagctccaaaatgctaggcttgtttgaccaggaaaacgaggggggggggcatttagcgggtcgggagcagggatggacgaaatttcgtttcgttttcgttttgtcctacattttcggcactttttgagtttcgttttcgtgtttcgttttcgtctaccaaagttttttcgtttcgttttcggtttcgtcagagcaaaattggatgaaaaaagtacgaaaaagcactggtaagaataggccccagtagtataaggccccgggggcgggggtccagacccctgcccctgcttaaaaaaacacccatttttgttcttcaggattttgtcccaggtgccggggtccaaatccatgagaggattaattaaattaattcatccagaggcagagggactcgaacccaagaggtctaatccaaagcactaccactgggtcagcgatacaactatccgaaaaaggataattagcaattatatatatataatttaaaatcgattaaataattcaccaacgggagggggattcgaacccaaaaggccaaatccaacgcacaaccaattgaccgaggaacatagtcatccgaaaaaggatatttgtcagttatgtagtaaaaaaaaagtgccgcaagagtcaaaaatggacgggagaggggatgcaggcgacattctcccttttgcctatataaagggatatttgtaagcaaaaaaagcacaaataaaaaaattttttaaatgttcaacgcaccgtttacattaattttatctggcgctacgggaagtggaaaaactcaatggctattgaaacttttaaaacattacagtatg

SEQ ID NO: 105015 - DNA, 99 bp, Heterodera glycines
  Promoter: Source sequence=SeqID_13323; Location=267..365; Strand=-; Gene=SeqID_77188
tttttcgccgatgcggtgccaccccccgccgctgtgcgatctgcgcgaccggccgcgcgacaagcggtggcagcgcaacggcaaccgcccgcggggatg

SEQ ID NO: 105016 - DNA, 210 bp, Heterodera glycines
  Promoter: Source sequence=SeqID_20434; Location=2872..3081; Strand=-; Gene=SeqID_50968
tttcaaaattcatttttaggattcgaattttgggagtcacttttttctgttgcaatttgtcttctgtttttgcccctttcagttggcttcgactttcgcccgattgaccagcgatgggtcggccatgtgctcactgagctgttggacaattgcaaaaaatacattttcgatgtggacagactgcacacttttcgcaacgcgtaccaaatg

SEQ ID NO: 105017 - DNA, 152 bp, Heterodera glycines
  Promoter: Source sequence=SeqID_1957; Location=2170..2321; Strand=-; Gene=SeqID_77018
tctagagtctcattttcggggaactatgaaaagagttatgttcaaaaatatcgggctggcgctcattcgaccccaaccgtaaaatggttccttttttatatggaaaaaaaaaattttttttttacttacagtagaggtacaatgaacgaatg

SEQ ID NO: 105018 - DNA, 216 bp, Heterodera glycines
  Promoter: Source sequence=SeqID_30533; Location=745..960; Strand=-; Gene=SeqID_60951
tttgccatcgccgcgaattgcgccattcacgtgacccaaactgaattttaactaatcaaagattgtaagttcctaacaaaaatttaattttttatttatgtttaaaatgcgtttttcgcaggcctttccgacctcacccaacggctcgtgtatgtcgacgacaagcggagcctggaatcgatctgcatactcttcaatcggatcatcgaaaacatg

SEQ ID NO: 105019 - DNA, 283 bp, Heterodera glycines
  misc_feature (46)..(46): n is a, c, g, or t
  Promoter: Source sequence=SeqID_7158; Location=1..283; Strand=+; Gene= SeqID_46381
gagctaaaattgttttgacaacagctttcggcacttgttctgctcncaaatcgtttattgtcaagtggtcttggtctgggtgacttctttactcctggtaaatggaagccgacaacagatttgccatcctggcttcaaacgtcacggagatgacaaaggagaggaaactttggatcaatacaaattcctcaattttggcggtccaagcgaccgtaattgacatcaaaagtaaatatctaagtctaagattctgaaaatttatatatattttaccatagaaatg

SEQ ID NO: 105020 - DNA, 68 bp, Heterodera glycines
  Promoter: Source sequence=SeqID_4467; Location=4000..4067; Strand=-; Gene=SeqID_54544
ttgcaaattgatcttccacaaagaatgtgccacatttcgctgccaaaattccatgcacatccccaatg

SEQ ID NO: 105021 - DNA, 98 bp, Heterodera glycines
  Promoter: Source sequence=SeqID_10124; Location=2088..2185; Strand=-; Gene=SeqID_73214
cgtgagaaaaaacaattaattagcacgcaataattaacccagctaatgattaattaagcgggatcacaactccgtatggagagcgcatcataataatg

SEQ ID NO: 105022 - DNA, 1003 bp, Heterodera glycines
  Promoter: Source sequence=SeqID_5832; Location=444..1446; Strand=-; Gene=SeqID_59370
tcccctttctgaggaggtttaaaaataatcccccaaggaggataaaaagaggatgtacggtaattacaaaaaaagcaaaatgttttaaattggtaatgatgaacaagagcatttattgttttgcttttctaaaatttttattaaataattatttaataaatttaaaattattttacaaattattttataaagcgaaagtaatttatgtaattatatttttttcaattttaattttatacaattttaatttattttgtcgaattttatacaatgttttaatatcatttaatgcatttttgagcatatccaatgggttgcttaatgttgattatcatcaatttgtccaaatataggttaaatgacccgtaaaattcacaataacttcagctaattaatgtattaaaaatgtgaataattaattaagccgagattcgcccttccctgatcggaatggataaagaatgatgcaattccatttactttatatgtttccaattttttggcatttttctgttttttagcaacgattttttctcgctttttagcacctaaaaattcgttcaaataaatatttcttgctatttattatttttacaaaggttgttgatacataaaacgttgccctcacacaaatgaataaaaaatttaatagtgacaacacaaatgacccgtaaattgcaatagcatcagcaaaatgcatacataattaatgtattaattaattgttttgaaatgatgtcacaaagatgagattaataataattttttagctaattaattaattgtcattataattaattaatagctaattttttcataaaaattcaaagcagctttgtgacaaaaaacgaggaggagcgaaaaaggacaaatgggaataattaagcgacatatcaattaaaaaggcatgccataatgggaggaaacaaaacgccaaagacttagaaacatcgtgatcaaagcaatgaaataaatttccgatcaaaagcactcaatccaaatg

SEQ ID NO: 105023 - DNA, 100 bp, Heterodera glycines
  Promoter: Source sequence=SeqID_26737; Location=1..100; Strand=+; Gene=SeqID_57509
aaagaatcatttaaaaaattgtacacgtttatggaaattttttaaattgtaaataaaatttttaatgccatttttaattgaaggtgtgccctcctcaatg

SEQ ID NO: 105024 - DNA, 337 bp, Heterodera glycines
  Promoter: Source sequence=SeqID_30705; Location=718..1054; Strand=-; Gene=SeqID_61107
ggtacgcgaatttgtgttggactgtgaagttttgtgtgggaccaacgacagcaaagttttggtgggatagaatttcatggaaacatttttaataataaattacgcggcaaaatttagtgggaaaaggaaaacgagcatcggacggcaaagtgtacgacataaaacacatcgacgacgattatatcaaaaatcactcatacctccaaagaagccttggcaattacttacaattagcattttcctctgattattgcgttaattttcagctgttttcgacattttatacttggatggtgtgtctttaatagagctgcccttaacggaacggttgaaaatg

SEQ ID NO: 105025 - DNA, 158 bp, Heterodera glycines
  misc_feature (9)..(9): n is a, c, g, or t
  Promoter: Source sequence=SeqID_44249; Location=691..848; Strand=-; Gene=SeqID_71755
ctccccccncccccccccccaatctcccgtccctcatttgtcagatcactcatcggttttcgctgtatttgctcggccttttcgacctgatcactttgttcatgtctttctgcctcttctatggcatttattcttttaaaagaatatttgttaaaatg

SEQ ID NO: 105026 - DNA, 503 bp, Heterodera glycines
  Promoter: Source sequence=SeqID_16720; Location=1036..1538; Strand=-; Gene=SeqID_81120
tgcttatgtgtggacgggacaaaaagaacagacacaaaggaaaagcattgacccaaattcgaattcgatttgaatttttcaaaatctccgctgcccatttgtccctgttggcattgcgctctcttccgccatttgtccacccctttgccccgagctcccctttcattcctaattgattgattgaatcaatcaattcttttcctttgatgttttccgccctttgatgcttccgccatcgtttggccaaagggacggcgaagggaaaaacaacaacaaaatattatttatggagaaaagaggcgagaaaagtcgagaacacacacaagcacatttagcaaattgatcgactgcgccgctcactttcgaaatctttcgaatgatttcgccccaatgttttttttgatttttttttgtgtggatttacaaatggaaaatcaaaggattaattgccttgggattttctgttttgtctttccatttgctggctgatgcgcaacggaatg

SEQ ID NO: 105027 - DNA, 240 bp, Heterodera glycines
  misc_feature (13)..(13): n is a, c, g, or t
  Promoter: Source sequence=SeqID_2154; Location=1..240; Strand=+; Gene= SeqID_78137
atcaatgattttntgtgtgataacaaaattatttgaaaaacctcccttaattaattatttaattaattcattaatgattttgtttattttttaatcgcatatttccacatacaaattaaacataattaaatcaatttcattatgacaaagcaacaatatttggcaccaattctcttgaatattgtctttgttcatgcacggcattttgtgccatgagtgaaatcgctgctgaattcaatg

SEQ ID NO: 105028 - DNA, 115 bp, Heterodera glycines
  Promoter: Source sequence=SeqID_10471; Location=5830..5944; Strand=-; Gene=SeqID_73679
aatttagtcattttattgctctgttcaacgggctcccattccgtgttgaatagtctaagaaattgcaataaaaatttccatcgacaaattcttccgcaagtgtcaaaaaattatg

SEQ ID NO: 105029 - DNA, 51 bp, Heterodera glycines
  Promoter: Source sequence=SeqID_17182; Location=1453..1503; Strand=+; Gene=SeqID_81631
gctgaaaaagcgggagaaaatgggggagggattggcatttttaaaagaatg

SEQ ID NO: 105030 - DNA, 390 bp, Heterodera glycines
  Promoter: Source sequence=SeqID_3782; Location=1..390; Strand=+; Gene= SeqID_51856
cattaatattcattctcaattattttccattcgttcttttcgcggaatgattcatttcgatggaaaagcaaattttactttacagactgatgaattaatggaaagaaaacatattcatttattcgtttgcactgtccatttagcatttattactttattttggtttagttttggtggataggactaatttttaaaattatttttttaattagttttttagaataataaagacaatgctttttctcgtttcgtttgtcctttgttcgcccttttttgcttccgtaaatttggccaattttcaaccgtaaatttccataatcattcataaaatagcaaatgttatcattgtgttggctttcaggctttacctgattaactcagcctctcatg

SEQ ID NO: 105031 - DNA, 298 bp, Heterodera glycines
  Promoter: Source sequence=SeqID_36546; Location=1..298; Strand=+; Gene=SeqID_65830
actagggaagcaacttttagtgaaaaaactttttttttgctcatttgttttgaagaaaggagctcaaaaaacgcatttctgcgttaaaattttttcatttggacgtcacttttcgtcactggaaatcactattttggggttttgtcactaaaatagttaaaaatcactattttggcgttttgtcactattttttcactatttcgacattttttggaaaattctttaacaaaaatgcaataagaacaactaaatatcgcaataattgttttttattcttaaatttagacttaaaatatg

SEQ ID NO: 105032 - DNA, 101 bp, Heterodera glycines
  Promoter: Source sequence=SeqID_29985; Location=1396..1496; Strand=-; Gene=SeqID_60448
gcgacaattgtacaggtcggcggcccaaccatttgatgccaaaagtgctaattatttcaatttaaagagcgttggcttatgcactgacgggcaccgaaatg

SEQ ID NO: 105033 - DNA, 1003 bp, Heterodera glycines
  Promoter: Source sequence=SeqID_12358; Location=1861..2863; Strand=-; Gene=SeqID_75959
aaatttttgaatgttcatttttatttgttgagttttcatttaaattttcttttgctaattattcgaaactgtaaaaataattaaattagattacttatacatagttagcgagcgattaatgtgacccaaaactgaatttcctaatttgaaattttgattttgacattatgatgcaaaaacaaaagaatttcagtatttgttccggcggtgccgaatgcgagaatatttttaaaagttgaatgaatttattaaaggatttagtcaaaaaatgcggttttataagcaaggtttttgttattttttttagtaaatttcttattaaagattaggttctaactgggtccaggcttttcctgctggactcccgaggtgtatagatacaggtgttatttttcagcaacttgtattttttcaatgtacttgtatttcaattatggaatccagataacaaacattcccaaaatatcgacgaactatatttcttatcattcatttggagttttttctggggtatttttagtcgcgcgggtcgagcaaattgtcaggtctgaattcgggtcgggagatcgatgtccaaattagaattatggtcgatgggaggatgatcaatcagtagaattatgaccaatgagtgtgggttagaatgataggtgatgggagaagataatcagtacaattatagccaagtgggagaggatgatcagtaggattatgaccggtgggtgaggatgatcagtaggattatggccaaatccaactgaaatggccaagaggcaaaaacccaatttttgcccctttctctggcttttacattattttcaactctgcttcttcttctctaatggtgcccttcataaattgagtagagtttttttaatgcatataaaagcctatccaattatagcaatttacatattcatctgcagttattgcttattcattttcatttctttacattttaaaaaatatatttccaattctctaaactcattctgataaaatg

SEQ ID NO: 105034 - DNA, 67 bp, Heterodera glycines
  Promoter: Source sequence=SeqID_37831; Location=765..831; Strand=-; Gene=SeqID_46535
ggttggtgacccaactaaatgcccctccccttttttctaattaatttcgccattagatggctcaatg

SEQ ID NO: 105035 - DNA, 63 bp, Heterodera glycines
  Promoter: Source sequence=SeqID_7551; Location=1323..1385; Strand=+; Gene=SeqID_65184
agcaaaattgctgccgtttcgtgtgctaattgtttaattgaaaaggcaaacaatgagaaaatg

SEQ ID NO: 105036 - DNA, 391 bp, Heterodera glycines
  Promoter: Source sequence=SeqID_14605; Location=1..391; Strand=+; Gene=SeqID_78684
gtggtgaaaataagtgatagacaataggaaataggtgaaatgtctaggcttaggtggtgaaaagcaaacagtgagacattcatgataagtgatgaaaaccaaaaaaataattaagtgttagtacatattgcttagaatgcattttcgtcgcctgtaaatacaatgtgatatagagtgcgcggtataaacaattcgctgaattttggctgggtagcccaaagtcattagaaagttaaacccaaatgttatttggaatgatccgggagatataccatatgatggacttttgaaagttaaagtcataccgccgaaaaggttgcggtaccctttattgccttttcatgccataggttatttatttttatgccaaatcgatttaatgtttaggatg

SEQ ID NO: 105037 - DNA, 376 bp, Heterodera glycines
  Promoter: Source sequence=SeqID_1957; Location=1016..1391; Strand=+; Gene=SeqID_77019
cctgcaaatttttgaaaatttctttatgctttaaaaaagttatggccagaaaatttcaaaaaacatggttttcttaacatttttggtcataactttttttttaaacaaaacgaaatgtttagcaattttgcaggctaatagaagacatttagggctatcgagtgataccaaaaatgttttgatttggttggcaaagaaaaaggttatacccaaaaaacatgtgttcagactaaaacgaccccaaccgaattttgcatggtcgtcgagtctatgatcattttcaggcggctttatttgatggaatgggcccaattaaaaaaacaatataaaagttaatgaccaattcgtatttcaatttagggaaagtctcggcatg

SEQ ID NO: 105038 - DNA, 792 bp, Heterodera glycines
  Promoter: Source sequence=SeqID_13465; Location=301..1092; Strand=+; Gene=SeqID_77356
cctgaaaattattttgatattttaatagtgccatttgaaaacttccaaacttttaaaattaatggggcaatgtgctgcatttccaatgaaaatcaaccaaaaaaaaaaaaaattttttttaaacagaaattcaaggactgtactggaaaatgaaaggaaggcatttttgaaagcgttttttcaaaaaaaaaaagtcgtcgacttgcaaaaaaatcgcaaaatttggcagtttttgggtcaaaatctgttaacaaaccgcactcaaattttcaaaattttttcccgacggcgcctaccggcaccgtcggccccccccggttcaccaaaaatttttggaaaaagtgcgccgcaaaaaaatgggggtttgaaaagcaaaaaaaaaaggtcgtcgatttacatggccgggaccatttcgcaaaattggccgctgaccccccccccccccctccagaccatttcgcaaaaattttggttgacctccccccctttttaatgtatgaattggcataagatagccatacggggagctataagtcaatttctcgccaaaaactttcttgatttatcaaaaataaaaacaattcacttgtgccgattgtgcggacgggaaccggttggcattgtgcacagtgccggcaccaattagtcgagtgtgtgccaccgttgccaacgctgccgcaggcgttgtgccgccgctgaggagccgttggttgcgcaacagttgttgctgttgctgtttgagctgtggcgttttggtaatgggggaacattgtaagacagggttcccaaatg

SEQ ID NO: 105039 - DNA, 188 bp, Heterodera glycines
  Promoter: Source sequence=SeqID_5786; Location=1..188; Strand=+; Gene= SeqID_59222
ggtttttttgtgttgtcaaagaaattgaagaaagggtgagagaaatattgttaaaaaaatgagtgacagataggagagtttagggagaacgcaaacaaggtggtagagagagaaagggaaagagagagagagagagaaattcgaaagtgatagagaaattgaagaaaacgagaataagaaaggagatg

SEQ ID NO: 105040 - DNA, 171 bp, Heterodera glycines
  Promoter: Source sequence=SeqID_10764; Location=928..1098; Strand=-; Gene=SeqID_74016
gcaattaatctaaaatatataacaatttttaatgaattaaaaaaaaaagaaatttcttcgattaaaatttaaaaattcgaattcatttaaaaaatatatatttatttgcgtcatttacatgcctgcccacaaaatatttccatctataatgccaggtttctgtggtcaatg

SEQ ID NO: 105041 - DNA, 800 bp, Heterodera glycines
  Promoter: Source sequence=SeqID_21947; Location=1771..2570; Strand=-; Gene=SeqID_52585
gctctctctttttgtcagtatctctctgaatttggatttctattcacattttcattttaataaaattttattgcttttacgcatttttgtgaccatttttctccttggcatacgtcgcaatttgtccgtcttcaactattttagcttacaattagtccgattttcactaatttatttacctatacatatacacaagttttgttggtgggtcagaattgtggaaatgtttggcatgacttcgtcctcctcttcgatggctttggtctgtcaccactttttaacatattccttagattgtttttttgggcattgccttttctatgccattggtccacaaaaaccactacaaatctggcatgacaccggttcactatgggtcaagcccagcgtttatgattcgctttttcaaattaaaaaatggtctatttataccacaatctagtcatatacatacctaaacggtaatagtttagatggtgccacacctttttgacaaaaatttcttgaactttttaaaagttgtgcaaacagttatgtggggttttcggtgatgctgatcctgaaaatgacacccgttttggccaattccgacccccggacttggattcgaacaaaaatttgaaaattcaaaattcatttttatgttcgtatcattacaatgaccattctttgatgttgcaatgtttgcgaataaacttagattgtttttaatcgatttttgaatagaagtgagaatttcgaaagttttgaatttcaactttgttcgaattcgggtccgggattcgaatttgatcaaaatg

SEQ ID NO: 105042 - DNA, 52 bp, Heterodera glycines
  Promoter: Source sequence=SeqID_17467; Location=154..205; Strand=+; Gene=SeqID_81954
tccattatggcattaattacattaattttggagccctttcctaaatgacatg

SEQ ID NO: 105043 - DNA, 149 bp, Heterodera glycines
  Promoter: Source sequence=SeqID_21227; Location=981..1129; Strand=-; Gene=SeqID_51818
atctggtgcacaaggagatgttgacagcagtcctttgccgaaaaaaccccaaaaaggttttgtttagtgggtcgccttttgtggggcacaatttttctttgaaattcaattcagaagagaacgcaaaacgtgcaggcaatagggtcatg

SEQ ID NO: 105044 - DNA, 340 bp, Heterodera glycines
  Promoter: Source sequence=SeqID_16127; Location=2348..2687; Strand=-; Gene=SeqID_80490
ggttgctggacctaacccttcgggggattgtggttagcaccaaaagtcgtcgctggacctatccttaagggggattgtggttcgcaccaaaaattgtggctggtcctgcccttttgggttatggaccggacatttttgcatctgcattcttaatgggatgtgtgagccctgactgatggatttcagcacaggacgactacactccacagcgaaaatgatgtctttgacctttatttgtgcattttttgttaataaatttttaacatatgtgtacatttatggttaattacctcatatttttgccgcatttgtaatactttctgatttgttgttttagatg

SEQ ID NO: 105045 - DNA, 1003 bp, Heterodera glycines
  Promoter: Source sequence=SeqID_454; Location=1027..2029; Strand=-; Gene=SeqID_53092
ttctaccaatatactttaaaaataatatatcaaaacgaataaattattaaacaaatatcttatttaataaaattataaatttcatcaaaaagcgggtgaaaacgcatcgttgataagagaaaataaaggcattaatttacaaaattcatttgttctctattctcaggtgcttatggcagctcaatcgaactcacaatatatatatttcatctcttttagcataattaattaaagcaaataaagtaccaatattcaaaattattaaatttttccatacctatataaacccaagaaaaattcagcagaggcatgcttcattccaaaccgattcagtcaaaggaagaaaggtgaataattcgtattttaatcatttgtttgaatttataaaaaattttatttattaatttaaaaatgaattttgtatacaaatttatcaaaaattagtagtgtgctaagaaaggcaaaattacaaattaattatgtttttaatataataatggaaaggaaaattatgatgtttatgttagggttgggacccaattggccggtacccattttgaccctttgctttattgtatttcccttttcccttggtatgttacgcccctttttccgctcataaatacccgcgatgttgaccctcccagttcagttcatttatttgtgttattttccttcttttgttatttaaatattcctccccaaatttgtgtcttcgtttcctttctgctccaaataaatattgaacttaggactcttgattggatggagaggtcaacagcaatcgaatttgctgagtcatcgctgctggactgcatttgtttattatctaggcgataataaacaacatttttgttggacctgctaacagttaggcactgttagtagtaaaaaatttgcgctgctgattttgtgtattggcgacacttttcagttcatccacgcgcacccactgttaacaagctaggcgctgttagcaatagagtggtgaacgacaaaaatg

SEQ ID NO: 105046 - DNA, 96 bp, Heterodera glycines
  Promoter: Source sequence=SeqID_1815; Location=2200..2295; Strand=-; Gene=SeqID_76145
aacgtggctgctcgagcagttcagcaacaatattgatgcaactcgcccagaacagaatccagcaaattcttggcaaaaatttactttgacaaaatg

SEQ ID NO: 105047 - DNA, 1003 bp, Heterodera glycines
  Promoter: Source sequence=SeqID_11384; Location=1664..2666; Strand=-; Gene=SeqID_74779
tgtttggcgcttggcatggacccggacggtcgcattttacattttaaaagcttaattaatatttttttttagctgtccaacgacaccgtgaccaaattgggccccgacaaaataaaacgaaattggaaaatgaaaagcgacggacggaggacggcggacgaaagtgccaacgccattcgccaccaacaacagattcaatgtgtgtgggacacacagaaatcgggcaagcgaaatacgggaaaaagaacgagggggggggggggtttggctcggtcctggtgccgaacagtcaaaacccaaaaaagggaaggaaaatggatccaaagcagtaggtgctgactttggggaccgaaatgggtacaagcggctgaaggagccgccggacaagaaattggaaagcccaaggggagggccaaatgtgaagcaaacgtgaaatgtgacaaaaattggaaaatgaatgaacgcaaagtattttttttgttggttttatttggttttttttgtggaaaaaaattgccaaaagaaatgaaatggtgagatttcgtcggatttcgagaatttggctgcgaatggccggagaaaaagcgataatgagttgaggcctcatttctttttatatgcgcgtctgggtgggcaagatgggcgggattagagcaagggccaatgagcgagcaacgaattggggcgggtggaatggcgagcagcgaagtggcgaggcggggatgggccattggcattgtgatgatggaattggcgtcggggtgacggagaacggatggcgaacatcaacaaatccgtccgagattgtgcgatagcattgagatggcgaatttcctgggggattactggggaaaaagggagggaaagtgggccaagcccgaagattagcacgaaatgtttatggtgaaatttccccccaatttctacggattaacattaataatatttttttttttgtgattttttattattttaatttttaaatagtttgtcggagacaatg

SEQ ID NO: 105048 - DNA, 1003 bp, Heterodera glycines
  Promoter: Source sequence=SeqID_10982; Location=277..1279; Strand=+; Gene=SeqID_74292
tttttttccaacaacaaattgcaatccaccgattttactctccgtttttcatataaatgccgaggaaatgtgtgccgtatctgtcgtccaaaaagcagatattgtgcccgagggagggccctttaattaggcaatgaatggcacagacccacattttgtgcctcgaggggctgacattattcggcacctcgcaaggcaagccaggccaggaggccactcacatgcgtatcgttgacatctcgcgcatattctattcagcagttcgtcgctcgtgaataggggcaggccattgttgttggttgagtggccaagtgagggggggggggcgggcgacaaggcttatgtaaagaataaagcggcacccaaaaatgagagcccccgggggaccaataattttaaatgtcgtttaattacacaaattaaccacttactatgcccttggtttggtagcgtataaatttaaaaaatatatggcatataaaagcattaactagagatgatatacggtaattaaacccagtactttcttataatttttgaaataattttcaatttttggagaaaaatttatttcattagcctaatgtttaagagatgtttttcgttgcttttaaagctatttaggttttttaaaattgaaaaatttaccgatttaagcataagtcaattgtcagcgtcgcagttttgaccacttaattttttaataaaattaaatttttcttttcaggatttaactaaccgaaaagtattttttaatgaaaaatggctacaattccatgcttggaactcatttttcctattgtttggctttttgtttcaacattcgtcaaccccagcaagttcaaccaacgaattcacctttcagtgaagttcgtaaaatttattaaaaattacaaagtttttaattaattttctttcctttttcatggccatccattacgttgatccgacaaaaaatggctttcgtgttgtgctgcgggatgaatttttgcgctcacatatg

SEQ ID NO: 105049 - DNA, 124 bp, Heterodera glycines
  Promoter: Source sequence=SeqID_3396; Location=401..524; Strand=+; Gene=SeqID_84513
ttttggttaactgctgtttttcaatttttttttcatataatataatttccaatttatcgtttgcttactcaatcgatgtgttttggataaagcaaaattcgttgccatatgaatttttaatatg

SEQ ID NO: 105050 - DNA, 953 bp, Heterodera glycines
  Promoter: Source sequence=SeqID_27156; Location=323..1275; Strand=-; Gene=SeqID_57857
atttcaaaaaagatgcaaaacatttttaatgggttggaaggctgaatgaattatcgggggaaactcgttttgttgcttgtttgctttctccgcgtccatattattatgttttgggacgactgtcttctgctccaatcgaaaatcgccgatgggcctaatggcccccaaaaaatttaaaacaattttcattggatggaacgccaaaacaaaaacaaaaaaattagtttaaactttcaatacattgccaattggccaacaaaaacaaattttgatggtttatgagagcaattttgggccgctggttaataataattcgaccggaaaatgattttacgaagattgaactctgttacagcattttttggaattttgtttaacagcatttttttatacaaatttgtggaattatgagggctaaaaaaggcgcaaaataattattcatttttttacgcaaatttggaaaataaaatttttaatcaaaaaaatgttgaaggagaatgcagactgaaattaatcagaattgttaaaatttattagcaaattaaaatattaattaaaattttatcatttaaatataaaaaaatgcatttaattaaatgataaaaaaaattctgaggtgattgtaaaaatagtgtttttgattaggattaggattaattacattattcgcacattcttttaaaaaaataaatttgaattgtgaaatataattttaaaaatatatatttttatctatctgggttgaaagtttgaaagtagaataaaataaatttgccaaaaatttattagtccaaattttcttttctccttttttaattatttaaaaaataaggttccaatttttgaaaataaaattaaaaattaaacaagattactttttatttaggcaacatcactagaagacttggaagctcttagacagttagctgagaagcaatttcaatttcaaaatg

SEQ ID NO: 105051 - DNA, 135 bp, Heterodera glycines
  Promoter: Source sequence=SeqID_20870; Location=460..594; Strand=+; Gene=SeqID_51455
tgtgagtgatgcttcaaaatattagtttcattaaatacttttatagtttggtcttgttttcaattttaccaaaatttaatatattgtatggcattttagtgcataattttatgtttgccaattttcaggtcaatg

SEQ ID NO: 105052 - DNA, 947 bp, Heterodera glycines
  Promoter: Source sequence=SeqID_6143; Location=2316..3262; Strand=-; Gene=SeqID_60500
acattaatcgctgataaataaatttttcgttgagttggaacaatggggaagaggaggggagggttggaataagttggtaaatgttttttcacagaattttgggaacacattaaaatataataaatgctcacgaataatattggtccacatagtgcatcgactaacattataccagcgtcaatccccctcccgtgccggcaacataagccacacaaaatagccaccaatccatccccatcccctgccggatgttggcaactaaagccatgcacccggcctatcaatccacagtggtggcaacttaagccaccaatccctcagcccctgcccggtgttggcagttaaagccatacacccggcctatctatctgcgggtgggaagcaacgtaagcctcccaatccctcctaagccgctgcctggtgttggcaggtaacgccatacacccggcctacccctcccgagggtgacgacaacttaagccacgaatcggatcctcaagctcatgggtttgggactttaaagggaagaaagcaaaaaaaaaggaaattgaaaaatattttgaaaagattcgttaaaagacaattaaatgccaaaataaatgacaagcaaaaaataatgtgcattttgcgcgacgtcggcccgcgggcgatgtgcaaaaaacgggtgtgactggttcctctacccacgacaatctctgcctttgtacattttgtcgtgggtatgtgacaaaaacttctgtgttcaaaaaacatgagcagtgtacaagcgcctgggggtgtttcggacaaaaacgagcgacggagagcaaaaaactgttgctcttttcatatgagaacgttgcgctaggtgccctgagagacgaataatgtttgtgatcggacaaaaaactcctatgagttgctcctatttaagtagctctctctacccttcccattatcaaaaaatg

SEQ ID NO: 105053 - DNA, 506 bp, Heterodera glycines
  Promoter: Source sequence=SeqID_43383; Location=1..506; Strand=+; Gene=SeqID_71063
tgccatttccgtcatttgtgctattttgtgccaatacctacccccttttttcagcattataaaattattactgctatacataacctatttattaaaaaaataatatttttattttcgcaatattattgcttaatataataaatcgatgaataaaaataaaataataaatttatttttattttcttttattgttgcttttttatttttccatgtaataataaaataattttatacatttatatttttatgaaaattaaaatttttgattttttttatacaaaaatacattagaaaacgttgcttaatcataaaagtttttcctccatccacttttaaatttttgaaaaattccaaaataattagacttattaaaataattattatttacatttggaattggtgagaaaaataaataaattttttaaattaagaggatttaaatcatgaaaaaggtcgtgaccaaaattttgggtatttttaaaattgcattatgccttggcataatg

SEQ ID NO: 105054 - DNA, 90 bp, Heterodera glycines
  Promoter: Source sequence=SeqID_2856; Location=8260..8349; Strand=+; Gene=SeqID_81975
tctgcaaaagtgccgaataatcaacatctaacttaattgctttgattaaatgtaaattaaactctaattagaacaaaatacagtaaaatg

SEQ ID NO: 105055 - DNA, 340 bp, Heterodera glycines
  Promoter: Source sequence=SeqID_2949; Location=4235..4574; Strand=-; Gene=SeqID_82477
gcagcagcaattttgaattaatgaggacggaaggaagcacacaaatgatctaacggaatccctacactatcattctttcgattattaatttaccaaaaaaaaagttttcctttttaaatttatttttcaaccaaacgatctgtagtatcaacaacaaactcatttcctatgttttgttgtttttttattttgtttgttttctatttatttattttttggaagagaattggctttcaatactttttttatttttgttttatgcctattttaaatggatttacatttctgttcacttttttattatattttctatatttttaactttgtcttcctaaaaatg

SEQ ID NO: 105056 - DNA, 1003 bp, Heterodera glycines
  Promoter: Source sequence=SeqID_14354; Location=1075..2077; Strand=-; Gene=SeqID_78388
ttttgtgactaattttagcttgttttaatcaattttagagcaaaagtgtaaacttaaaaaattttgaattttcgactttgttcggattcgggtccggggattttggtaattagtcaaaataaattgtcagattcgtggatcagcgccccagaaaaccccaaggaaaagcgttttacacaacttttttttaaattttttatttttttcgaaaaatgggggggataaactgcactattacccgaaaatcttgtgaaatttttaatttgaaattgcaaaaacaacctataaaatttatggggaataaaattttttaaattaatttgcacccctaattttcaagtttttttggtgcatattttgcggtttttgtgcatatttcacgattttattagcatatttatgcgcatattttggccattttcgtgcatatttttgacagccctgataattaggtatgtttgtcaagatttatcgctttctctttttgtatacaaatatctactactggactgtagtcaaaaaaacaaacaaaaatttcttatataagattctcgaatcgtgtgagaaaatcttttttaaacaaagtttactatcgaaaccaacactgtcgagatcactactatcgaaaactaacagcaccgtgctacacacatgaaaaaatttgaaccatgttcatgtcaaaaattcatttttttcaaattttggcgaattatttttcattaaatttttacgggctttttggcttgaaatacccaacagtaaaaccggcattgaaacttgaaaagaaacttaattacagcaccttaattggttttgatacatttaaatcaagcgtaactcaatgttagaaaaaataaataaaaattaaaaatataaatcaaacatttctataccaaatagtattttttcttctcatttctcacctgccccgccccctcccaagtttcacaaaaacgcattgtcggaacttgcacaaacttctcacttgtcagatgttcccatg

SEQ ID NO: 105057 - DNA, 945 bp, Heterodera glycines
  Promoter: Source sequence=SeqID_9233; Location=1..945; Strand=+; Gene= SeqID_70699
ttatggttcgggttaaagaattcagaattggtcaaaattggtgtcagattcgtgatcactgatcactgatcagatacctctaaaaatcaccagtcttatttttaagtagcgccggcaactgtcacaaattttccgagttacgctcatcgctggggactcaaatacaatttaaataaattcttttttgacaaatgaaacctcaaaaaaaaatttctcccaccctcttcctccctcttccttctctctctctctttctttctctctctctctccctctctctcaatctcgctctctcatttcctttctctccctctcttaatctctctcttttcatactctctaaagactttcactctctccccctctctctcaatctcgctctctcattccctttctctccctctcttaatctctctctttgcatactctctaaatactttcactctctctctttctctctccctctctctctcatttcctttctctccttctcatctctctcataatcttttcacactctctaaatactttcactctctctctctttctttctcgctcaaatttctctgtctctctctattttttctttcactctctttttatctcttttccttacctctctctttcctccccctcctttctatcaagctctctatcgttcactttccctctctctcttaatttctgtcaaatccctctctctctctctcacttcattcttcctttccctttctcttaatctctctctcatttcctttttctccctctctcctttcttcgttctctcgctttttaaccttcactcgcatttattttttaaacaaacataatgacaaaacaatgccaattcaatcaatgaaaaatgcaaaaggtctcgcttagtatatagttaagggatttccgattttcatcttacaaaatttagttttctttatttgaacaatg

SEQ ID NO: 105058 - DNA, 291 bp, Heterodera glycines
  misc_feature (20)..(20): n is a, c, g, or t
  misc_feature (87)..(87): n is a, c, g, or t
  misc_feature (152)..(152): n is a, c, g, or t
  misc_feature (186)..(186): n is a, c, g, or t
  misc_feature (272)..(272): n is a, c, g, or t
  Promoter: Source sequence=SeqID_32607; Location=1..291; Strand=+; Gene=SeqID_62908
cgtactaaaccgaccccganccggggatttcgcttcaaaaaaaaattatgacgaaattaatattttaaattgaaaaaaatcatattntgaaattttcattagtatctgcatgaaaaaagctcgcactagtcagggcttcccttttttggtgnatttgattatgtgacccataatgataaatttctnttatttctttgagccacttcaaaatcatcgtcttattataaataatcgtaattaaaatttcctaaaatagtatcgggattccttcnagcatatcttcaaaaaatg

SEQ ID NO: 105059 - DNA, 295 bp, Heterodera glycines
  Promoter: Source sequence=SeqID_16029; Location=951..1245; Strand=+; Gene=SeqID_80387
gagagggttcaaaggaccctacttacgggttatgtcgcccctataccccaaaaatgtcaggatccctatagttttacggattgatcaataataaaaaagtctagatcttttggaaatacaaaatagagaggatttcgcaaaattcagatttttctttttcacagcttcagaaaattacaccttctggggctgtaccgtggaaaacgattgtgacgcagtcagtaaattccttgcatttgaaaaatgcgaatgtttatttggtattaatggtttcaatctttcaaacttggaaatg

SEQ ID NO: 105060 - DNA, 261 bp, Heterodera glycines
  Promoter: Source sequence=SeqID_20099; Location=1..261; Strand=+; Gene=SeqID_84888
ttcagattctctattaacatgtaaaatttcaaaaaatttcgtcagtttacaaaaaagttatggccaaaaaacctcaaaaattaactttttcttggctttttcggcgccgcgtggcataacttttttatttttgaatcattcatttctatttttacatgtaaatatagagcacacatagagctttcaaatgatgccagattggctaaagctaactgacaaataaaaaagttatagcatttcaaaatttgcggctccgaaatg

SEQ ID NO: 105061 - DNA, 87 bp, Heterodera glycines
  Promoter: Source sequence=SeqID_20777; Location=1..87; Strand=+; Gene= SeqID_51343
gcttctcgagatgaatcgattgatatataatttgcgccattttttcaagggcttcactatgatatatccaaaattaagcaattgatg

SEQ ID NO: 105062 - DNA, 642 bp, Heterodera glycines
  misc_feature (8)..(8): n is a, c, g, or t
  Promoter: Source sequence=SeqID_10839; Location=5327..5968; Strand=-; Gene=SeqID_74110
aattatantggactaaaaaaggctaaatactggacataacctatgagaggaaaaaagcccgaaatatggactaaaaagctcaacttggctaaatatggatcaaaatatggactaaaaactgccaaaatatatgctttaaaccataaaaaattacgaatttggtgtttatattcaatatttgcttaaataaacttaaaaaatacaataaacaaacaaaaatagacttaaaatttaaaaatggaaattttttttattatcgtaccatcacctccaagtttgccaattcaaaaaaattcgcattaaataaaaaggaaaagttcgcaaaaaaaatagtgaaaatattaattaaaaatgtcaaaaggtcgatgaaaaaccaaaatttttcatatttttgggggtctaattttaaaaatttccaaaaagtcaaactttaggggtgtatttttcgcttttttctcatttttcttgtgaaaatttgccaaaaatggccaaaatatggactaaaaacacaaaaatggcgaaatatggatttattcccgaaaacccctaaaatatggatttatatggactaaaaaccttcaccaaatcgtaaaattttaatgcagaaatgctatttttgagcccctttcttcatagcatatg

SEQ ID NO: 105063 - DNA, 94 bp, Heterodera glycines
  Promoter: Source sequence=SeqID_2216; Location=5212..5305; Strand=+; Gene=SeqID_78523
ggcaaaaatattcgccgaattgggacaaaagttagaaaaagcccgaaaaacgaatgctcaatgggcgggacgagtggcagcagtgagcggaatg

SEQ ID NO: 105064 - DNA, 840 bp, Heterodera glycines
  Promoter: Source sequence=SeqID_2326; Location=1554..2393; Strand=-; Gene=SeqID_79138
ttttctgaaatttttttcatttcgggggcgggggggggggggggaatttccccgctggttacgtgggcctactgtacaaaaaacagcagaaataatttagtaataagttatgggcacaaaaacggtttttagaagagggcgaaatgaagtgcaaccgattctcgtgaatacgacccaattttttcaaatccccaaccatttatgggggctgtcacgggcttttttacctggcaattgcgcgttcctcctccatttaagcaactttatttcaaattcaaaatgtgaacaagtttttcaatcacttttttattaaacaagcaaaaaacacaaaaaataagatcaaaattaaggcaaaaatgaaattacacaatgattaaattaattgttagtgaaattggtaagggcgtcattatattcagaccgcatatttgcatcaaaaattacagggttaaatccctttcgggccaatacaaaattcgataaaagtcgagcacagcgcccgttgccgtcgaaaaaggggtgaatgtatgtctaaatattgattgggtgagtaaaggatcaataaaaacaatatttcctatgtattatgcattgtttgaacagataattttgtttgtgtatgaatttcactaaattagcttttcagaacaagaattttgtcttttaattacatattttgcttttaaaattactgctaattctataagtaaactgcattactaggcggtaatggacttccgcggttagtgaatggatggtagtagtatgttgttgtaaattaaaccactcgacgaattccgacatcttcgccgtcacttcttcccaaggcacggcgacatg

SEQ ID NO: 105065 - DNA, 262 bp, Heterodera glycines
  Promoter: Source sequence=SeqID_38652; Location=733..994; Strand=-; Gene=SeqID_67404
taagcctaaactttttggcctgtttaaaaaggaattaaaaatttttaaaaattttattcatctcccttttgatagaaaaagcatcagagagccttatttaacttttaattaacatttggtgcgtttcagagcactttctgaaaaaatacttatgaattaattttgcaaaaaataaataattaatgaaaaagtcagaatttcgaaaaattttaaaaacaacaagcgttggcattttttcaggttaagttagtcctttacaatg

SEQ ID NO: 105066 - DNA, 1003 bp, Heterodera glycines
  Promoter: Source sequence=SeqID_3521; Location=615..1617; Strand=+; Gene=SeqID_85014
aaatgattaattcatttggttataaggccattaatgctaacacttataataataatttaaatttgccgtaattatttgtcacttatttaataatgccaattctttttcactttataaaaagtttcccaagaaattaacttatttgagtcacattatttttcattcgttttttctgaattttcatttagccattgtctttttcgtattggcatttttcacttttaatttattttttttcacctatcttatcggtgccaaatgctttcgttgcctttttacttggaatgaaataaataaatgcctttgcgcttttataaatattaaatgccaaataagcatttttatttgaaatatatataatattgatgatcatgcattactagagcttggatttttatgtgctaaattcctgaaatataataaaattttgctaaaaatgctgaaatatgtgctaaaaaccaaaaaaaatgccaaattatgtgcgaaaatatgattgaataaaatcgtctgccaatttttcggatgaaaatgttctgggtgtacagacattttattattaaaaaacttggctttacgtggctgcttatttctttaaaatgtcatttgtcttctgtttgtgtcccctccccggcggaaaatcaaaaacatttttattattcaaaatggcattaaataaatgccaaaacattcattcaaacgcattgaaactccaaagtactcagaatttgccacatttgttctgtttgtgttgtatgaacatcgacatttcaaattcatttctttaatttaatgtcgacaatttttcttcccttttctcagcccgaggggacgatgaataataataattagtgacaaattaattggggcagcacaatttgttggcaaaatcaccagccaaatgtgcgtataaaagtggtgatcaaatggctgtcaaatcaccaaaaacattcattttatttattattttattgcgccttttcctaaaattcaatttccaaaaatg

SEQ ID NO: 105067 - DNA, 499 bp, Heterodera glycines
  Promoter: Source sequence=SeqID_36965; Location=807..1305; Strand=-; Gene=SeqID_66159
tcttccgccgattgaattggctcgacgccaaatgcctggtccattcgtccaacggccttttccccactcggcacgtgtcccctcaactgatcgttctgcacagcgtgggccaatgtcggctggccatctgcgcactgatctgtccccacgggcgccccgtggacgaagtcgtcttccgtttcgcgggcagcaaaccgattacggtattggcaattatcgtaatcatagaaaaaataattaggcaatataattgattaaatacaattccaataattcaaatgcaaattttacaaaagacccaacacggtccgacccccacgccccacggtggtctatcccctctctccaccttttgacgaacgagggggggggggaggagaaggaggagggggtcgactgtttgtcaattaattacccctaatttcacccactaattgtaagtatgttgttgatcatttagttccccgtctctgtgcctgacccattgccaaatacaatg

SEQ ID NO: 105068 - DNA, 298 bp, Heterodera glycines
  Promoter: Source sequence=SeqID_4146; Location=230..527; Strand=+; Gene=SeqID_53369
tttgataagccaataaaaatgaagaatataaaataagatataaaattgcaaaaaagtttgataaaagcttttctcaaaaacagtgagatttttaaaggaggaaagtttcagcttttttaaatatttttttaacttggcaaaacgtctttttattttttttaacttctgacattttgatttgtcaaaaattcaaaaacgtatttacctagtttttttttgatttacttttcccttacttttcaaaggcttttacctgataaaataacataattttttttaaacttttagagtgaggatg

SEQ ID NO: 105069 - DNA, 120 bp, Heterodera glycines
  Promoter: Source sequence=SeqID_13101; Location=1615..1734; Strand=-; Gene=SeqID_76893
aaaaataataattaggttaatgagggataattcaattatttgctcatttttagtgcggaaatattctggttttttatttccaatcgctgttccattacattccgcacatttggcgttatg

SEQ ID NO: 105070 - DNA, 159 bp, Heterodera glycines
  Promoter: Source sequence=SeqID_32750; Location=1..159; Strand=+; Gene=SeqID_63003
aaatttttaaattttatggtaaatatgttcatagggcccagattcaaaattaaacaaattatatatcaatcgatagctctcggtctgtaatggaagaatccgaaagaattttttggcggcaaccaatccctgaagagttacagacccgggactgaaatg

SEQ ID NO: 105071 - DNA, 807 bp, Heterodera glycines
  Promoter: Source sequence=SeqID_12671; Location=1878..2684; Strand=+; Gene=SeqID_76350
ataggccatgtgatgaccaatggacagaagatacatttgataggattaaatccaagcctaagcttttcttcattttgtatgcgtatctttagtctttgtttgtacatacacacacttgttaataggaataataataataaaaaaatgtttaggtttttgctgaatcccttgtttcaccgcctaattcaaattatccaaaaacctccgctattttgcttccgttaaatttggggtggaggtacggtctctccccgacatttatgaccctacgggctaaactacttgccctcagttatggcttttgatccgaaaagaatgacttcgatggagtccattttgtattgttttgtttgttgtttttgttaactttgtgctcttggatattaaattaaacgtggtttcaaaaattgctcatgagtcatggacctactgattgattcaatattctggggtgatgcttcagcagcgacagatccgatcgaaaagacaaaaattcagagttagcccctgagtacggtatgccaagttcggtacctcgatgccattggtataaaaggatacagcgaaatatgtaggcaataagaccgatatgtttatcattaagcctgaaagtcgcttttgtcactaaagtgcaattaaaccgcgttcttttttactcttcccgaggcattcatcctcctttatattttaatgtgattttttaataaataaatcaccactataaaaggtgttcattcgcaatcgcttttcccatttgcttagtttttggtttttctattcatctgcaacatattgtattatattatg

SEQ ID NO: 105072 - DNA, 155 bp, Heterodera glycines
  Promoter: Source sequence=SeqID_11580; Location=292..446; Strand=-; Gene=SeqID_75019
tcgattgctgttgatttgcactaatgagggggcggttgtcagaagaaacatttttcgcttttttaacggggggtgccatcaaagaaaaaacaataaatttgcttaatgaaaattttctataaaaaaactaacaaatttccagcgcggagggcatg

SEQ ID NO: 105073 - DNA, 1003 bp, Heterodera glycines
  Promoter: Source sequence=SeqID_20953; Location=907..1909; Strand=-; Gene=SeqID_51534
attttttgccagaatggatacgataccgataagactgatcaacggcacaatgactcacgattaaatcaagcgagcgaaatgaaagcaattttcaaaaatatgcttttttaatatttttaaaatttatatttatgtcaaacaacgcaataaatcttttatcaaccagtacagttaaatcaacaaaaaaagtgtgggaggacttgttcagcagagacaaaattagaaacatttaataaacaatctgtttgaatgccaagtgatcagaaaataagctgtgatcagcagtcagattttgctaagggcgatcaaacccgcaaccaaaatatattggtactgatcaaatattatttaaaaaacttgggactgatcagaaattgattggaataatttattgtcctgaccagtttttgggagtgatcagatttgcatgatcagttctttgtcaagtcaatgcaaatgtattttcgtgtaacgattgacaaatatcgtatcggattatgcaagtactatatttaagatggtcaaactttttaaaaaatgtttaaaaatgcaaaagttaccaaaagtaatgaaaaaggggcggattaaaggtgccatactgtggcgtaaattcacaaatttttactcgacggagaatgttacggtgcagctacacaaaaagcctacctattttgtctgtttttgttatatttcattgttttgagatgtacacaatgcgcctctcaagtcttagaaacctacacaagtgtgaaattttgtcgaaaaacgacaaagaaagtgtttggaaaaaatattttgccaagaaaatgacaagaaacaagaacaaaaaacgaataaaaggctaagaaatattgtgccataagaaaatgccaggagaaggatgcgaggccgcaaagagtccgagcccataatttccaaaaaaataaaggaaaaaacaaagaaatgcccccacctccacaaactctaagcccaactgaccatttgctgtccctgttccgaaatg

SEQ ID NO: 105074 - DNA, 755 bp, Heterodera glycines
  Promoter: Source sequence=SeqID_27471; Location=1..755; Strand=+; Gene=SeqID_58164
ctcattaaaatgtgtcttacaattaagaatttgttttagggtgccatgctcatcgaactgtgccaccgcaaacaatggcacaagtgttcgcattggctgccgaactgttgtgccgagtgaccgacacaatgcaaccaatttgcctggacaacccccccccccgaaaattaaaaaattttaatttttaaatttcttttttttccggtcgccaaaatttcgttcattgcccgcgacacttcgacggatgcgcgcgcctttggcttcgttttcggcacggcggacggcaaacacaaattttacggggtgaaaacggcacggacggcggaccacgcggtgctctccattcgggtgggcatttgatttggtttaacaagacaaacaaattttcttgccaaggcccaaaaaatcataaaaaattttctgaaccaattattcttttttttaaatgacaaaaattggtgattttttggcgaaaaacggctacaaactcatgctttttgttcccgacgacgcaaattttaaaataacattaaagaaaattttttttgtaatttttgccccgaagagccaaaaaaaaagtctttggattttccccttggaagtttttttttctggctacgggtctgctgtctcccccaatgttaaaaagaaacataaaaaaaaattttttttctaataaattatttgagagaccggacaactgagtcccatccaaatgtgtcccccattttgcatgtttaacttttcaggacatg

SEQ ID NO: 105075 - DNA, 164 bp, Heterodera glycines
  Promoter: Source sequence=SeqID_9314; Location=2552..2715; Strand=+; Gene=SeqID_70975
tgcttaaatttgagtcggggtcactttggcgcagtcaactttaaagtgctctaacttttttgttccgcaaccaaataaaataatcgtgatatctaacgatagggctaagtagtctctattagcctgacaaatttcaaaaaattattttaggctgaaaaaatatg

SEQ ID NO: 105076 - DNA, 70 bp, Heterodera glycines
  Promoter: Source sequence=SeqID_10291; Location=1987..2056; Strand=-; Gene=SeqID_73455
cccccccccctccccacagttttccgaggatgagcgcaacaaatacgttggacagttcagtgtcgtcatg

SEQ ID NO: 105077 - DNA, 1003 bp, Heterodera glycines
  Promoter: Source sequence=SeqID_19501; Location=1401..2403; Strand=+; Gene=SeqID_84220
atcagaacatttctgacaaatcagaacatttttattttatcagatttggaccctccaaatcagaacattttattttatcagatttggaccctccaaatcagaacattttattttatcagatttggaccctccaaatcagaacatttctgataaatcagaacagatcacacccctgttttatatggactaaaaaccttcaccaaatcaaaaaatgttaatgcagaaatgctatttttaagcccttttcttcatagtgaaaaggacacacgaacagtggccaaaatcattggacggacattaaatgcattcttgtgaaaattgtgatattgatatccacaaaaataaactgtaaaactatggaaatactgtatagatatgggactgggtcgttttggcgcccacgttttggcgccagcgcgagtttttttattataacttttttcattgttggccaaatctctaacaatcttggtatcaatcgaaagcccttcacaagctctattagccttacaaaaaacaaaaaaaaatttagcttgtaaaaaagttattaagaaaaaacttccaaacttttgggtttttttgtaattttatgttataacttttttggtaatgtctaatcgcgaaacaatagcttagaaatagcttctaaacacgttaagctttcgaatgataccaagaatgttaaatttggttaacaataaaaaaagttataatcaaaaaactcgcgctggcgccaagaatgtcggcgccaaaacgaccccgcacccttaccaacgcatcccaaaacgccaagcacatctcataaccgctaaaacgaacttttgcgggattttcgaaatttgaaaaattttgtccaaacaagcacaaaaagtatacttatgtatatacaacacgtacctctctaacaacagaactccaataaattttttatatttttcttgtaaaaattttgtataaattacatacagtcagggaccaaagtatttgagcaaactatgcaatg

SEQ ID NO: 105078 - DNA, 964 bp, Heterodera glycines
  Promoter: Source sequence=SeqID_7385; Location=2298..3261; Strand=-; Gene=SeqID_64674
ttttcaagcaatcatggatccaaattgattgaattaaatgcttgattatagattatatttattagggatttactttaaataaattaattataaaataattttatttgattaatttgcttaataacatttaaataaattaattataaaatttttgcggttttcgcgcaacgcccttttttgcggttttcgcaaaatactcatttttgcggttttcgcgcaacgacgcggcaccgttggatttgatttgttgatttctttgccacccaactccaaaagtgaccaattgattgttttgatataatttcattttttctttatttttccgcgtcaagcttttgcgtataaatgatttaaatgattgattgattgaaatattttattcatttgtaatgtttgttcacttcatgattaatgcatgcccaacaaatgttatttaatattaaatagaaaaagtaattttatgaaacaataaatgtaaaaagggaatgaatgactcatcagcctaaatcagacaacattttaatgctttatcaccaaaaagcaaagccaccaccgaataaatgaaatgactcaaaaatgggccaaccgccgctcaaaggtttttagtgcttgaaactgtgaattctgtcggttggcaaagaatgttttgcccaatcttcaacaacattttagtaagacatatgaaatgtttttcgttccttttacaatttttattaattgaaatgccataattccaaagaatttttattctaaaagccatgaaaaaatggtaattcatggccataccgggaaggggaggaaatattgtaacacgggaatactttaattcaaacaaaaatttaaaatatatttttatttttccgaattataaagaatttcattgggtaatcacccaaatattccattgattcttaactaaaataattcttatcaatgatttcggcataaaaaattgttcaaaatg

SEQ ID NO: 105079 - DNA, 748 bp, Heterodera glycines
  Promoter: Source sequence=SeqID_3722; Location=33..780; Strand=+; Gene=SeqID_51622
ggtgacctattgatctgcagtcaattgctctgccactgagctacgactccgttgaattagagattctcattttcctccttctttctttaaaaagctcctctaaagaaaaactggattttatggttaaagtggacgaagaaagcagaaaagggaacgatttccttctaatatgcaacttatttgttagctgagaaaaataatgaattatttattatattaaaaagacataaaataaataaaattaacgataaaaaaagaaaaatcaaatgggtggaataaaacaataaaatattttttatttatattttatttaattaatattaatatttatgtagttatttccgaatatgtaaataaataaatttatttattttttcttttatgcaaattaccagcataatttttgcgttttctttgcaatatctacagaaatcttttatgaaaataaaattttctcccattttttttatcaaaaaatattgtataatttaattatttttttgccatataattttaattatcctttccctcctcccccaaggcacgccaatcggctttcatcgaagtgcttagtcatgtgccgtcccagccctcgtccgatcaaacggtgccggatcgtccccgggctgttttggcaccgggcaaagatcgccccaactttcacattgaattgcgctcccaagagctgtttgtggggcagccgcttcgtctggagacaaaactgacgccgatcagcgacccgtcaatg

SEQ ID NO: 105080 - DNA, 471 bp, Heterodera glycines
  misc_feature (20)..(20): n is a, c, g, or t
  misc_feature (63)..(63): n is a, c, g, or t
  misc_feature (91)..(91): n is a, c, g, or t
  Promoter: Source sequence=SeqID_42011; Location=1..471; Strand=+; Gene=SeqID_70022
tcaccaattcaattttttgnagttttaaggaccaattaggacaataaaagaaaactcatcccntaacattaaaaattttgtgggataattntaatagaaaaagcttatttgttagcaacataatatgacggcaattaagctcccaacattaaatcattggaatgaattttctaataaaacgcactttattttgtaaaaaaatattcaaaaatttaaattttcacagtttttcaccttcacagattattatttaaaattttctttaatatatatattttttgaaaatacaatatacataatttattttttataaaaaatgtcaattttcgttcctttaaaaatgttttccacttcttcggcgtaaacaacaggattcgacgggggaattgaaagattaatgttctagcaaagcccaaaatcgattcatctaactaaatcctcgctttcaaaaaactcatttcctttatgatg

SEQ ID NO: 105081 - DNA, 258 bp, Heterodera glycines
  Promoter: Source sequence=SeqID_8869; Location=3090..3347; Strand=-; Gene=SeqID_69468
tcctttcatccctttatataccccttctataaatagtcatcaaaaataaaattaaattgaaaaatgaactgcccgcataaaattaagtgttgtcattactgtccctgtcattacgagatttgtaagagatgtaaaaaacacagtcttttgcatttcggtacatcattttttgataatttctggctatgccccaaatgcgcgaaatatgttccctatgaaaatataaataggtcaaataaataagaggaattaaaaatg

SEQ ID NO: 105082 - DNA, 1003 bp, Heterodera glycines
  Promoter: Source sequence=SeqID_28438; Location=555..1557; Strand=-; Gene=SeqID_59058
tgttagccggagttgaacatttaggagttgaagttggacactattattttttctattaaacagagcgttaaaaaattgccagacttttgaaacaaagattccgagccgagaattttttttttggcatttttgctgtttagggcaccagaaaaatctataatgaggacctttttgaagagatttggaattgcaaaagagctgtcaggttcgttttagcgctccgaaatccccgtgaaaattttctcgactaatgacaaaaaaattttttaacaaaacacaaggacccactttttggatttttttgggggcattaaacagcaaaagtgctgaaattttagcaaaaatgcaacaatcttatataaattgtctagctacttatttttgtgggcacttcttccatttgtaatttgactttttccctttccactcacttaagtctcttccgccctccacttttgcaatttgctgcaaatggcagcctcctccgtcaaattcgagctgtttgaccaacagttttgccgtacttttgttgttgcataattttaagtggttcagtttttgttcaggattaaaacattgccaatagtctaagcaataacaaatttacactccttgaacttatttgttagctttatttcaaatgccgataatttttttgtttgaaatgtttaatcctaaacccgtagcgaaatccccaaatatggttttttgtgcgggatcccgcaggagccgcccattgtatttttttattcaaagaacattaagccaagtacctattttttgaatacctatgtatttgccataaataaaatttagtcattaatcggcaacccagcagttcttccctcactagcgtgggaagagtatataagtaagaaattgttagggtttcttccatttgccttattctccaatatcagaatttgcctccctatttggctcttccattgccttattctccaatatcagcacttgcctccctctgccgatattcgtccaaatg

SEQ ID NO: 105083 - DNA, 99 bp, Heterodera glycines
  Promoter: Source sequence=SeqID_15834; Location=87..185; Strand=+; Gene=SeqID_80159
ggtctttataagttaacgagcagagaataaatacctttttcagatagagaggaaggagtgaaagcacttgcggacatggatacatcccgacaaaaaatg

SEQ ID NO: 105084 - DNA, 199 bp, Heterodera glycines
  Promoter: Source sequence=SeqID_38104; Location=1..199; Strand=+; Gene=SeqID_67016
gtgattgaatgtccaattcttatgccaaactattcgtttttaaaaattagaatcaataaatttctgatcagactccgattaaaattttggaatttaatttcatcgatatatacaaaaattctcatttattcagaaaatctaattataataaatcttgatcagaaccgaaattcattgttacttacttgaattaaggatg

SEQ ID NO: 105085 - DNA, 98 bp, Heterodera glycines
  Promoter: Source sequence=SeqID_4496; Location=247..344; Strand=+; Gene=SeqID_54667
tttctcgcaattaccagagaatgtactaattaatatttgttaaattgggaaaaccgtctgttgctctaaccaatttctcacgcacttttcaggaaatg

SEQ ID NO: 105086 - DNA, 1003 bp, Heterodera glycines
  Promoter: Source sequence=SeqID_31164; Location=617..1619; Strand=+; Gene=SeqID_61540
ctgtagaccattttgtcctttttctgatgaacctaacggttttttccagaaaattttcccaccccctaggattttttttgaaaatttccccgatttccaatgtattttggggtgtctagatcaccatgaaggagtgatcggatcaacttgttgttaaatacttttttgatcagcatcaaaacttatgttagcatgaattatttcagatttttctgtgctctcaaatttgagattcaaaaactggtgttaaacatatgcaccactgaaaatggggtatggtacacaaagtcaactgtaattcgggtttgaaccgatattttgcttaatgattggtatcatttgaaagccattaaaaattatacaaaaaatgtcaaaacatttggtcatcaccaatatttaactttttatgaagccaaatttctcgaaaaggctagtggtgttagacttatgctcctaactgtatgcactgtgaaagtgatacaataaatttttaatttttaactttgttcacaaaatttattcacactcatacataatataatatgcaatgaagttttgtatggaaatgtcaccgtttttgactgcctcaacttgacctcaaatttgcactgatttttccacgtttcgatacgcgctggtgtacaaacatttctatgacataacttaattgacaatttggagagcaatttgcaattcgcaaaggcaatggaatgccgaaatcatttttcgagggcaaatcttatggattcatacttggaaaaaaaaattttccttgtgcacaggttttcttaaaatttttgcataggctagactatttttgaatcttttctactaaattttattttttagaaatttgttttctaacattgtctcctgcatttttacaagggcatttttttaattagaggtcgtttttggctggcatttcactctagtaattgttttctttgtcatcatcgcgtgttttttgtttatttttaaagttctgtgctttatcaaaatg

SEQ ID NO: 105087 - DNA, 176 bp, Heterodera glycines
  misc_feature (37)..(37): n is a, c, g, or t
  misc_feature (71)..(72): n is a, c, g, or t
  misc_feature (85)..(86): n is a, c, g, or t
  Promoter: Source sequence=SeqID_44846; Location=1058..1233; Strand=-; Gene=SeqID_72263
aaaatatatgaaaattaattaatttgctaaatgagtnttctaaatatttttcttaaagcagccactgtgcnnaaaaatgacaccnncaattcttcttcttcctctacagttgattttcaaatgagccctaagaaccacggcacacacaacagttcgtcatcgaaagccaaataatg

SEQ ID NO: 105088 - DNA, 146 bp, Heterodera glycines
  Promoter: Source sequence=SeqID_28610; Location=1..146; Strand=+; Gene=SeqID_59207
ttatcctagtcaaataattttttgttttttttaatgatatgtgacgatgcagcagttacggtataacactttatattcaaagtattttgcttaaatttttatatttttttatgtttgtaaaataatttacattcaaatatgaaatg

SEQ ID NO: 105089 - DNA, 402 bp, Heterodera glycines
  misc_feature (52)..(54): n is a, c, g, or t
  Promoter: Source sequence=SeqID_11805; Location=1..402; Strand=+; Gene=SeqID_75306
agcgaaggttttctcgtgggcggatggatgggccacaaaaaacaaaaatcannncagggtacactcattaattaaacaatttggagtatttggcaggtgccgccaacaacgaaattttccaccgtcttccgccgattccgtcgtccctccgccgtccgcgccgcctccgccgtacagtgcgtacgctgtcactgctgcgacggacgcgcgccgaatgcgccaaaacgtgtcgccacattcaaattgtccttccgtcgtctcggccctctcctcgtcaatgattccgcaacatttcgttaggtgggttaaagctcgaattagttgcagaatcccgaattctttttttgtccctaaattgattattaaaatcgcattttcagaccccctggcggtggtcccatg

SEQ ID NO: 105090 - DNA, 74 bp, Heterodera glycines
  Promoter: Source sequence=SeqID_6717; Location=1187..1260; Strand=+; Gene=SeqID_62607
ttctacgtcaaacaaacggcatcatagcacgggctgatggtggcggcattgtcaacaattgggcgcacgaaatg

SEQ ID NO: 105091 - DNA, 131 bp, Heterodera glycines
  Promoter: Source sequence=SeqID_30163; Location=966..1096; Strand=+; Gene=SeqID_60598
tttcctttgctgaataaattttcaaaaattaatttaatgaaaataaaattttcaagtggtacataaattcaaagcgagaatttaataatgatggttcgagccgggatttcctccctgctggcaaatgaatg

SEQ ID NO: 105092 - DNA, 298 bp, Heterodera glycines
  Promoter: Source sequence=SeqID_4146; Location=228..525; Strand=-; Gene=SeqID_53370
tcctcactctaaaagtttaaaaaaaattatgttattttatcaggtaaaagcctttgaaaagtaagggaaaagtaaatcaaaaaaaaactaggtaaatacgtttttgaatttttgacaaatcaaaatgtcagaagttaaaaaaaataaaaagacgttttgccaagttaaaaaaatatttaaaaaagctgaaactttcctcctttaaaaatctcactgtttttgagaaaagcttttatcaaacttttttgcaattttatatcttattttatattcttcatttttattggcttatcaaatg

SEQ ID NO: 105093 - DNA, 754 bp, Heterodera glycines
  Promoter: Source sequence=SeqID_19592; Location=917..1670; Strand=-; Gene=SeqID_84331
ttgcatggtttttttataacgtaaattatcattaataaaatattcaaatattttttgatcaagaaattataaaatatgttgaataaatatccttttcgaatcaatgcaaaaaaagagattaattagggtgtaatatgccttaaaaatttaatcaattaggttccaattgagttttccaattctatgcatttgtttctgctaataaaaaaagcaaaataaaaaaagcagaaggaaatcttttcacgattaaatttttaataaaatttatttcacaacaaataatattttgtttttgatctagattattgaaattttgactcgaaaaacagtaaacagtaaatttgagctaaaaatcgattgttagtagagatcggaccggtcggttttttctgtatttttcggtttcggtttttaaccgaaaaaaaccgaccgagaaatttttgagtttttcggtttcggtttttttcggtttcggtttttttcggtttcggttttttttcggtttttataccgaagccgaccgactgaaataatcaaaaaaccgaaaaaaccgaccgacttttttcaaaaaccgaaaaaaaccgactggcgattgaagcgacataacccgttaataacaatttttggcataatatactgtttgaaattcgatggtttttgattaagttttcggacttttgaaaagtttatcactaattttcatttctttttaatttagtgatataaaacaaacattacagcaatagtcaacatg

SEQ ID NO: 105094 - DNA, 97 bp, Heterodera glycines
  Promoter: Source sequence=SeqID_1498; Location=157..253; Strand=+; Gene=SeqID_73979
tttggacaaacaatgcgagcgtgtccaagagtggcgcaaacgccaaaatgccaaaaagaaaggcaacaaccgcgttggccaccttcgtattggaatg

SEQ ID NO: 105095 - DNA, 164 bp, Heterodera glycines
  Promoter: Source sequence=SeqID_12445; Location=2087..2250; Strand=-; Gene=SeqID_76073
tttaccatttacattcgttgattagcctaaggcatttttggcaattatttttattgctgattgctgtacatttatgtaataaattcaatttaatactagcttttcaagaagagtctagcttgaaattggaaagattttgacaactttataaacgtttcaaaatg

SEQ ID NO: 105096 - DNA, 776 bp, Heterodera glycines
  Promoter: Source sequence=SeqID_10010; Location=3979..4754; Strand=-; Gene=SeqID_73060
tttttttaaatttttttaggtcgattcttaggggtgtattttttggttttattgcatttttgttaaggaattttccaaaaaatgtcgaaatagtgaaaaaatagtgacgatacgccaaaatagtgatttctagtgactgataatgacatcagaattgaaaaattttaatgcagaaatgcgttttttgagctcctttcttcaaatcaattgagcaaaaaaaagaaagttttttcactaaaagttgcggccctatttattacgtccaattgttcattatcgtgtaaaataatgtctataaatttcaattatgcacttaaaatcctaaataaatgtttgtttccatttcaaacaccggttttatgggcgaaaaaatatcaaaataatggaatacatttcttatttgtttttttgaaaataaattaaattgaggcaaacattttattcactggtgtcaatttatttcttttttttttgagacacatcaatagagctgagatttttatgaaaaaaaacacttgattttcccatttttaacacatatttagtatatatttcagtattttttggcacatattttattacatatttcagggtttttagcacataaaagtcccagccagcagctctactgatcaacaaaattttttcatcattatttgataagtaaattttattccatagaatattttaatagagcagaattgctatggttatgtgattgatcgtcattataaaataaatttttatgaatttggttacaaaatatttttagaatg

SEQ ID NO: 105097 - DNA, 228 bp, Heterodera glycines
  Promoter: Source sequence=SeqID_38247; Location=957..1184; Strand=-; Gene=SeqID_67126
tttttgagggcgtcgacacacatccctggtattaatgggaaacaaaaaatctccttagtttctggcgcctattggcaaaatcccaacacctagttcgcgggatttaaattaaaattatcgattattaattagatttccgagaaatttttgaattcctttctaattaaaaaaaatttccattttaaggattttattttttcaatttcttaaacaattcatagaaaaatg

SEQ ID NO: 105098 - DNA, 113 bp, Heterodera glycines
  Promoter: Source sequence=SeqID_29339; Location=898..1010; Strand=-; Gene=SeqID_59851
ggtttttgttggcatttgtgccgacttttccatccaaatgtcccttaagcattgaatattggttccgatgcgtcgatttggacggagacggccaaatttcgctctatgaaatg

SEQ ID NO: 105099 - DNA, 837 bp, Heterodera glycines
  Promoter: Source sequence=SeqID_15272; Location=2149..2985; Strand=-; Gene=SeqID_79485
taaagcattaaaaatagagaaaaatctggaaaatattacgagatttattatattttattatgttcaaaagaaaaaaagataattcaaaatttaaggaaaaaatcggattttcagaaaaaaatttataactcggttctgaaaagtcattatttaaaagtaaaatactacaaaaatccccaatttttagctctattttataaattttatttcacatttttatcacttttttgaaaaatgttataaaaataaaagtgattttgggattcgggaccaaaggggggtgcacatgatttttgagtgaaaaaattttttcgacaaaaatcttccaaaaacatgtctttaggggttatttgggccgctgatcacgaatatgaaatcagatttcagttatgacatcgttaagacctcagaatccctgtgtgattggggattctgagacatcattttgaggggggggggcaggttcggatccggacggtgtaacattaattttctatgcattttttgattacttttacattttttaattaatttgttttgtattattaaaaataaataaaaatttttaatttaaattaaattattttggtgaacaaatgttttaatttaaattatttaatttaatattgttttattaattattttaaattattttctgatgaataaatgttttatttaatttgaattttcgagaattaattcctttcaatttcaataaatattctatattataaatttctaactttatttttaataagtaaaaggatttttttaatttgataaatttataatacatccaataatacaattttcttatttatttcattttaaaccatg

SEQ ID NO: 105100 - DNA, 511 bp, Heterodera glycines
  Promoter: Source sequence=SeqID_43945; Location=264..774; Strand=+; Gene=SeqID_71507
tattttatggtatttatgttttcataatttttaattttgtatatttactagcatttaaaaattaatgtgaaatttgtccggtaaattgcaaaagtacatcaacccaatttttgatgttttccggatggaaagatatcgatttgggtgaaaaaatactagaaacaatgataatggcggacggttatcgcatttctgagtctaaatgcttacagtgtatgtaataattgtgcgaataagcgaacaatctacctaatccttcacacattctctgccataaaaccaaatatttcattggcatatccaaattttggtgcatattttatgaaagtggtcctaccatcggcaattaccatttcttttttttcgcagaaaccaaaacactgcactattgctaaaataaatccccgataggtgcctaattgtaattgtgtctcatttctttcctcttgaatttgtggaaattggaatttgttttgaaatgattgacgaggaaaagccattttagaaaatg

SEQ ID NO: 105101 - DNA, 1003 bp, Heterodera glycines
  Promoter: Source sequence=SeqID_2186; Location=130..1132; Strand=+; Gene=SeqID_78360
ccccccccccccccttgagtttaacccattttaccccctttttgagttttggcaatattttaagaggaattcgataaaattttgaaatatttaatatttggcatttgttttcgtatttttaactaaattttcttacaaaatcgactaaaaacacaaaaaattttcccggcggcgcctgtcggcgtcgtcgtacataaaaattcctttaaaaattttaattgttaccttaaaatctagaaaaatgcccattttttgttaaagttttgtgaacaaataccactttaaattctatttttcccctatggcgccaagcccatcccctattttttaaaaactgtacgcaaaatttcaaccaggaagttactttttggacaaaatttttttggtcaaatctggccaaaaaaaagttatttggacaattttttagctatttataggcttttttactcaaatgccatctttttgtgtgctgacgccccacttttttttacccttatggtgggttgtcgcccctttttgatgttatgctatatataccctgtattcaacataaattaatatgtattcttctctagaatctattgtttttcttctctagaatacatttttttaacatttccgtgttttcattaattctttataagctttatttttgatactgtgtgctgaggtgcgtgacgtcaataggctcctggcttttatttaaataataactaaaaacgaaaacaaagatattaataaattgaatttttgtaatagatttgtatacaataccgcgctggaataaaaaatacgatcaaactcctaccaatctcaataacgtagtaaaaaataacgtttttttaattcatgtaatttttaaaaataatcatataaataacagtttatttgagcataaaataaagttttaataataattgttgtgaaatcttttaataacattgtctttttaatctacaaagacaccaatgttaaaaaatttaagatttccaaccgtaaaatg

SEQ ID NO: 105102 - DNA, 82 bp, Heterodera glycines
  Promoter: Source sequence=SeqID_20754; Location=481..562; Strand=+; Gene=SeqID_51320
aaaataaaataaatttttttaaattttattttatagaaatgtcttttgggccattttactcgaaaaggcatatgccaaaatg

SEQ ID NO: 105103 - DNA, 500 bp, Heterodera glycines
  misc_feature (7)..(7): n is a, c, g, or t
  Promoter: Source sequence=SeqID_33169; Location=463..962; Strand=-; Gene=SeqID_63314
tttctcnatggatttgtccaagcgaggcttgcttcccctttttgagggccccggttgcaggtcaagcagtgtttgagtgttgttgtctccaattgtgatgacgtcatcatcattttgaggggaaaaattttcccgtttcgactcatccatttctttaaatttaaaattattataaaaaactcaaaaaatgattaattttgttctcaaacaacaattgatcattgatttttctcggggccattacgattaagaaatagtttatgattataattgttaaaagcataaaatgaacctgcgaaaaaacacgtaattattgattgatagtgagaggggtgttagcgcgcagcgacctccagacgggctgtcccttttaatcgataggccacgcccatccacaaacacatagacgagagagtagtggttagagaaagatacaaaagggcgccaatttaaacacacagtgaaacccaagccaatttattgattttttacagattatg

SEQ ID NO: 105104 - DNA, 1003 bp, Heterodera glycines
  Promoter: Source sequence=SeqID_9014; Location=1133..2135; Strand=-; Gene=SeqID_69996
tatttgaaatttactaatataaacaattattttttatgatgaaagaaataaaaatttagaaacctgcattaaaatatgccttaaaaactaccaaaaatgccttttagtactaaaaaaatgccaaaaatttttacaaaattcagatgtgattgaaaaacatcacaaccatctaatagatttagacaattggataaattttgatttcaaaatttacagctaaaagaatattacatttcttataaacaaattttttccaagtattcttacaaaaggctcaaaaatttcagtttttaagggtgtatttttaaaattacaaaaaatcgatccttagggggtgaacattcaccaagcaaaaaaatttgaggcacaaaataattatgaatcattttgaattcttacaattagcagtaaaaatattgtttgtctgggatttaagttaattcgaaaaatataatttttttgtcactgatattttctttaacaaatactcgaagaaaatcgcaattagtttctgaatgatgtattaaagaaaaataccatattattaattcaaaatttcaagtctgggtgagaaagagagggaattggtcaagaaggagaaatttttttttatatttttaaaaacagctatttaaaaagcaaaaaaatttaaaaagattgaaaatttattttaaacccagaattttgggcttagaaaattccaagaatcccccctgaaataaaattttaaaaaattttcctcgaattcgttccccaaaacggaaaaaattaacaataatttttaaactattttttatacctaaaaaattaaataaaaaatttcaaaaccacacttaacattattaatttagcgaaaacagtcaagtaatctgaggactttcgttttgtttatcttacaaataaatacctgttaattaaatttttgtttccttcaagcgaaaaaaaagaggcggaattgcgggagtgcgccgaaaaggttgtcaaggcgaagaaggccaggatg

SEQ ID NO: 105105 - DNA, 561 bp, Heterodera glycines
  Promoter: Source sequence=SeqID_17539; Location=1639..2199; Strand=-; Gene=SeqID_82040
tttttattgattaataataaatttaaataaaattaaaaaataaataaataataaaataaataaacaatcccaaaactaaaacctattggtttaaaccaaaacctattggatgggtgcgggagtgaacctaaacctattggatgggtgcgggggtgaacctaaacctattgaagggtttttattgattaaaaataatttaaattaaaaataaaataaataattcgcaaaaccaaagcctaatggagaagggaaagggcgtcagctgtcgggagggaagcgacgccgggtcatttgagcactcgcgcgtaccacatgagcgcccgcaggggccatttgagcgcacggttgtgataatttgagcgctaatgactgaccgctactaggttaaagggaccgggaggggggagggggtagtaactactaattttattgtctttttcaactgcataaaataaagaattttttcttaaaatcaatttttttttaccatcactattttgtttaaattctaaatttataatattcattaaattaaattaatttttatattctagaaaaatg

SEQ ID NO: 105106 - DNA, 258 bp, Heterodera glycines
  Promoter: Source sequence=SeqID_1974; Location=1523..1780; Strand=+; Gene=SeqID_77117
ttttttacagtttttaattgtgtaaaatcatttattttaaacctcatttttggactattcgaatttgatttagtctaggcttaacaaatgcgaggaatgagtcgatggaaagggacccatcgacaaaatacaaagaacagcacaatctccgtgttttatccaactttatattaatataatgtttaacttccctcaacagaatggcacattcgccatgtcttttcccattgtggcacaataacttccgtaacagaaatg

SEQ ID NO: 105107 - DNA, 1003 bp, Heterodera glycines
  Promoter: Source sequence=SeqID_774; Location=295..1297; Strand=-; Gene=SeqID_60938
ggcgaattttaaatttatttctaacagatattcaccaaaaaaattaagactttttcgataaatttacgttttttaactatattaaattatcgtgatttactcaaaattggaactcagattttttaaattttttttcttgcggcacatttttcaaaaaaaaaaacttgatgaatgtgcgaggggagagttccggcggtgccgataggcgccgccggggaaaattttaagaatttatatgaattttgttagaacttagccaaatttttcagaaattttcttcttttaaatgaaaataaggcattacccccaaatcagaacatttcttagaaacaagaacataaagaaaccctgtatttatccaccaatccacaaataaaataaaaaacaagtaaaatttattttatttcataaaaatttctcgatagttaaaaaaaattcaaaattgtctaaattttttgccttatttcgcacgaatatgccattcttaggggtgtattttcacccccgtgcccccgcgggggtgaaggtcgcgggggcgggggttgcgggggtcagagtcacgggggcgggggcgggggtgagcccaaaaaacctgtcccgcccccgggggcgggggcgggggcggggctcgaaccctattgaaaacgttgggagtcaaaactgggaattccgttacgtctatgtttgaacagcaagcagaactacgagggtttaacgacgatccgcttgccaaaccaaatattcacgccctacaaattcgagattctcgttcggtcaaatccggcttctcgtttgcggtccccgaatttttttcctctctatttagttcaaaatccgttgctctatatgtgaaaatttcaatcatatttaggacatattatgtgatcactgatccgatacggaaaatgtgcactgctgaattggactaatcagcttttaaaaacttttgctgtgtattttttgatcagtgattgctttgcgttcagctgatattattcatatg

SEQ ID NO: 105108 - DNA, 1003 bp, Heterodera glycines
  Promoter: Source sequence=SeqID_19819; Location=1411..2413; Strand=-; Gene=SeqID_84558
aaattgctttgatattatgttaatgagttatttcttgaagaaaagtattaaaatgacacctgaaaagtatgacggatttgttaaactaaggaaattattcttagaatgagtaacattatatgcactttatcttatcgactattatagcaccttcacctatcttctcgctttacatatttagtgaatattatgagcaatcaaataatatatttctaagattttcaaaaattatataaatcagtttggccgtgttaaataagaaagaaaatcattgaaaattaagaagcaaatagtttttcttggtcaaaaaaaaacgagcaacaaatgtcatcccgaacaaagcaaaatgaatgaatgatcagagaaaaacaaacaaaaaatgaacaaactcagaaatcacacattttcatcgccaacaatttctgagttcaaatttgcgtttggtttcgctaaattaattaaataaatggtaaaaatttattgtatttcaaattaaaataaaccgttttttaatgaaattatgaaagtttttgcgcgacaaatcggacaattgttgttctgtttaaccctaaatttgtaaatgttaaagttaaagaaattaattgtcctttcatttaccaaaaatcaatgcattccgagtgaaaattgtgctaaatgcaaaattagtattaatgtatagggatgggattcttagttttttaactattttttctgcggctttaactcgacgagaaatgcacgaaaaacacattatttttcgaaaatttttcgtttttagtgccactattcatcactaggaatcactattttggagcttcgccactaaaaaaaaactatttcgaaagttggccactaaaataattttttgccactattttggcattttgtcattatttttgccactatttcgcgattttacaaatttgtaaaggaatattcactaattttcttcaaatataccaaataaaacccatatttttaaaggaaatatcgaatcaaaatg

SEQ ID NO: 105109 - DNA, 225 bp, Heterodera glycines
  Promoter: Source sequence=SeqID_11918; Location=1036..1260; Strand=+; Gene=SeqID_75429
ggtgtttccgaatccattggtataaaaaataaataacatttcctaattaaggaaagaagttttgccaaaaatttacgaacgcgttcaggccaaaattaggagtgatttggaacagtgcacagtgttgtcgttcacaagtgactgttgggccggcacttccgataattttattaggtatttttgttttaatattttaactatttttatttagcctgacaccgcatg

SEQ ID NO: 105110 - DNA, 298 bp, Heterodera glycines
  misc_feature (125)..(125): n is a, c, g, or t
  Promoter: Source sequence=SeqID_34451; Location=1..298; Strand=+; Gene=SeqID_64238
catcacttcattttccaatcaacaattacttgagttcacaaattcttttatttttctgagacacttcgacgacataatttctttaaatttaaatttctcgactacaatcaacaaaattctggatntattttctaaattctggtgttaatcagcgaaacatattccgacaattccatcaaaaacggccgacacgcggagaagaccgaattctttagaggaagaaggactaaacgaaggacaaaccgaaagggataaaaggctttggctcatccatcaaaaaaggcagttgcgtaatatg

SEQ ID NO: 105111 - DNA, 140 bp, Heterodera glycines
  Promoter: Source sequence=SeqID_10649; Location=786..925; Strand=+; Gene=SeqID_73892
tttctaaatgttgcgctttgaaattatttcgctttaattttaacttattttatttttttaaacgttaaaaatattataaaaaatttaaaaaagtaaaatgtaaattaaaaataatataaatataacattattaaataatg

SEQ ID NO: 105112 - DNA, 178 bp, Heterodera glycines
  Promoter: Source sequence=SeqID_44117; Location=1386..1563; Strand=-; Gene=SeqID_71652
ccaaaagtcatgaaatcatgtttacaaggttttcggagttgctgatcatgaatccggcattcttttgggacaattccgaattctagacccgacttcgaaacatgttttcatgacttttggaaacataaaaaatttttcgaaaaaaagggggggggacaaagcacagtattacccaatg

SEQ ID NO: 105113 - DNA, 422 bp, Heterodera glycines
  Promoter: Source sequence=SeqID_16774; Location=2118..2539; Strand=-; Gene=SeqID_81189
tttttatgaattggcaaacacgattgcaccacagctcctatactaaaaaagagacatgtgtggcacagtggtttattgcaagatagtaaagcgaaatgggacggaggttcaagtccgccacacgacatattatttacacagcggcccaattttgtgctctcagtgcaaataggtttttatttatttagtaatcagaacgccaaaactttgcaaaacttaaaattttttggggattttgccttgtaaaaatggaagagccgatctcgagttaaaaagcattttggtaaataagcaaagcattatcctataaatggggttaaaatatatgcttatgcaaaatttcaagaaaatcgcaactttggaaaaaattttacgactgcgcgaattttcaataaattttcagtattttagagctaaaaatg

SEQ ID NO: 105114 - DNA, 993 bp, Heterodera glycines
  Promoter: Source sequence=SeqID_30544; Location=1160..2152; Strand=-; Gene=SeqID_60961
tcgctgcgaatatccgtttcacgttctgacaacgatcctggcgcggtcaggtcatttggaacaccctcaaccagtgcaagcagttcattaacaattcgcccttaaaatcggtccgtatttaaaaaggcaagtcttttcttgactatccctgttcataaaacctctagagatgggtatttatcccatttctattcggcctggcttggattaacatttggacaagtttcagaagtgtattcttcgtttcttgcgggtttttcgaagcaactgtacatcattttcgagtacattacaaaccaccggcattaatcgctccgtttaatttttgtaaagccttatttttctgtataataatcagtagggttgatatttttatgacctaattttcctcctactcccttgtagttgttaatgggataactcgaaaggattttcaaggaaaattcgaacttgtgccccccccacgcgaaacaaaattgagataatctggcatgagtaattttcggtaatagtaaagtttatccccccaccctttttcgaaaattttttttgttttcaaaaaacatgaaaacatgtttccatgggttttcggagttgctgatcacggagcggcatccatttcgactaattccgaatcccggacccaaatttgaacaaagccgaaaattcaaatttttcgaatttccatttttagtctaaaaatggtttaaatgatcttttattgaagcactaatgactttaacttcattttcatgtatttaaacaaagtttgaaccaagaatgcaaaattcgaaaaatttgaatcttcgactttttgttcgaattcggggtccgggggtttagaattggtcgaaacagatgccggattcgtggtcagcgactccaaaaacccttgggtaaagaaaattgtagttttcagttaattaatgatttatcaagttttgacttatactaaaaaacaaaattttaaataacaaaattccagcagcgatg

SEQ ID NO: 105115 - DNA, 391 bp, Heterodera glycines
  Promoter: Source sequence=SeqID_23680; Location=1..391; Strand=+; Gene=SeqID_45801
gcccccgggccatcactcgccacggccatcaccgaacgaacaaccgatcattccccccacattttgtaaggtctgtacatttgcacgtgaatccaattgttgtttaggggggaggggcaacggacgacaaacgatcaccccatcacatcactgtccccccaccactccgctgccatcactgtgatgagtgcaccaaattataaaaggggggccgcgagaggggccaccccaaaacgaaacgaaacgcaaaggaaaagcaaaggaataaataattaattattcactcattccatcgcgaagaagccaagccatcttcaccagcaattgcccctctcatttcattcaattttcagcaattgtgccataattaattattaattggagaacaatg

SEQ ID NO: 105116 - DNA, 487 bp, Heterodera glycines
  Promoter: Source sequence=SeqID_7186; Location=2603..3089; Strand=-; Gene=SeqID_64080
tctttggaattcttttaacttgacacgaaatatagacaattatacacaaaaattggatttatttgtatgaattcaacgaatgtttaaaaaaattaagattcatccttcattcgttcataacaactacccctcccctttttgggacatgttaaaatgacaggtatacatattttcttgcgaatttgactccctttgttttaattttaaatttggtattttattctgataaattggcgtaatgttttgttcctgttcgtgtccgaatgtgtaccgtaaaaaaattacataggtgtttcaattttcataaaatttgcaatttttagccaattttttcttaaaattgcatgaaaaatcgtcaaaaataaattcgaagtgatgtcatttgctgcatctcgaggttttgtgtgtacaatttgccacgttaagtcaagttttgtaggacgaggcagagggggcagaggaattgccccaagccaaactgagaatg

SEQ ID NO: 105117 - DNA, 140 bp, Heterodera glycines
  Promoter: Source sequence=SeqID_22639; Location=1341..1480; Strand=-; Gene=SeqID_53310
tctaaaaaaggattttgaaaaggcgaatctttttctaaacgaatgctaagcaatttgacatctcagaaaaaagttgtgatactttcaaattcttatcacgttataactcaagtcctaaactgctgttttcaccaaaaatg

SEQ ID NO: 105118 - DNA, 118 bp, Heterodera glycines
  Promoter: Source sequence=SeqID_27572; Location=1516..1633; Strand=-; Gene=SeqID_58266
acgccgtgccaatttcagaggaaattccaaccaatcgttccgtcaaggaaaatggtcaaatcagcaacctcgtcaatctcagggacaatggcaaaatcggcagaatcctgttaacatg

SEQ ID NO: 105119 - DNA, 1003 bp, Heterodera glycines
  Promoter: Source sequence=SeqID_14446; Location=1348..2350; Strand=+; Gene=SeqID_78488
tatttcaaagtcgcacttatctttaatttttcggtcatcgtacaatgggtgacgaacgaaggctaagcgccgtttttcatttattcattttctaacttttcatttcttaattttcacgttcttttttattgcccatttcgcaccgcaataaaagcacaacatcacttaagccgtaactgaaaagtgttgaagagcgcccgaggggtggtgattaattaaaaatagaaaaaaaaaattaaattaacgaaaaggcgcaatgtcattggcattttgccgtcccaggatgatggaagtcatgttggcatgccctttcgacccggctttttcagaatgaatgccgagacgcggggagaggcatggaatttgtcattttcatattagtgaataacgaaaagttccattgccaaaatataagcgtacaacgcattttgtaattggtcaaccggattaaatttatattcattgaaattttttttttcgaattgattggcatgttaaaatatttcattcaaaaattttaatttataaggaaatatttataaaatggaatttttgaatttttgatgatagagtttaaaaataattttgtaaaaatttttaaaaataaaatactttaatcaactcatttttttaaacttttggacttcaatattatcatattaatataaaaatatttaattatttttgttgtgaaattcttgataagtgaattttataaaaataaaaataaaattttttagacttcactattatcataataaaataaaaatattaatttatttcgattttaaaatgaacagttttctgcattcacatttttccattgatttattctatgaaactaatgtcaatttaacgctaaaagagtacctctgcccctaattagcatacaattttctctgggcacaatttttccatagcattcattaacaataatttttttttccgactccattaatttatgcataattattaaaacataaattaaatcttagcaaaaatg

SEQ ID NO: 105120 - DNA, 273 bp, Heterodera glycines
  Promoter: Source sequence=SeqID_28857; Location=920..1192; Strand=-; Gene=SeqID_59432
gtataaattttttgccttttatccatgaatatgtcattcttaggggtgtattttcacccccgcgccccagcgggggtgaaggtcgcgggggcgggggatggcgggggtcagagtcgcgggggcggggacgggggtgaggccaaaaaacctgtcccgcccccggcaggggcgggggtgacgggggcggggtccgaaccctagttttttgagacgcgcattttgatggtttttgagtaacgacctgccgcctcagcaattgaacaattccacatg

SEQ ID NO: 105121 - DNA, 300 bp, Heterodera glycines
  Promoter: Source sequence=SeqID_4611; Location=584..883; Strand=+; Gene=SeqID_55081
tttcctattcacgatgaaatcttttgccccacaaaaggcaagctgcttgttgaagctaatgacagcagcccatcagcggcttcttctgctgcttctggtgttcgcattagcagtttcttgctatacgaagaagataatgttcgttgcacttttaatttcaaatcattttttccattttttctttagtcggccccatttatcaattttttgaattatttggacgcggttgtctctgtccttttcatggccatctgcattttgatcaatgttttcgctgtttccgcttacaaacggcaaatg

SEQ ID NO: 105122 - DNA, 302 bp, Heterodera glycines
  Promoter: Source sequence=SeqID_10085; Location=2279..2580; Strand=+; Gene=SeqID_73151
gtgattcggcaagcgatcaaccaccatttattcaatcgatcgattttgcactaatttaaccatttaaaaaataaagttttaaaaatgttagaaaataggatcgctcactcaaaaaaattggtcataaaaagtttaaaaataggtataaatccaacaaataaaattctaaatgaggatttagaagcatttgaaaaatgtgggtgggcgctcgcgctatataaataagtgcgcgtgtccccatcggcccatttcaatttattcctgtcaaacatttgaccgtcagtttttttgtcagcatcatg

SEQ ID NO: 105123 - DNA, 127 bp, Heterodera glycines
  Promoter: Source sequence=SeqID_10147; Location=1..127; Strand=+; Gene=SeqID_73245
atcataactttttttcaggctggccaaattttataaatttggtatcattcgaaagctctacatgtttagaagcttttgataagttatttctaagcgattgaacaacttataaaaaagttgaaacatg

SEQ ID NO: 105124 - DNA, 244 bp, Heterodera glycines
  Promoter: Source sequence=SeqID_45084; Location=652..895; Strand=-; Gene=SeqID_72465
tccgtgccatccctgatatgtacccgctatgaggtgtgaaatttggtgaaatcaattttctatttggactaaatttcttgaattttgcatgcttacacaaatgaaacaaattttaaaaaagctaaaaatttgttttttctcaagttgactattatccaattcatcctttggggctgttcagtcatctcggaaaaagaattgtggcaaaatgatggcaaagaactgactgaaagagtgcaaaatg

SEQ ID NO: 105125 - DNA, 56 bp, Heterodera glycines
  Promoter: Source sequence=SeqID_26748; Location=1..56; Strand=+; Gene= SeqID_57516
accaagaagaggagcattcaaaacgattgagcgaagaggttgaacttgtcaaaatg

SEQ ID NO: 105126 - DNA, 734 bp, Heterodera glycines
  Promoter: Source sequence=SeqID_11657; Location=125..858; Strand=+; Gene=SeqID_75117
aaaattttttttctttttctcctaagagaggcatttttcaaattggaaattaccattttacattttgtcattttacaaaatattacatattatcaaatcctgattttttttgttatattctatgaaataaattttccataaaaatgtaaaaaaaatgaaaaaaaagattcatgggttagcgagtgtccttgttcttttccggcaccgagcagggtcaaaattcgatcatcccatcaataacatatttttaaatgttattttagctttgtatttatgagctctatagaattcagtttgcctgtgttttgttcgccaactcagttaaattttgtgattggaaagcgagatttatgcgagagcaaaccgatacaaatgtaagctaaaatagccttaattattaaataaataaaagttttggctgggttggtcggaacattcgtgaagaatatgcaataattgtttcttttagattcaacccttacaatcatttactgcgctttaaattcttttgtaagttttttttggatttatttttccattttctgataaaaattactttgggatgcaaatgtggtggggttaaggggccatttcggcatcgaaattgttaaactattttttcgttgtctaaccaatttcctaaataagagatatcaaccaaatttctactcttctcaaaaattccttcctcccctttttagcaaatgcgcctgagcgttggcgcgtggaaaatg

SEQ ID NO: 105127 - DNA, 331 bp, Heterodera glycines
  Promoter: Source sequence=SeqID_11407; Location=1555..1885; Strand=-; Gene=SeqID_74801
aataaataataaatagggatacaatttaaatgcaaaaatttttgacggagtttttgaacaattatttgtaaaatattcatattgccagaatgacttgaaatttttcaagaggaaaatattttggaaaagggtgatcactgatcagtaggggatgatttataattttaaaaaaaaaatcctggcgctattaaagtgtttgttttgaattttttaaaaaccatataggcgagcgacccttttgttttacaaaaatttttaatgtctagtcatgtaaacttattttttaattaattggattaagtataccaccgatcatttcatcaatggcatg

SEQ ID NO: 105128 - DNA, 290 bp, Heterodera glycines
  Promoter: Source sequence=SeqID_15761; Location=3030..3319; Strand=-; Gene=SeqID_80086
tttttttttttattaaaaaattttttttattttttttaaaattttaggttttttcctaaaaaataccccccccccccttaaaatttagcccccccccccccttataataagccccacttttgagggggggtgaaaaaattaagccccccgggggctctatttgggaaatatggtattccttttaaaatattaaaaaattaaaatttattttgctaaaattagataaatataagcagttttttatttttaaattttattgttaagcatccaacaatttttcatgtccaatg

SEQ ID NO: 105129 - DNA, 1003 bp, Heterodera glycines
  misc_feature (69)..(69): n is a, c, g, or t
  Promoter: Source sequence=SeqID_25021; Location=815..1817; Strand=+; Gene=SeqID_55750
tgggtaaatttttatttccacgcccaaaatcgccaatttctttactttatttttaaatttcctgttttnggtgattgaaaaaaattgtttttttattataaattactagcggggtcagcgccttcggcgcatccccccgctaggcagttcgattgtgttatagaattatgaatgataaaatcgactggctcggccgcttcgcgccctcgcatcattttcttggcttttctccaatctctgggactcaacccaccagcaattcaatctctgggactcaattctccggcattccaaacattgggacttaacctaccaactttcaattacattccaatcgctgggactcgacccaccaactttcaatgacattccaatcgctgggactcaacccaccaactttcaatgacattccaatctctgggactcaaatctgcggcattctaaacattgggactcaacccaccaactttcaatgacattccaatcgctgggactcaacccaccagcatttcaatctctgggactcaaatctccggcattacaaacactgggactcaacccaccaactttcaatgacattccaatcgctgagactcaacccaccaactttcaatgacattccaatcgctgggacttaacccaccagcatttcaatctctgggactcaaatctccggcattccaaacacggactcaacccactaactttcaatgacattccaatctctaggattcaacccatcagcatttcaatcactgggactcaattctcctgcatttcaatcactgggactcaattctcctgcatttcaatcactggcactcaacccaccaacattccaatcactgggactcaaatctccggcattacaaacactgggactcaacccaccaactttcaatgacattccaatcactgaaactcaacccaccagcatttcaatctctgggactcaaatctccggcaatacaaacactgggactcaacccaccaactttcaatg

SEQ ID NO: 105130 - DNA, 69 bp, Heterodera glycines
  Promoter: Source sequence=SeqID_707; Location=1..69; Strand=+; Gene =SeqID_59403
cagaggaacaaacagtctcaatgcctgttgtatagaggcccggtaatactgccggacctggtcggaatg

SEQ ID NO: 105131 - DNA, 244 bp, Heterodera glycines
  misc_feature (15)..(15): n is a, c, g, or t
  Promoter: Source sequence=SeqID_41288; Location=1..244; Strand=+; Gene=SeqID_69451
cccggttcgaattancaatttattagagattaaaatttcattgataaaaataacaaatattaattaaaattgaaaatgactaaataacatattaaattatttaatgaaaaatttataattttaaattgaataataaaaacaaaaagaaattttatattatgggtattttttacaaaaaatttaacatttttgaaaagttaaatttttgcaaatattctcaaaaaattcgaattttctaaccatg

SEQ ID NO: 105132 - DNA, 239 bp, Heterodera glycines
  Promoter: Source sequence=SeqID_10491; Location=166..404; Strand=+; Gene=SeqID_73704
ggtgggggcacctctgataagtcagtaccatcattcgccatgttcctcagaatgttcgtccttcgtccgtctttcgccccgcggtgactgttcagtccgctgacattgtccgcgtccgcgccgatgccatcgtcgacccgctgaagggatcactgttcgccgcactgctccaatcgccagcggaggaaacgacggaaaaagtgttggaagcaaagtccattttggacgtattggaaatg

SEQ ID NO: 105133 - DNA, 458 bp, Heterodera glycines
  Promoter: Source sequence=SeqID_8223; Location=899..1356; Strand=-; Gene=SeqID_67349
tagagaccggcgggatcaggacttccgcgggattttacgggagtcccgctcccgactcccgcttttttcggtgaacgggatttttacgggattcccgttagggactcccgtcccggaaaattttgaactcccgatcccgctcccggaaatttttacccaaaaaactggagtaaactgcactggtaagaattgagtttgtaaaaataatgatttttatcgaaaatctgttaaatataataaaggaagtcgaatttatttaagcaatttgaaaaaaaaattctgattttcgacccaaaaataagattttttcatttcaaatttctccttactaaatttttctatatatttttaattaataaattaattgtccttcaaatttgtgcattaaaaatatttttgtgtttttaattaaattttcgaattactcccgctcccgcccgggactcccgttaaaaatg

SEQ ID NO: 105134 - DNA, 344 bp, Heterodera glycines
  Promoter: Source sequence=SeqID_13131; Location=1808..2151; Strand=-; Gene=SeqID_76935
tttaataaatatataaaatttacaagataatgatttttattttatggaaaaagataaaaataattcactgctattattgtcttattattcaaactttatgcatttgaggtgttgggtcatttttttgcgtgattttgatctataaaacccatataaaacacttaatagataatatataaaagatataacaaaataaaataatacatcaattttcacagcaactatcataatgataatctataataaatttattaattaaattaataaatccatatatgaagaataaaaataaatatatattattctgatagaaaaaatataacaataaaaataattattaaatg

SEQ ID NO: 105135 - DNA, 310 bp, Heterodera glycines
  Promoter: Source sequence=SeqID_26852; Location=663..972; Strand=-; Gene=SeqID_57599
tggaaagagcagctcgagctctacagaaggtatggaaagaaaaaatagttatttctggacttttttcagaaatcagaattattctccaatgtggcccaaatttaggcccccagccacagccccttgcttctcccagttttaagtcttggatttgtcaaataaattcaagacttcaaattaataatcaaaaattctcttaaaatttttttgaacccaattcaaaaaaggaaaaaaatttgcagtcaaaaaattattcgaatttctccaattttgtttccataatttccgaaagttattcggtatcataatg

SEQ ID NO: 105136 - DNA, 109 bp, Heterodera glycines
  Promoter: Source sequence=SeqID_24699; Location=896..1004; Strand=-; Gene=SeqID_55448
ggtaagattcaaatgtgacgtgcctcatttggattcattttagaaattattaaatttattatttaaattttactttttcaatttcatttttctttttttagttctaatg

SEQ ID NO: 105137 - DNA, 958 bp, Heterodera glycines
  Promoter: Source sequence=SeqID_17238; Location=263..1220; Strand=+; Gene=SeqID_81707
actaaaggagtttctgattcattatttaaattgctaatatctatagctaattgcctacttttgctcaatgaaacaaactaggattgggcccccgaccgtcggggttggaaaagtcggggttcggcgtcgtcggggtcagcaagttcggggtcggggtcggaccaaatcgttcgggtcggggtcggggttcggggtttttcaatttttaccttatgcctaatagtcaaaattttttaattattttttctgaaataatattttttaatttccataataataattgtatttgtttttatatttttttatttcttttttatcagaaattttgtatagaattaattttttttcacgaaattttaaaattttttattttttcggcgacattatttttaaaattactgtttattttttccgttataaatataaaaattacttataaaaaatattatggtagcaaaaaaggcaatttcgagaaattacatttcaaaaataaattatatgcaataaaaaaagtgaattttattcaaaaaatgatcaaaaatttattattacttttttgtttttcaaaacattttttcgcggcgcgcattttctaaagacttttagggagaaaggggtccggcggtaccgataggcgccgccgggaaaattttgaaaatttggatagatctgttaacagattttgtccagaaaatgctaaatttttgcggttttgagctaatttttttaataagatttacgaatttttgggcccgatgaagccgataggcagctccaggcggattttgaaatcaagctctattttctaacatttttcaccaaaagatttatgaatttcccagaaagttttgttttttctcttgatattttgtaaaaagtattttgaaaattgtagagtacattgttaaatattcaaatttacttgaaatttcatcgccccgaatgcaattacgaaatg

SEQ ID NO: 105138 - DNA, 596 bp, Heterodera glycines
  Promoter: Source sequence=SeqID_2784; Location=565..1160; Strand=+; Gene=SeqID_81574
attaatggattttgtttgaaaaaaaaatctcttttgtccacattaaaaaaagtcaataggcgcatctgatcatttgctgggttaacaaaacgcataaaaatgcaacaaaaaaaaaattctcgtgtgttttgggttttttgaaattcattttttcaaattcaagtgaaggaattcttgaagggagcagctcttttcctccccgccggttacctccccgagaaattttaaaaaattttttttattaacttagaaaattttcaagaaaaaagcttagaaagtttttaataaggaaattctatgaaaaaaaaattttttgagaaaattcagcgcttttttggaaaattttttaaaaatcttagtttaaccacaaaaatttttgtttagaattttcctatgaaaaaactttctaagatttttattcaaaaatttctaatttagtattttttaaagaaatttctcgggggggggggaacgatgcggggggggggggaaacgtagtgcacccttcttgaaggggtaacataggcaaaacagaaaatatcagttatattttttctttaaagctttgggtaaacagtgattttgaattaagaatg

SEQ ID NO: 105139 - DNA, 1003 bp, Heterodera glycines
  Promoter: Source sequence=SeqID_12377; Location=1047..2049; Strand=-; Gene=SeqID_75983
ttatataaattttacgaaaaattgtcacaaaaatttctttggaaaatttttcaattaaaaagtcattaaccaacattagcaatcgattggatatgcttggtcttttttctattccagtacgttttctctgctccccccccccccccccccccgctttttcttctattttttcgttcgtttgggtggtctttggccccatagccctcgtccctgtccctccaagccagtcagtccgcccccccccccccctcattttgtgccagccagcacgggaaaatgtaaagcagttaacacagttcgctcgctatacatatacataaattgtggataattccattaatattctgcctaatttttcccattcggcgcctatcattagggctgggaatttaagtcaaatgcatattttgtgacttttttacactttttgggatttttatgacttttttgagtttttgcaactttttcatgatttttttgactttttgaggcaaaatttgaattttagcgaagaaaatgccgaaaaaaaaaattctgaaaaatgaaattttgatcggtgaaaaggcaatgaaacctgaatgagttttttcttaattgtggaagaatctctttttatgcttattttaggtacctatttataaaattaagtgcctaaaaatacgatcaaaatgttattctataaattattaaaaatggaatttttttaactttcgcctattttttcaggagttttttcaatttttcttgactttttttttgtcaccttttgcaatttttatgacttttttagtcgactttttgaagatttttggtgacttaaattcccagcctaccgatcactgctaaaggatttgacaaaaattgtttatgtatgtaaaaatttattttcatcttttgttccattttcgtattcatgctaatatgacacgaccaaatctgaaatttaaatttaaaatattatgtctcgttaaaaaaaaataaaataatttcattttcggagatg

SEQ ID NO: 105140 - DNA, 957 bp, Heterodera glycines
  misc_feature (256)..(256): n is a, c, g, or t
  misc_feature (274)..(274): n is a, c, g, or t
  Promoter: Source sequence=SeqID_6462; Location=4881..5837; Strand=+; Gene=SeqID_61681
ttattaaaataaaaatgttattaattcgaaggctcaaaatcccaaatcgtacaattaaaagttgtcattgttcagctaaactaaacgcctttgctttttcatcattgccttcgcgaaggattcacaaaacgcaaagcgttaccaactgagtcacgaaagggcacaaagacaaaaagaataaaatgcaaaataaatgttttatttattgtcaaatccccggaattcctgcgtatccgcgtggaattcactttgtctntatatcaaaatattaatncttaaatttcttacaaaatataaaaaattattttcttaaaatttaaaaattttaaattaacaaaatttcattattattttttattaaattattaatattatttaatttaccaaaatttaaaaaaaaatttttaaagttttcaaaaattttcaagaattttcttgaaatgaggggggggggggggtggctgttttaagaaacgcactagcacctctatgatttacgaattttgcaaatttttaattcctcacttttgccccacaattcctctctttctctgctgtctctcttccccaagcacatatttttggtaccgtaagggaaattctttgaaaataaataacataaaaaaacagtcagaccaaattaaataattaatttgataattcaatggcagaaaaaaatgttatccgaaggctcagctatgttatgaaattattgtcattgtttagctcctaaaaacatgcagatattttcatcattgccttcgcgaaggattcaaaatgcaaagcgttaccaactgagccacgaaaaggcacgaagacaaaaagcataaaatgcagatgcagaataaatgttttattttttcgtcaaatccccggaattcgtgcgtatgccgtattatttgcttttgatccgagtcgggggaccgtttcagcgacgccgttttggcgtcaagtatg

SEQ ID NO: 105141 - DNA, 348 bp, Heterodera glycines
  Promoter: Source sequence=SeqID_5394; Location=1..348; Strand=+; Gene= SeqID_57875
ttctcgggggggaaacgagctgctcccgtaccagggatggttccatgatttggcatggggaagggttgtatcaaagtgcgaacgggcgtttccccctcatttcaaaatttattaaattaaaaaaataacgtgtttttctacaataaagtcccaacccccttaattaaggaaatgctttcagattggcgacccacttttgcgcactttgttcgcctctttgtgctgtgtgaagcacgacgcttcaattctgggcagaacaatgtctgtccgctttactatttttggtgttttatgtgtaaattttatggtggtttccttttttgaaggtgcaaaaacatcccccacatg

SEQ ID NO: 105142 - DNA, 804 bp, Heterodera glycines
  Promoter: Source sequence=SeqID_25755; Location=1..804; Strand=+; Gene=SeqID_56492
aaaaaaattcttgccgaaaaaatggctatctctttttctcttggggatttgaccgcaaacttggtaccaacatttgccttctctagtctgggctctaccaaacactcacacgatatttgaaatgctaacgaaaaaaattcttgccgaaaaaatggctgtctcttttttctcttggggatttgaccgcaaacttggtaccaacatttgccttctctagtctggctctaccaaacactcacacgatatttgaaatgctaacgaaaaaaattcttgccgaaaaaatggctatctcttttttctcctggggatttgaccgcaaacttggtaccaacattttccttctctagtctggctctaccaaacactcacacgatatttgaaatgctaacgaaaaaaattcttgcccaaaaaatggctatctcttttttctcctggggatttgaccgcaaacttggtaccaacatttgccttctctagtctggctctaccaaacactcacacgatatttgaaatgctaacgaaaaaaattcttgccgaaaaaatggctatctcttttttctcttggggatttgaccgcaaacttggtaccaacatttgccttctctagtctggctctaccaaacactcacacgatatttgaaatgctaacgaaaaaaattcttgccgaaaaaatggctgtctcttttttctcttggggatttgaccgcaaacttggtaccaacattttccttctctagtctggctctaccaaacactcacacgatatttgaaatgctaacgaaaaaaattcttgcccaaaaaatg

SEQ ID NO: 105143 - DNA, 71 bp, Heterodera glycines
  Promoter: Source sequence=SeqID_7572; Location=1450..1520; Strand=-; Gene=SeqID_65272
cccgacacgtatccatgcctttttctttggtgtactgattgccattttcagcatgttcggacaatctgatg

SEQ ID NO: 105144 - DNA, 57 bp, Heterodera glycines
  Promoter: Source sequence=SeqID_14622; Location=1..57; Strand=+; Gene= SeqID_78704
agcctcagaagaattgccgattttcaagcttttaacgattaaaacagagaacaaatg

SEQ ID NO: 105145 - DNA, 91 bp, Heterodera glycines
  Promoter: Source sequence=SeqID_5810; Location=898..988; Strand=-; Gene=SeqID_59307
atttagcatcatttgaaagttccacatgtttagaagcttgtgataagctattcttaagcgatttaacaagttataaaaaagttgcaagatg

SEQ ID NO: 105146 - DNA, 801 bp, Heterodera glycines
  Promoter: Source sequence=SeqID_21684; Location=548..1348; Strand=+; Gene=SeqID_52300
actttttacaaataataattttgtaaggtttttgccaacaaattggacaatttggtagcatttaaaaactctttatgagaaaaagctttttctaagcaaaatattcattatttctaaaaatctaagtttgatctcatattttcccagtgtcacattttcttaaaatgaaaggctttctatcgatgtcgcattttcagggagccttttagtcaactcctcaaagaatgaaatgctttcatcattttgttaaacattatttttcaataaaaataggcaatatccatggctgctataataatttaatatacatatgcatgttataatgtcatagcaaatcctactggtgctgcaattataactatgatcattaattattattatttagtgagaatctacttttaaatgtaatttacaaagtagacaatgtccacggatgatagctaatataaaattataaattttatattagctatagttgctataatgcattatcaaattataaaagtaggaaaatatcaatataaaaggcaatcatttgttaaaaaattagaaccaatttttatttctttaagaattttttgactcattttaaagcaaatgtgaaggttctcaaaaaatctcactaatcttttttttaatgaattttaatttgttttgtctaaaaatttgaagaacaaaaatacaagtccaggttaggcatgaaaatcctggatttcctgtaaaatatttttagatgtttctaagtgaataattatttttttaaatttatttaaaattttagcaaaaacattctctaaaatg

SEQ ID NO: 105147 - DNA, 66 bp, Heterodera glycines
  Promoter: Source sequence=SeqID_253; Location=577..642; Strand=+; Gene=SeqID_79768
ggtgaggctcacgctgcttttcccattcattccgtcatcaattcaatttgtttctttttcagaatg

SEQ ID NO: 105148 - DNA, 1003 bp, Heterodera glycines
  Promoter: Source sequence=SeqID_10788; Location=1558..2560; Strand=-; Gene=SeqID_74045
gcgggtgcgtgaaccgtcggctatttagctgtggaaaagcgcttcgcgctttgggagcttcgctacctagactgttacgggggaagaggtacaaccacgggtgggaaggtacaattgtgatcagaagaggtacaactacggtttttttagctctggttgtggagatttggaattttttaaaaattatctgggacttttaggccgcttcgcggcctcgaacgggcgcttcgcgcccgttttttaaattttgttgggcttatacgggcgcttcgcacccgtttctaaatttgttgggctattaaggccgcttcgcggcctcagacgggcgcttcgcgcccgttttttacttcttgagcttcggatcgaattggttggagaggtttttttgaatttttaaaaaattattaggggtttttagtccacatcgaggatcaagacgggcgcttcgcgcccgtttttaaatttgttggccttggacgggcgcttcgcgcccgttattcaattttgttgacctcaaacgggcgcttcgcgcccattttttagcttgttgggccgatcgcggcctcagtcgggcgcctcgcgccagtttttcaaattttgttggccttacagagattagaagaggtaaaaagagattaaaagaggtacaaaagtgattaaaagaggtacaaaagtgattagaagaagtacaaaagcgattagaagaggtacaaatttgatgaagaggtacaaatgtgatttaaagaggtacaaaagtgattaaaagaggtacaaaagtgattagaagaagtacaaaagcgattagaagaggtacaaatttgatgaagaggtacaaatgtgatttaaagaggtacaccagtgataaaagaggtacaaaagtgattagaagaggtacaacagagattagaagaggtacaaatgtgatttaaagaggtacaacagtgattagaagagttacaaaagtgataaaagaggtacaaaagtgattagaagaggtacaatg

SEQ ID NO: 105149 - DNA, 1003 bp, Heterodera glycines
  Promoter: Source sequence=SeqID_18603; Location=297..1299; Strand=-; Gene=SeqID_83252
attgatttttattagagctgcacgggaccgggaccgtgacgggaattcccgggtttttcaggtccccgtcacggttccggtttttgaaaaaatggaaatcccggtcccggctttgctagtcccggtcccggcgggaataaataagcactggtaagaatgggggtctggtgagaaaagagaaggaaattggtgagaagtagaaatttttgagaaaaaaaaaattaaattatttatttcattttaatagaaaattttttcgaattcaccccccccccccccccaaccgaaaattaaaaaaattttattggtacatttttgaatataggcaattttcgtaacaaagtgcactcaaattttctaaattttttcaaaaaatttcctcttgggaatagtcccggttggtcccggcatttctcgcggtctcggtcccgggcgaaaaacttggtcccggtcccggcttttccggtcctggtaagtcccggtccccgttttggtcaaaagtcacggtcccgcctagttaaaaatgatcaaatattatattttcagcagcctccattttttccaaaaataaccatttaaaaattttatataaatatttggtacatattacatattttgggttttttgtacatatttcgtgattttcttacatatttatgtacatattttgtctttttctattaatgatcatttataatatttttcgtttttattaaaatattcattttaattttgccataatttttaagaatatttattaataggcttttctgatttttccaaaatcacaatattcttattttccagtctcattctgatcaaattggcgtaattgcttctttcttttttttttgcgtcaaaacgttacgctaattgaattttttcacatttttctctcagcttaaccctgtgttttgttcaattaaaaatccacttaattagtcagtaatcaatgacccttattttgaggattggaattaaaaataacatttttcagcagatg

SEQ ID NO: 105150 - DNA, 56 bp, Heterodera glycines
  Promoter: Source sequence=SeqID_6479; Location=335..390; Strand=+; Gene=SeqID_61738
ggtaaattttgcatttttcaaatttaatttttaaattttccattttttagccaatg

SEQ ID NO: 105151 - DNA, 104 bp, Heterodera glycines
  misc_feature (74)..(74): n is a, c, g, or t
  Promoter: Source sequence=SeqID_14074; Location=1..104; Strand=+; Gene=SeqID_78047
ttcagcaatattttttctacgaaggtgaaaatgattaaaataataataaataatataatttaccaattttgatntattaatttgttcagtttttgccggtgatg

SEQ ID NO: 105152 - DNA, 457 bp, Heterodera glycines
  Promoter: Source sequence=SeqID_43222; Location=180..636; Strand=-; Gene=SeqID_70950
ttttgtggtcttttagagggtcaaagaggattttttggaaaatgaggatttgcggatttttgtggacttttgagaaatttaaggatttttgtggttttttgatcacggcaagtcaattttgggctccaagtgtaaataagtttatttttaattcagcaaatagaacgccaaaactttgctaacttaaaatcttttttgggattttcccttctaaaaagagaagagccgatctcgagttaaaaatattactcgaaaaaataaacagggattcgatagagggggggggggggggtcaaaatatggggttgtgcaaaatttaaaaaaaattgtacctgtgggaaaaattttttaccttgttgaaatttaatttattttttagccaattaatgggttttaaacgcaaaaatgtcaaatcaaactaaacttataaattcttcagaattttcccttcaaaatg

SEQ ID NO: 105153 - DNA, 421 bp, Heterodera glycines
  misc_feature (185)..(185): n is a, c, g, or t
  misc_feature (323)..(323): n is a, c, g, or t
  Promoter: Source sequence=SeqID_3988; Location=1304..1724; Strand=+; Gene=SeqID_52714
aacgggttggatgcattacgttcccccccatttttcaaaaaaaaaaaatttaaagcggattataaaggaaaatggcaaagtttaaaatttctataagttttaacaaattcgctaaaatgcatggctgggcaattgagtacccaagattttctcaaaattttaccaaaaatttcctcaaaaatggnagataaaaaaggcactcgaatttttcgctccaaaatttttttggtgacaggcctaaaaactcaaacctttaatccaatgaactcacggcttttcagtcttcccgagctgaacagcaccaaagcaaccgcagcagcgcnggaggtggcggcattggcactgatttgtcatccgtcgacggcgcccaccaccaaccacaatcacaacgtttgccaaaggtgcgtcaacgccggcaatg

SEQ ID NO: 105154 - DNA, 287 bp, Heterodera glycines
  Promoter: Source sequence=SeqID_30139; Location=656..942; Strand=-; Gene=SeqID_60574
tttttgatacaatttaccaatcaaatggtccttccactccctttatataccccttctataaatagcaaccaaaaataaaattaaattgaaaaatgaactgtccacataaaattaagtgttgtcattactgtccctgtcattacgagatttgtaacagatgtaaaaagcacagtcttttgcatttcggtacatcattttttgataatttctggctatgccccaaatgcgcgaaacatgttccctatgaaaatataaataggtcaaataaataagatgcattaaaaatg

SEQ ID NO: 105155 - DNA, 161 bp, Heterodera glycines
  Promoter: Source sequence=SeqID_15131; Location=1044..1204; Strand=-; Gene=SeqID_79320
aacttacgaagtttttgaaatttgcagactgatagagaactcttattgttagggctatccaacagatacgttttaatgatttttgttccactaattaatgaaaaattcactcattagtaaagtgccaagaaattgctgtccgcataaagctgagcattatg

SEQ ID NO: 105156 - DNA, 1003 bp, Heterodera glycines
  Promoter: Source sequence=SeqID_1856; Location=688..1690; Strand=+; Gene=SeqID_76391
atctgtgctgttcgactacgtgtgatattggactacagtgatcagcgatcagtgacaagacagtacttggcagatcggtgatcagaacgacttgtgagtacggtaggagaaatcaggataagaaatacgaatgagttaagcttatggcctataaattgggatgagtcgatttttttggcacagcaaagcggaaccaaaatcattttaccattctattcataagttttggttttgttttgtaattgggcgacaaaactgagtcgccaatctcttgtcttatccatgttaagccttatgctttaaacagcatcaattagtgaccaaaattcatagcaaatcatttaagttcttataataataattgttcaagttaaggcgcttggcgaatctgagtaagagagctttgagtgtggtgcggaccatcaactgtgttcaacgcttcgacggcccaaaagtgtgacacatttcgcattgtgtgaaaactgtgagtatgagtggaaattgtattacgagggccgaacattcagctttgcttaacaaacaatatgcttttcatttgattaaccaaataaactgcgctatgcttttaattaattgttaaacactaatgcacttttatggtccctaaaattttggaaaataattagtatttaattgatctgatgtgtaaatgccggttaaattatacactcttggtacaattgaaggcgtttaggaacattgttttgttttggatttcaacaaatcattttggagaattacaggtgaagaacgacatcagtggtgatcaaacgcttcggcggattcaaagtgaacggacaaagctgactgatcgaacggacatttgacttctgtgggcggacaaagtgaatttcttttcttctattaatcaattagacaaaaataaacaccaaacaaaaccaagtaaaataaaaagggggaattgaaataaaaaggggatcagaatcaaaaattaggtttgcttcggcagttcaaaagcatg

SEQ ID NO: 105157 - DNA, 290 bp, Heterodera glycines
  Promoter: Source sequence=SeqID_18823; Location=737..1026; Strand=+; Gene=SeqID_83511
ttacttttgccaacgccgttccgtggtcgagcaagcggattacggtggtaggttacagtacccaaaaggccattagcgccggtccatccgtgctttgtccattgtcatcatttggtgttgcgaaaacggcactatttgtacggagaattctgagctgtataaactcatattgttttactattacctaaattgttttattgattaattattctaattgtatcttaattttttaatcctactttgctggggtttattttttgttttgtatttgctatttttattgaacgatg

SEQ ID NO: 105158 - DNA, 1003 bp, Heterodera glycines
  Promoter: Source sequence=SeqID_6350; Location=315..1317; Strand=-; Gene=SeqID_61232
ggaaaatcgcgtaataccttgggtgatgtggctaatttgaattttaaaggactttaaaatatataaacgtcccaagtttttttataagaatgctttttagccaaatttagacttttttttcaattttttaaacagatttcaccagaaatgcgaaatgggcgttgtttgaacaaataatctatcataactttgcttaaactcaaaaaaaaaacttatcaagttgatatcaatagataaaaagcactagcttcttatgctctagcatacaaaatttaaaaaatttactcattaaaaaatttgaaacaatgaaaaggaaaatttttttttttgtacatttttgctcacatttttttggaacatgacaaaaattttgtttttgtaggctaatggagaatttgttcaagaaatggatactatcagtttaaattattttatttttataattaaaacattttgtgaataatgaaaaaacacttttaacgccaaaatttttcataattcaaaacaaaaacttgtttcaactatgatttataaaattgaaaaaaaagaaaatatcaaagacaatttttcttaatgaaaaccattttttacacatcatcaaattccttttatgtgaatttacattcgctgtttattagcatttttttgggaaattagatagtttgttcattctactggtgaatcaccaataaatacagagaatcaaaaaattctgttaacattgaaatcatttggcaaactatacatttattatgaaataaataatttttattattagctcatttaaaacaggatgtcttttttgccaaaattaaaagacagaaattagttatgaaaaagcagatttttggcgaaaatcagaaaatcccaatgtttttgccaggggcaatatttatttaatattcttgataaatcagaacatatcaacacacaccctgctgatgatttaaaaagatttttgaaattttactttgcataatttggacaaatttaagcaaaaatg

SEQ ID NO: 105159 - DNA, 433 bp, Heterodera glycines
  misc_feature (35)..(35): n is a, c, g, or t
  Promoter: Source sequence=SeqID_13744; Location=1..433; Strand=+; Gene=SeqID_77664
aaaaaatattaaataatatttttcagaccaaaatntatcaaataatatatttttaaaccaaaaaaattattaaaccaaaaaattattaaaagatttatttttagacaaaaaaattattaaaagatttatttttagacaaaaaaattattaaaagatatattttaaatattgtaactaaacctggtaaaaacagtcattatattcgcccaatttaataataaaatatttttttccgaataaaaacacaatttaaattccaaaaaataaacaattcccgaaaaataaaatattaatttttatcatatgattttaattctcaaaaaatatatatttatttttgaattcttgacaataaatttaaaattatcatgtcttttaatttagaaaattttttacatatttttccaaatttttgctccttaagaacttcatg

SEQ ID NO: 105160 - DNA, 1003 bp, Heterodera glycines
  Promoter: Source sequence=SeqID_2991; Location=1135..2137; Strand=-; Gene=SeqID_82666
gagcgaagacaatttggtcggaggaatataacaaaataaaatgaatgagggaaaagaccaggagggaggaaatgatcgtctatttatggacaagtgacaacaacaaaaatggcgtggaatttgaatggacagatcgccataataattcaaataggctcatccgaacaaaaaattattattttaccaaaaaactcaattcttaccagtgcatttttactcccgttttttgggtcaaatttccgggagcgggagcgggaatcccgtaaaaatcacgctcccgtaaaaatcccgcccgacaaaaaagtacgggagtcgggagcgggactcccgtaaactcccacgggactcccgttcccgccggtctctatcaataagtgatttttttggcgcgcaaattaaggcacaataaaaatatctgctaattggatcccagcggaatattttttgtgccaaaaaacttcactttttcccccctctccacacattattattagcttaggttgttttggtattttttggtgtcctccaaatttaggacgtccttgaaaagacattgaccaccttttctgtcattcatttgaaaaccctctttttaatgaggtaatttagggtttttttgaaattttatttttctttggcattctatccattttgactacccttaaaacaactttttgatttccatttttgtatttgagtatccaaattattaaactgtcctttatactttccgtcattgctgttcttgaatgcatacctattcaattaaaataattctaagctttatatatataatatatataaatttttagcacaattttcttcatttaaacataatattatactgtacattgtgccgtgtgctgtaccaacgtgttgatatggtatttggatgtcctccgctacagtaaaattgttgttgatcggtcgacaacagcaacatcatcatcatcttcaccagaacaaaaacagcaataaacaatcaacaaaagcagaaccaatg

SEQ ID NO: 105161 - DNA, 125 bp, Heterodera glycines
  Promoter: Source sequence=SeqID_9262; Location=2203..2327; Strand=-; Gene=SeqID_70787
agttgggccaacaaccattttcactttgcattgacgcaagtaatcatggcgaaaaaaaactcgttccgattgtgatccgatttttcaatggcaaattgggactcaggacccgaatgttggacatg

SEQ ID NO: 105162 - DNA, 742 bp, Heterodera glycines
  Promoter: Source sequence=SeqID_3761; Location=619..1360; Strand=-; Gene=SeqID_51770
taagcgtggctgaacaaacaagcatataaattcaatggtcgtaaaccaattagcactaattgcttctttaatttccgctttgcctgaatgagtatttcctgcgccggcctcgtctcctctctgttggtgaacatcgccagcatattgctaactacctaacaaaaacatttttagtccagaagccaatttattaattatttatctctaccatttgtcgaggctgtgcacgcaaaaccaaattggctttctctgggcagccaaaagtgaaaattcgcaaaagtctttggccaaaattttgttgagacatttgttcgaagttcatagacctaaaaaacatgaatagccaaaaaagacataggtgtgcaaatgtctgctttttcagttttccactctgccgttcccatgtttttttttagtacctgactctaaaaattaacacgttatttattcaaacgctaatttgtaagcatttcagagctattgtatttcaatttcaattctttttattccaattttccgcactttagcaaatgccaaaatcgaagcgcgacttagttggtcagcaatttattattcttcagccaaatttgtccataattttcttcaatttgttttttccttcagtttctctcacaaaagtgaagaagaagagccgcgagggcaaagaaaacattttgaaagaggcgggaaaaaaatttgtttttttttgaaaattccaacaaaaattttaggtcagagaatg

SEQ ID NO: 105163 - DNA, 119 bp, Heterodera glycines
  Promoter: Source sequence=SeqID_11747; Location=486..604; Strand=+; Gene=SeqID_75238
tatttggaataaaataaacgaggcattaagaagacaattaacacaaacaattaaattctttaaaaatttaaaagtattttaatttcctaaagctatgatttattttatgcacaaaaatg

SEQ ID NO: 105164 - DNA, 388 bp, Heterodera glycines
  Promoter: Source sequence=SeqID_146; Location=4537..4924; Strand=-; Gene=SeqID_74915
tggcaaagtgcgggaccagcttcgcaccggatgttggccggtaacaataaggaaatcatcattgtaaaccgtggtggcccacaatgttcaaaggaaagttcatcgtgctacaatcccaagaaggggtaggacaagttgaaaacaatcccgtgatgggcaggacatgttgaccacagtcccatgaagggcaggcaacgtttaccacaaatgtgacagatgcccgaagggccagtcagtgaatcgcaaatggtgcgacgcatgccctgaagggccagtcagcgaaccgcaatggtgcgacatatgccctaaagagccagtcagcgaaccgctttggtgcgacacatgctcagaagggccagtcagcgaaccgcaaatggtgcgacacatg

SEQ ID NO: 105165 - DNA, 55 bp, Heterodera glycines
  Promoter: Source sequence=SeqID_3583; Location=8542..8596; Strand=-; Gene=SeqID_50960
cctcaaacttgggtaattaaaccgaaggggaaatggggggacggcacaaaaaatg

SEQ ID NO: 105166 - DNA, 819 bp, Heterodera glycines
  Promoter: Source sequence=SeqID_1665; Location=709..1527; Strand=-; Gene=SeqID_75185
tatttgctataattactagtaatgactggtcgagagtctcgagtgggaaatttgggtctttttttttgggggggggggggaaggcataattaaagaactataatattgtctatagttctgagccagtttcgtgatttatctgttatttctcaaaactaaagccaaatattgttttaaaatcttataaataattatttaaatttttaaagaaatggtaaatttatattccataagtttgaaaaattaatgaactcacatgaccaataaatttaaggaataattaatgaaaatgtgtaaataattcttgcagcaatttactatattatgaattaatgaccctaataaattcaaaaaaccgccaaattaatccgtcaaatctccgcccccgcccaaattttgtcaatatgccgcactgttatacatcttcaaaatttaaaatttgcaaggcaaagatttaaaattatattggaaaattatgaagaagcaatagtaaaattgatggaaaaagtaaaaaattttacttttttttattttttaaatttaattaattttcaatttttaattcattgcatttttgcggtgattattcatcaaattctgctgaatcatcttctatctatccatttcatttttttcacatagtgatcgacagaaaacgaattttaaaaatgttaaatcatttcaataatatgacaaaattagtaaaaaaacaattaattgaattaattattctattgtaaataaaataaaattaaaataaaataatttatatttaaatttaaataatttttccatgtttttagaagagtgaacaaaatg

SEQ ID NO: 105167 - DNA, 971 bp, Heterodera glycines
  Promoter: Source sequence=SeqID_20114; Location=1..971; Strand=+; Gene=SeqID_84905
aaaatagttaactaaaatagtgagtaaaaatcccaaaatagtgaagaaatagtgacaaaaagtgtgaaatagtgacgaatagtgacatgattacagccaaaaaattgaacaaaacattttttaactagtgagttgccaatgaggtaacatttcctttataaaattctcttagcaaatatttaactttttaaatcaaaaattttgtcaagaaaaaattttgggggaagaatttttgagaaaattttttcatttcgtaggagtgtatttttaaaaaattttcggtcgattcataggggtgtatttttctgaattttttgtagtcgattcttaggggtgtatttttcgtttttattacatttttcttaaggatattttccaaaaaatgtcaaaatagtgaaaaatttaaatttaaaaatagaatatatgagcaatttaagaataatgagcaatttataaattcaaaaaaaaacagcaaaagctatgggtttaaataaaaaaaatacttttaaaaaaataaaaactaaataaccaaataaaaatatatttgaattgcaataaacataactaataaatgccaatttaacagaacagatccaccatcaacgaagaatgtagctgcaaaaaccaccaagtggaagggtttgggacaagaatttaattgtaaaataatttcagataatttaatagaaaataaatcctaaaaaaaataaaatttccgccctttcctccgcaggtccgccgtccttttcgcctggcccttcgtccgtttccgctcgtccgttgtcgcccgccgctcgtccgtcgtcgtccgccgctggtccgtcgtcgtccgccgctcttccgtcgtcgttccgctacgaccagagctcatgggcaacgcccgtctggaccggttgataagaaatgaaattgtaattttgtttctcaaaaagcttttaaacagattaaattttcaaatgataccaacaatg

SEQ ID NO: 105168 - DNA, 565 bp, Heterodera glycines
  Promoter: Source sequence=SeqID_12811; Location=1..565; Strand=+; Gene=SeqID_76536
atttttgcatattaaaattaataaaaacaaaataagtacatcaatttaatttaatttaaattagaatttatttttttatagaagaaaactgcaaacgaaatttatatcgtggcaaaagcaaatacctatggtaaaataaaaaagtgacttttgaaataacacaaaatttttaaatgccgaaacgcgacgcgcaactgcctttgaaaaataaataaataaattaaaaaaatcataataaaaaaatacaattcattctatcatttttcatttatttttgtaacattagaaaaagtattattatattccacataataatgaaagcttttgaacaaaaatatctttcgcaattccattcttttgtgttgtaaatcaaaagctttcaaaaagcgtttagtatataaagcgctaaaattacaccaaaatcaacaaaaagaataaataaataaaatgcttttttcaatttttctaatttgcttaaaaagagaaactattttttatataattaatactagcaaaaaaaaaaatcatttattcgaaattccaaattttgaaatttaagaaaatg

SEQ ID NO: 105169 - DNA, 817 bp, Heterodera glycines
  Promoter: Source sequence=SeqID_10856; Location=2148..2964; Strand=-; Gene=SeqID_74136
gctcacgacagtttccagatatacaaggtgccgtggaacaagttgctgctcaacctccgcatcaaaataaggtgcaaaacaataccaacaaaacatcaaaaaactatttcaaggtggcatcaaataaaaaacaattttttaatttcctccataattttttaatcgaattaagaaacaaaaaacacagaaaaatccggaaagttaaggtgctaggtatgcttcatacaagccatattggttataattagggtaggccgagcccggttccgagcaggccctgacccggtgccaggctttttgatcaaggcacggtttagaaatttctacccggaaccgagcccggttttctgtacccggtaatacccgggcctgatttttgcctaaatacccaggcctggcctaacctagttgtaatccgaacaataattagtttttaattcaaaaatcagatttgaataaatgaaaatttttccttgaattctaatgaccaaatttagtgaggttctaggccatagaaggggcccatactgttgctataatttttgaatttatgataatttatttttaacaattttggtgtcatgacaaatcgtacactgctgtacaaattcgtacaaaattgcttaggttaggcctaggatttaggcttaggcttaggcctaagctttaagctaggccaggcttaggcttgctcgggtctaggcttaggctttattttgtctaatataagttgactttttgtacgagttgccataaaaatttttttctgttttttattttgctttgcttaaatacgccccctcagccaagcaaaatg

SEQ ID NO: 105170 - DNA, 429 bp, Heterodera glycines
  Promoter: Source sequence=SeqID_15545; Location=3336..3764; Strand=-; Gene=SeqID_47302
tcgacaattttgtttttaatttgatcatctcatttcacatttgcacttttttttattgtcaatcatatatacatatatatatattacatacacatgtgcaaggggtgtctcacaagggaaccacccaaactgtaagtcggaaaatgcatccatataaatttgatacaatttttttcattacgggtggtagtttaggatttccgtaattgaaaccaagctacgtccaatcccgttgcacatgtatgatcagatcaatcatccaaaggaattgcaaaattttaacgcttttaaagtttcttcataccaatgcttcgtacaattttattggttttcattctacattttatatttatataataattatctcgattactgaaacgatacactgataaatttccatacataatttagcttttagttcgtaaaatg

SEQ ID NO: 105171 - DNA, 199 bp, Heterodera glycines
  Promoter: Source sequence=SeqID_15346; Location=1386..1584; Strand=+; Gene=SeqID_79602
aaatcatttggtttattaaacggcatttttgcacctgttcgtcctcagtttgagcactacgcggctcagcggcactttctggcgtgtgtcgaacagaaaaatggagcgatctgcggcacatccggccataatgccttcctctatggggttgcagttaatatgctgcacagtgttgggcccaacagcgtaatggcgaatg

SEQ ID NO: 105172 - DNA, 766 bp, Heterodera glycines
  Promoter: Source sequence=SeqID_39948; Location=1..766; Strand=+; Gene=SeqID_68398
aaagtgccgtcgctcaacgctcttgtattttcaacgattgcaatttcaattggtgaaaatggataaagggaataaggaggggagtaggattagggagtaattaagtctggtataaggaacaattagcggggagttaagggggggcggcacaaggcaattgatttgttgcagtatctccaaatgaccataattgatattaattgccttagttattccttttgcgctgcgagttctgtgattctttttagagggtaaattagtctgaggattggaattggcagaattgtactttcatttgtgtcttcaatgaattaaggaattaattgttttttgttttaaggtatacgttgatctggtttccgcggaatagtcccaataaatctcggggccggagggggggggggggtcggggagcaactctacgtaaaattccaaaacagagatagcagttggggaccgtactttctatattcttacagtacatatctaataaaaaatataaaaaaattacatttttcgaaactcaaatttttgcatgaatagaatttgttaccatgttttggagttttaagttgcttttttcaaaaataataaaggatgttgtggtccagctagtccgaatgcgcctcggggaacttttttttaatttggctcaatttacaaaacattttctccaagaaacacgaaattttcttaagtaattattttttcgtgaatgactgctgttgtcccatgttatgtccctgctggacattgattggccatg

SEQ ID NO: 105173 - DNA, 1003 bp, Heterodera glycines
  misc_feature (546)..(546): n is a, c, g, or t
  Promoter: Source sequence=SeqID_17849; Location=1333..2335; Strand=-; Gene=SeqID_82382
cgtcaaaactgcataaatctgtgcttttatatatgttatcatcatatgattttgtcgatgattttttaaatcgtataattaagggaactaaaagcatttgagagagtaatctattcctgtcgacgagtggaatagattggtactagtttcagggttctagcccaacaaattttatgctggggtggggcggaccacttttcaaataaagccggtgattagcattttggccaaaactaaaccgcacactcacgccgctcgcttgctcgggcgcccaccttattgacattctgtctgttgttagctgataaatgagtcaattataaattcttaagtgcctccagaaatttttttttcaattttaaatagctttttcttatacattatgtacataattaattcataaatattttatttactatgctaaattatttttattatttaatgatctcaatttatccattccatttatttgctaacactttttccaaacgattggtcgtcggccacaaaaaaaatgaataattattgtacggaatattaaacganaattgtccaattggtccattcccatccatcggaaatggcattccatcagttgttttaacgatgattcggcttcctatttttcgctttttcccttttttcatcgcttttgctcaatttgccaacgcttttcccagcgattggacaaaaattgtgcttggggagtgtaaatttgtggtgatttggcgcccccttcagctgctttcccattttttctactccttttttgtctgtccataaataggcaccgaaaagccacccaaatcacacattttccattcaaatcacagctaatccatcctttcattcaatcatcaatcagttgaaccttccttgcacccttcatccatcccatcactctgcccttcatccaatcaaaaacggtaaattaaagaattagtataaaatgtaatttttaaaaaattaatttaaaaaaagcaaaaaagaacttcacaaaatg

SEQ ID NO: 105174 - DNA, 467 bp, Heterodera glycines
  Promoter: Source sequence=SeqID_2052; Location=6251..6717; Strand=-; Gene=SeqID_77528
ggttggttcgttcacactttgtcagttaaccaccaattttaacagattgttttgtggcagctttcggttttaggaagttaaattatgaaaatcatttatttcctaaaagatgacaaagatgggacattttctgtataaaaaagaggaaggaaaaatataaaatcggaacccattgaatatgtatctgccattttttgggccaattgtccgttaccaattgtctaattgatcatttttctccatttttaacagtgtaaagcacaaaattgtaaggcaaccaaaaatggtggtgtatttgcgcaacgaattgaccagcagctgacaaaacaagcggaggagaagcgaccgttacgatcaaatgaagaggagagcgacgactacggtagaaacccaaagaaaaaagattcgttttaataaaaaaaaaattaaaaaaaggaaaaacttcacaaaaacaacaaaaacacatg

SEQ ID NO: 105175 - DNA, 120 bp, Heterodera glycines
  Promoter: Source sequence=SeqID_31723; Location=759..878; Strand=-; Gene=SeqID_62034
tgtcatctcaaatcattctatcaccaagttttgcgccaaattttgtagcttttttccttttttttaaatttctgtaattctgtttaatttgagtttttgtcctgatctgcttcaacaatg

SEQ ID NO: 105176 - DNA, 456 bp, Heterodera glycines
  Promoter: Source sequence=SeqID_25124; Location=1346..1801; Strand=-; Gene=SeqID_55853
caggtccatgccgagttggagcagatcaatgaagaggcggttgcaagcgtggcccatcccaaattgagcatgcgtgccatgttctgtcccccgttgttgtggcccctcgtgttggcagtgttcatgatgttgtcccagcagtgaaccggaatcaacgcaggtgtgctttttatttaattgactaattaattaatggaaagttggtgttgacttacaaatttttttttgaataaagaagccaaaagaaaattttacagaacttgacacaaatactacccgatcggttgtgttttgatcaagccttatcttaatttttcaaaacttgacgaaaacctatccgatcggattgtttgatcaaacctatattaaaaattgtaattgatccccattattttattaaaaaattgtatttaatcgtctcagtataaattacatttttcttttttttcagctatg

SEQ ID NO: 105177 - DNA, 190 bp, Heterodera glycines
  Promoter: Source sequence=SeqID_20030; Location=1928..2117; Strand=-; Gene=SeqID_84804
gaggcaggggggggggggggggtgaggagaggaactggtcaacaaatgggtctccggatagtgtggaaggtaggtgatctgctgtcaaattggagagatccaataaagtggcggggggggggggattttgggggggaaggcacccccttttcgccactttctccaatccgttgcttattgccagcgaatg

SEQ ID NO: 105178 - DNA, 258 bp, Heterodera glycines
  Promoter: Source sequence=SeqID_638; Location=3490..3747; Strand=-; Gene=SeqID_57911
aaatttaaaaatttaggagccaaatttaaaggctttctcccccccccccttaatttggcagaatgtgatcagaagtgccgaggagacgcaaatgttgatcgcggaacgggcgcgtctctccgagcaggaggccattgagcaggcacgacgtgccagcgaagccgaggcggaagcgcaacgcgcaaaactatcccagctgagggtttgtggggttgtgccatttcaggcgcaattcgcttgccaatgttgaaaaatatg

SEQ ID NO: 105179 - DNA, 232 bp, Heterodera glycines
  Promoter: Source sequence=SeqID_19881; Location=733..964; Strand=-; Gene=SeqID_47614
agtgtgaattttaaaaaattgtttttttgaaaaacatggctaaccttttttgtatttttttccgtccgttcgtccattatttcactttgttccccaggaatccgactttgttgagcaacagatgcgctctcaggaagtgtttctgcttcgggcgcgggaccggcaccgggagaagctgtgcctgctggagaagcagttcctggagcagaagcaccagctggagcgcagcatg

SEQ ID NO: 105180 - DNA, 241 bp, Heterodera glycines
  Promoter: Source sequence=SeqID_15954; Location=598..838; Strand=-; Gene=SeqID_80305
ggtgggttacacgcgatttgtactcagttgggcgccggaggctttccccgggttaaccgggttaacgctattggaatatatattttttcattttgaatagatttcggacattggctaccatacgtcggacgcataccgtactccggagcttggccatcgtcaaacccaacaaaattttggcggcggtgccaacactaacaacatcaataatatcaccgatgagtcaccgcctgagtcgatg

SEQ ID NO: 105181 - DNA, 216 bp, Heterodera glycines
  Promoter: Source sequence=SeqID_428; Location=1..216; Strand=+; Gene =SeqID_52358
gtttccggcaccggtgcgccgcgagcggcggggacgaacgtgcggagcgcaaggtgcgcgggctggagctcacctacaccgccagccaactgctcccgttcgagcgcatgcgtcagctggtgctcaacttcttcggccggtgagcacgagggggtgggtgggataacaatggaatgtgtgtgtgtgtgtgtgtgtatgctacccccgatcaggatg

SEQ ID NO: 105182 - DNA, 101 bp, Heterodera glycines
  Promoter: Source sequence=SeqID_14919; Location=3693..3793; Strand=-; Gene=SeqID_79083
tttcaatgattactttattgattgatcgattattgatgggattaattgcttgacaatcgattggttacgaaaaatcattgacgcaacttccagaaacaatg

SEQ ID NO: 105183 - DNA, 145 bp, Heterodera glycines
  Promoter: Source sequence=SeqID_19164; Location=1877..2021; Strand=-; Gene=SeqID_47565
tagtgaaaacggaaataatgtatataaaaggagcgcatttgcagtgtttgctcacataattcattgcccacatattattgttattatatattgctcatcgtctgcaactttaatcccacgaagcgacgtgcccggcgcaacaatg

SEQ ID NO: 105184 - DNA, 296 bp, Heterodera glycines
  Promoter: Source sequence=SeqID_11; Location=10227..10522; Strand=+; Gene=SeqID_69061
agatatgtctgaacatattgaaaggaaaacttccaataaggcgaaagtcgcatttgcgtaaattgggcgcaataaagcattggttaagaggtctgtcacgcactagatgcgcaaaaagcgcaagaagaatattgttaaatgctccgtcacaagtcgggtctggagctcctgctattgcgggactattagcaagtattttggtgccaatgttgatagaaaacataataaataaataaacgattaattgaaataagaatgagtaattaataataataataataatgcggcacacaatg

SEQ ID NO: 105185 - DNA, 57 bp, Heterodera glycines
  misc_feature (40)..(40): n is a, c, g, or t
  Promoter: Source sequence=SeqID_33728; Location=948..1004; Strand=-; Gene=SeqID_63703
aagaatgttcgacttttgtatcaagaaaatctcggaattnatgtgagggaatcgatg

SEQ ID NO: 105186 - DNA, 352 bp, Heterodera glycines
  Promoter: Source sequence=SeqID_29273; Location=931..1282; Strand=-; Gene=SeqID_59798
aaaaattaaggaagcaaaagttttttagttatttgaaccattaatccagttgtttgatttaatgatgtttttttctaaattcatgacgatcaaattatcagacacaatcactttctaccacttatataaagttgtttaggcgatcaggtattgaaaaaacttagttttgaatccgattttggacaaaagagcaaatgtcgggacacgccattgccggatagtacatagtaccaccattttttgttcaattttcttaatttttgctaatatgtcatccccaaaatccgaaatttagtcatttgaaatcaaatttatttacctatcttttccaatgaatttccttctgtccatg

SEQ ID NO: 105187 - DNA, 73 bp, Heterodera glycines
  Promoter: Source sequence=SeqID_32865; Location=1..73; Strand=+; Gene= SeqID_63106
aataattaattactaattacgtcttcactcccatttctttatcatttttgatcattctttgctattttagatg

SEQ ID NO: 105188 - DNA, 475 bp, Heterodera glycines
  misc_feature (9)..(9): n is a, c, g, or t
  Promoter: Source sequence=SeqID_13364; Location=1..475; Strand=+; Gene=SeqID_77238
ccccccccncccccctcgagggagtatcgaaaaatagccgtcccggggcagttattataggaaaaacggtagaaagaatttattggtccaaaagcgagcgagtacagtggaccatgcttgggtgtataaatctaatttccataagataaccgtttcgggataaaagtgcatgaaaaaatgtgccctgccactcgcttagcccattttggcattgatcactgccaacttttttggcattgccactacctattgaaattttatgcctgatgaaaatgtatagaaaaatgtgcccgccctgccactccctcacttaacccattttagcgtgatcgctacaaaattggatttttatgtttggcgaaaagtgcatagcaaattcattcaaaatattcattcatttttattcacaaattaaatcaaaactctctcattagaaaagactgcttctagtgaaaaagaattttttttcaaaatg

SEQ ID NO: 105189 - DNA, 694 bp, Heterodera glycines
  Promoter: Source sequence=SeqID_22109; Location=1..694; Strand=+; Gene=SeqID_52761
gaaaaaaataaggacaatttacaaaagtcggtgaattttagaatggcatggcaacggaaaaagggaacactaaaaacaaatggtattttgattttaatatttttcaacaatttatttgcccctaaattacccattttaattcgctttgtctgtttgatcagtgatcagggtcttctgccgtcgttcacttgccaatgccaaaatgatggtcgttttcttcctctgctaccgcttctgtaacccttcgaatgtgtcgagaccagtaattaagtgccccccgccctcggggcattcataaccattccaagtaaatccccccacccccccccctaccgtaccctttccttctctccccatttgctcatccatcttccttcttctctcttgtgtaaatattatttgtgggctccaatgcgactgacaacgagcggactgtgcgttggtcgttctgtgacattcgaattgcacttggacaattagtccatttttgttaattggcactttcactagtgacgcaaatgaaaatgatcactaataacttgcgagaattcataaggcaaacaaacaaagaaagggagaacgaatttagcatttccatcggaaaactatcaaaatcaaaaggaatacataaatttgtaactcatattaattaatctttggcttgcaatgaatagtggacaatcggcccaaaatg

SEQ ID NO: 105190 - DNA, 231 bp, Heterodera glycines
  Promoter: Source sequence=SeqID_19405; Location=1..231; Strand=+; Gene=SeqID_84132
ctcggtgtgcgcaatgccaacgtttctatgcccgtactcgaattgctcggtgattttttgtacaaatgaccattgattgcattattttaaacaaaaatgctcgtgaatcggttaaggtctttctggtcttctcccagtgcatccacgaacctttctccgggcgcgaatgaaccgattgaatggtaaatgccaatggatgcttactgggataaattttcataattaaaaatg

SEQ ID NO: 105191 - DNA, 155 bp, Heterodera glycines
  Promoter: Source sequence=SeqID_4898; Location=1441..1595; Strand=+; Gene=SeqID_56138
ttctccgctctctccgattgattcttcccctctctctcccccccccccactttttctaattgctttattcactcataattttccctcatttattctcttatattttcccaatttccccctcccctttttcttttatttaaatcgttctgagaatg

SEQ ID NO: 105192 - DNA, 109 bp, Heterodera glycines
  Promoter: Source sequence=SeqID_18300; Location=1..109; Strand=+; Gene=SeqID_82887
atttttaaatttgtagatttcgtcagcagtgccatcgcgaacccaaagaccatagggaagaaaaggcgaaaaacgaacattttgtggcggcgaataatcggagcaaatg

SEQ ID NO: 105193 - DNA, 452 bp, Heterodera glycines
  Promoter: Source sequence=SeqID_25445; Location=566..1017; Strand=+; Gene=SeqID_56180
ttgtgcataaaggattgtatttgacgcattctcggaaaaaaagggaaaagcctttcaagtaagaaaaaaaatggaccccttgaagagtcgtggctagagacaggcatggttaattattcggtctctaatttaggttgttttaccgaaaaacagaccaaaaatttggaataatttaatgttaaattctgaaaatttgtaaatttggcgattttactgcaataaatcttgcagagataaataacattgaataatatttaatattttaattaattctttcggcaaaaaatatcataaaatttcattttttatagtgttttgatttaatcaggtgaaaaaactaaaaattggattaaaagaaaaatgagtttatttttgggggggtggttcatattttttaccgaaacatttgaaaatagctgtaatttagatgcattctgaagagcataacaatg

SEQ ID NO: 105194 - DNA, 1003 bp, Heterodera glycines
  Promoter: Source sequence=SeqID_2367; Location=4042..5044; Strand=-; Gene=SeqID_79354
cacagcaaaatgtgttttaaattcattttaattggctaataattttcgctaattagttttatttcaattgtaaaaccaatgaatgcttttctcattttttgcaaatttttaaaagtcaaagaattccatcattaaaacagacaataaagccaataaattttgtgtttatgtttaaaaatgatattttaaatgatgctttcactgtttaaaattgattttgcgagtgctaaattaaaattaaattaaaatcaacataatttcaaatttaaattttcctctttttccccaattttgttttgtttgttttgttcgtcgccctcccctgatcgatcattaatttcggttgggttgtcacaaacactgatcgcccgctccacccacccattgactttgtttgactctccgtccgatcacagcccccccccctttttatcacttatcaccgccaatcgccgtcctttcattcgttcgtccgttgatgatgctccatgtcattcattatttaatgcgttttattaattagtgcttgctaattacttctaattatctaatcccctttctttgttttgtcactcccctctctttgtttttcatttttaattaattaattaattttgtttatttattttttgctttttgaattttttgttcaattagtgcctaaatgttatgtcttcttcgtcctcgtcaacaaattgcagcgtcatcagcagcccatttaagctgaatccgtacaataacaatggcaacgacaacaataacaatagttttcaacaggtaataacaagaaaaaaatcccatttgggtgcaagtttaatgaggctaattaattaatatttgtgaaattaatgggcaatttattcattagaattaatacgtgttaacaaaatttaatcatgcttttaactcaaatattattatatgttacttatattcccaaaattaaattgccgttttaaactacgatacattacggtagcatgagtacgcgtccggatggatg

SEQ ID NO: 105195 - DNA, 1003 bp, Heterodera glycines
  Promoter: Source sequence=SeqID_1800; Location=3949..4951; Strand=-; Gene=SeqID_76030
gttttttaactatattaaattatcgtgatttactcaaaattggaactcagatttttaaaattttttttcttgcggcacatttttcaaaaaaaaacttgatgaatgtgcgaggggagagttccggcggtgccgataggcgccgccgggaaaattttttgaatttgaatgcaatttgttaacaaattagccaaatttttcagaaatttgcgagttttagatgaaaataaggcattacccccaaatcagaacatttcttagaaacaagaacataaagaaaccctgtattaatcagaaaaaataaattaattaaaggaaaacgttagccggaatcgaactcagacaaaagtactgttagtattgaagcactatccaccaatccacaaataaaataaaaaacaagtaaaatttattttatttcataaaaatttctcgatagttaaaaaattacaaaattgtctaaattttttgccttatttcccacgaatatgccattcttaggggtgtattttcacccccgtgcccccgcgggggtgaaggtcgcgggggcgggggttgcgggggtcagagtcacgggggcgggggcgggggtgagcccaaaaaacctgtcctgcccccgggggcgggggcgggggcggggctcgaaccctatttaaaactattaatcggtgactcaaggagctgaaacagcaatgattatgatcaattatttaaatataaaaagaaatttggaatgatcacacacttattaaaattaataaaaaatattttaaatcttcaaaattagaacaataaaaagcattaactatttaaataaatatttttataataaatagcaaaaacccaaaaataatataatgttttttatagcagtcggacaataagctattagaaaaaatgaaaagtcataaaataatattttttggttttctatgtgcttttgtaaattgtgttaggaaaacaatgctttgagatcgtcttattgaccgatcgtgacctgaaaatg

SEQ ID NO: 105196 - DNA, 883 bp, Heterodera glycines
  Promoter: Source sequence=SeqID_37291; Location=311..1193; Strand=+; Gene=SeqID_66396
aaaattttaatattaattttttttctttgtttttgaagtctcctggatgctgcttccgccaatccgagtggtgatcactgatcagaaacagtaaaaaacgaattgattgattgtcagatacgattatgagaccgaaattgttggactttgtcatttaaatatagttgtacaatatttgctttttttgcacatgaatttataaaacgatataggattcggctaaactttgtatagtcaacccccagaaaaaatcgattagcacttgcaaatttaatgtttttcattttgttgcgaagtgaataggttttttaaatcattaaaatgaagagatagtacgtcaaactgagagaaataacagaaaaaaggaatcgacgagataatagtactaggcttttttctgcccagtgggtggacccatatttattgttcttgcttagaccttgtttgtttgtacatttgtagctttgcttttaattgactacaataaaaatgtgtgttgccatggcttattaatatggaacggatttttaaggggcgaaaaattccaaaataagggcgaaaaaatcgcaaagtaagggcgaaaataaggtcgaaacgccaaaataagggcaaaaacttattttaagggcgaacatctaaaataaggatttctaaggtcgaataagggcgttaaaccgcaaaattttcgaacaaaaaatatgtttttcgtgcttttctcgtcgagttaaagccgcagaaaaaataaggaaaaacttaaaaatccgttccccacttattaattgattaaaattttgtttttcattcaatagtttttccatttttatccacttaaaatatttatttgtaattaaaattggtttaagccattttcacccaaaatatg

SEQ ID NO: 105197 - DNA, 484 bp, Heterodera glycines
  Promoter: Source sequence=SeqID_1512; Location=5737..6220; Strand=+; Gene=SeqID_74105
gtgtatatattttttggattttaccgggttttttcactttcagcacactaaaaataaatatgaagaattttgcaaccttttttgtttttgttcagtgatcttttgccttctttttagctcacccattgtcattttcccaatgaaaaaacaattagcctaccgaacagggccaagtgctgttaaatcgcataaaacaaaaaaggtagaattttttgtttttttttgttttttcaaagttcctatattaaagccgccttgtgagcataggcattggacccaaatcaaattagaaagtgaagatcatcttctgtatgatctgatgtacgatgggaaaacttgcgaattcacccacattgaacgcacttcctattcacacacttgcaaacgatgccgatcctatcataaattttgccttgttcgatactccgttctttctgatctgatcaccccctggcagccacgcctataaaagcacaaaaaaatg

SEQ ID NO: 105198 - DNA, 889 bp, Heterodera glycines
  Promoter: Source sequence=SeqID_11215; Location=490..1378; Strand=+; Gene=SeqID_74574
gggatgcgacttttagtgacgaaaaatcccaaaatagttaactaaaatagtgagtaaaaatgccaaaatagtgagaaaatagtgtcaaaaagtccgaaatagtgacgaatagtgacaaattttcagccaaaaattgagcaaaaataatttttattcactatgcagttgcaaatgagtaggactgggatttttgagggcaaaaaatacaaaataggttcctaaaaaataatttttagaattaaaaatttttgcaaagaaagtgaattttgtgaaaaatttttcatttcttaggagtgatttttgaaaatttttatgtcgattcttaggggtgtattttttgaaaaaaaattttaggtcgattcttaggggtgtattttttggttttattgcgtttttgttaaggaattttccaaaaaatgttgaaatagtgaaaaaatagtgacaaaacgccaaaatagtgatttttaactattttagtgacgaagtcgccaaaatagtgatttctagtgacgaaaagtgacgtccaaatgaaaaaattttaacgcagaaatgcgctttttgagctcctttcttcaaatcaattgagcaaaaaatttagttaaaacctaaaaatcgcatccctactgatgatgatggtgatgtagagctggatggagtcggagatgacgatgaatttttcatttgttagcactttcaatgtcgattttgtttgtttttttgaaaaaaattgacggcatataattttcagaaaattttatttatccccatgggggataaatggagactgggggattatttttcaaacccttcctagactgggggataattggagattgagggattaatggagattgggggataattagagcaaatacggtaggtcgaaatg

SEQ ID NO: 105199 - DNA, 476 bp, Heterodera glycines
  Promoter: Source sequence=SeqID_22293; Location=1939..2414; Strand=-; Gene=SeqID_52966
aaatatgtataaaaatatgtacatttgtaatatgtagaaaaacccgaaatatgtaaaaatatgtaaataaaagtcccaacttttgttctcaaacacaaaaaaataaagtgtttttcctactatttagagcatggagaagccaggaaaaaatatctatttacataaaattgccagccctaataatagtagacgaaaaatatgatatttgatacagaagaaaatcaggacacttgggagctctgacttttctctttgcattttttttcattcaattatacctttttaacgtcgaatattagctgattaaaaatcttaatagcaaccattttacatataagcttgggtatgtgtaatgtttggcaggaaaagcgtgggttaaacgtggccaaatgcttttaaaagaaaatggaaaaaccatcttaaaattatcattttctttcacaaaataatattaatttcagccgttcacaaaaatg

SEQ ID NO: 105200 - DNA, 1003 bp, Heterodera glycines
  Promoter: Source sequence=SeqID_1612; Location=513..1515; Strand=+; Gene=SeqID_74835
ctgacaatcgctcatgtctatctcccaaacatcttgaaatgctacttatttgcaatgtgaatttcaataatgatttggttaatattgtttactttttggataaaattttacgattttacacccctaaatttgaggatttttagtgcctattttccatttttttattgcctattttgggggttttttagagcctaaagcctacctattttggcggtttttagtgcctataaatgtgagccctatatattaccatgcaaagtttcaccagctggtttaaagtttaaaaaaggtaaatttttaaaaaattaacacaattaaaatttttttgaatttggtagactatttaaagttgccaaatatacatataaaaaaaaatgcacataaatttttctaaattgagggtaattatccaaagtttcttcaaattcgtaaataagagttaaaaatctcgaaaatagctaattttacatgaaaaaaatacaaaataagctaaatttttaattttgaagaaaatttattaaaaagtaaaacttttcctttgaggactttttttcttaaatttctaatttttcattttcgaaaaataaaaaatttagttttttgaaaatttttggtccaattcggtcaaaaaggctgcttaatagagtgtgccatttaaataaaggatttttttagaaaatgccgaaatatccacttaaatcacgaaatatgcattcaaaaattcatgtattgtaaatttcgtcctataaggttcaaactaaattaaaaacattttttttgcccatttcatgggtattatggcgaaaagttataagcaataaattttctaaaaactctttttttgagtttttttctgccaataatttttttgaaaatgcacaaaattttttttgaaattttgaaggctaacagagagcatttagggttaccgaatgataacaaaaaattaaaatttggttacgctttttcatgggttttcagttttggctttccatagttcatg

SEQ ID NO: 105201 - DNA, 191 bp, Heterodera glycines
  Promoter: Source sequence=SeqID_11827; Location=350..540; Strand=-; Gene=SeqID_75329
tttggtatcggataaccaacagccccacatttggatattcgctatgccatttttgtttattcgtatttgtttcccaactctttccatgtttggttggcaaatatatgaagcattctttttcattacataaaattttcataatttttccatttcaattcccatatttcccgtttccttaggccttagctatg

SEQ ID NO: 105202 - DNA, 350 bp, Heterodera glycines
  Promoter: Source sequence=SeqID_9947; Location=1..350; Strand=+; Gene= SeqID_72993
ttaaatttcagtttacccatatttgtttatttttgcaaaattttaagccgtctcgccaaaaaaagttgcaatggattcccaaagacgcaaatgaccgccgcaactggaagttgtgcgtcactttaaaagcggtacggttgctttaacactccatgttgcattttgggtcaaattttgaaaattttaaggaaattttatcgtctactaatttttcgaaaaatgcacccattaaaattttgagatttttcattcggaggacccgcctataggcctgggctttcaatatttctctcttttgtcagattatcccttcgctctccccactttctgcgccttctccgcccccaatg

SEQ ID NO: 105203 - DNA, 562 bp, Heterodera glycines
  Promoter: Source sequence=SeqID_34319; Location=1..562; Strand=+; Gene=SeqID_64142
ctttcaatttgaaaaacgaaatttaaatttaattttttccttccaaattagcatattaattaacaaattaataaaataatacatcatcatatgttttgttctgctttgatagaaaaggttttgctcttgctgcttgtgtttctgcaatgctgcttcaccaacagttatggcagtatggcaattaaaaaatttttatttttaattatctaacaaaccctacggtggcccgagattgtgaattcaattttttgtacagtatccatgttttaaaattcaaaaacaaatcgcaacaagtcatttttagacatggttattccacacgttttggacttggtgtatttcgtgaagacaaaagtttttttaaattaggcctctctctattcggggttttcgcccctaaaaattttcactcctattaattacaagcaaaataatttgaaaaaaattcatgcaccgcgtacattcttccggaatttctcgttttcatattgttcattttttccaagaatatgattgttttgtgaccattcgtcaccgtagtggcacaccgccggacgaaatg

SEQ ID NO: 105204 - DNA, 214 bp, Heterodera glycines
  Promoter: Source sequence=SeqID_4183; Location=760..973; Strand=-; Gene=SeqID_53506
tcatcaattattcataaaaagataagactgcaggtcaagcggggatcgaacccccagacccccccccccccccccctcatctcatataacccctaaaagagatgaaagatgatcatttctcctttttttaatttcctgtcattccttcctgattaatttgtgtcttttctttcagttttcttttcataattgtcaatttttttaatcttcaatg

SEQ ID NO: 105205 - DNA, 178 bp, Heterodera glycines
  Promoter: Source sequence=SeqID_6; Location=7317..7494; Strand=+; Gene=SeqID_50787
cgtttgtttaacggatttgttcattttcacgggcaatgttagccttttggacaacatttggccaatgttccgcaattctatgtgtgcgatgattttgaataccatcgcttttcgtcgtttgcgtcaattggccccgtcacttctcaacgattgttcattcaattgaaccacaaaaatg

SEQ ID NO: 105206 - DNA, 595 bp, Heterodera glycines
  Promoter: Source sequence=SeqID_21379; Location=265..859; Strand=-; Gene=SeqID_51985
tttttggaggaattgtcaggagaaaaagtcaaagagagagagagagcgaacgaataataataataataataatgaaagtggcggaggaagagcaaccacttttatactaaattttgaagttatagcaatttaaaaatcacaaaaaacccgaaataggcaaaataggcattataaaagtcattgtagacatcccaaaccaagcggaaaatgcgttttttgtgcttatctttgcgtatcaagtgcgcaaaaatttaggcatttgcctaaaaaagaagccctaattattagattacatataactgtaaatatgcaaattgtgtaaaaataattttattatacattcatcatttgttttcttctctctttgttcaggtttttctccttgacaatgccttcaaaaattgtacgctttcacattttttacaaaagcataaaaataatattaaaatgtgtttttgcgattgttttacttaaatgtcccctctttttttttctttgattgcattgttttcatatgaatttttgagaaaagaaaaagcccactgaagtacaaaagtgccgaaattctgtcttaataattgccttcaacaaaatg

SEQ ID NO: 105207 - DNA, 1003 bp, Heterodera glycines
  Promoter: Source sequence=SeqID_315; Location=10672..11674; Strand=-; Gene=SeqID_81966
ttgataaacgtttatctgaacaggatcgcaattcattctcattctgtagcaccttttgacacttttttttggcatttttgactgttttatttgcttaaatcgctttttttgccgatcttcaaaaataacaataatttgtcaccatatttagaagatgtttttgagcattttgacgatctgtactcaaaattgctaaatttgccgtctgaaagcatggaaagaatgttaattgatgaacaattggacaaaaatttgaaaacaaatttggaattttgtattttatatgcaaatatcaaaaatataatgacttcaattaaagtaacagaaaatgagcaaaaaattatagaaaaagaacagaaggcctttgaagaactcttcagcgcaatttcatcttttagcaaaatttcccagtatgaaacttgcattctgtggcagttttggcgcggtttgggcaaattttttggtttgtgataaaaaacgcacgaaaaaaagttgtttgttttttttttgttgcggggttgtgttatgctacttttcgagttattagagccaattttataggttatttttagagcctaaaaggcctaaaaaattttgaaaaaaaactattttggcatttgcccaaaattattaggaaaatgcaataaaaacgaacaatacacaacttagaatgaccctaagattttcaaaaatacatcccaaagaaatgaaaaattttctcaaaaaattgatcgccaaaatctaatttttttatttgacaaaaaattttgattttaaaaattatttatctcaatattgatttggcttagttttgtagctttttgaataaatttgtcattttacacccctaaatttgagactttttagtgcctattttacatttttagtgcctattttgggggtttttagaacctaaaaatattagccctagtgataaaaaagcaaaaaataattttaaaaaattacataatttttgtttcttttttcagtggaaaataaaatg

SEQ ID NO: 105208 - DNA, 960 bp, Heterodera glycines
  misc_feature (696)..(696): n is a, c, g, or t
  Promoter: Source sequence=SeqID_24286; Location=1..960; Strand=+; Gene=SeqID_55005
atgaagtgtgtctgtccctctccctctctctaattttcgaacaaattttggggaagggaacaacaaatcactcctttttctctgttgttaattgtgttcggccgtttcagtctcttattagagggcacaattttttatttacatattttttcctcaaaagtttgacatttgattccgttgggttgaaatgtgtaagggaaagagattcaaatgtgaatgaataataacagagaaacagacatatggcggcacatttttgtgtttgtgtgcgttttattgttttagttttatgttggggaaccgcgttttttttttgtgattatgacaaacaaaacagaaactcagaggaactgaggtgaagaaaagactgatgagagtgacaaagaaagcgatcggaaacgaaaatcatgggaaggaagtgagagaaagtgagagaaagagaaatagagaaagagagagagacgagaagtgatatagagaggaagggcgaagagatgaagcgtgagagagagagagtgagagagatagagagaaagcgatcggtgagcagcacaaaagccgagcgctgaaaagaaaaaaccgctcttcaaacagttgatggaacagcagttcagcacagaagatgaaattgagtaatgctgatggtgacgctttttgaggaggagtgaaaataactgcaactaccgtattttctanatttaaaggccctcggggatttagggagtatacggtaatggttgtttttgagagaagtcatccgagaaggagggggacggacacattaggtcaattatttatgatagcatttacctaattggattacgttcccacccctccccccccttatcgtttcctctgctctaaaaatttttaaaaaacctaaagaatttttcaaaaaaaaatttaaaacattttttatgagattttaaaaaaaattcaataaaatcaatcaaataaatg

SEQ ID NO: 105209 - DNA, 689 bp, Heterodera glycines
  misc_feature (460)..(460): n is a, c, g, or t
  misc_feature (466)..(466): n is a, c, g, or t
  Promoter: Source sequence=SeqID_26440; Location=1..689; Strand=+; Gene=SeqID_57172
gttttcggggcagtccccctgaaccgatgcgcccagatttatggggagaccgaatccttccggaatagcttcactatagcctgtactttaattctgcgttggatttttgctccccataattgtttgagtaccccaaacggacacttgaaaaaatcgatttatttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcaatttttttgttttcggggcagtccccccgaaccgatgcgcccagatttatggggagaccgaatccttcgggaatagcttccctatagcctgtactttattctgcgttggatttttgctccccataaattgttgagtanccccanacggacacttgaaaaaatcgatttttttgttttgggggcagtcccccccgagcgatgcgccccagatttatggggagaccgaatccttccggaatagcttccctatagcctgtactttatttctgcgttggatttttgctccccataaatggttgagtaccccaaacggacacttgaaaaaatcgattttttatttcataaatatttttttcagaaagtcatg

SEQ ID NO: 105210 - DNA, 311 bp, Heterodera glycines
  misc_feature (11)..(11): n is a, c, g, or t
  misc_feature (35)..(35): n is a, c, g, or t
  Promoter: Source sequence=SeqID_30412; Location=1..311; Strand=+; Gene=SeqID_60820
cggaaaaatgngaatatcagatggggtgcgctctnttctaaaaattcctcttttcgtctaaccatccctccctattgtgcactatttcgtttcaaaattgaataattttttttggctttttgaaataaattgtgaaaaatatacgaaaattattttcggttttaattatgctgtacaatgcttttaagccccgccgtgcggcggctccccttttgtgcactattttagtttttaaaattggttccggactttttggctttttgaaataaattgtgaaaaatatacgaaaattattttagcttttaattatg

SEQ ID NO: 105211 - DNA, 1003 bp, Heterodera glycines
  Promoter: Source sequence=SeqID_20434; Location=839..1841; Strand=-; Gene=SeqID_50969
ttatttctctctctctcacttatcaattctcggcatttgcatttcatggacattttacgttttttggttttgatgcctttcattctgcagcattttttcgtaatgatcaccactaatttactaatttgttggttgcatttgctttaattggcaattaaaatagttatattgaaatgctcatccaactgagcttagtggagaattttgaaaataaaaatgaaaatatcagcctttaaacttaatccgtctctttttggcgggttctcactgatcagtgccgattccttaattctgttgcatattttccatttgcttaaatcaaatccatttaatttgaaaattaattggcaattttattagcaattcaaaattattcgtgtcttttataaaaatagtaattgcatcaatttccgattttggttggtttgatcagtcggtggtttgtgccgtggcggtgcttttgaaattgaatttgttggagaattggcatgacgaagaattgaattcaattttgttgcctaattagtcacttttttgcgttgccccccccccccctaattgatcgctttctttctctctctctctctcactttgttcatattctctctctttttttgttgttcgtttttattgcacatttgcaaacaattatcctcattatcccatatatattatttaatcattagtaatttcttgatcattaattgcctatcaatgatattttgtaattaaaaaatttctttctcttcctctattctctatgtttattttagttaattcgaaaaatattaaaaataaaaataaataattcatttaaattcaccccaccgataatttctgatcacctttcgttcatttgcttgactcattaataacattaatttcttttcataattgcttcctcgttcttttccttttaattttatgcaaaaaatttcacgagaaatgcgcaattttagtagcaaatttcttctttattcttcaattttgaagattttcaatg

SEQ ID NO: 105212 - DNA, 90 bp, Heterodera glycines
  Promoter: Source sequence=SeqID_43956; Location=666..755; Strand=-; Gene=SeqID_71515
ttagagttaaattttaactgaactgttaattattacctaattatgaacaaagtttttgtatgaaatgaacgaaacttgcagataaaaatg

SEQ ID NO: 105213 - DNA, 745 bp, Heterodera glycines
  misc_feature (25)..(25): n is a, c, g, or t
  misc_feature (53)..(53): n is a, c, g, or t
  misc_feature (61)..(61): n is a, c, g, or t
  misc_feature (76)..(76): n is a, c, g, or t
  misc_feature (91)..(91): n is a, c, g, or t
  misc_feature (109)..(110): n is a, c, g, or t
  Promoter: Source sequence=SeqID_23378; Location=1..745; Strand=+; Gene=SeqID_54087
caaatttagagtgtttaaatttttntggctaataaaatcctcccgtgattgtnttgtattnataatggtgaggaanttgctttattaagtngtgtttttatagggttgnnattagattgatttgataagtggtagaagttttagaagattttttttcattatgagtgtgaatgttggtggttattggttttctggaattatataagttttgataatttaaaaattttatgtaatgtaagatgattgatttgttttgccgagcaattatcgcaatttgtacaaatattggcgcagcgtcaaaaggaccgattttatattttacaaggtaggtaatctatagagtgcttgctcagctttcagcacaaaaaatcaccgattcagcactgtaaacagcaccaaattttcccaaaataatgattataaaaaacctccaaaataggtgctaaaatggtaatgagatacataattttaaaaaatcaaaatcttgtcaaaaaaataaatttaaaaaaacttaggagatgaattatttttgataaaatttttcatttcttaagggtgtatttttctgaaattttttgggtcgtttctcaggggtgtattttcgtttttattgcatttttgttaataaattttttgaaaattgctgaaaatattttcgaaaattcctcaaaatgacgaaacagcacaaaaaaagcaccaaaatgccaaatcagcacaaaaaccaaaaaatcgagaaatcagcatg

SEQ ID NO: 105214 - DNA, 173 bp, Heterodera glycines
  Promoter: Source sequence=SeqID_29588; Location=1172..1344; Strand=-; Gene=SeqID_60064
ggggatctctagagcttggacattgtggggacagtgaggagatttatgcggggggagaagcggcatttgcggaggagcaagcgaatgacttggccagtgtcacactgaacttccgttctggaagagtgtgcgattattttcgcgtgtacatttggatgctctggacggaaatg

SEQ ID NO: 105215 - DNA, 309 bp, Heterodera glycines
  Promoter: Source sequence=SeqID_43709; Location=194..502; Strand=-; Gene=SeqID_71315
tgcctcgaaaaaccaacgcgtcccttgattcataattaagggtgaccttttgacctctaaggattgaaaaaatcagcttttaggaaattccttagagaatttaataaaataacctctaaaattggaaatttatgccaaaaatgagattttcgatttactcaatttgaagcaaagagagaaaacgtgagcgttgcgtgttaatgcccttttatcaattaacttaactattgattctagaattgaaattcgttagtttaaacataaaattggagtttagacaatttttaaagtaataattgatttaaaatg

SEQ ID NO: 105216 - DNA, 471 bp, Heterodera glycines
  Promoter: Source sequence=SeqID_9862; Location=627..1097; Strand=-; Gene=SeqID_72890
agctaatcaccaacaatcgtccgcaatgacgttaaactagcctaagccatcaacaactgtccgaaacgctaatcacccggctgccacgagtccggaatgacgttaaactagcaaagcatcggccaacccacacaacaatcgtccgcaataacattaaactaaagaaccaaccaaacaacaaatgtccgcaaagacataaactagaaaagcaaacaaaacatgtccgcaatgacgttaaactagagaaacaaaccacgcaaagtccgcaatgacgttaaactagcaaagcatcaaatgtccgcaatgacgttaaactagagaaacaaaccacgcaaagtccgcaatgacgttaaactagcaaagcatcaattgtccgcaatgacgttaaactagcaaagcaccggccaccaaacaaccattgtccgaaaagacgctaaactagcaatccatccgacggtcagggccgaaatg

SEQ ID NO: 105217 - DNA, 80 bp, Heterodera glycines
  Promoter: Source sequence=SeqID_7512; Location=1363..1442; Strand=-; Gene=SeqID_65077
aatttaatgcatttagaattcgactgaaaagcaaaacgaaaccttttacttgagggcattttctccgcctttttcttatg

SEQ ID NO: 105218 - DNA, 277 bp, Heterodera glycines
  Promoter: Source sequence=SeqID_11936; Location=473..749; Strand=+; Gene=SeqID_75457
aaaaataaatgcttgaaccaaaatatgattttaagtatcaatactataaacaggttctgttttggttttataactcgctctatttacaaaaatagggcgcagaaaatgggttttttcttgaattttttactctaattagccaatttatgattttttaaatctcaaacattctaaaactttctaatcgaattatttaatttctaaaatcctggctggccctttcaataataaaaaatcaaattttacaaagtgggtatttcagtgcctagcgaagatg

SEQ ID NO: 105219 - DNA, 334 bp, Heterodera glycines
  Promoter: Source sequence=SeqID_2558; Location=1988..2321; Strand=-; Gene=SeqID_80408
tgccgaggatcattttgcttttgtcctattccattggctccacgggatttctctgccaatgaaagcaaatttacgtttcctttaccatatggtgtgctgttgaaatggaacttaaaaagacttaaataatttatatctggcgaactgtttaaatttaaaaaaatcgcaaatttttttatcgaaggaaaaaagacattaaagttaaacaaatttacctatgtatgtatatgtgttcacgcaattaaaagctataactaacttaaccctttatgtgcacttgtatgataatttcttatttgagctttttgtattaaaataattttgctaaaaaatg

SEQ ID NO: 105220 - DNA, 82 bp, Heterodera glycines
  Promoter: Source sequence=SeqID_5183; Location=5084..5165; Strand=-; Gene=SeqID_57188
ggtgcaccaaaattgatcatttttatgacactaaaaattgtcaaatttttttcaatttgtttcaggcaccaaatttgaaatg

SEQ ID NO: 105221 - DNA, 1003 bp, Heterodera glycines
  Promoter: Source sequence=SeqID_6828; Location=2433..3435; Strand=+; Gene=SeqID_63010
ggttaaaaattgtggcaaaataatgccaaaaattggcaagaaataaatagggaaatttggcacaaaaatgtgcaaaaatttggtaagaaataaatagggaaatttggcacaaaaatgtgtaaaaattggcaaaataaagggttaaaaatttgggcaaaacaatgccaaaaattggcaagaaataaattgggaaataagggggcaaaacaatgccaaaaaattgcggcaaaatggcacaaaaaactgtaccataataatgccaatctggcacataaataataaatggcaaaaagtaatgggtaaatgggtaaacaaatgccaaagaaggaaaaattaaggcataaataaatgataatggattattgattggcttttccttccgtaaagtgaattaaatgaaatgaaaatgaccaaatggacaaaaaatcaattaataaattgtttattgtctgaaggtgtcaaattacataatgggcatgcgggaaggagggcggcactacaaagtacgcgaccaattaaaaaaattgaattgtttatttggcaccgttccaataaccccgcccccttcataattgatttgtttatttgacccctcctcccgccttctcgccgcccgctctcgccccctgcccccgctggtgacgtcaatttttccctttatgagagcaaattaatgtttattgtccattgccaatgtggccgagtggttagtgcgtcagtctggccgcccccctggggttcggatccgcttggtgcggggaatttttggagaattttaaatgaatttaaattcaacgtctttgacctttaagacgtctaaaataatttaaaattaaataaatttaattaaaataatttgcataaagtcgcgcagtcaaaaaagtcgcgcacccccctgcaataggtttgggtttccaagaaaaagtcgcgcaataggttttggcttcagtactgaaaagtctggcgctcagatggcccgcgatcacttggcggcgctcaaatg

SEQ ID NO: 105222 - DNA, 118 bp, Heterodera glycines
  Promoter: Source sequence=SeqID_27583; Location=836..953; Strand=-; Gene=SeqID_58273
tgttttgcacaacggaatcaattattctaattaaattgaattctaattacccctcatttaaattaattgctgcctttctctccttcaggcaatctttgccgcttctgagtacacaatg

SEQ ID NO: 105223 - DNA, 358 bp, Heterodera glycines
  Promoter: Source sequence=SeqID_44857; Location=251..608; Strand=+; Gene=SeqID_46792
tttttgtatattcttaagaccgtgacgccccaaaaaatgcacaaattattccattcgattttaataagcctggtacagtggaaatggtctttcattttacacagaaaaacaattgtacgaaaaattgccggaagatttaacatcggtggcacttttggaggcggaggacatttccatcgaaagttgttccgttgcttacgttccgatcatcggatatttgcttatggtggcggaaagtacgcaaattccaacggacacaaaagcgctcgtggaaattgtaaaaaagcgcaaataaaaatgtttggagtatagaaatttaaaatccatcccttcacagattttttcttccgagggaatg

SEQ ID NO: 105224 - DNA, 243 bp, Heterodera glycines
  Promoter: Source sequence=SeqID_21626; Location=1582..1824; Strand=+; Gene=SeqID_52223
agaccaaaatttgtacttaaaaagcgacgagaacaatttgaaattgaagccccattaatttatgtggtgaattgcatggccagaatctcgagattttatttcaattcaaattgggccgagaattctgaatggaaattaaatgtatttttcaaatggggcaattttgacccaattttattgaatggggataaaatgaattatttttattttaatcgatcggcaaaattggacgacgacaaaatg

SEQ ID NO: 105225 - DNA, 449 bp, Heterodera glycines
  Promoter: Source sequence=SeqID_31; Location=3758..4206; Strand=+; Gene=SeqID_50792
gtgattcggcaagcgatcactcaccatttaactaatcgatcgatttttcactttaaaataaaattttaaaaatgtttgaaaataggatcgctcactcaaaaaatgggtcataaaaagtttaaaaaataggtataaatccagcaaataaaattctaagtaaggatttagagtaatttaaaaatgtgggtgggcgctcgcgctatataaataagtgcgcgtgtccccatcggcccatttcaatttattcctgtcaaacatttggccatcagtttttcatgtcggataaaaaagcattgtttaagcgtgttatcgcagaggtggacctcactataagcacgggcggcataactttgagcggcccccgcctgtctgttccccgtttcattccgtttgaggaaaacgggcgttgccgagcatgtaaaggaactgaggctgaggtggacacaatg

SEQ ID NO: 105226 - DNA, 621 bp, Heterodera glycines
  Promoter: Source sequence=SeqID_8701; Location=1654..2274; Strand=+; Gene=SeqID_68893
aattttattcattagcgattaacgggagaaaggattcaaaattgtgtggcattttattaaaaatgataaaccatgccatctatcacaccagtatttattgggtcgactcaagtgttcatagaccagtgatagattataaagtccatttcaagctgcagttacagattacacggcaatctttttaaatttatttataatttgcctcctgtttaattaataattttgaatttttcacgtaaattataatagagaggggtaggcacaataaaggtgccaatttataaatgtaaaatactttgaaaaaaatcaaaataaattcatcatttgtcgagcggatccgatcccatggcaaatggtcattaaaatggaagtgaaaattacaataacattaaactaatgtatctttgcttgtgtttttgtttgatctattttttcgggtgttttagtgaaggcgcgctgtcatttcgtcccgcgtcgtttcgtcccccaagccaaaatgagtcatttcgtccccaaatttctttttatttataaaatatttagtttttaaagtgttaccactaaaaatttttctgggtttagttaaacaaatcataaatttacgaatttagacgtatgatg

SEQ ID NO: 105227 - DNA, 300 bp, Heterodera glycines
  Promoter: Source sequence=SeqID_21659; Location=1..300; Strand=+; Gene=SeqID_52262
cattggccaatcccatcaaatcccatcaattgacaatgccattggctaatccaatcaaatcccatcaattgccaatgccattggccaatcccatcaaatcccattgctattggccaatcccatcaaatcccattgctattggccaatcccatcaaatgccaatgccattggccaatcccatcaaatctcatcaattgccaatgccattggccaatcccatcaaatcccattgctattggccaatcccatcaaatcccattgctattggccaatcccatcaaatcccatcaattgacaatg

SEQ ID NO: 105228 - DNA, 58 bp, Heterodera glycines
  Promoter: Source sequence=SeqID_6744; Location=2531..2588; Strand=-; Gene=SeqID_62717
aaaaaatgaattaaataataataataataataattttttcagaaattttttcataatg

SEQ ID NO: 105229 - DNA, 53 bp, Heterodera glycines
  Promoter: Source sequence=SeqID_20301; Location=2677..2729; Strand=-; Gene=SeqID_50809
gtcaataaacttttattattttttttataaaacttaaatattttgcagcgatg

SEQ ID NO: 105230 - DNA, 569 bp, Heterodera glycines
  Promoter: Source sequence=SeqID_18529; Location=1548..2116; Strand=-; Gene=SeqID_83157
agtaacgaaattgcattaccgtatatgctctaattatagcccatgggggattatttttcaacctcctcagaaaaggggggataattagagactgggggattatgatagagggattatttttcaaaacacctcgtagactgggggataattggagactgcgggattaatagagactgggctataattagagcatatacggtatttttggcagacttgtgtttgtttttaaaataaattttaatttttttaagggaattatttggcaaaaacttatctcaaatttcgattcttttaatttgtaaataaaaattccgtttttttttaacttccatcttcccattaagtgcaattaataaaattatgaaaaaaagcgaaggcaagtacaaatttgtaaaaaatgacttttgcttttgatcattaacaatttacaaaataaatttttgtataaaaatgatgggaaagactgttaaaaggaaaatgtaatttaaatttttcaatttataaattatttttaaatatttaaattcgtattttttttaataattgggtttcaaataaacttaaaaatg

SEQ ID NO: 105231 - DNA, 682 bp, Heterodera glycines
  Promoter: Source sequence=SeqID_119; Location=904..1585; Strand=-; Gene=SeqID_72905
aattttagtgttctttatcctgaatttgaaaaaaaaacttggtcaccctcaatatacatatacttctgaacaattctaatgctaaaaaacaggcactcgcgcgaaaactgaataaaaattttgtatttgaaaaattttgtccaaaaatttttacgttggaaaattaccggtttttaccggtaccggtaccggtggaaaaagttggtaccggtaccggtttttgcattaccggtcagtaccggtaccggtttttttacaattaccgattaccgctcaactctagtcgaattgattatttatttggggtaaagtaaaactccccgaaatctcatcatttgcaaaatattctcctatttggtggtcctcttatgtgcgttcccttttctttcgatccgtcgtcattttatgtcaaaatgtttccgcgccttccgtttttggcaatgatttttcgcctcctattggcacttgtccaacccctcgagcccattggcaacagttgaagctgaactggttcaaaattgttttaataaaatgcgattctcgtgtttttctcatcaagtattatccgtaaaaaataggaaaaccctaaaaatccaggctttatccaacgcaattatttttctgctatttgtgtgacatcattcgaaattcaacagcaaattttgctaattgccaaaaaatg

SEQ ID NO: 105232 - DNA, 283 bp, Heterodera glycines
  Promoter: Source sequence=SeqID_13334; Location=574..856; Strand=+; Gene=SeqID_77200
aattcatagaataagtgcgtatatatatatacttgacatttaaaaaaataatcgattaattaactctgcgcattagcattttctgcacatgatgctgggtaatagtggagaattggtgtcccggcgaaaaataaatttaaaaattttcttttctagttttctatgtaaaaaaataggctgattacggatctgagtccagaattcgaaaaatcattgaattagtgtatgatttttcatcaagtacttgatttttcttaataaatgttcatgtcagaaaaacatg

SEQ ID NO: 105233 - DNA, 107 bp, Heterodera glycines
  Promoter: Source sequence=SeqID_15784; Location=1..107; Strand=+; Gene=SeqID_80106
ataaaaacaacatcaacatacttataatcaatttactgtagagcagtgttgtttttattccatgttcgcacgcttgctcctgtcaaggttgtgccaaaaaaataatg

SEQ ID NO: 105234 - DNA, 1003 bp, Heterodera glycines
  Promoter: Source sequence=SeqID_5584; Location=2695..3697; Strand=-; Gene=SeqID_58556
aaaagaatttttttaatttaagaatcattttttgtttattttttcataaaaataaaaatacacccattctaaaacgggctgatttcactaataatgacctaattcggcataacaaaaaaaattgccaattttataaaaaattaaatcactgacgaaaacccaaaaatttcctggataaaaaacctttttccgggcagcaaaatccggcgccattacaatggtaacccttttggcactcgttttttgcttgggttgaagaacatttttgtaaaggctcaattagatttgggcgccatgtttcattgcactgtgaacctaaaataattaggctaattaatgctaattataattttggaaaatttaatttgaaacattcaattaattttttgtgagcacttatgaaatggtcaacgtacacaaaaaaaaattttcaatatttttttaaatattttttttcggagaaaaagttttgaacaggaaaattttttcttaaaaaataaaatgaatattaaaaaatattatgtttttatttctttaaattttccaactttttttctctgaaaaataaatctttttttttttaaattttgtttacaattaattgctcattgtacgaattgtcaaattgactcgaaaaatggtatcaggcccaaccgaacaatattggcaatccaataaaacaagatcccgtcatggttttcctgtaattttggctatttcaacaaaaacatcaggaccggtacccacattttatacattaagtataaatatataattatatttcacaaattcaatttcttatccactcttttccactgaaaataaaattttgataattttaattttaaatttgaaaattttttaaattgttacataaaagaatacgctaaacactgtgaaaaaaaaattaacaattaattgacaacagcacaaattaaaaaattgcggcgacgcttttttctaattatgatgaaataattaaataaaaaatccagtgaccatg

SEQ ID NO: 105235 - DNA, 113 bp, Heterodera glycines
  Promoter: Source sequence=SeqID_4416; Location=456..568; Strand=-; Gene=SeqID_54376
tttggccgatcgaacaccgacaaatcaaacagaactaaggcgaattgcttatcgaataggagacctttttcaggcaactaattggtcattcaggcaaaagtaaatgggaaatg

SEQ ID NO: 105236 - DNA, 180 bp, Heterodera glycines
  misc_feature (24)..(24): n is a, c, g, or t
  Promoter: Source sequence=SeqID_35601; Location=1..180; Strand=+; Gene=SeqID_65124
aaatccgtgaagagatttctgttnggcaagcagtaatttttttaaattaaaaatgttataattttattattaaaattgttttcctatttaattttaattgttttttcggcactccgttggaccgaccaaaaatgcagtgaaaatggcattgtattttcagcagagaatcgccgtcaaatg

SEQ ID NO: 105237 - DNA, 543 bp, Heterodera glycines
  Promoter: Source sequence=SeqID_40364; Location=689..1231; Strand=-; Gene=SeqID_68725
gatgttgctatcaacacgatgtgtgttacataataaatggcaaaaacgttatgattgtgatattaacttttgcatttatctttataaaactactgattgctttctaacaaaagtttgctagttttttatatttttaaagatttattatgtttaggatttgttatgcttgtcagttcatatttttggagagagttttaaagagcaataaaaattcgcatttttactatttttaaattatataaaaaattgataatcacgtatatgtacaatattttgtttacattgacggatttataaaacgcgcaagcacggaaattttatatggtttaaaaaattttttttctggtctttaaactatataagtacccaaaattactttagacttttagaatcaatataaattaataaatttagcattttggttgaaattagaggcgcatttaaattttgaaattctcagatttttcaaatatgttatttttgcttttccagataaaattttggtttagacaaataacaaaaaagattttggactgactaatg

SEQ ID NO: 105238 - DNA, 117 bp, Heterodera glycines
  Promoter: Source sequence=SeqID_11299; Location=2146..2262; Strand=-; Gene=SeqID_74674
cttaattttgaatattgttgattcagaaaccaatgcttttaggaaataatattgatatgttcttttgcctcatctacaatatttaatttaattaattagcttttactaattaaaatg

SEQ ID NO: 105239 - DNA, 79 bp, Heterodera glycines
  Promoter: Source sequence=SeqID_27726; Location=782..860; Strand=-; Gene=SeqID_58396
aagcgatgtccaattagtgaaaaggcggcgacggatcaatgggaaaatgaaaaaaattgggacgacaatttgaacaatg

SEQ ID NO: 105240 - DNA, 1003 bp, Heterodera glycines
  misc_feature (787)..(787): n is a, c, g, or t
  Promoter: Source sequence=SeqID_2165; Location=1426..2428; Strand=+; Gene=SeqID_78211
aataaattctttggagctctttagtgaatttatctctccgcctaataaagataacataaaagattttttatcctaaattatacaatgatttactgtaacagaaaaatgacataacataaaattattggaaaatgaatcttcagctaaattgaggttaattgtaaacctcttcgcctgctacataaaattgttgaccaaacgccaattattgctcgagtgaaaggcacagtacggaatcccaagcgagattttgcggaatatccgtcctgcagcatttgatcaccgcatcaccattgatcagacttgtttgatcggagtacgaccgtagtgtcagtcgacttgatatttaagtgtcaaaagtgatcagaaaaaatatccggaaatacatataaaatttgaaaaatttccaaaattttcctcacaaatttataacagattaattattatgagttcaaataagcccgactttggaaaaatttaaattttataaacaaccgcttaagaaagtgaattgttttaataaaagtttaagagatttcttccaactcgactatcaatttctcaaaagttttaaaaaatagcgctgaaaatatgaaaaggaaaagtaactaatttgaatgaacaaatctgacacccccccccccattaggcgacgacctttctttgctatcttcacactgtttttttacggacgcattttttcctaaaaactattggaaccaaggcagggggccaatcacattttacgaacgacaagcgacaaaaacggacgacaaacgaacaaatnttggcatatgtcattacgacaaaaaattatgtccgtttgaataagccgtttttccgtttgtcgttcgtaattgtgattggccccagggggaggagtcccggcgttgccagctttcagtgacggtctcatcttcaagtctaatttcaaaaaattttcagcggcacctaccagcactgccggaccctcctgttttccaaaagttttattgaaaaaatg

SEQ ID NO: 105241 - DNA, 114 bp, Heterodera glycines
  Promoter: Source sequence=SeqID_6034; Location=3723..3836; Strand=+; Gene=SeqID_60083
ttgtgatcgtgttccttctttttcagttatgtcgaccaaaatgtcatcgcttttctccgccgttttcatccactgttggcccatttgaacattaatttgtccattgcggcaatg

SEQ ID NO: 105242 - DNA, 80 bp, Heterodera glycines
  Promoter: Source sequence=SeqID_26024; Location=1..80; Strand=+; Gene= SeqID_56773
tgggcactgcactaaattgagtccgtaattttacccttttgatgttcagaattgttggcaagtcgctggccatgaaaatg

SEQ ID NO: 105243 - DNA, 198 bp, Heterodera glycines
  Promoter: Source sequence=SeqID_18165; Location=388..585; Strand=+; Gene=SeqID_82746
tttttaaaagtgacgggaaaaattgcatagattcggcaccaattggatcccaaaggaaaatttgaacagatagatgacaaaacgacaggaaccacgcttaaattagaaaagttataattttttgttatttttttcgtttaaaaattttgatttaattgaatttgatttaccaagataataaagaaactctggaagatg

SEQ ID NO: 105244 - DNA, 60 bp, Heterodera glycines
  Promoter: Source sequence=SeqID_12397; Location=408..467; Strand=+; Gene=SeqID_76006
ggttatgatttttaattgtaaaattaaacaattcaaaattcattcagcttttattgaatg

SEQ ID NO: 105245 - DNA, 140 bp, Heterodera glycines
  Promoter: Source sequence=SeqID_5424; Location=1955..2094; Strand=-; Gene=SeqID_57973
ttcagtggttaatttgcaacaatcttttgagtttttcctcatctaatttgaatccattaattaatttaaccccactcccattttaggctatttgctgcttatgttggccgctccctttctgtttataattgtgctgaatg

SEQ ID NO: 105246 - DNA, 69 bp, Heterodera glycines
  Promoter: Source sequence=SeqID_21498; Location=1612..1680; Strand=-; Gene=SeqID_52110
ggtcaaattttgtgtcgtttattatttttcttaatttattttttcaatttcagtgagctgttgaaaatg

SEQ ID NO: 105247 - DNA, 336 bp, Heterodera glycines
  Promoter: Source sequence=SeqID_5890; Location=4908..5243; Strand=+; Gene=SeqID_59580
ttgctcaattgtcgtcgttttcgttgtacacagagaagggatgattgatgaagatgaattgccgataattaataatggaaaaatggcaaccaaatgaattttttgtgccttttatatatgaatttatccgaaaaatttgactcttccgactaaaaaatttgctatttaaggcccacacattttgcttttccacgttcattccgttcattcattccatccacttaattattcgtcctcctccaccgccacttaaatcgtcagtttatttaggtaattaattgttttgttatgtgcattttcattgtgctaattgccccccccatttttcagcgaatg

SEQ ID NO: 105248 - DNA, 580 bp, Heterodera glycines
  misc_feature (60)..(60): n is a, c, g, or t
  Promoter: Source sequence=SeqID_14637; Location=1..580; Strand=+; Gene=SeqID_78726
ataaggaaaaaatttgatgggttgtgggtggctttattaatattatttataattacgacnccataaacgcacaaattaacactttttattaaaaaataaattataaatgattacgatattttatgatatatttatacaatagaattacttagaaatttaaaattttaatgtttttatttaaacaaatgcaaaaattcattttcttataataaaatgaattttattaactattttacttttaaaatgatatattgatttttattttttcataatttggtcgaaccctattagaatagttgctttatttatgtaagcttaatttaatagattcataacaaatctgacttttatgagtccaatcagactatatgagtccaataaaatatttatgattcccatgacaatttatgagtcaaatcattttttgaatccaatgatttttatataaagttttgagtcgaatttttatttttcaaactgtcagcctgaaattgcaaatacacaaagtaagacaaaataatagtggatattggtatcgaatttcttcaagaatattttagaaaatttttgaatttacatg

SEQ ID NO: 105249 - DNA, 434 bp, Heterodera glycines
  Promoter: Source sequence=SeqID_1290; Location=1..434; Strand=+; Gene= SeqID_46773
gagtataaaagaaagaaacctcatgccccaagccatcagaccataatcggacgacatcatcagctagccaggaaacaaacgtattcgttcagacgcatttggactttactaaataaatggctttccataaaattgataatgacagtgcaaactcaatcaccaatgccttagacttttttcgtattccacccaccaatgtgagcgtctcttcatcaaaagtgtttgagctgcttcccagtaacccactgacggacactccctaccacttcaagcttcactccagccaaaactttattgatttgtccaaatgctacttacaaagtgaattccgaattcgcaaagaaaatgagcatggtcagctggttgacctcgcagctgacgaagttgctccgatccagatgatcggtcaaactttcatccgaaacatcaaaatg

SEQ ID NO: 105250 - DNA, 1003 bp, Heterodera glycines
  Promoter: Source sequence=SeqID_298; Location=1330..2332; Strand=+; Gene=SeqID_81648
attgtttttggcgttatgtccctcgcaaaatttaaaataaacaattctggcaatccataagatgccgaagggtttataaaaaaaaatttgtcgttcggcacgttaaaatcgtacattttccaagcatacaaaattgtcataacctttttttttgatttcaataatcaaaacaaaaattattgagcatcatttggtagcgctaagtttttccaatagcctgaaaaatcttaaaaaattctaggttttgaaaaaaaaagttagacagaaaaacaattgttgaacagctttttttataagtgcaaaaatatcttgaaaataacgaatagagaaaataatattattttaattgacaattgtaaatcaatcaagatcaatttagttcatcatgactgttaagttgggtttagggttgtccaaaaaaaatttcgaaaaatccaccccctcctctgaccctacaaataaatgacacaagaaaaacgtgactggaacgggcagttcgggactgaattggctcccataggaaagtgatcggaactaaactctttgtcatctcgagatcattcctcctccatttccggtctcgagggcgcacagtgaaattttcttttcaaatcgcattttaaatttggcggcggcggcggacgctggcgcaaagttcagttccaaagttccgcgacagtttttaagttcgcgcgcggggatttggccctcaaaaaaaacgccacaaatggtgggggcacattaattaatttgggacttttcacaaatggttttgcggttgtgtcccatgcgcgcgcgcgagcgacccccgccaaacaaagacaaaacgcacacaaaatggtggggggggggcggcgggagggggtaggacaccggcttccctataggctgtactttaattctgcgtaggatttttgctccccataaatgtttgagtaccccaaacggacacttgaaaaaatcgatttttttgtttcataaatatttttttcagaaagtcatg

SEQ ID NO: 105251 - DNA, 53 bp, Heterodera glycines
  Promoter: Source sequence=SeqID_18617; Location=1792..1844; Strand=-; Gene=SeqID_83270
ttttgccactttattctttccttttttgccctgtaggcactcgtccttacatg

SEQ ID NO: 105252 - DNA, 528 bp, Heterodera glycines
  Promoter: Source sequence=SeqID_26199; Location=1130..1657; Strand=-; Gene=SeqID_45981
ttaaaaaataggtcgactacaacccaaaatattaaaatgatggacgatatatataattctatacaaaagaatcaacaaattgacataatctatattgattttgtcaaggcgtttgattctgttccaattgatttattacttcaaaaaatcaaaaagattggaattgaaggaaaaattcataattttttaactaactttttaaaaaatcggagttttaaggttaaaattggcgaggaattgtcagaaagtttcagaatattttcaggagtgccccagggaagtgtcttagggccattactctttttaatttttataaatgatctgccgtcctttattgcaaatgaagcatcatcagttggcataaaaatgtatgccgatgatgttaaattatattatacacatgaaaacgatgaccattcaaattagttggataaagcaattgaggctttggaaaaatggtcaaaaataaatgggttagaaatttcaactgaaaaatgttttgttttatatttagggaaaaataatatg

SEQ ID NO: 105253 - DNA, 175 bp, Heterodera glycines
  Promoter: Source sequence=SeqID_8385; Location=3650..3824; Strand=-; Gene=SeqID_67887
ttcgagaatggcatatgtaatgtgaatgtaggtcacacttacgaccgaaacaaataagagggaccatcttattaaatgataaataaataaataaattacggatgtataaattaaagaggtatataaaaggtggcaatttttggatagattcattttgctattttcttgaaaaatg

SEQ ID NO: 105254 - DNA, 955 bp, Heterodera glycines
  Promoter: Source sequence=SeqID_2856; Location=6161..7115; Strand=-; Gene=SeqID_81976
attcccttaattctaactaatttttaattggctgattttaacaatcagccaactttgtttgttacattatgtttcaatgttttcattttctaatttttgattttcttacaatttgtaacttataatttataattttatcagagctataaatgtttccagatttacgtaatttcagttttatccatttggtttcctcgaattccaattattttaataaaatccaaattttttttttaaaattttattagaaacacaatagggcttgccactctctttcctgtgcatcgtttgtcggcactgcttttctccccggcattaacagcgcctttgggtaagttaatatccgtactaattaattttgttttatctgtcctttgattgctcactttcaaaaattgaatatttaatccagaatttatgtgttagtgaaatgcatttttccgtttgacggtttctattttttgccacggggcacaccttttaaactgaatcaacacagtattttcgtctattggaataacaatgagaaacaaaaaccttgttggattgttgtggtgttttgctccatttttccttccccggggaattgttagtcattttctgtgctccattttttccatttctgtctttcttttttcattatttcaacccattaggtagaaagagcaacacatcactaaggaattaatttcttttcattaagtaattctctaattgcaacaattaaataaattttcgttatttttttcacagaaattctctgtgtaaaataaatgaacggaaagataagaaattcattttcaaagcaaataaccatgttttattgtcgtttgtttgatttttattacctaaatttatttttaatttttaagtgagacaatttgccaaaatttcggcgacccttcgccaaacagtgccaacgcaacagcaaaacagcaggaggacaatgtcaatg

SEQ ID NO: 105255 - DNA, 405 bp, Heterodera glycines
  Promoter: Source sequence=SeqID_37535; Location=560..964; Strand=-; Gene=SeqID_66584
gtcagaatttcgaaaaattttaaaaacaacaagcgttgcattttttcaggttaagttagtccttttcaatggagaaggcctgcaaaatttggagagattatatcgattttagtgcgctaggttcgatgaaactttttaaaatataagcctaaactttttggcctgtttaaaaaggaattaaaaatttttaaaatatttattcatctcccttttgatagaaaaagcatcagagagccttatttaacttttaattaacatttggtgcgtttcagagcactttctgaaaaaatacttatgaattaattttgcaaaaaataaataagtaatgaaaaagtcagaatttcgaaaaattttaaaaacaacaagcgttggcattttttcaggttaagttagtcctttacaatg

SEQ ID NO: 105256 - DNA, 662 bp, Heterodera glycines
  misc_feature (183)..(183): n is a, c, g, or t
  misc_feature (205)..(205): n is a, c, g, or t
  Promoter: Source sequence=SeqID_31909; Location=631..1292; Strand=-; Gene=SeqID_62219
atcagaaatttaaaaatagtaatcagaaaatacacccagcaaaaaagtgcgtcagtgatactgtactttttaatgcgcttttataacaaagcaaaatggtaatgaaagtacgtatagtaaagacccattacagtatatcactaaaacagtgtgtttacaatacgcttttaaaaatcccaattngatgtatttcgggggacaactntaattaaaagaactaaggcgcctaaatgctcaaaaaaaattcaaaaaaggaatcaatgtgctttttaaaaaacaaacttcacgttcttgaatttttttgggaaatcatttataaaattttgaaaagaaatctttttttaattatttttaatataactgccaaatggtttatttataaaattaaaattttttactattttataaattaaaatttcttccaaaaaattttgggcctcgtaaatcgattttgatctgtttcctacgaaatcaatccctcctcctgtaattgttccccgtaaaaagtagaaaaaaattctgatgaaatccctctgaaaaactctctccgggatttgattggcatgccatgttaattacctcgtgctcactttgccacacatcttccaacatgccattgtggaagttgggttggcccatgtaaaagcggaggttggccaatg

SEQ ID NO: 105257 - DNA, 247 bp, Heterodera glycines
  Promoter: Source sequence=SeqID_41127; Location=454..700; Strand=-; Gene=SeqID_69326
ttaggctttttggagaagcgaagaaaacatctgtgttgactttatagtgtattttaaaggcctacggacccaacaaaacagaaaagccaattggcagaagaatcaaaagcagagggaaatttgtagttgaaaaagaatggctttggattatcttttgggtaaaaactaagagtatttttgttgttttttttgtaaaatttttgttgatttttttttaccttttttgccacttggggcgacagaaatg

SEQ ID NO: 105258 - DNA, 254 bp, Heterodera glycines
  Promoter: Source sequence=SeqID_14096; Location=1..254; Strand=+; Gene=SeqID_78080
cgaaatgtcccagcatcataatgtccaagcgtcataatttggaagattcgaccatgcataccccctaaaattgttgatttttttatgtttgttattttatgtgattatgataaattcttatgaacttcatattctgaagccttagaattatgtaattttaggatttttcgaaaatttttattgggggacatttttactgattttagcttgggggacatttcgacgattggacattatgacgcttggacattatg

SEQ ID NO: 105259 - DNA, 304 bp, Heterodera glycines
  Promoter: Source sequence=SeqID_25871; Location=25..328; Strand=+; Gene=SeqID_45961
catggcttttgattttctatttacggagtttaacatttcacaacaccgaagcattaacattttcatttctcgcttaaatttgaaccccccccccccttctttcccaacagtttaaagtattattaccttgatgtgttttctgtccctgctaatcaccgctcaattataaggctccccgtcgaaactgagccccgcctcggcagtgttcgcacccaagccgttgtgcgtgttccgtgggcacaccgcggacgtgttggacttgagctggtcgccccgcaattatttcctcctttcttccggcatg

SEQ ID NO: 105260 - DNA, 472 bp, Heterodera glycines
  misc_feature (23)..(23): n is a, c, g, or t
  Promoter: Source sequence=SeqID_23970; Location=1..472; Strand=+; Gene=SeqID_54673
ttattttttattaataaattaancattttggaagaatcaatttctttaagagttagaatgttgattattatttactaaaatatcccataaggatagttataaataaatcatcaagataaattttggaaaatttcttgatcaagaattaaatgatataatgggattttctaaatgacgcctgaaaaatttgaatttttactgatttgttaaatagttattaaaatttcgtattaattaaaatcaattaaagagtttaaagaaatctgaaaaatgttccattccactgaagttaatattttaagcttgtttaatttatttaaataatttatttatttttaatgataaataaatttgtaaaaaagaactaaaaaatagcattttagaaaattttaaccgtaaacttaggtagttcaaaaataaaactttataaaaatgctctgcaataaaaaaaattaaaaaatgaaacaaaatg

SEQ ID NO: 105261 - DNA, 646 bp, Heterodera glycines
  misc_feature (52)..(52): n is a, c, g, or t
  Promoter: Source sequence=SeqID_7349; Location=1..646; Strand=+; Gene= SeqID_64550
aaagttttgaaaaaatgaataaaaagttttatttacttcaagattaccttgnaaccaagaaaactatagaattgaataaatcacatgcttttacgcggcttgcttaaggcctaaccagcggatttttcatggatacaattttgtttttgtttaccctttttttttgaattttccgcccatatattaccaaagatatttgtataaaaattaagaagaaaatgtgaatttttattttatttttattcttttttaatttattttcttttaatcgtataattaaatgcattgaccccgttttatataattatatttaattattttatcaatcattgagttttttcgaatcgtcacatcacgctctctgacccgcccaacgatttttttctcatttattaattgcaatacaatactgttccaattggtaaataaatttaaaaatgaataaccaacctccttttcccaatttaatcccgaaattcgattcgcaatgaatttaatttgtcaaataataaaaattttttaatttgtcaaataataaaaattttagccaaaaagctataaaagtgacaaataaattcatttttgcaatcataatttacgacaaaagtgtgctgctgctgctgctgctgctaattgccataaaatg

SEQ ID NO: 105262 - DNA, 296 bp, Heterodera glycines
  Promoter: Source sequence=SeqID_40679; Location=1..296; Strand=+; Gene=SeqID_68932
accattgatgtccttatttttgagataattatgatctaacgtcctttaaaccatttaaatcaaaaatataaaaaatgaaaatggaataatttttatttaattttttaaaattaagattgcggtttacttgttccaaacagacagctcgctgttcatccaaattgttggacattacattctgctgaatgatgcgcgtgcacttgtgatgccagcctggtttctgctctgggcctccggtgaaatgcgaaaaattgttggcaaattgattttttgtgccaaaaatgatccaaataatg

SEQ ID NO: 105263 - DNA, 1003 bp, Heterodera glycines
  Promoter: Source sequence=SeqID_18836; Location=44..1046; Strand=+; Gene=SeqID_83528
cgttttcgcgtgggcgttttcgcgtggccgttttcgcgtggccgttttcgcgtgtccgttttcgcgtggccgttttcgcgtggccgttttcgcgtggccgttttcgcgtggccgttttcgcgtggccgttttcgcgtggccgttttcgcgtgtccgttttcgcgtggccgttttcgcgtgtccgttttcgcgtggccgttttcgcgtgggccgttttcgcgtggccgttttcgcgtgggcgttttcgcgtggccgttttcgcgtggccgttttcgcgtgtccgttttcgcgtgtccgttttcgcgtggccgttttcgcgtggccgttttcgcgtgggccgttttcgcgtggccgttttcgcgtgggcgttttcgcgtggccgttttcgcgtggccgttttcgcgtggccgttttcgcgtggccgttttcgcgtgccgttttcgcgtggccgttttcgcgtggccgttttcgcgtggccgttttcgcgtgggccgttttcgcgtggccgttttcgcgtgggcgttttcgcgtggccgttttcgcgtggccgttttcgcgtgtccgttttcgcgtgtccgttttcgcgtggccgttttcgcgtggccgttttcgcgtggccgttttcgcgtgggccgttttcgcgtggccgttttcgcgtgggccgttttcgcgtgggccgttttcgcgtggttgcatacaaaatagaataattactcacactatattttaccaaatttgttgctcttatttctttttacttatgtaattcattttataattaagtgagtttataaacttaattaagactgtttcaattatataatatggaccagcagcaaaaaattaaaacaaaacgaaacaaagttaagttagaacatgacggcgcactctatgttttcgaccaattgagcgctggttgggtatttccaatttgctactgtcttttaacatcgaagtgtgccgcaatttatacgcgtatgttacagcttcttttggaacgatg

SEQ ID NO: 105264 - DNA, 107 bp, Heterodera glycines
  Promoter: Source sequence=SeqID_11024; Location=1..107; Strand=+; Gene=SeqID_74350
aagattatatttcacaaaataatttttttttttttagaatttttttttgcgtcaaaataatgtttttaaaatttctgattttggtcttctgttttcaattggcaatg

SEQ ID NO: 105265 - DNA, 879 bp, Heterodera glycines
  Promoter: Source sequence=SeqID_5584; Location=1666..2544; Strand=+; Gene=SeqID_58557
actgtaaataataaaatgataaattcattaaaaataatgaaaatgaagaggagtttttgctttggaaagaatttgtgtaagaaaaataatcaaaaaaaaagataagagaataagaaaaaattgttttatatttttggaaattttaaataacattcttatcatgtgaaaacaaatttattttaaagtaaaaaaaaaattcgctaaaaccacaattctaaaattggtaaataacgattcatgccaattaggacctaatttctccataataaaatgataaaattttcggtatataaaatgaaaaacaatttatgggaaaaaaatttcaaattttttttaatgaatattcaatttccaatttcctattttatttttacatttttcaaaattcgaattccaccgggcaagtaacattttctgttttacagatcaaccaaaaatcaaccaataataataatgatgatgattaaactacaaaagcacctccatgcagcagcagcagcagcaagcagtccaatcctacgaaaaattgttgtttaatgtttaatttttttttcgccggagaccgtttttaacccttttttaaacgagaatctcgtccgtggagacaggtcgagtctccaaccacctgctgctgttgctggaattattttgcaggtaagatgtaataattgatcgatcagtttagttgagtgatcaatcttgaaaaatgtgtgcacaattttctcacccccccccccatttttaccgaatgtaattttcggtccgccgtcatttcaatagccaaccaaacagttcacccaactcaagaacaaccactcaaattggtccaatatttatttgtttgtaatcctgtgggtataaattaaatccatcaaaatg

SEQ ID NO: 105266 - DNA, 153 bp, Heterodera glycines
  Promoter: Source sequence=SeqID_1979; Location=4086..4238; Strand=-; Gene=SeqID_77143
ttttggattcggtttaaacttggccaaatatttggcagaagaaggccaccaaattgtaattaattagggttttaatttacattttatggttaatttcgccaaaatttccaaattttacgaataaataaaattaaaacgcacttttagcatatg

SEQ ID NO: 105267 - DNA, 58 bp, Heterodera glycines
  Promoter: Source sequence=SeqID_8829; Location=1..58; Strand=+; Gene =SeqID_69345
tttaattaaagtttgtaatcccaatttttgcccgtgctttcattgggctgtcatcatg

SEQ ID NO: 105268 - DNA, 1003 bp, Heterodera glycines
  Promoter: Source sequence=SeqID_3199; Location=1139..2141; Strand=+; Gene=SeqID_83643
attttctgttattaaaataaactttttcacttaatagatatagaaaattttattaagatgaatttaattttgaaaattttcatgtaaaaattattccaaaattagtttcaaaatttgataatgaatttttctgaaattaatcacccaaacccaaataattcacaattccattagcaaaagataaaagcaaaaaattgagaaaaaaaaatattagaaagcaattaaaacacaagcagagcagacgaacataattaatcactaaaaaaaagttaattggaagggaaattaacggggataattatgaagagacaaatggggagcacataaatatgtaattgcataaaataacgaaagccaaaaaaggcaccgaatttaatcatggaaaatgtcattgggccatcccaaaaaaaggggggacaactcagcgaaaagagaggggaaggaaaaatttgggaaaatgatcagcaaaaagtgatcgcaacacaatgtctggacggatggatcaacagcaaatcgggcgcaacagcagcgaaacagaaccggattagcacagaaagcagcacaaagcacagaacagtgagacattgggcaaaagcaaagcgattggacagagtatttaagggctaattggatcaacgaaggcacacaacacaaccacaaattcatttacagaacctcaatcactagtctcaactttttttggcacttaataaatggcatgtcgatcccacacccttccaaccacaaattcttattgttttgactaatccccaattaacgggtctcattaacaaatcgaggacaatcagtaacccgaccccaaaattcgagtagatgtccccagtgacttccctaagccccactttattggtacttcgctgggttatggcatgccgtctcccgacattgccaacaattttcctctaaattcgagccgcttgtcacctaattatttttctttccctttagccgcttaatcttaatcaaatccgattaaaaaatg

SEQ ID NO: 105269 - DNA, 366 bp, Heterodera glycines
  Promoter: Source sequence=SeqID_17302; Location=2083..2448; Strand=-; Gene=SeqID_81779
aaaaattttgaaaatttttgaaatttttaaaatttggaaaaattagagctcattaaactttccaataagttcgctggcaccccctccctcagaccaaaccctgacgtggtattcacctggtactgaagtgggaaaaaaaaattaactgagtctccgtgtctgtacgggtccgggatttggtctgatcaaaaaataaaaaatactggattatagaggacacttctgcggagtgccctcacagcgggaattttttgatccgagtttcagaaaaaaagttaggggccctcaaatgcacgaaaaaatgagaaatcagccgctgggactcagttgggcgtcgagaatttttttctatagttttcccagatg

SEQ ID NO: 105270 - DNA, 348 bp, Heterodera glycines
  Promoter: Source sequence=SeqID_1680; Location=2102..2449; Strand=+; Gene=SeqID_75298
acgagtgcttgcagatgtcaccaaagtggccagagaaaaaactgaatggattgctgagctcagcaataattgattggaaacataataaaaaaatttttaaacagaaaacgtccaatttatacgttaatgtagattttttaaatactggttaatatgtagagaatcttaaaaatttttgagggaaatcacgttaaggaaatcttgttttccgcccatatacatatatgtatccccgttcaatcggtgtacctatggatggttatacattatttatacataaatataggtcccatacagacacaaaaaattatcagactgttggagtgctaaacaattgttgcatcaatg

SEQ ID NO: 105271 - DNA, 985 bp, Heterodera glycines
  Promoter: Source sequence=SeqID_747; Location=1545..2529; Strand=-; Gene=SeqID_60385
ttttctatgcttttattaacagctaaacagaattatttcggaaacggaagaacaatttgtgttatattaacacatatttgatcaggtatattttttatgggcgtgcctctcttttgaaatctctcaaaaagactattactgccaaaaaatttcatttatttacataggtttttaccaaagacaactatctcactatgggtcaagcccaatgttagacaaaattgcacataacgccaaaagcgtaattggcgtaatttttgcgcgctaattcaaaatttacactggtaaataccttttttgtattttttattttgatcagacataactcgcttcattcccaactaaactgaataaatttggtatctaattttgtgtttttgattagcgctcaaaatatgtcccattttgcgttttgtccttttttattattctcaaataaatttttgatcgttttttatgtggcaacaaaaacaaaaagcggtgactcattgttaattaggtacatatattgcaaacagaaaaacaaagataaaacttctttcattagatatttgtgtggttatatacgccgagctgaaagtatttctcaaccactatgtataaatgcaataattcctttactttcccccgtcgtcccgcaaaatttcattctctcgttttgtttgtttgtccgtttgtttgttttcatattttcccttttaaccaccgctgtttgctgctctctgctcgtttattctgccaattacacatcattctgccccaagccaaaaataaataaaaaataaaatttatttccaaaatttatcctttcagaaacaccccttaaattattctaaaattacaattatttcttggtctaaactccaacaaaaatggtgcgtaaactgaaaatgataattccccccatttgagtcttttcctccattttgtcccccccccttcccaggaccggtccatcctcgtcccctacacttctcggttgatg

SEQ ID NO: 105272 - DNA, 116 bp, Heterodera glycines
  Promoter: Source sequence=SeqID_41299; Location=315..430; Strand=-; Gene=SeqID_69458
ttttcagggctagttgattcggcaggtgagttgttacacactccttagcggattccgacttccatggccaccgtcctgctgtctatatcaaccaacaccttttatggggtctaatg

SEQ ID NO: 105273 - DNA, 70 bp, Heterodera glycines
  Promoter: Source sequence=SeqID_12064; Location=2097..2166; Strand=-; Gene=SeqID_75610
cccccccccccgttccctcttccgaaagcttggaaaattttaggcattttaggagtatttttccattatg

SEQ ID NO: 105274 - DNA, 166 bp, Heterodera glycines
  Promoter: Source sequence=SeqID_9211; Location=2837..3002; Strand=+; Gene=SeqID_70616
gctaaatttgtccaattttgacgccattacttttcatttaatttcccacttttctcagtgcgtcggttggctgtccgaacggcacacggattgtctgaaccgtttcctcgagttcctttgcatgcccatcgactgggccaagcatttgtgttacatcaccaaaatg

SEQ ID NO: 105275 - DNA, 938 bp, Heterodera glycines
  Promoter: Source sequence=SeqID_3801; Location=1..938; Strand=+; Gene= SeqID_51928
tctagagtcaatggctcgaaattacagaataggctgtatttagcattgtcattttcaatgatgttactacaatgaaaagccaaagaaatgtatttattggattttctaattttgatttttaaggacactaattaattatcccaaaaagcctcaaattttgcatttgaacaaatttgacaaaagacaaaactttccgtgtgttcctgtgctgctaaagatcgggattcttagattgttcataaaaaccaaaccaattgaatgtgcgaattgcgaatttgccgacgaccagcagaaagtgccgttcatgccgtaaattaaatgattttagtcaattaaaaatagcgatttacttaattttgaattttcttttttgtttgatcaggacacacaaaaattatatttaacgaaaacaaaaataacaaataaatgcgagtgtttgtcgtctttgaattttaatggaatgttatgagtgtttatacttttcttttcatttcgattttatgtttttaactcatccgaacaattacacgaaattgtcaaattattcgttttaaatattttctaaataaatatatttttaatttttttttaatttcaattaaaattatacaacaaaagcataaaaattggaattactacaacacatgattataattcgagaacaaagaatgtcaattgataaagtcaacacggaaggagcggacggcggcggagagagcgaacgaatggcggggaaaatggaaaattaaatgggcaaattaacaattaattatgagggtaattagtaaaacaaatgaatgacattgaagcattttggccagagcaattcctgctgataaatggaacagataagaaaaagcataaggcaaatgatcagttctaaattctttgaaaattaaatgtaaatatttccaaaatattttttcaattaaaaaatg

SEQ ID NO: 105276 - DNA, 390 bp, Heterodera glycines
  Promoter: Source sequence=SeqID_3612; Location=4546..4935; Strand=-; Gene=SeqID_51109
ttttatgtttagggttttatttatttattttttatttttggaacttttttttattgttttccaagaaaaactcaaacataaattttttttttcgcagaaaaattccaaaaactcgagattaaaatgcatgaaactgtctcaaatatatttttggcatttttagttagggtttatattaattattttcaattatactttttgcttattttccaatattcgaaaatataatttttttcgcagtatttaaaatgcatgaaactatctctataataaattaaataatatttttatttcaaaaacatattttaaagtacacaacacgataacaaaaatggcgacgaaatattcaaaaattaatgttatagtaacatggattaattacagctaatg

SEQ ID NO: 105277 - DNA, 67 bp, Heterodera glycines
  Promoter: Source sequence=SeqID_8658; Location=1701..1767; Strand=-; Gene=SeqID_68789
tttcgatgtcatttctttcgcatttttaaaatttgattaattaattcacttttgacgttggaaaatg

SEQ ID NO: 105278 - DNA, 1003 bp, Heterodera glycines
  Promoter: Source sequence=SeqID_28145; Location=725..1727; Strand=-; Gene=SeqID_58793
ctaccaatgttccaccaccctaattaaaggccccaataattgggtgatgttaaaagtatacattaaagcatcattttacaaattgcctattattattgtacatgattttaaaataaaaatttcatatagaaatgaatgcataaaaaatttttcaagatgacttgtgaaaattttgattaggttttaattttgggaaattgaccaaggatggttttatgtttacttgattacgattttgtttatacgttttttgatcaaatttaatccattttctgtgcataccctagcaaaagcctgcaaaatgactagaagaatctgaaaaaaaggcaaaacgtttcctgatgaaaccaaatccttctggttacggtggttgattatttaaaacccaaaatatgaaactgcaattgctattttttttgtccacaaatgcttacaattgcttttcctagggtttatcaaacttggaatgatgatattcattttgcaattaaaattgccaagctcatttaagttcctccgtgtcctttcctccaaataccgaaaaccgggacttaggtactcatttgtacgacgttttttcagtaccaggtcccggtcccgctaatactctagtttctcattcatctcagaccaaattcttttgttattattattgataattgcttgaaatttatgagatttgaaatttatgagatttaaaaagaatatatttttcatttgtctaatgaataattactcctttttgagtaatttcttaccaaaaagtatttttctgtaccaatgaataaattacaaatttttaagtcaaaagcacagatttatttatatacaatggcaaatggaaaagcaacaaaaataaattacaaaaactgaatcttctaatataattattcttcttttttctgccttcaaacgaattcatttaaatctttttaaatttaataaattattataatttttatcaaaaacaataaaaattttatttatttattttttgataatg

SEQ ID NO: 105279 - DNA, 121 bp, Heterodera glycines
  Promoter: Source sequence=SeqID_2406; Location=529..649; Strand=+; Gene=SeqID_79565
agttttacgactggagcacagctcgttttttatatatagataattttttaattttcaaatattttgaaaaaatcaccaccatattttccacatttttcatccctcttcattttccagaatg

SEQ ID NO: 105280 - DNA, 729 bp, Heterodera glycines
  Promoter: Source sequence=SeqID_227; Location=356..1084; Strand=+; Gene=SeqID_47212
taccaggcgaatacacggaaaaaatttacgactctccgctctatgcacgtgttttaccaaaagaagtattagaaattgaaattgaattgcgaactatgactgacggacgactggtaccattttcctatggtacagtgctgatcgtattgatatttaagaaggtgataaatttttgaaatcactcatttttgttaccactataattgataaaatggttcacattctatacgacacatcggtttcgggctatgatgcattttttgtgcaaaatggatgtggagtcggggatgactcctcctaccaagtttttcgaggcgcgcaaccgtttcagcgcgggtggggcactgcacaaacgggtgcaggaataggagatatttttcgtggtctctggcgctttttcctgcctctaattcgcagagctggagatactgtagcagacgaaacaattcagactggaaaacgctttataaatagagtaatcgatgaaaaacccggcttaaaaggaagtatagagacattgacaactgagagtaaacggggagcagacaatgttttagagaagggcggatttcgacgtcaatttggcacaggaggacgaagaaagcgtataaaagctaacaattctcccactctatcacatcagactttaatcggaaaagcaataacgaaaccattaattaaaagcaaaaaaaggcttcgatcagacgcgtttggtctttattaaaaatg

SEQ ID NO: 105281 - DNA, 55 bp, Heterodera glycines
  Promoter: Source sequence=SeqID_44372; Location=306..360; Strand=+; Gene=SeqID_71872
ggtacaatgctatttttctaaatttggttaatttaaaatttagggtaataaaatg

SEQ ID NO: 105282 - DNA, 401 bp, Heterodera glycines
  Promoter: Source sequence=SeqID_39959; Location=514..914; Strand=-; Gene=SeqID_68408
cctaaaaatttattttttttacatcaaatttattttttgccaatttcctttcttttcactatactaattaaatccacgaattttgcggtcaagtcattcctgaaatctcctaattcgtcggtagagcaaagagtacgacctcgagtctccaacgcgaacttagtggcccaactgaatgcgtaaaattggcaatgcttttctcgcgaatgctcgattcatttgaactgagtcactccgtccgtctcgggagtacaatctcgagtatccaactcatttttcgattacctctaacaagcaaatggtctcgaggaattattgccgagtgattggcccaatgaaatttttcaattcccatttttgtcccattccaaaatttcaaatttttagggagaaagaaaatg

SEQ ID NO: 105283 - DNA, 51 bp, Heterodera glycines
  Promoter: Source sequence=SeqID_25135; Location=947..997; Strand=-; Gene=SeqID_55861
ttgccaatagcaattattttctgttcgtccgttgtccaattgcgcgagatg

SEQ ID NO: 105284 - DNA, 223 bp, Heterodera glycines
  misc_feature (83)..(83): n is a, c, g, or t
  Promoter: Source sequence=SeqID_1007; Location=1..223; Strand=+; Gene= SeqID_65889
aatgtagcatatttaagtttctttctcatttgaatgcttccacgaaaaaaattcgcgaccctcagtaaaaaatgtcttacatncgtcaagaacatcctcaaattttttaaaaatttcttgtttttttgtcatttctttcaatgcatctcgagaacactccgctgcagttccattacatcagcagctgtaacagttgaagcagttccggcacgagatcggaatg

SEQ ID NO: 105285 - DNA, 296 bp, Heterodera glycines
  Promoter: Source sequence=SeqID_36987; Location=48..343; Strand=+; Gene=SeqID_46484
ggtattttttgggaaagaaaatccccgtaaaatatgaaatagccacaaaatgacataaaaattactttttttggtatttttaggcaacattttcaaacttattttttctttataaattttcaaaatatgtaaaaaaatgaaaatatatatgaaaaaaatccaaaatatgtacaaatatgtaagaaaatcccgaaatatgtaaaaatatgtaaatattgtcccaggtcccggtcccgtggcactctattaaattctataactcaatcttttaagcttttttcgtcaattttgacatg

SEQ ID NO: 105286 - DNA, 113 bp, Heterodera glycines
  Promoter: Source sequence=SeqID_684; Location=8047..8159; Strand=-; Gene=SeqID_58946
cgggggggggggggattttttagacattttaagtagttacattgaaaagagcacaaaatgctctacaagatgcaaaagacaacaactctacaacttttacctgcagggatatg

SEQ ID NO: 105287 - DNA, 55 bp, Heterodera glycines
  Promoter: Source sequence=SeqID_13134; Location=1246..1300; Strand=-; Gene=SeqID_76938
tctgcaaattggttttgaacaataaaatatatttaaggacagtggttctcacatg

SEQ ID NO: 105288 - DNA, 364 bp, Heterodera glycines
  Promoter: Source sequence=SeqID_472; Location=1..364; Strand=+; Gene =SeqID_53690
ccgaattggacagattgatcgagttgggtgttctccatttgttgactacagcagatgggccgcaccaattgtggcagtgcgcaaagcaaatgggaaagtgcgcatatgtttcgactttagcactggactcaacgcggcactcgaaccacatcatcacccgctcccacggcctgagaaactttttgccaaattaaacggcgcaaaaatattttcccaaattgattttaaggacgcttatttgcaaattagcgttgatgaacagtcgcgtcaactcttaggcgttaacactcacaagggactttatcaatgccaacgcctggcattcggaatcaaaagcgcaccaggcatttttcaatggacaatg

SEQ ID NO: 105289 - DNA, 302 bp, Heterodera glycines
  Promoter: Source sequence=SeqID_12710; Location=3320..3621; Strand=-; Gene=SeqID_76401
ggaaggcctttgccatgtctgtctccttttctttctttcgttctctctctctctcgcctctctctttctctattttcaaccatctctctctctctttctctccatccctctctctctctttgtctttccaaacgcgctttctttctcccttctctatttctttcaaagtctatttcctttctttcatcccctcacttcctctctctctctctttttataatggaaacaaaattcactcataataagtttttacccaatttgttttaattaatactttcacaatgaattgtattccaggaatg

SEQ ID NO: 105290 - DNA, 103 bp, Heterodera glycines
  Promoter: Source sequence=SeqID_2372; Location=4236..4338; Strand=-; Gene=SeqID_79395
caactctccgttggcgcactgtcacgcgccaatggaagcggtcggccgcgcagtcgggtgaatattttttgatgaattattggcggactatcgccgccaaatg

SEQ ID NO: 105291 - DNA, 191 bp, Heterodera glycines
  Promoter: Source sequence=SeqID_9829; Location=124..314; Strand=+; Gene=SeqID_72842
tttggaaaagctttatttctcactattcatcaaattttattctctagaatttaattttaagtattttcatatgaaacgtcgaaaattttaaaggacgaataatcttgaggttagatgaaattctggttatctatttgttctgctaatcttacatttacatctagatttatcaaaaataaatacaaaaaatg

SEQ ID NO: 105292 - DNA, 1003 bp, Heterodera glycines
  Promoter: Source sequence=SeqID_11629; Location=1370..2372; Strand=-; Gene=SeqID_75075
aaagcttttcaattaattttatcgttaaatatttttaaaagataaaaaaacaaacttactcatatatttaatttatttttaaatgtgaaaaatgcgttgccttccgtcaaaatttgtgtttagttccttttttaagcttttgttagacccctttgttttcttttgtttcattctttccccccgaaagttttattgacccaaaaggtggacaaataggcgggcattattttttcaaattatttaactcagattctcgccaattaataattattatttttttattaattcttccattggtgtcggtttgaaaagaccgaagctcatagagctgcaaaccgatacgctcgagaacctataattaatttcctttcaatttttaggccttgtctcgagcgtgtgcttggccttcgaccagacggaattttgccaaaattgcgaggaaaaaactcgggggtgggggggggggcaaaagagccaattcttgcactgaaaatttgccttaatacagaaaagtcaggataaagcaattttgaaaatgacggggaaatggaaaaagatttattcgttcagcataaaaatagaagaatgagacaaattaaaaaagaaagagcacactataaacagagagagcgagagagagggggagagagagagcgaaagagagagaaagcgagagagagagagggggagagacagagagaagagagagagagagagagaaagtgttcattgaataagcatagacacatagagaaaaagcgtaaaccaatttcggagccaaacggacgacatactagatgaccatatcgcacatagtcgataccaaagtacatcaaataatcgtattataacacttatgctttaattgagccaagaaaattagcaatgaatgccaagaaaataatttattttcaaagttaaaattggatttacatttataataaattgaattgctttggacatcaaaaaaaatgccaaaaagcgagaaatgaaggaaaaaatg

SEQ ID NO: 105293 - DNA, 1003 bp, Heterodera glycines
  Promoter: Source sequence=SeqID_6950; Location=1549..2551; Strand=-; Gene=SeqID_63381
agggcggaaaaaagccctgaactaaaaaaggaaaacctcaaattaaggtttctttgattgtaaaaatatatataaaggatcagatcaatccatcttggtgatcagataacaacatttcaggctaaaatgatatatttcgtataaaaaatgttattaaatggaaaataattagaatttgttaaaattagaaaataaaggtttcatgaaaaaaggttatgtaatatcattatgttaattttaagaaaatatttttttattggaaataaattcttccaagaaaaaatgctgactgttaaataccaaatgggtatcctaatttaatattaaatgaaaattataattcaatttgaaacggctttttatttattaatacttagtaaatttattttcaatttaagttgttgactccatgaaatgccagtacactacccttttttaatgttttacgttaaatgttttattaaatttaaaatcgattttttacttaaatacaaaaaaagcatttctacatttctcttaaataagcacatgatcacactgatcaaaatttattttattttaaatatttatctattataattttaaacaatttttttgtataaaacccaaacaatcctaaaaaaaatactttcacttattcaccaaaattgcatgatcagcacatttcatcatgataaaaattgaacaaaaagagcgaaaaagaacaaataaatgatcaacaaaaaagaaaaacagttcaaaaatttgaagcaattaaagaaaaattgaatcaaaatggaaaatgtaatcggagaaacagtgtcaaaattgagagaaaaatttaaacgcggcatatgaaaaagatgcatttatttttattaaaataataaaaagaaaatccattaattgcaggaaattggtcggatatatttgccaaccaaaaaattatttactttttaaagaataatttttttcaaaagcctcattatttaaaaattttaatttcctttttattatagaaatg

SEQ ID NO: 105294 - DNA, 143 bp, Heterodera glycines
  Promoter: Source sequence=SeqID_4717; Location=1..143; Strand=+; Gene= SeqID_55491
accttaaggaaaaactccctgaatattgttgcaacgacgtacaaatactcacccacgccctcgtcgaattacgccgggaattcaaacaactgacacaacggaacggaaaacacggaggaattgacatcctgtggcaagccatg

SEQ ID NO: 105295 - DNA, 304 bp, Heterodera glycines
  Promoter: Source sequence=SeqID_3970; Location=3442..3745; Strand=+; Gene=SeqID_52627
cctaaaaaaatttaaaaaaataattctaactaaaaattgccattcaccctaaaaattcgcttccatttctcttcaattgaaattccaagaaaagaactgtatcgaaatatggccaaaaaattgaaaaaaaacaaaaaatcaatttggccgagattaatcaggatgaagaaagcagtgaccgaacatagtgagcaccttgtcttccgcgttgtgttcgtctcccgccttgggttcaaccacagaaaaatcggtgagtgcagagcagcaataggcgctgaagagacggagcagtgcggacacaatg

SEQ ID NO: 105296 - DNA, 163 bp, Heterodera glycines
  Promoter: Source sequence=SeqID_18836; Location=1124..1286; Strand=-; Gene=SeqID_83529
tcttagacttctcggcgaaagcaggatcagtgttgtaagcctaaactactaagaaaaaaatttatcatctgaaaaattcaattgacatgtgtgaggccaaggattctgatctgcctcttcatgttgcggacaagatgaaaaaaacagtagcggacactgcatg

SEQ ID NO: 105297 - DNA, 70 bp, Heterodera glycines
  Promoter: Source sequence=SeqID_18060; Location=906..975; Strand=-; Gene=SeqID_82650
ggtaaaaaacaattattcaacagttaatttacacctgcttttatttaatattatatttttagctcaaatg

SEQ ID NO: 105298 - DNA, 154 bp, Heterodera glycines
  Promoter: Source sequence=SeqID_24473; Location=1169..1322; Strand=-; Gene=SeqID_55200
cgtacttttacatataaacataaaaaatatatgtggggcataaactgcataggagcaaataattgcaatattaatccgggtcaaattcttatcaagcaatgataaccaatcctttgcattaaggctgaaaccccgatgtctgggttgtgaaatg

SEQ ID NO: 105299 - DNA, 202 bp, Heterodera glycines
  Promoter: Source sequence=SeqID_1147; Location=1..202; Strand=+; Gene= SeqID_68687
gattgatctcaaaaacgacgattgaagacgacgaaagtgatcgtggcccaatttgatgaatgtggaaacggaacttttgaatgctgttgtaaagcaatttccgttgaattccgatcaattaattgttgagattggaaaagatgaagtgctaaaaaaggtcatgaagtaccttcgcactcaatggcccacttcaaagaatatg

SEQ ID NO: 105300 - DNA, 76 bp, Heterodera glycines
  Promoter: Source sequence=SeqID_37130; Location=112..187; Strand=+; Gene=SeqID_66280
ttagctgctcgacccggaaagttcgccaatgtgagaggcagccggtcggcacaatgtgctcgtcattttgacaatg

SEQ ID NO: 105301 - DNA, 425 bp, Heterodera glycines
  Promoter: Source sequence=SeqID_4542; Location=2502..2926; Strand=+; Gene=SeqID_54833
accaacaacaacaagtaagggttggacaactgataaaagagaattcaaattggctctgtgccttggcccgaacgaaatcctccaaaaaatgtaaaaagttgattcgaatggcaagcaccgatcagctgctttcacttgtggaaatttgtttgaatctcgtcgcttcgcgcttccgacttacaacccgacagaaaaaacgattaatgccctatgtgagcactgtacgccggatgagcagaacgagaagtgagcggggtgccaggcgcgtgcttgtccagaagggcgcaggatttggcggattgttcgctgctcttttaacacccgttttggttgaattggcaaagaatgtcgtgagcaaaaatgcataaatacccccacatcattattgttttttcatgcaccattcattcatttgacaaaatatg

SEQ ID NO: 105302 - DNA, 1003 bp, Heterodera glycines
  Promoter: Source sequence=SeqID_9211; Location=4577..5579; Strand=+; Gene=SeqID_70617
tttttaggaaatgttgtgcgataaatatttccatttttttagtttcggtttctcacttttttcaggtgtccggtgatggttttctgaaccaattgttggccggaattttgcggacgttcgttcgttttaaataatttatttttttatcactttttaacaatgattttactattggtgtatttattgcatacagttttgaaccaattgcggattccgaccggcgcgatcggatgtggcgcacttgtttcaaggaaccatcgcgcccgaattatgagtaaaaataaattaattaaaaagtataaatcagatttcgatatatatttttagtataatttcccaatgtcccagccttttccccaacttttacgtccccttttaccaataggctgttccaaatctgcatcatcctctacctgttctgcattttgcttatcactgctggggttggtttttgtcttttttcgcaatttttaaaatccaaatgaattaatcgccacagatttatctgtcacgcgttcgccatttggtggccctgcactatttgcccgagcgtgcgcacccgcgagcaatgcatttgtacaacaaaatcatggccaaccgagaggacatgtgagtgctgacagtgaatggtgatgatgaaaatggcaaacaaacagtgtagcagtgcattaggaggacaaaaaagcgaaagcattgggcaaaaaacaactgaatgggcttttgtttggcatggacgttttaatttttacaaaagattttttggaaatgactccaaaaattcaaaattaaatcgctcactaaatttttatttagccgacccatttccgacccttgcccaattcctcttaaactcttcacttttaaaaatattttagacacaattaactccactcctacccaattttacttttttttgtcttaataaatttcaaaaaaacattgataaacagggattaactcttcaatttctttccttaaaactcccaaatttttcgtcaggatg

SEQ ID NO: 105303 - DNA, 297 bp, Heterodera glycines
  Promoter: Source sequence=SeqID_3612; Location=4945..5241; Strand=+; Gene=SeqID_51110
ggtaattcaaattattcaacatttttggcatatcattaaaattatttacatataaaaatttaaaaaatgcaacaacataaatgaacttttaaattgtttttcatattaaaattagaacggaatgaaaaaaatgacggaaaattggcgcctaattaacgccgcaccgcgttcacggacaataaaatattcgttctcctcctcagtgcgcatgagaagctgacgacgtatgtacgtcttcccctcccctccccctccataaatccttccctaattatttatagagcatcggcagggatg

SEQ ID NO: 105304 - DNA, 989 bp, Heterodera glycines
  Promoter: Source sequence=SeqID_7245; Location=545..1533; Strand=-; Gene=SeqID_64245
cctgaaacttttttatgtcatgagtcacgactaaaagccggaagaattttgggggttttgcttaaactttattgctaattgtcaaatattcaattataagcacaactttataaatatttaagctttttttattactatctatgatttaattttaaattgcgcatgatgttgattaatcataaaactatttcacaaaagaaaccaaaatagttgaatattttgaaaaattgcatgagaaatcactaaatatgataataaacgaacgaaatataaaagttccataatttatttatacatactaaatcaatgtttcgaaacgaaatttcaaactcttaatattactgactaacttgttttcatcatttattgtaacataaacaaaaataaacgaattaaacataaaatagttatgtaataaaaaacaaaaattacttcatatttttcttcgatttctgttatcaaaataaaaaacaaatatgcattaaatctcacaatttgttatataaaatcgttaaaagctaaactattttaaattagaaaactatagtgaataataacataaatatttaaaaactaataagtgacaaatcggaaacccgatttctttatgcgatttgacaaagttgtatgtttttatgaaaattttatggacgcaatggctattgttaatgaattgcgaaaccaatttatttctaactttacttatggataaaaatatataaatatttgttgcgttcaacaaaacacgatgtaaaaaatattaaaaagaattttcagaaaaacaaaaatagctaataaataaatttttaaaaggcaatggtataaaaagaatgatttttctgctcgaatttatatttttcaaatgttagtttgcaaaattttgataaaaaccacaaataaaaaataaataaattatatacgaagataaaatatatattatttatttatgcattaattttaaatattttaatattaaaaaataatagatg

SEQ ID NO: 105305 - DNA, 224 bp, Heterodera glycines
  Promoter: Source sequence=SeqID_4928; Location=700..923; Strand=+; Gene=SeqID_56246
tcccccgcactttctcagagtgctctccttctctacttctctctcgattccgcctcatctttctttctgtccgtcgatctgatcaacggaaagccaagactgaatgtgggactgacttttccgcttcaaagtcgcgtcattgaaaagtccgttaacgatgaaagtacgctttgctttggttctttccttttcatgcctttaccctctctaaatgccacagaatg

SEQ ID NO: 105306 - DNA, 1003 bp, Heterodera glycines
  Promoter: Source sequence=SeqID_20125; Location=432..1434; Strand=+; Gene=SeqID_84913
tctcgagcatgatagggagggcggtgcgcaatagaccttttatttttgagggaatttttaaatttatactcaatcccagaaaaatgtctatctctttttttgagaaattttatacctcacaaaagcgcttgcgtagagacggagggctgtgcacaatcgccattttatttcacagaggcgccgggggaaaaattgagaattttgaccatatttttagcagattttattaattctttatttttggtttttcggaaaaaattggttctattttcattttaatgctctattacaaacccaaattattaaataattgtaaaacattatgccaatttatcaaaatttaaaaagattctgaggattttccccaaaagcctcaaaaatcctcaaaatttctcaaaaagccacaaaaatcctcaaatcctcatattccaaaaaaatcctcattgacctatcaaaaagccacaaaatgaggataaatcctcagatctgggagccctggatatcatagtgattcaaatatgtttcacattgcaaaactttatcttctcaatattttactcagatccccattcttaccggtgcatatttttttgcctatgccgcgggttgagaaaaatttcgggtcgggcactcaaaaaatttcgggttcgggttgagaaaaacctcgggtttcgggttcgggttggcatcactgccgcctacctacttgcaaaattaaagaaacttttttttggattttattgaaaaaattagagtgccacgggaccgggaattttgggcaaacccgggaccgggacctttttgggttgaaaacccgggaatttttggctgggaaaaccgggaccttggtactcagttgtccgctaccaggtcccggtcccgtggcactctagaaaaaatacatacataggtatgtaaaatgaatgtagaaaaactttgttaactgataatatttgtttttacagttttttccacttttctgcaatacaataaacaacaaatg

SEQ ID NO: 105307 - DNA, 157 bp, Heterodera glycines
  Promoter: Source sequence=SeqID_12096; Location=1798..1954; Strand=+; Gene=SeqID_75656
tcttttggtctgtaggatgtttttgtattaatgaatcgagtcaaaaattacatttcgtgtaaaagaaacggtcgatttcacataattttttcatctttgctaagccaattgaaatccgaaacgaaaactgtcttaataatttccactcaacaaaatg

SEQ ID NO: 105308 - DNA, 82 bp, Heterodera glycines
  Promoter: Source sequence=SeqID_9678; Location=3450..3531; Strand=+; Gene=SeqID_72306
agtgagttgggcatgaataaaacaaacattgcccattccaacggatgaatgaatgcctttcagaagtgccactgagcggatg

SEQ ID NO: 105309 - DNA, 664 bp, Heterodera glycines
  Promoter: Source sequence=SeqID_942; Location=1..664; Strand=+; Gene =SeqID_64606
tttttcggtttatttcgattttttttgaatctgtttattttttttcaaaaaagcaataaactattctattaatagaaaaagcaaaaatttcctctgagtaaaattgtagagctattgaaactctatattgcgagctcaagccataactttagggccggcggtgctgataagagccgccggaggaaaattttaagaatttttaatgattttgttaaaaaaatggccaactgatttgtcaaaaaagtcggtcgattgtttcggttttttaattatttcgtcgaacggtttcggttaaaaaaccgaaaaaaaccgaaaccgaaaaaaaccgaaaaacaaaaatttctcgttcggtttttttcggttaaaaaccgaaaatcgaaaaataccgaaaaaaaaccgaccggtccgatctctaaagtgtatgaatgaatgaatgaattgcgaaaaaatgtgtgaaatctgtcccctaaactagaaaagtactgaataatggcgctatttgccttttctaattcgtaaaaatacataggtacgtacatatgttctgaagcactttgaacaaagtctcaaaaaagccacttgggcaaataacgccaatttaaatgaacaaacaaaaacacaaaatacataccatcaattattaattattattaaacaaaaaatg

SEQ ID NO: 105310 - DNA, 1003 bp, Heterodera glycines
  Promoter: Source sequence=SeqID_7087; Location=2219..3221; Strand=+; Gene=SeqID_63806
agggccaaattgttcacatttttcactttgtggcccatttggccgatttttgcccccctcaattgtcctcccccattgctcacccatttcggtttaattacccaagtttgagataaaatttggtggtaattttctgtgctttctttctgtgcggccccaatccgaccgtagtcccgtctcgatcgcccccggcccctttgtgctctccctccaacttgtcaaagtcctgcacccaagtgcaggcaattgtcggactccaccgcgcccacacccgcacacaaactcggagtacgacaagtggcgacctgggcagggacaaccaagcaacgacaaacagcaacaagtgcgcgacaagccgcggcggtgcactcaacggaaaaggtgtggtgaatttggaaaaattcactcggtgttccaagttttcgctctccgtggcaaaacttggacacaacaaggaggggggaagcaaaagtgggagttcggggaaatactgatcggtctccgtgccatcagtatttcctaggtcaaattactgctcggtctccgtgccagcagtattttgtcaattactggtcggtctccgtgccgccagtaatcggtaatattactgatcggtctccgtgccatcagtaataggggcaattactggttggtctccgtgccgccagtaatcaagcaaagtactgctcgctctccgtggcaacagtaccggtccttgccaagcaaaggaaggacagttggcgtgaactgctcgctctccgtggcagcagttactccaacccgacgcggacaagtcaaacggtcggaacaacacaagtgtactgcttgatctccgtgtcagcagtacaaccagagcagccaatcaatcaacaagcaacaagcaagaagcgaaggcaaagcacaacaagcaacaaggcaaagcacagcaagcatcaagcaacaagcaaagcacagcaagcagtcaatagcaacaagcacagctacagcaacagagcaaacaatg

SEQ ID NO: 105311 - DNA, 231 bp, Heterodera glycines
  Promoter: Source sequence=SeqID_15033; Location=1469..1699; Strand=-; Gene=SeqID_79209
ttaggctatttggagagcggaagaaaacatatgtgatagttttgacttttcgttaaacgcctacgggccaaacaaaacagaatacgaattggcagatgaatcaaaagcagagggaaatgcctcgcaagaataagcataaaattctttttggggttttcgtccattgttgccaattaaaaataaataaaaatctaagaaagaaatccaaaaatatacagcaaaataaaaatg

SEQ ID NO: 105312 - DNA, 471 bp, Heterodera glycines
  Promoter: Source sequence=SeqID_1654; Location=1..471; Strand=+; Gene= SeqID_75107
ttgtaattttttgtgataataattcgtgaaaaatatgttctctatggttttagggatacgaattttacatccatttcgatggattccaaatccctaactcgaacaaaatttatttttgtaatgaattttcggttattgttttgagttctttgatgggattcagaatttttgaaaaggagaacaggttcgtgaagcgaccccataaaactcccagaacaagtttacaggactagacgacagattataaaaacaaaagggccctccctccctctgttttaagtaaaattcaaatgtgccacttttaaagtagcgcccaatttttattcaaattcataaagaaaagttttggccatcccatttttctgaaattggcccaaaatcattttgtaaatgtttaaaattcggtcaacatcatcatctaaaaaattgccaaaaagcaaattgtgcaatactgaattgtatagtaaaatg

SEQ ID NO: 105313 - DNA, 73 bp, Heterodera glycines
  Promoter: Source sequence=SeqID_29427; Location=1228..1300; Strand=-; Gene=SeqID_59933
agacgcagaaagacaacagttcattgaagagtgcgaacaactttttggcatcaaaattgacgaagcaaagatg

SEQ ID NO: 105314 - DNA, 373 bp, Heterodera glycines
  Promoter: Source sequence=SeqID_35702; Location=1..373; Strand=+; Gene=SeqID_65192
cccccccccaaacgaaaatttaaaaattttatgggtacatttttgaatataggcaattttcataacaaagtgcactcaaattttcaaatttttttccaaaaaaatcccggtcccgtgcaactctactttaaatattaaaatgtctaaattaaagtcttaacattcttttttattattttggatcagtagtaaaattacattaatctagtccaaattttcaaagctttcgtttattctaattcattcgattttgaactgcgaattatttaattcaaatttaatttaatttaatttaaaaataactgttttaattaggtggctccgccatttcccacctttctcaacaacatttaaactgatcgatcagaatatg

SEQ ID NO: 105315 - DNA, 893 bp, Heterodera glycines
  Promoter: Source sequence=SeqID_159; Location=1258..2150; Strand=-; Gene=SeqID_75592
aggcgaacttcggatgcacaacttaagaatgacccgtgattttgatcaatgcgggcatatcgtgacgaaaaattgtaaggactagagaccggagaggcccatgggcccgggcttttaaccgggccgcctggtcccggtcccagtactttcaaaattccgatctctagcaaggacaaaacaattcgtatcatatttgttgaaattaactggctggtctcaggcgagaaaagtgcctgtcatgctcccggcgggggttaaacgccaccaccccttaattaaggatacgcgaattattgtaaccatggaatcgactagagaccggtgcgggacgtgattccgcgcgggatcccagtccgcaatccaacattttttggaaaatgagggatttgtgggattaatcccgcgggtcgccgtcccgaaaaaaaataacgagttccaatcacgcagcgggaccgataggtttgaaatttccaatctctagaagtgatcttacaaaagtataccaattgccaacataaaaaaggagaactcacaaaaaggcactgactaatgctttgaataaatgtattggcgttatgccctacctccccactatggcactatgggtacgccccactgtgcagagaaaagcctagtactatctcgtcgtttctctttttctttgtaatttctctcactttggcgtactatctcttcattttaattatgtaaaaatcaacattcacttcatcctgtttaacttttttcctacttgttaaatccacaccaaattttgcatatcgatagagaaaaaaattatgaacaaactttcagtgttttgagtaaaaatttcggcccagaaaatttttaattgtcagtttttatgaaaattcttaattttttaaagatttatg

SEQ ID NO: 105316 - DNA, 228 bp, Heterodera glycines
  Promoter: Source sequence=SeqID_12430; Location=4116..4343; Strand=-; Gene=SeqID_76041
actcgaattccattcatcgatgccttttcgcttggaaaggaaaaatattgcaaatttgttgaccgatcggtccaagtcgaaagtgacttggattttgccaatttaaaagtggaaggcattgaaaaggaggatgaaaatcttgttgaaagtgtcagtgccgcttcaatttacaatggcaaagaaagttcgatttcaacaacagcgaactcgacaaattccactgaaatg

SEQ ID NO: 105317 - DNA, 87 bp, Heterodera glycines
  Promoter: Source sequence=SeqID_8092; Location=3324..3410; Strand=-; Gene=SeqID_66956
tcactgtaaatccaagtcggattacagttgatcagcatcatcttgaatttgatccgagtgggacaaattaagaaaagtccaactatg

SEQ ID NO: 105318 - DNA, 486 bp, Heterodera glycines
  Promoter: Source sequence=SeqID_32153; Location=1223..1708; Strand=-; Gene=SeqID_62485
agaagaataaaaaatataataagagattgcaaaaaaaaatatattatttaggtttttcagtttttttttttttgaaaaatttataatgatttttccataatttttattgtacattatgccttttgtatcttttgccatgactccgaaaatatttttaggcaaggctttaaaaaaccctcaaaatatgcagtaaaaatggcaaataggcctctagtaatgttttctcagcctgtatattataatttgttgaaatgaaattttgacaataaattaatatttttgacaaagttccaaatcgatttttgggctttttagctataaaataaaaacctagatatagtgcactaaaaagccgaacaaagcttaacaatagcacccttaatatgttttattaaacgacaaaatgccacattataatttattttctaattttattttaaaatttattatttcctccccgttacaccatttcatcctcccccaatg

SEQ ID NO: 105319 - DNA, 422 bp, Heterodera glycines
  Promoter: Source sequence=SeqID_16774; Location=2120..2541; Strand=+; Gene=SeqID_81190
tttttagctctaaaatactgaaaatttattgaaaattcgcgcagtcgtaaaattttttccaaagttgcgattttcttgaaattttgcataagcatatattttaaccccatttataggataatgctttgcttatttaccaaaatgctttttaactcgagatcggctcttccatttttacaaggcaaaatccccaaaaaattttaagttttgcaaagttttggcgttctgattactaaataaataaaaacctatttgcactgagagcacaaaattgggccgctgtgtaaataatatgtcgtgtggcggacttgaacctccgtcccatttcgctttactatcttgcaataaaccactgtgccacacatgtctcttttttagtataggagctgtggtgcaatcgtgtttgccaattcataaaaatg

SEQ ID NO: 105320 - DNA, 122 bp, Heterodera glycines
  Promoter: Source sequence=SeqID_37165; Location=511..632; Strand=+; Gene=SeqID_66313
tttcgaaagtcagaaaacacttaataataaattaatttaaaattttgttttatttttattgtgtgtttttaaaagtgttttatcttaattttttagccaaaacctaaaacaacaaaaaaatg

SEQ ID NO: 105321 - DNA, 73 bp, Heterodera glycines
  Promoter: Source sequence=SeqID_23391; Location=1650..1722; Strand=-; Gene=SeqID_54096
gagcaattggcattgaaaagaactgacaatagcgatctttttctgctgatccgttgcgcaattgcgagagatg

SEQ ID NO: 105322 - DNA, 58 bp, Heterodera glycines
  Promoter: Source sequence=SeqID_25603; Location=1..58; Strand=+; Gene= SeqID_56348
agtcatagtgacttggggtcttttgcatattgtagagcattttgtgctctttcagatg

SEQ ID NO: 105323 - DNA, 79 bp, Heterodera glycines
  Promoter: Source sequence=SeqID_1042; Location=6318..6396; Strand=-; Gene=SeqID_66814
actaaaaagcgtgcaaaaaacgtaaattttgttgtttgaaatttgaaatggccgggatcgggcctgaacttggaaaatg

SEQ ID NO: 105324 - DNA, 106 bp, Heterodera glycines
  Promoter: Source sequence=SeqID_9067; Location=1089..1194; Strand=-; Gene=SeqID_70143
tattaaacctgaaatacaaaaattgacatgacaataattcaaatatctatgactagggagtgtaattatatggatataaaatcgcgaaatatggccataaaatatg

SEQ ID NO: 105325 - DNA, 320 bp, Heterodera glycines
  Promoter: Source sequence=SeqID_6640; Location=1..320; Strand=+; Gene= SeqID_62297
cagctgagtttggcactccaattccggcacttttcagcctgaaaaagggcaagcgtgcctctaattctatttttccaacccatttcgaatctttttacatcgattctgaccgtttttaagcatttttgagtttggggactatgaccaatatttatcggcggtgttgttggcatgaatgctcaaaaacacagaatgcgaacaaattaaagcttttaaacgttttaacaatttgtgataattctgatttaaattcattgaacttaatctttgaaatgaattaacaaaaattcaacatttgcttgatcacaattgcgatcatg

SEQ ID NO: 105326 - DNA, 354 bp, Heterodera glycines
  Promoter: Source sequence=SeqID_4471; Location=4151..4504; Strand=+; Gene=SeqID_54565
atctctgatcattcattcattgatttttcgttgaaatgagcaactctttctttgtaattttgcccagcaatacgccgggatttgtcggcaataaaacgaataaattcaaagtacacttgccaaaaaaattagtgtttgatgggccgggttggatggtgggcatgtctggcataatatatcccaacaggtgtgtgggtttgcacagttctcattgcccttgtacagtttagctgggcgactgtagggaccctggagaggcaatacgtagtggtgcacctgcgcgatgggcgcaagttccggttcagagtgccaaggggcagcttcctttcgcctcagcagctcgaacgtggaatg

SEQ ID NO: 105327 - DNA, 362 bp, Heterodera glycines
  misc_feature (11)..(11): n is a, c, g, or t
  Promoter: Source sequence=SeqID_10206; Location=3404..3765; Strand=-; Gene=SeqID_73331
ttaagctattntggaaattttatcactttgaactgcccaccttattacagtacaagaaagttactgtgtaatttcccttggcaactgaaaataattatttgaaaaaggcatatcgcggggcatttcgtcactctcactcatccaatcgtcttcaccacaccactctcctaaatgccggtgttcaacatctgatcagaaaatgaaatgaaaataaattaacaatttaattacgataggaaaatctaaaaaaggcacaaaactacagtaatcgcttaaaaatggaatcggagcattagcacacaataattattatctcaattgcctgtcgctaacgctttttttttgcctacagcacaaaaatg

SEQ ID NO: 105328 - DNA, 204 bp, Heterodera glycines
  Promoter: Source sequence=SeqID_823; Location=7271..7474; Strand=+; Gene=SeqID_62120
ttgcgcgcaagtgagattttgtgcacattcaagcgcttttatatgtgcgtaggagcaccgtaactttgtctttcacgtagcgcgcatcactgtaccttttcgctatataaaagcacgcaaatatgacgcaaaacttcattttaatcacaagattttttttgcaaaataaaaatgaatacttttaataatgttcagcaaaacatg

SEQ ID NO: 105329 - DNA, 953 bp, Heterodera glycines
  Promoter: Source sequence=SeqID_12786; Location=1..953; Strand=+; Gene=SeqID_76497
ttttgagtttattttttttctgtcggtgaatttttttgctttttacaccgtctttttttctggtatgattttacaaaaaaaaattttggaaaaaggggtccagaggagccgatagacgctgccgcaaaaaattttgaaaatttgagtcttatttgtgcacagattttgtccaaaaaatgaccaaattttgcgaatttgagcaaattttttatgaaataataagtttttgggcccagcggtgccgataggcgccgccgggggtaaaattgaaaatttgagtgcaatttgttaaaattgttaacatattttatccctaaaattagcaaattttaatcggtctaaaaagtcaaaaaacgatgaaaaatgcaatttataggagcgcttgcatttttcaagttaaaaaaaaatcgggtactgaagtgtccattggcaagcgcgcccataatttgcatttttcgcataattgtgcacgttatcaattgattccgatcatttttaaatggttttgagtttgggagctatgagacatatttacccaatttttaagaaaaatgggggttttagtggaaaatttttgaaaatttgttgggatttattaactgattttgcccaaaatacctttatttcgagcgaatttttaaaagaaatttagagttttaatttaaattgggtcatccttgaaactctgctttttgtttgcacttttcgaataatattggtagatcataaactacgcattctttctactgctggaatggaatttgaatatacatctatcattatataatattaaattcgatcaatatgcattaatattgtattttatattttgcttttcatattcattttacattttatagcctcctttaaactaacaaaagcttaccacgaaaatttacaatcaaaattattttaaaataaatttaaaaattaaaaaatatattcgaaaaatg

SEQ ID NO: 105330 - DNA, 1003 bp, Heterodera glycines
  Promoter: Source sequence=SeqID_4169; Location=1067..2069; Strand=-; Gene=SeqID_53441
attttttatcttttaaatgaaaatttttttctcttaattattaaaaagattgaaatttttggcatttccggtcacatttcaaattttttaactttctggaagagatattccaataaaatacagacactaaataaaacaattaaatgtttctgttcctaaacaagcatagaaataaaagacatgtgcgccatttatttgtgcgtttggtaaatatatgcaattttcattaatctcccacccttttgtcacagtcaacaattgggacaacagaatgtaatttgggtttagatttcttttcgcaacagttttttctcctaattaatttatactttgtgccgataaatcacatttatgtaaatcagtcttcatattagcagactatcatgggaaaaataaaaaaatcttttaaatgaaaatttttttctcttaattattaaaaagattgaaatttttggcatttccggtcacatttcaaattttttaactttctggaagagatattccaataaaatacagacactaaataaaacaattaaatgtttctgttcctaaacaagcatagaaataaaagacatgtgcgccatttatttgtgcgtttggtaaatatatgcaattttcattaatctcccacccttttgtcacagtcaacaattgggacaacagaatgtaatttgggtttagatttcttttcgcaacagttttttctcctaattaatttatactttgtgccgataaatcacatttatgtaaatcagtcttcatattagcagactatcatgggaaaaataaaaaaatcttttaaatgaaaatttttttctcttaattattaaaaagattgaaatttttggcatttccggtcacatttcaaattttttaactttctggaagagatattccaataaaatacagacactaaataaaacaattaaatgtttctgttcctaaacaagcatagaaataaaagacatgtgcaccatttatttgtgcgtttggtaaacatatg

SEQ ID NO: 105331 - DNA, 416 bp, Heterodera glycines
  Promoter: Source sequence=SeqID_2529; Location=550..965; Strand=+; Gene=SeqID_80220
aaaaagatttattgcatttttttgcaattaccctgggtcttgtcatgacagttacgtattacggtatttcattacagttgacaaaaaacattgtcttaaatttcaaagctcctcacaattcttctcaagaatggaagaagggggtcttgatgggataatattgggggattctgcttaccctcagaaaaattggttgtttacgccagtaagatttccccgaaatcaaaaagaagaagcatataatgccgcacatgccgtaacacgtgttactatcgaacagtgctttggtatttgcaaaaatcgatggagatgtttaatgaataagtgtaggctccaacccggtataaatttattttttgcttttttcacttttaaattaagaaaaattggcaaaagtagcaacagtttgcagtatg

SEQ ID NO: 105332 - DNA, 349 bp, Heterodera glycines
  Promoter: Source sequence=SeqID_2078; Location=1..349; Strand=+; Gene= SeqID_77717
agcccaaaagccaacaggtccaatttaattaaatttacaatttaaattgtatgtgttaatcaatttaagcttctcaaagaagcgctaaccaaggatgaacatccggaaatgtttgtcacaacagcattggagcgatttgacagcgaaattgtggtaaatattccgtggttaaatttcaaaaaaatatattttaaataaattaaaacatattggaaaataatatttataaataaatttaaatatatatttcaaaaacctaatttctgaataaatttaaataaatttttgaaaaaaatatatataaataaatttaaatgcataatgaaagggtcgtcaaactttgcccatg

SEQ ID NO: 105333 - DNA, 62 bp, Heterodera glycines
  Promoter: Source sequence=SeqID_26303; Location=824..885; Strand=-; Gene=SeqID_57051
gttttttttgtgggggtaaagtgaaaaagtacccaatttttagttctaacatttaaccaatg

SEQ ID NO: 105334 - DNA, 89 bp, Heterodera glycines
  Promoter: Source sequence=SeqID_36264; Location=1..89; Strand=+; Gene= SeqID_65627
ttgccaccatttgtcggctgtttcgcactttaatcatcacattcaaaattgttttgtacggaatgccagaacgttttgccaaaaaaatg

SEQ ID NO: 105335 - DNA, 204 bp, Heterodera glycines
  Promoter: Source sequence=SeqID_11118; Location=948..1151; Strand=-; Gene=SeqID_74460
ttttgcagaccgcggacccataaaagatttgtctcttcaaatatgtgtaggactactgtaattgacaaattccggtcacaaattgggcccaataagccaaattgtatgttcatctttcacttaaaaataaatttagctaatcctcttgttcattcttcaatcctcctcaatcccttccatcccactcatccgatctgatcaatg

SEQ ID NO: 105336 - DNA, 1003 bp, Heterodera glycines
  Promoter: Source sequence=SeqID_11814; Location=2197..3199; Strand=-; Gene=SeqID_75317
tattttctgctgctacacattgtgaaattcaaccagctaaaagcaggaggagtcataatgccataaaataaacaaaaatcgtttttttttctattaaaatgcaaggagatggatcaaattgcagatttatttttgtttggattaatattattatagtaaataatgtttttgttcatctgaagaatgcattggccctcgaaaattgttttaatttttataatttaacattttcttaagtattcgaaaaaggaaatcaaaaataaaattttcgtaaattttctaaatattgacgataattctgtttaacttaatacagtatgccaaataaacattttttgttttgttgttttattacagtatgccaaagagtaatcatataaaaattcattttttggggagttcaaaaaacaaacaaaaattttgtacgccatttaagtagtttacaaaaaatgtttgtttctcaagaatctcacgtatggattattacaaacttagctttaccattcatgacaccactcgaattttccacaaaaattttgagaaagaaaaagcatgaaaaagatttaccgtgtgcaaagcgggccaaacaacaacaagcattgggaaaaacaaacaaaaaaaagaaaacttttgaacattcggcgccaaaagcagaaagccaagggaagagggcagaaagtgtgtggaaaaggtggagattagcagagagagagagaaggagagagacgagagagagagagagaaggaagaaaaaagagggtgagagaaagagagagaggggaggggaagtgacttagggataagagagagggggtgaggagagagagagagagaaagaaaatgaatgagatatacaagaaagaaaaaagagagtgagagaaagagagagagagagaggtgcggggaagtgatttagggacatttagatgggtgggggagagagaatgaaggtgagagtaaagtgttttatcataggcataagacgatgataaaaaacgaaatg

SEQ ID NO: 105337 - DNA, 1003 bp, Heterodera glycines
  Promoter: Source sequence=SeqID_646; Location=501..1503; Strand=-; Gene=SeqID_58007
ttttctggaaagatcggaaaacattatttatttttgtgtataaatttatgttttatttaaaaaatttaccgagaattaaatataccaaaatgaattaatggacaaattgtgaaaaaatggcaaaatgaatcatagaaaattcaacaaaaatgtgaccgcggggccattccctccccgttttttgtcctttttctcattttccatataatttcattattagtgagaatgtacaacagaccacgagaatgtgaaaatgaatgcctagtaataataataatgataataaataccagtttgactgacacttttttgtcatattaaattcgcccgcctttcgccgcaacaatcgccgccccccccccccggcgaatgcgcaaagtgtcgccgctggtgccgccgccccctccccctcaaaacgatttgttggtacagtcaataaacatttggtacaaaaaccgaaccaaccaaaaccatcctcaatcattgattatactcacaaataatatgttgaatgaacgttgcaacatcaaaatatcattaaccttattatccgtgttatgtcatccgtccttaattccaaagaaagtccttgaaaagaatttgccatccaaggacaaaagcagcataaaattacagcttttattctgcggaaggaaagaatctcattaaattacgcattaaagcagtaaaatgaaactttttattttgttctgttcgattatttttgcgttaatgcaattgattttgacagaaaccgaagaaaaggtaaatgtgaaatatatgtattattactaactgaaaagaatgcaaattatcactttttaattttgtgaatcccccacccctttggagtttaaaaaaatgtacaattcacatgcccttaaatactccttaattactaacctaattagcaattcaaattaatccctctctcacccccatttgatcagcaaatcgaagtgtttggagaagagcgcacaaaaagaggagacgaagggaaatg

SEQ ID NO: 105338 - DNA, 221 bp, Heterodera glycines
  Promoter: Source sequence=SeqID_27594; Location=1002..1222; Strand=-; Gene=SeqID_58280
tttaaatgcatagcttttttttctcacagaatcaacaagaatttttccatattcgtggagaaaatcgacgtttgcaggagcaatgccgtcgctttcggcacgaacggaaacggtggacagaatggctaaggaagaagtacggtaattggaaagagagagaaaacggagacaagagagagcagcagacaacgactacagtaacgttggacgggcaacgcatg

SEQ ID NO: 105339 - DNA, 112 bp, Heterodera glycines; identical to SEQ ID NO: 101677
  Promoter: Source sequence=SeqID_324; Location=4546..4657; Strand=+; Gene=SeqID_47479

SEQ ID NO: 105340 - DNA, 550 bp, Heterodera glycines
  Promoter: Source sequence=SeqID_3939; Location=2415..2964; Strand=-; Gene=SeqID_52532
aacagtgaaagagagagatgaattcagcacaaatagacgtgttgctcaaaaggctgcgtgttacaagcggcaagttcattggcgtttatccatcaaacaaaataccgcctgttcttgagaggcagaaacgaatgcggcgctacccccactgcatggttgtaaacacagacaaggagggcacacgcggagagcattgggtggcttgttacgtgccatctgcaacgcaaattgaatactttgacagcctaggtgtggcaccaaatcccgatttatccgcctatctcaacaagtttcagcatgtgcaggtaaacatgcatcaaattcagttcccttcatcggacgcttgcggccatttttgtgtctatttcttggccagtcgttgttccggcaccccgttttgcgacgttgttgaaacattgcgcaaaacgcgtgggatggcggactggttagttaaatggtatgtacgtacactggctcgccatgtataaaaggccgactaaaagtggagaaggtaccacattgtttctttcattgagagaacagaaggatg

SEQ ID NO: 105341 - DNA, 193 bp, Heterodera glycines
  misc_feature (181)..(181): n is a, c, g, or t
  Promoter: Source sequence=SeqID_16702; Location=877..1069; Strand=+; Gene=SeqID_81102
tggcccgccgttccaatggcaatggcaaataaaatcgtggaggaccaatttggcgctgttcttgacaaactgagacacgtcgaagaaaaggaagccaattcgcccgatttactcggtcacttgggtcggcgccatcccctcaaaatgcctttcccccccactcaaaatgcctttccccccnccactcaaaatg

SEQ ID NO: 105342 - DNA, 447 bp, Heterodera glycines
  Promoter: Source sequence=SeqID_22305; Location=816..1262; Strand=-; Gene=SeqID_52980
tttattgtactcacttttaaatatttgtctgatgaaagcttgaatacatattagaaaatatataggcattaaaccggttgaaaaaaaagaattttgccaaagatccatgacatccctatgaatataaatttttttcgaaatacatatccttccaaaattttattttgtttttctatctaatttaataagttttaaactagagtgcagcgggaccgggaaatttgggcaagaccgggaccgggactttttgggttgaaaaaccgggactttttggctgggaaaaccgggaaaaaagccgggaatttcccggtcaaaactggtcaaaaccgggaccttggtactcagttgtactcagttgcccgtgttcaggtcccggtcccgctgcactctactttcatcgtatttctccaatttgctttagtggacctcgccggttgtgcggggatg

SEQ ID NO: 105343 - DNA, 702 bp, Heterodera glycines
  Promoter: Source sequence=SeqID_1884; Location=1..702; Strand=+; Gene= SeqID_76556
cgaaataatgcttgtggggaaagaacgctgaaaatgtggaagggaacgcttaaaaatgggaagggttaatgttcactcccaggtcaaatcgataatccattcctgtgctgggcaggaatggatgcgcacagagaaaagatgagaaaatatccctctctaccctccccacccgctccccacaaaatttgaatttcccctcatctgtcactttggtgaccaatcaaaaaatttttctgtcaaaaattttcccctcccctcgtctgtcacttttgaaatcaatcaaaaaattttcacccccctccccatcggctgtcagtttttaaatcaatcaaatttttccgctcatcaaaaaagaacatgacatttgacacacgccccctcataggtttaggtttccctaattaattaattaattgctcacaccccatcacatatccgagtcggggtcgttttggcgcccacgttttggcgccagggtcgttttggcgccgacgttttggcgccagggtcgttttggcgccgacgttttggcgcccacgttttggcgccaaaatgtagataaagggcgaaattgtatatttttttgttttttcttggagtggggcaaagtctataaaaggagcaccttcctagtagatttagtattttttttattttcattcttcaaataacgcatttttgttttttcttgtttaggaaatg

SEQ ID NO: 105344 - DNA, 1003 bp, Heterodera glycines
  Promoter: Source sequence=SeqID_11454; Location=1253..2255; Strand=-; Gene=SeqID_74850
tgttaaaatcgaccaattcttggtgccgttcgatagctattaacgttctctaatcgaactgctgaatgcaagaaaattttattgcttttcaaaaaagttatagccaaaaatcgtaaaaaattttttacaaacttgatcaaattttttgaaacttggtaggtagataaagaacgttaatagctatagaatgatacaaagaatgtttaatttggtcaactttacaaaagttatgactatttttttgtcgaaaaacagtacgagttgggttttttccctaacaaagacgtcgacgcaaaaaataaataataattaaatattgagtaacaaattttttgattttttaaaaataattttatatcccggcgacgtttagcggcgacttttgtcctcttctccgtttgatatcctgcactattttgccggtttacctcagttcagcccccacgtttgggcctataactttctataacttttttctttgtcatccaaatccaaaatttttggtatcattcaaaagattaatgtgtttagaagctttttctaagcgattgcttcgcgattagacaattaccaaaaaagttatacatgaaaattgcgaaaaagttgaaattttgaagtttttccttaagaacttttttctatgcaagaaaattttgagcgagtccgcttttttcagctttttaattgataaatagtgggttttggcgcaaaatctaataaaaaatttttgaatttcaatatgtaaaatgatttctttaaaaattttctacaaatttttcccatataataaataataattagaaatatatagctcaaactcaaattagtgataaataaaatttgtgaatccattttttgacaaatattttgccaactttccttcccccccctcacccgttacgaattgcaattttcattctggctgttgtacatagttgatcttctcatcaacaatggtgccaatgtgcatcatggcgacccggccggcgtcaccgcgttaatg

SEQ ID NO: 105345 - DNA, 235 bp, Heterodera glycines
  Promoter: Source sequence=SeqID_9504; Location=2317..2551; Strand=-; Gene=SeqID_71662
ttggccataattgaattttttggaagtttttgccatattccatcccaaaaagtatttttaaaattatttattcatttatttattaatagcgaaatttatttcaatttttttatgaaattgtgccgcaataaataagaattcaagtttttaaatctatagatttttgcgatttcaatatgccataccctaaattcaaaaaatttaatgaaaatgatgccaaattgaacaaaaaatg

SEQ ID NO: 105346 - DNA, 316 bp, Heterodera glycines
  Promoter: Source sequence=SeqID_14366; Location=1440..1755; Strand=+; Gene=SeqID_78397
aactgacacaatttgggaccgttcgggtattacaatcctcgagcattttagcacattgacatacagatagactaattaatatatatcaattagcgaatgtttcaagcttttcttccctgccgactcaattcattaatcaatgtttaattaactgtttgtttaatcttaattgcttctgaccagcagataatcagtcaaaaattttccttttaattaaaattggcattttaagcgctaaaagattcaggccaaggaatgttaggtgatcagcaagcaaatccaagccctattttgatcagctgtgatttaagccatg

SEQ ID NO: 105347 - DNA, 473 bp, Heterodera glycines
  Promoter: Source sequence=SeqID_23726; Location=1488..1960; Strand=-; Gene=SeqID_54421
cgaagctgatttttttgcggcgctttttccaaaaaacttttggggcgcaaggggggccggcggcgccgatagtaaggatttttacggtccggcggtgccgatagtaaggatttttacggtccggcggtgccgataggcgccgccgggggaaaaattaagaattttgaccatatttttagtatattttcattaaaaaattctttaaattgccaaacattatgccaatttatcaaaatttaaaagattctgaggattttccccaaaagcctcaaaaatcctcaaaatttctcaaaaagccacaaaaatcctcaaatcctcattttccaaaaaaatcctcattgacctatcaaaaagccacaaaatgaggataaatcctcagatctggcaaccctatattaaaattgtctattcgctctgttagcaaatttaatgcaaaattcaataaattgacataaaaataatgataaaaaatg

SEQ ID NO: 105348 - DNA, 1000 bp, Heterodera glycines
  Promoter: Source sequence=SeqID_16022; Location=1..1000; Strand=+; Gene=SeqID_80378
tttgtttattactagagtagagcgggaccgtgaattcccggtcatccgaggtcccggtcccggattttgaaaagctcaggtcccggtcccggtagggcaaccgggaaccgggaaaaacaagcactggtaagaatgggggtctgagtgcaaaaattagtgagaaaattggagtaaaaggaaaaaatttagaaataataattaaatatattcgataaagtagcacgaccaactgtgcaaatgacctagtggctagtctccttcactttcccttcttctttcccctggttcattccctctacagaaattaaaatatttgaattttctttttgtacactcatggctttcctatcgacaaaatatgattcttaatttttttaattgtattttatcattttttaaagaaaaccgtacaaattgagcctagtaatctcaaaaaccagccttttttttttgttgaaatttgttaacaaatcacactcaaattttcaaaattttcccggcggcgcctatcggcaccgccggacccccttcttccccaaaagttttctggaaaaagcgcgccgaaaaaagtgatgtgaaaagtatgtaaatctgaatttctattaatattcgatcatttaaagtacaaaatgattgttggttgaaattagtttgaaaatttttattaatttaaatagctttaacttttggattttataaaataaaaaccaaaataaaaatttaattatttaatattttcacttgaaataaattaaaatttgaatttttttttaattttttgaatttttaaaaattcccggttggtcccggttcccggtcccgaacaaaaatcgaggtcccgtcccgacttctcaggtcccggcaagtcccggtcccggttttgcccaaaattcccggtcccgctctactcaattaattaccataactttgctcaaaatcaatatcgatcttggtatcattaataactaactgttttttagcctacaaacttcaaataatg

SEQ ID NO: 105349 - DNA, 810 bp, Heterodera glycines
  misc_feature (191)..(191): n is a, c, g, or t
  Promoter: Source sequence=SeqID_41310; Location=500..1309; Strand=-; Gene=SeqID_69464
tttttaggtgttaaaaatcctggaaataggtattaaaatacgttgccaaaaaaagtgcaaaaataggtgctaaaaacgccaaaaaatgccaaaataggtgctaaaaaattggaaaaatccatgtctttatgcacaaaaatccccaaaaatgattcagtttgatcgatttcacccgcacaattgcaacttcnaagataacaaataattaaattttgaagacgaatttttgggaaaatttttaatttcttaggggaatattttctgaaattttggtcaatttttaggggtatatttttaaaattttatggcatcgattaataggggtgtatttttcgtttttgtttgcagttttgctatgaaatttctggaaaaaggccaaaaaggtgctaaaactcgaaaaatgccaaaataggtgctattgaccgaaaatccagttttaggtaattttaggtgctaaaaagtcgctctaaatcgaaaattgttaggagaaaatgctatttttgggcttctctcatcataattaagccgcaaaaaaaataggtaaaaacctaaaaatcccatctctacagatcaccttagcaatttaggagaacttcaaattaaaaaggattttataaatttaggataaaaaattggaaaacaaattgatttcgagtactttttcattgattatttgagaatggttcaaaaattttgaattttggctagcctcctctgaacttaatcgaaatttttcgaattttggcatgcttatagaaaacacctagggctatcgagtgctactaaattcattcaattcggacaactatg

SEQ ID NO: 105350 - DNA, 815 bp, Heterodera glycines
  Promoter: Source sequence=SeqID_7596; Location=1225..2039; Strand=+; Gene=SeqID_46452
ttttttacagattttcactgaaaattggccatttcaaaaataccttatcgtttttaattaattctatacaaaaatatttatgataaaaagaaataaaaaaagtacataaaattattattatgaataataaaatttttaaactaaagtaataaaaaaaatttgactatatagtataaggcaaaaattgaaaaatcccgaccccgaccccgaccttgctgaccccgacgaccccgaaccccgacttttccaaccccgacggtcggggacgcaactctagataaaacggaacggacaaagtctgaattctagcccaaacttagctacctaatttgaaatattatttatttttggcattttgcctaaaattcacgattaaaaaactgttccttctcgtgcctttggcgaaattgaagcccgtttatctcgtcaaaatgaacagggctttgacggaattggccggcaccagggcttccttcgggacaactatgtcttggtggttttccaaaaaaaaacgggaccgggcggccccgtaaaaccctcaggctcgtcaggtcaataccaaaaactgctcttccctctggctatgtttatgcagtggcttattaaacaaaataatttttaaagaaacgctataaatccgagtgcagaagaaattgtttttcgttcattaataattgtgagtcacagacacccaaaatttcaaaaaaaaaacattttttttcttttttactaaattttactaatttttatttcttttttttttgttagatacataaatcaaaaattagcatttgccatttctgccgagcgaaatg

SEQ ID NO: 105351 - DNA, 737 bp, Heterodera glycines
  Promoter: Source sequence=SeqID_894; Location=2608..3344; Strand=+; Gene=SeqID_63419
tcttttggcatttttttcacaattaatgattctgatacgtcattggaagacaaggccttcattggaaacgggcattgttacactaccaagagtatgtccttaaaattgtcaatcgcccgtgggtaattggagaaaaaataaatcatccattcttttttgaacaattttgacacaattgatcactcaaaaatctttttgatcactcggacctctatttgatcacttgaaactcgtttgatcactcgtgaactctttgatcacataatgagagaattggcattatttcaaaacattagacaaccagttgatcaaattacccaggtacgtacatcgccgggctggaacagttcggccagcgtcggagacgggggcggctcctcaatggtcggctgtcggctgacttgcgcgttggcgacaatggcactcgccaacgcttctccatcaccgccgctttccggcggtcggctgctgagcagcgacgcggcgtgcaccggcggcgactgttgttttaagacgcacacgctcgctggcggcactggcgagtgccgcccctccgcgcttgccgcccctgccgcgcgtttatgctggtgcaacaagcgccgcttttggcccgcgtgcaactgctgctgcgtgccgttggacgacgacggccgcgacacggtcatggcgactaccagcggggacgacgaggtcgcgtcgctggtgtccatgcgctcgtcctcgtcgtccagctgatg

SEQ ID NO: 105352 - DNA, 96 bp, Heterodera glycines
  misc_feature (49)..(49): n is a, c, g, or t
  Promoter: Source sequence=SeqID_26874; Location=1087..1182; Strand=-; Gene=SeqID_57619
gtttcagtctgtttatcatttgcgcaggtccgaaaaaacagtctctaanaatatttattaaattgaattatttattttttagaatttctttgaatg

SEQ ID NO: 105353 - DNA, 99 bp, Heterodera glycines
  Promoter: Source sequence=SeqID_5407; Location=120..218; Strand=-; Gene=SeqID_57921
atcagcaaatgctgatcacgaaactaatccgtactccattattcatgaccggggggggggtaggtcagtaatcagtcatgacggattaagaaaagcatg

SEQ ID NO: 105354 - DNA, 83 bp, Heterodera glycines
  Promoter: Source sequence=SeqID_10424; Location=4056..4138; Strand=+; Gene=SeqID_73621
tctggaaattgaatttaaaagtaaattaaatttcaaatctaattttaaaattaaaactttcagccgaattgaatagaaaaatg

SEQ ID NO: 105355 - DNA, 192 bp, Heterodera glycines
  Promoter: Source sequence=SeqID_24722; Location=1..192; Strand=+; Gene=SeqID_55470
cgtgagaaaatcttgacgccgaaatttaaaaaaaattgttccctgaaattttcaagaaaaaaatcttggaaaatttttataataaatatctaattacgcataattggattataaattttagcatccataattcggaatgcgacgcagcaacagctcgcaaatgttggccctgccgcgcaaactgctgacatg

SEQ ID NO: 105356 - DNA, 85 bp, Heterodera glycines
  Promoter: Source sequence=SeqID_11667; Location=3408..3492; Strand=-; Gene=SeqID_46974
ctcgaggacggacgcaccttgggccgactacaacatcttcccggagtccactcttcacctcgtcctgcgccttcgtggagggatg

SEQ ID NO: 105357 - DNA, 70 bp, Heterodera glycines
  Promoter: Source sequence=SeqID_4169; Location=880..949; Strand=+; Gene=SeqID_53442
gggaaaaaaaagggggaaaattaatttttgaaaaactcaaaaatttttctacctcatccgtgaagcgatg

SEQ ID NO: 105358 - DNA, 81 bp, Heterodera glycines
  Promoter: Source sequence=SeqID_22937; Location=273..353; Strand=+; Gene=SeqID_53639
ggtgtataattttaggtttttttttttgaaaaaatatttaagatacaaaatgccgataattactgcttgttttacgcgatg

SEQ ID NO: 105359 - DNA, 94 bp, Heterodera glycines; identical to SEQ ID NO: 97954
  Promoter: Source sequence=SeqID_30566; Location=528..621; Strand=-; Gene=SeqID_60981

SEQ ID NO: 105360 - DNA, 63 bp, Heterodera glycines
  Promoter: Source sequence=SeqID_14895; Location=1894..1956; Strand=-; Gene=SeqID_79058
tgtcgtggcttcggtttttccaaaattcccgccccgtttttctaaatagttttatgcacaatg

SEQ ID NO: 105361 - DNA, 1003 bp, Heterodera glycines
  Promoter: Source sequence=SeqID_8968; Location=435..1437; Strand=+; Gene=SeqID_69844
actccccgccccctcccccctcggccactcgtacgttctacggggaacctgctggccgaccccttatacacttgtgatcataatcagggtccgaactgaaaaaatcagcatttgaccgacaaaaaacagatatgacccctttaaatcagcaaaatgctgataaatcagcagagttgggagccctctgatcataatgaattatggcataaaaattttttttagaaataagttcatttggaagttaaaattaaaaatgaaaagctaaaattaatgtcttttatttcagagaagatatccctttcaaatctcacattcaaggcaatttaaaacttttatcaaattcctttcttacttttttgctagcacttttgtttattaaagaatttttttgtttttttaagcaatgtgccaaacttttaaaaaaaaatttctcagtgacgaactgaacagtgacggaacgatcagtgacgaaatgatcggccaccaaaagaatattttttacaatttttggggttaaaattaaaaaattgataaaaatggggtccggtagtgccgacagtcgccgcctaaatttcaaaattgattttttccttatgagttaatatgtttttgattttaaattgtgtaagaagctttacaaaaaagttgcttttttggggggtattgttctcaattctcattaaaaaaccatttgctgataaatgtcgcttacaaattagtaaaattctgattttcattattctagcagattttggtatcgattatgagtatttaaaaaggtatttatgtgtgaatttctaaaggttgaagatcggcagttttttccaaaagatttgttatgtaattctgataaatctaccaaaaaatatttgtttttgtgccaattaaaaaaggcctgtatctcttacttatgttaatttttacaaatttaactacatatttgaaattgtgtaaacaaaaattatttcatttccccgcagtgacctcctccgtcctgacaatg

SEQ ID NO: 105362 - DNA, 403 bp, Heterodera glycines
  Promoter: Source sequence=SeqID_8409; Location=480..882; Strand=+; Gene=SeqID_67967
aagagaatttaattaattttggattgaattttcaagaaaataaatatttaaaaggcattcctttaatgattcatactatttaaaagtcagcccaaaattgtttttttcatcttggagaatttttttattgttcgaaatttttgactataaattttcatataaatttttcgtaatttatttttaattaataaaataatatttaacattttgtgggccaataaaaatttttgaatttaaattctttaagcttttctcttttttgtttatttaagaatttaacaattttttcttcgaaatttggtaaaagttcttttaaaaattgctttcttggcattttgtctaccgcctctttaaggcccattcgaacgcgatcaccaagctggacaagaccggcaacgacatg

SEQ ID NO: 105363 - DNA, 312 bp, Heterodera glycines
  Promoter: Source sequence=SeqID_3081; Location=3444..3755; Strand=+; Gene=SeqID_83119
acaattgcacgtggatcactggtcactttctgcttccatcgtccaaattgtcgttttcgaatgtttacaatgagtaaaaatatatgaatatatgtaattaattattccgttgctttatttaatccaattatttaatacttttgtccgtatttttcttacaaagacaatttgtcctttttttcttctcttttcgttccctttggtgtgatgagtaatcatccccattctttgtcaattggccaaccacaacaaaaaagtcgtcgacagcgatggtgcggcgacggtccttttctgctgcttacactgacaatg

SEQ ID NO: 105364 - DNA, 109 bp, Heterodera glycines
  Promoter: Source sequence=SeqID_17080; Location=1365..1473; Strand=-; Gene=SeqID_81511
tttctaagcgaatgctaagcaatttgacatcccagaaaacatttgtgatattttcaaatttttatcacgttataactcaagtcctaaactgctgttttcagcaaaaatg

SEQ ID NO: 105365 - DNA, 357 bp, Heterodera glycines
  Promoter: Source sequence=SeqID_21670; Location=1..357; Strand=+; Gene=SeqID_52276
ttttgttagcactgactcatttagcagcttctgaccccctctcccccccccaatttcctccgttttttattcgatgcctatcaaaacgtttaattcggttattccattttatattgactgctcacttttctctataatttcttttaatttggtcttttctttcctttttctaaatgtgcataatttctgtatgtatttgtgttctacttattggacggtggtaaaaacagataaatatattaagggtcattaatttaaaaaggaaacgaaaatgatttaacttaatttattatttattagtaaaaagatattatcaaacgaatgaattaattaaatcaactaattataagcgaaatg

SEQ ID NO: 105366 - DNA, 174 bp, Heterodera glycines
  misc_feature (24)..(24): n is a, c, g, or t
  Promoter: Source sequence=SeqID_7374; Location=1..174; Strand=+; Gene= SeqID_64641
ctcaacttttgatcgtaagtgtgntcgagaattggggatggtcgagatcagaattgaaaaaaaaacaactgcgaattgcagaaattctgtggagttttggagagcgaaaatccgatggatttaaatattttatccctccaaaaaatatttacgcataaaaatcaaataaaaatg

SEQ ID NO: 105367 - DNA, 303 bp, Heterodera glycines
  Promoter: Source sequence=SeqID_28013; Location=1..303; Strand=+; Gene=SeqID_58674
ttaaaaacgggaattttcaagttcactgtgcttgatctttattaagtccaatttcgaactccggacccgaaatttaaagccaaaattgtcgaaattctcattttttttccaaaatcacattttgataaaaatttggattttttacccgtgaaaaaatacaaaacgatcggaaaagcaattaaattttatgtgataccatcaacaaacagtatttatgtttattttaaatttaatttcaaataaattttaaaatgaaaattattaaaaataaaaccaaaattcatagaattaaaaaaaacaatg

SEQ ID NO: 105368 - DNA, 438 bp, Heterodera glycines
  misc_feature (156)..(156): n is a, c, g, or t
  misc_feature (167)..(167): n is a, c, g, or t
  Promoter: Source sequence=SeqID_35859; Location=667..1104; Strand=-; Gene=SeqID_65321
aaatttttgaaaaaaaactatttttcaactattttttactagtgaataaaaatttgttatgaaaaatgcaataaaaagcgaaaaattccccccccttaagaatcgacccgaaatttttcaaaaatgcacccctaacaaatgaaaaatcaatctccnaatatttattnatttattaattatttcttgacaagaatttatgattttaaaaatatttagctcaatactgatttggcctaattttttttactttttgaataaattttgtcattttacatccctaaatttgaaagtttttagcaactatttacccatttttagcaactacttttttgggtcttttagaaactaaaaactaactattttgcagttttttgcaactagaaatataagccctagtaataacatgcactggcgaaataagtattcttaaaaagtatg

SEQ ID NO: 105369 - DNA, 250 bp, Heterodera glycines
  misc_feature (6)..(7): n is a, c, g, or t
  Promoter: Source sequence=SeqID_4466; Location=2692..2941; Strand=-; Gene=SeqID_54543
ctgcannggtctcttttgattatacctaatttactgaattgcttgctgtcaatcgcataaagaaattggtatatattttttattacttttatataaatttttcatagttattacaaaaaaaaacaaagaaataatccatttgattaaataaaaatttaaatatattcactgaactcgggaaaaattatcgaatttggtataaaaattaatttttccattatttttatataggatttttttcaaatttatg

SEQ ID NO: 105370 - DNA, 1003 bp, Heterodera glycines
  Promoter: Source sequence=SeqID_12668; Location=1256..2258; Strand=+; Gene=SeqID_76342
gcttttcaattttttggccttcccccaaagtgtcgtctttttcttccaatatttttccgtttgcttgttaatccgggaagagccatcaattttacgcattataaatgtgtgctgtcggaggaaaatttgttttgctccgccggagggaatttcaatttgcaggcgcaggttttaagtcggaaggaaaaaggcattttgccaacatcatttttgttattcacaaaataattaactttttttcgtccatttttatttttattaatccgccatttattttttggggttattcccccaaatttcttttgtctcatatcaatgcaccgtctcccaattatccatcatccttttttaacaattaagccctaatagccgctaaaactgctgcaccaaagagtgaccattcattgctcggcctccgtcactttccgctaaacatttgccctccccggggcactcactttggccgctgatccctccccccggggcaattcatttcttcaaagtgatgcctcaggggatttttgggccacggacattccccggcggattgaatgaatttttcacctgtcagctcaattagagagggccagccgtcgtcactgtttgctaccatccggccaagcactcactcattcaattcattgtgtgtctgctcagtttgacttggccacaatggccggcggcagtctttctaattgatcagtcactcgctttgtgctgatcagtcattgcttcccaaattgatcaattcgccattgaacaacaaataacatcttatccctttacactgactaaatgccaacggcaaaattcatttttttaagtttttagaatttttatttggcaatttgtccaatgtgataatgtttttccctttctgaattttgcattattccgtttttcagtctttggcaattcgtccgtttttgtctttttttcaattttgggaaatttttgcactttggcattccgtaaattgtttggcattttgccttcccaaatg

SEQ ID NO: 105371 - DNA, 157 bp, Heterodera glycines
  Promoter: Source sequence=SeqID_18851; Location=580..736; Strand=-; Gene=SeqID_83546
tcggaaagagcaatttaaaatttgttttttttgaaaattttatgcgatttgttaacagattttgcaccaaaataatcaattttataaatttttggtttaaaatcacattttttgtttttaaaatcaaaataatgaagaaataagcacaaatagcatg

SEQ ID NO: 105372 - DNA, 580 bp, Heterodera glycines
  misc_feature (90)..(90): n is a, c, g, or t
  misc_feature (150)..(150): n is a, c, g, or t
  misc_feature (211)..(211): n is a, c, g, or t
  misc_feature (216)..(216): n is a, c, g, or t
  Promoter: Source sequence=SeqID_15346; Location=2423..3002; Strand=-; Gene=SeqID_47289
gaatggggacggggaaatgctggcgaaccctgagcccttttttgggcgactcctttattattacgttctgtcatgtctcaaaatgcaccnttcagccaaatcccattttactgaatagtcaaacattttttttgaaaatatattccaaantttgtgtatatatttttttgtattaaaagcatttgctggttcatggaatgacaaaacgtancttanaggcgagagaggaccccccccccccctttcggtcgcaaaaaggataagaattaagaatgattattttttgactccacaattcattgtcaatctctgccccttttttgtataaattgtgatgtttcaatgttccagcattgtctgcagtatcgtcagagatgtgccgaaaattggtttttaatgagaaaaattggtgcatcccttttccgtttttcattgccattttaaatagttattcaaacaaataaatcatgataataatactgactattttatgatgcgttatttactgtaaatgcaaaatttaatttattttggcaaataaattcactgttatattaatttgtgcgttttctttcagatg

SEQ ID NO: 105373 - DNA, 185 bp, Heterodera glycines
  Promoter: Source sequence=SeqID_8502; Location=1..185; Strand=+; Gene= SeqID_68314
cccgttcagggaaaatttttcttctgggtgtcaattaattgaaaaacaaaaataaattctgtttttttttccggcaacgaatcgtttgaacttttaaaaattagatattaaaactgttaacaaaaatttgttgaattataaaaaaattttgtaaataaattttggtcacagaaaaattgattatg

SEQ ID NO: 105374 - DNA, 170 bp, Heterodera glycines
  Promoter: Source sequence=SeqID_6226; Location=1..170; Strand=+; Gene= SeqID_46205
attcaattacgattgtgccgtgggttcgcttgccattgctccctttgccagattaattgttttgattaattttagatatgcgagaattaataaggtagggaaacatttgaagaaaaaatagttaacatgaatgcgttagtgtggaggatgtgctagaagatgaggacatg

SEQ ID NO: 105375 - DNA, 130 bp, Heterodera glycines
  Promoter: Source sequence=SeqID_3057; Location=1..130; Strand=+; Gene= SeqID_82993
ttcctccattatcgattttccatcgccattatttcgccccctataaattcacatttttttttttgctattttatcatttaaaccgcatttcatctctctctcctcttattagatcaaaaacaaaaaaatg

SEQ ID NO: 105376 - DNA, 1003 bp, Heterodera glycines
  misc_feature (5)..(5): n is a, c, g, or t
  Promoter: Source sequence=SeqID_11784; Location=2764..3766; Strand=-; Gene=SeqID_75284
ttttntggcggtattttataagtgtgccatttaaattttgtttcaattctatttcctcatacattttattaatgagttaaaacaccgaaattatatatatgtagcgtatattaaattaacaaacatattaacacagacaatcattagccccaaaattagcgagggatctaaaacccaaaaaacttggcctttttacttatttaaattttttataaattcgtaataacaattccacgtgatatgccataccgtttgtctatcaatctgtttaagaaggatgcttgctgtgttgaataaatttggatctgaaatatttttaacgcgaaaatttgctagacacttgaatacataattaatattccatccaatacatgataaacaagcttttcatcagaatgaatgagaattttcaattagggagacaaatttccttagttttatttgataaaaattggaaaattaatattctggcgacgtcttctcaacttgatcagaatctatataaaacatttcttcattaaaaatgtgatttatttactattttatataatgtttgaaattatgttttttaattatttgctcttttagattttaggccaaattatttcatgaagatttaagaaatttgaaatttcggtgcccacttttattttttttatttttttatcatttttattcaataaaatgaatcgcttaaaagatttttatccgtattttacgtttgctatttgatttattgggtcagcgtttaccgataatttttatggtgtttttcttttatttatttgttaattaatttctatattttgtattaaaaaacatttacgaaaatattaccaaaatatatatattttttaatttaataaaatcttaaattctttatgatcaatattaatttaaaatctaaaaatttaaaaaaaaattaattcatttaatgctctctcgctataatatattattgatatagattaattttaacattttatcgtataatttttagatg

SEQ ID NO: 105377 - DNA, 1003 bp, Heterodera glycines
  Promoter: Source sequence=SeqID_18446; Location=939..1941; Strand=-; Gene=SeqID_83043
gatgggacgcgtaaaatgtgatgggacgcgtaaaatgtgatgggacgtgtaaaatgtgatgggacgcgtaaaatgtgatgggacgcgtaaaatgtgatgggacgcgtaaaatgtgatgggacgcgtaaaatgtgatgggacacgttatggcggacagaaagagcataaaatttgaatcaaaatgcaaaaaagcgcatgtcactgtgcccgaacggccaaaggacttcaatgtgccggaactgccgccacaatcatcaccttactgccagccgatcaggtcaattcgtttgtgatcagaacgcagcaggacgagctcttggggacggtactacaataacagaccactttttttatcgattgatttccaccccaaacctattggcttcaaaagttttgctttcactagaaataaaaagaaaaattgtgtatattaagaggaagtttttatgaatcctttcattcgcatttttaatctgttcttatttcattttttatgcgttcatcacatccttagtttcttaagccataacttttttcttactcaagacatacattcttggtattaatcgaaagttccgaccagtttcgaacccaggaacccaaattcgaacaaaaagtcgaaaatccaaattttcaacttttcgtccgaattcggatccggggttcgaaattagtcaaaatggatgtcagcttcgtgatcaaagaccccccagaaccccaacaaaaacgcttgacgacttttttaaactttggggaacaaactgcactattaccaaaattacaatggggttttccgaatttcagtacttttcgagaatattctggaacaatttacttacataaaacttagactttaagctttcgattaataccaagaatgtatgtcttgagtaagaaaaaagttatggcttaagaaactaagtgtggtcattgattggacgtgtaactgtcgatttagcaaacaactcatcgcacagaacaatttgcaaataaatttctgatg

SEQ ID NO: 105378 - DNA, 791 bp, Heterodera glycines
  Promoter: Source sequence=SeqID_24159; Location=551..1341; Strand=-; Gene=SeqID_54865
ttttaaaagaaaaaaaacataaaagctaaaatttattaatttttttagcgcaaaatcaacaacaaaagcgaaattttcgcttttttgcttatttttgacataatttattaattttaagaaaatttaaatttattcaatattctcgagaaattttggcgaaaaaatgattttttgaaaaatttttcgggttttgggctcaaaaaagctaatttagctgctgggggccgttctaatagaggtttttttgaaaaatgccaaaatatggacataaaatatggaccaaaatgccaaaatatggaaaaatatggaaatatggacataaatcgcgaaatatggaaaatatggatatagaaatccttcctagaagcttcaaaccaagctaaaaacatgtttttcgtgcgtttcaggcctcccacagtccaggaaaaaaatatggatttccatgtaattctattccctaataattagacgacattttcgttgcttttgcccgcttcttctttttctttcgctggtggcgacaatggcctaaaattaagatattttaaatatgatcaaagtgttattctataaattaattcacctaatttttcaggattttttttcgtgactttttggcgatttttatgacttttttagtcgactttttgaagatttttagtgccttaaattcccagccttatgcatcattgattgatttgtactttgctttctcattttaactgtctctttttaagttacataacaacagattttaaagggaaaagtgtgctaattgagcctccaaaatg

SEQ ID NO: 105379 - DNA, 75 bp, Heterodera glycines
  Promoter: Source sequence=SeqID_36826; Location=564..638; Strand=-; Gene=SeqID_66054
ttagaaagcaaacgaatctattcaccagctctcttcagcaaaaccttcgcctctccacatttcgacgacaaaatg

SEQ ID NO: 105380 - DNA, 398 bp, Heterodera glycines
  Promoter: Source sequence=SeqID_3643; Location=6609..7006; Strand=-; Gene=SeqID_51254
atttcgaaaaatttaaaaacaacaagcgttggcattttttcaagttaagttagtcctttacaatggagaaggcctgcaaaatttggagagattatatcgattttagtgcgctaggttcgatgaaactttttaaaatataagcctaatctttttggcctgtttaaaaaggaattaaaaatttttaaaatatttattcatctcccttttgatagaaaaagcatcagagagccttaattaacctgtaaataaagttttgtgtgtttcagagcactttctgaaaaaatacttatgaattaattttgcaaaaaataaataattaatgaaaaagtcagaatttcgaaaaattttaaaaacaacaagcgtggcattttttcaggttaagttagtcctttacaatg

SEQ ID NO: 105381 - DNA, 212 bp, Heterodera glycines
  Promoter: Source sequence=SeqID_1749; Location=1137..1348; Strand=-; Gene=SeqID_75678
tgtttttagtctgtaaaaatgcatttatttattcggcaaaattcgaacaattttaaaatggcaacaaaataccaaattgaatttccatattttggcaatgtgccaaaagaaccgatcggtcaaaatatgtgtgatcgctaaaatgcggttatctttgaaaatggctcagaatctgcttctggcaccggctagctgcatcggcgggtgagatg

SEQ ID NO: 105382 - DNA, 290 bp, Heterodera glycines
  Promoter: Source sequence=SeqID_30959; Location=856..1145; Strand=+; Gene=SeqID_61321
aataaaaaatgaaataaataacccaaacaaatttagaaatattatttttctgtaaaatattaaaaatcgcttaataaaaatgtattattatattaattaatatttgttagcatgatcattattactttctgcgcaattttatttgttttaatttcaccaattttgccatcatttataacaatatgcgtaagaccgcacatattgaattattttgggcaactgatgtgtaaacgcaataacattatgcacatgatttacgaaaatatgcctaaaattgaagatcaaaaatg

SEQ ID NO: 105383 - DNA, 103 bp, Heterodera glycines
  Promoter: Source sequence=SeqID_1466; Location=8606..8708; Strand=-; Gene=SeqID_73721
attgatcggatcatccaatcattgatcagtttgaagaaaatttaaaaagcaattttattatttttcaaaaaattaccatttttacagtaatattgccgaaatg

SEQ ID NO: 105384 - DNA, 1003 bp, Heterodera glycines
  Promoter: Source sequence=SeqID_12853; Location=857..1859; Strand=-; Gene=SeqID_76581
ttgttaaaaatctgtttttttgatcccgaatacacaaaattatgatttgctaattttctcccctaaattgttaaaaatgatcatgggaagtggtgaaacatataatatttgatacatttttgatcgaataaattgtaaaataactgatttgaagcaattttgcgaaatgttcttatttttgatcctaaaatcttattttttggccttgatgttcttattttgaaaaattttcgatccgagccctggtttaaaatgctaaaaataagaaataatgaaacaatatcaaataaaacagacaattggtcacttttggagctggggtggcaaagaaatcaacaaattcagatcagatctttcaagaagtttggcaaactcattagaatttagtaatctcgtctctttaggcaaaagtctatagagacgagaggttcgaataaagaacgaattgtatctagcattggttgagcaatacgctgttcttatagtagagatcggaccggtcggttttttttcggtttttttcggtttttttcggtatttttcggtttcggtttttataccgaaaccgaccgaccgaccctcttgtccgggctctatcttatagtgaattcattttttacaatgtttttggaaaaagaaaaggattcattattttgtaaatttattttacctaaaattatttcatgaaaaagttttaagtctatttttaatctacgactctcaagcgacttttgatcataaatgtttaacaattcagcataattaggtaaatcagcagcataattgttacgtctaaatattactctcaaaaaagttttttggacattctccagtttttctatatcctttttaaataaggattgaaaatcggagatccgaattctaaaattggtctgcaataaatattaaacaaatttacaagtatttgcgtatcaccagttttgattgactttagtatagcgaaagcagatcgtaatgcttttttcgagataatgtcaatatg

SEQ ID NO: 105385 - DNA, 107 bp, Heterodera glycines
  Promoter: Source sequence=SeqID_11667; Location=1285..1391; Strand=+; Gene=SeqID_75131
actaaacaaagttgaaaagacattgaaatgtggaaagtgggggggggggggggggtgggcggtgactgctcctcaccagtccgtggtagtagggcagtttccacatg

SEQ ID NO: 105386 - DNA, 67 bp, Heterodera glycines
  Promoter: Source sequence=SeqID_268; Location=1321..1387; Strand=-; Gene=SeqID_80662
cctggaaccattgttattttgctgaactcctaacatatgttttagaaaatagtgcttgattaatatg

SEQ ID NO: 105387 - DNA, 1003 bp, Heterodera glycines
  Promoter: Source sequence=SeqID_15961; Location=520..1522; Strand=+; Gene=SeqID_80315
atggcaaatttaaaaattaggtgacaaatgtacaacaaacttagtaacattcaacaggacaggttggacataaattaaattgaatttaggagtcaaaatttttaaaaaatccataaaccattaagtttttcaaaaggcacaaaaccgcattttatttttcagcgctatttttactaattacctaataatttaacaaaagctatttggaaattgctttcgcctgctaaatatgtatttaggtatggtttcagtttattttttgtgtaacaaagataccaaacaagagaatttcctgctgtactacataatttggaattttgtatttgtgattttttttttgaaaattaagaaacattacgcaaaagccaaacactgccatttaaaatttaaagcattttccgggtggtggcttatttttgccattgccattggcctttcttcgattcctttcatccttagaatttttcgaatcttttttcaaaaaaaacattgaaattttgtaaaaaaaaaatatttcgcaaattttcgccattttcaatttccttttgtttcccttataaaagtgtcctcttctcccaactttgcctatttaagcagctctcttttctcgctttcccctgtgtccaggccattcattattcattctctttaacgaagtaccacaacaacttctgcatcccagaacattcgttcattcattcatcagtcagtttttgcatgcttttatctttatttcgctaaactgttgtttatgtgttcaattcaattttttggtttattcatctgcgcttttttgttttgagataactttaaagccttaaactgaaagtgctgccaaaaagtggctctaataatttaagcaaaatgccttttttggttatttgtttagtgcataaataaaattgtttcctgaacgcataaatttcagtagagcaacaaacacttaattatattcatttcactgataaaagcctaatcccttcaaaaatttcagttcataatg

SEQ ID NO: 105388 - DNA, 348 bp, Heterodera glycines
  Promoter: Source sequence=SeqID_11317; Location=1..348; Strand=+; Gene=SeqID_74698
atttgcacgcctttcttcgtttttcttgtctcaacacacttccccacccttcgccaaatcattttgcaacgcttttcttccgtttttcttgtctaaacacacttcttactcattttgcaatgtttttttaaacagtgctctctctgtgcgtataatgaatgaataaaatgatatccaggcaaccaaatttattggcataattttgtttcaattttttagtgcatattttacgattttgtgcatatttgatacatctttggcaattttatttgcatatttatgtgcatattaatagcagaatggaatataatttaattgtaattgtttttggcaatttttacagacatg

SEQ ID NO: 105389 - DNA, 966 bp, Heterodera glycines
  Promoter: Source sequence=SeqID_14245; Location=381..1346; Strand=+; Gene=SeqID_78261
tactgacgatgggtgggacccgcccaaagtgccgtccttcgcgaatggtcaatctgaagggcaaacaaacgaaggcaatgagcggacaaaacacagattaactgacagattggcactttcgctgttttattgaaaagtacaaccattttcacttttttgattttgtgccttttaatgaaatatttgctgggacgaagtccgaatagttaaataaacaatttatttaaataaaataatatttctatgaaatgttaatttttcatttttatattaaaacattcggctggcaaaaataagaatgatattatagtatttttaatttaaaaaattgatataatttctaagaattcattgaagaaaaatgcatttttgactttttaatttaaaaatatttttattaatgatttttttttgttaatgcgtaaatgtgttttaatgttaaggttgaaggaaatatttatcacctaatttttcaataattttttttaaataatacataaattctgtatagtgaaacaatgggaattttaggcacaaaaaatcgcaaaataggcacaacaataggcattataaaattgatcctagaagcttcaaatcaagctaatttcattttttgtgcttatctcatgcataattcggacttcgtcatagcgcggatcattccgtccatgcctttttaaatgaccgttttgatcactcgcctgaatcattcgttgcgatacatatccccctcctcctcctcctcctcctccccctcctcctcctcctcctccccctcctcctccgcctcctctttctctttctccttctcctctcctccctccttctgctccttcccctctttcgccttcgctttgtgtctgcgctttaaaatccaacaaaatcatctgttgcgtctcttgtcgccctccgtcctctccgttctctttgtcctccgtttttttctcattattcgtccaataaatg

SEQ ID NO: 105390 - DNA, 446 bp, Heterodera glycines
  Promoter: Source sequence=SeqID_20056; Location=1713..2158; Strand=-; Gene=SeqID_47628
ttgtaacagattcattatgggtaaagtgaggaatgactacgctaggtaaaagcttttcactcccccccccccgaatacaaaaaacaaattttaaaaaatagcaaaatttgaattttgataagcgaaagtttttgggatttgttccttctccccccgccgaaatgggagggactggcaactgttgagtttgcattgggtacatttcattttttagcttctgcttgaattccgtggcactaaatggcaattgatcggttagtaaaattggataatttcagcggcagttaaatcaattatgaagaacccctcctataaatcccccagggagtgcccttctcttccctcctcccccagggagtgcccttctcttccctcctcctccacccagagaatgtcccttcctccgttcagcactctcttacaccacgcttaaatcaatctccatg

SEQ ID NO: 105391 - DNA, 397 bp, Heterodera glycines
  Promoter: Source sequence=SeqID_9997; Location=1..397; Strand=+; Gene= SeqID_73046
aggatctaacgaaattgagaattttgaaaattttagattttctactttttattcgggtccgggtttcgaaattggtcaaaatgatgtcagattcgtgttcaacgaccccgaaagcccttagaaacatattttcagtgacttttaaaaagttaaatattttttcaaaaaggggtcctaccatcggtagtattagccagtttggtgcaaaaatatatggacaaaggaattcgatgaaaaaaaaagtcgtgtaaaatcccaaaaaaaaaaaaatggatgtatgttgccaaaaactctcttcgcacaagttgccattaatttattgatcatgtaaatagacgaacatttcttcattttcaatttcaaaatttaattttagaaaataatttcactaaaaatg

SEQ ID NO: 105392 - DNA, 252 bp, Heterodera glycines
  Promoter: Source sequence=SeqID_26216; Location=980..1231; Strand=+; Gene=SeqID_56969
ttttgtcagattccgtatacggggacctgaatttgtcgaacaaaaatcggcattcaaattttttttgacatttttgtttcatattcgtgatcagcgactaagctcgttgttggagaaatgggcattgcagaacaatacaattgttgaatgattaaatgctatatgcttatttgttagctttttgtcacgattcggtttttttgttaaaactgtcaaatacaaaatttcagggaaaatttttgtataaaaatg

SEQ ID NO: 105393 - DNA, 491 bp, Heterodera glycines
  Promoter: Source sequence=SeqID_3429; Location=1880..2370; Strand=+; Gene=SeqID_84654
ttatgtttgcatatgtatttacgtctatcctgcctttttgattgtttttggtgcacttcataaataaagagaatcagagcctactattcactttgacgggcaaaacagaatatcgaattttctaaagaaatcatccaaaactttgagtattgtcaaggggtagtgtttatcttccgggtatttaactcgacttattcattcagcacatgtacattggtttaccaatcgagtagtgtgtagtaaaattaacaaaggggtagagagaaatgaagtcacatagaaattttttcattccgtcttcaaatccgctcatttatttgttgctcattaacattttagcgatctcgtagcctaatacacttacaactggatggacaacttgacttcgtataaattcataacgttttacattcctctcccgcactttatcatttatttttttcaattagacattaatatacatcttctagatagcgctaattgcaggcatg

SEQ ID NO: 105394 - DNA, 559 bp, Heterodera glycines
  Promoter: Source sequence=SeqID_21975; Location=1..559; Strand=+; Gene=SeqID_52610
accaatatatcgaaatcgttgtttagggtctaaaccacattttaataaaagaaaattaaacatgtatcggatcgggcagggcccggtaccggttttttaccggccccggaaaccggccctgcgatttttgaaaaaaaatccggtttaaccggtttataattttgccacaaattttccatttgctcattttcctttgaaaatgtctttttatggcataaagttcttatttttttgttacaatctgttgtgaaaacttgggcaaagtcaaagtcgaacgtaagaccccttcactgtctcctcccgtgcatacgtattattaaacgaaaagaaaaaacccgaaaatttttaactcatttcattcataattaaaaactgattttttgtaattttatttacctattttggaaaaatgtattcaaaaatttcgaatatagtaaaagaaattgcctaaagaagatttaaatttattcatttttatgcaaattttcatgctcacaaatcagatgaaaatgccaacaaaataaagaaggcaaatccggataactgtgtggatcggatg

SEQ ID NO: 105395 - DNA, 838 bp, Heterodera glycines
  Promoter: Source sequence=SeqID_8119; Location=1..838; Strand=+; Gene= SeqID_67022
ggtaatcattttacaaaaggttaaagcatatatataattctcaataagcactccgtaataaaataaaattttcacaatttaatttttgacatatgtcatttttcggcacttcaaagcaaaatttaacaggatgacaaaaatttggcaaaggctcgtccccgtaatacccgacttttctccaggcaaaattaatccatccattaaaacgttcggcttgaaactggttatggattaacgattgtaatttaataatgttatccctgacgtgcaaatttattttcacatcataaatcattacaaattccgttatttttctggtaaattgcttaaattctaaaactattttttttatttttggcaacaaaactaccggaaaatgtaaacatccaatggttggcatattccagggattaaaaggggaaaataaattttcataagagggaatcgaacctgcgagggcaaaaaggtaaggccggagcacaacctccgcaccaccaagcagcacaaaaaaatgcaaatatttatttaatttattgcgataaaaaaagtttggcacgtcatatctcggcactcagactcatttcgcagaaaataaaaacacttttcttaagaacccatgggtgctctatccacccaccaaatttcattcggaaatcccacggacacccggggaccttcctttgtaagcataatgctgatttaatgctatttaattgctttttaaccacataaatgccaatttaatgcttaaccttttttaaaattgattttgaccagggttttttttaaaagttcttatttaaaaaaaaattctttatagtgccgaatttactcaatg

SEQ ID NO: 105396 - DNA, 637 bp, Heterodera glycines
  Promoter: Source sequence=SeqID_38831; Location=1..637; Strand=+; Gene=SeqID_67546
tttcgcgccagagaaattcgccccaatacgagtcaagcattgggcgatgtgtgccgtgttgttttttcacgccacagtcacatgcgcgctctctatggataatccccttttctgctaggaaatgtgctgcggtaaattcatttgttgttttttgaagagtgttataaaattaaagctcattttattatcaatattgggggaaggatcgggttgggaagaatgaggggaagcacccttaggtaacgcgtattgcgctaatttattcataaaaatggtgggaaagcaaatgccctttcgttattttatgcaatgggaataaagattattacaattctacgcgcccgctgttgattttttaaaaattcaaattttcggcctcaaaacggaaaagtaccaaaaacagatagttagtccaaatgaatatgtgtattaggtcgtttctaattatttgcacccccctagaaatggcataacttttgaattctcacattttcttgctgtaattagcaatcattcaaaagccaagtgggtcagaattaccttgatcagagtttcaaatacataactttgtttgttttattttaaaaaatgtggtttactactatgcaaacaaaacaaaaattgtctttttaagatg

SEQ ID NO: 105397 - DNA, 94 bp, Heterodera glycines
  misc_feature (18)..(18): n is a, c, g, or t
  misc_feature (34)..(34): n is a, c, g, or t
  Promoter: Source sequence=SeqID_20996; Location=1..94; Strand=+; Gene= SeqID_51572
aatgattttattaaatanttaggaataatatttntttcctataattaaaaataattaataagaaaataatttagacaacggtgaatggaaaatg

SEQ ID NO: 105398 - DNA, 1003 bp, Heterodera glycines
  Promoter: Source sequence=SeqID_3452; Location=2684..3686; Strand=-; Gene=SeqID_84731
ttttttgaggcatataaatgaataaaaatgaattttctctgattaaaaaactgaaagaaaatcctacctctattgattaacgaataaaataaggaaattctacttaattgcaaagaaaaattaataaaaatattaataattttatttccacttaccaataaattgcaaattgttaaaataatgtttaaatgcttattcgaaagtcgtaaaatttttaagaaaaaataaaatttaaatttaaaccaaagtcagttacggacaactgaaaatttggatgggtttttgcacacccttcaagccaaataaagcctggaactgtcgctgaaattttacaattttatcgtaatattttttgaggcatataaatgaataaaaatgaatttttctgattaaaaattgaaaaagatcttatttctattgattaacaaataaaagaaggaaatcctacttaattgcaaagaaataataataattttattcatattttattctattaaattaattcattacgtgtaattaactaattaacaacttgtggactccatgggctacgaaatcagaaattttacaaagctatgcataagcattcaaaattgttcaattaaggtgctcatttaaaaaaaaagtaaattttcttaatttatgaataagttttattgaaaattgcttgtttttattgtcattttgaacaattattggtacctttttatacctattttatccgcaaattaatggataaattattgcgaaacccttgaaaattagtcaaaaaaggagtgttttaaatgggaaaaatgtaattttgagaagatccatcagaaaaacgaatgctttttcgcaatttaaaacgataaataatcaaaaatccaacatatttttatttttctatacaaatccatttttttaattaaaaactatttttcaaactaatacattttttggttatattaaatttggtccttttttgataaaattatttttataaaatgaaagttccagcatg

SEQ ID NO: 105399 - DNA, 288 bp, Heterodera glycines
  Promoter: Source sequence=SeqID_37965; Location=401..688; Strand=-; Gene=SeqID_66928
ttttcattaaacggggataaacgcggtcataaaattgcttgaaaaccgacggttgaagaaatttgaaaaaagccctcgtgttggcgcattttgttgatttgattttgtcctcgtgtgggactgtacaacttctgctcgccaattgtttaaaagtactcgttttgtactgagccgcagcaacaaaacgaacaccaaaacacacaaagaccgcataacaccgctaacaccgaaaatgttcttgaaaattctgttgttgatggaaaaattttaaggacgaacggaaatatg

SEQ ID NO: 105400 - DNA, 607 bp, Heterodera glycines
  Promoter: Source sequence=SeqID_6848; Location=1052..1658; Strand=-; Gene=SeqID_63095
gcttaattagaaccaattaggactgtttccgattaattgtgtgccattcatacatgtacaaggggtgtctcagcccaagggctgtcgccaaagcgactaagaaagtggagaaaaagaagaaatgagggaaaaagagagagagagagagagaaatggaaggaaattgaggaagagaaatttaattgagttaatttggataattttgaataattgtgattttttatattcctgtgatgtgatttctgtgcttagtattagtcactcttttttgttgtttgtcgctctgctaaaattgctccacctacgctttctctctccatataagcatccgcgttttctcacatctttatattatatttattcttttttttctattcagccacactctttttctttgcgtaggcgccgccgggaaaatttttttgaattttgtatgtttcgctaaggaaattttccctcttcgttacgaccacactccgcgacgaccccccccccctacgacgaacgaggggggggggggggggtgtctcgagacaccccttgtatatgtatgattgaaatttgcttttgcagctacacgccgttttgcgacagtcgcaagtccatg

SEQ ID NO: 105401 - DNA, 296 bp, Heterodera glycines
  misc_feature (77)..(77): n is a, c, g, or t
  misc_feature (133)..(133): n is a, c, g, or t
  Promoter: Source sequence=SeqID_18077; Location=1253..1548; Strand=-; Gene=SeqID_82663
tagaacttgtcaaaagctatcaaaataaagaaattaagacattaaaaaaacttcatgagcaataaaattttttttgnatcagtaggataaaaatgtttatttaatcgtggaattactttattttttatttatntacaatcttcttaaaattatttattctaagaatataattattatgtgtatatatatatatatatgtatttgccatgaataatattctgtcaaatcaaaataataaattcatttttaatgttttaaattttattttatttaagaaataactcatctttaaaatg

SEQ ID NO: 105402 - DNA, 144 bp, Heterodera glycines
  Promoter: Source sequence=SeqID_4577; Location=3082..3225; Strand=-; Gene=SeqID_54963
tgtgttgattatgctgttatcaaaaaagtttatataatcaaataaataattattttcaaagcatttatttgatttacttggcttttttgagtggagttcaaatgaatggcgatagtttaataaaaaaaaggaaaagctcaaatg

SEQ ID NO: 105403 - DNA, 171 bp, Heterodera glycines
  Promoter: Source sequence=SeqID_6628; Location=6060..6230; Strand=-; Gene=SeqID_62261
gacgcagcgccaatgacattcatactgccaaatcaccacaaaatcggcagatattaagcatttaataataaaaatagttataataaataaataaataataagaacttatgttttattaattcctaatttaaattccgcggaaactttaccgaaattcgaaagtaatgaatg

SEQ ID NO: 105404 - DNA, 59 bp, Heterodera glycines
  Promoter: Source sequence=SeqID_41554; Location=716..774; Strand=-; Gene=SeqID_69642
ggtaaattctgaatttcaattatttttattttgatttatttttcaatttttagccaatg

SEQ ID NO: 105405 - DNA, 76 bp, Heterodera glycines
  Promoter: Source sequence=SeqID_34169; Location=1..76; Strand=+; Gene= SeqID_64031
aaatcatatattaatgggattttacaaaaaaaaaatatttatttatgtagatttttagtgaaaatgccaaaatatg

SEQ ID NO: 105406 - DNA, 53 bp, Heterodera glycines
  misc_feature (40)..(40): n is a, c, g, or t
  Promoter: Source sequence=SeqID_22979; Location=1606..1658; Strand=-; Gene=SeqID_53682
caagcaatcgccctgctgaacaattcgatgaacaaccgcntttgattcagatg

SEQ ID NO: 105407 - DNA, 502 bp, Heterodera glycines
  Promoter: Source sequence=SeqID_38932; Location=1155..1656; Strand=-; Gene=SeqID_67624
tcattttgaagatagaaattctaaaaaagtataaaagctccagattttctctattttaatgctttttgcactttaattgattcatttagaagtgaattatgaattttcaaacattcgcctaaatttccaagggccaaaaaatgaaaaatcttttcaattcaaaaatttcagattaagatttaaattgtaccattatgcaaaagccaaaaattttgagaatttatacagggaaaggggttgaacaataaaagccccccctcgattggacccccccccccctcgaatataagccccctttggaggggggttgaacaatagaagccccggggcttataatcgaagaaatacgatatatgtagtgttttcaaaaaatgttatcacaattttcttgcattttctttatatttttttttggcaacggtttgtcctgctccgattcaaataatataaaataatttttactgttttcgaatccaaattctcctaggctgtggcgggaatg

SEQ ID NO: 105408 - DNA, 760 bp, Heterodera glycines
  Promoter: Source sequence=SeqID_25468; Location=583..1342; Strand=-; Gene=SeqID_56199
tttagtgactaaaaatcccgaaatagttaactaaaatagtgtcgaaaaagtgccaaaaaagtgacaaaatagtgaaaaaagtccgaaatagtgacgaatagtgacataatttttagccaaaaattgagcaaaaaataattattcactgattgcagttgcaaatgagctacattttctttataaaattctcttaacaaatattgacattttttaaatcaaaaattttgtcaagaaaaaaaatttgggggaagaatttttgaaaaaattttccaattcttagtggtgtatttttaaaaaaaattttggtcgattcttaggggtgtatttttttgaaatttttttaaatggattcttaggggtgtattttttgattttattgcatttttgttaaggaattttccaaaaatgttgaaatagtgaaaaaatagtgacaaaacgccaaaaaagtgaattttcactattttaagtgacaaaacagcaaaatactgatttctagtgacgaaaaatgacatccaaatgaaaaaaaaaatttttttgagctcctttcttcaaaacaattgagcaaaaaaaaaaattttttcactagaaatcgcggccctacatattactaatctttaaatatgctttttaatgttttgacaaaattaggtttttaataactacaaaggaaccaacatcaagtaattaaaacaaaacgaaacaatgcggagttggagcatgatggtgcattgacggtgccttattttgacccgaacgaatg

SEQ ID NO: 105409 - DNA, 405 bp, Heterodera glycines
  Promoter: Source sequence=SeqID_9701; Location=1472..1876; Strand=+; Gene=SeqID_72404
actttaaagcacataaaattttttgggtcaaatgaaatcttctcaaaagtctgggaagaagcaataaacaaatggccgaaaaatcaatcttttgagttttttggccagaacttttttattcagagctaattttttgaattttattgattaatcgggactatcaagcgctttaaaatataccaagcttatttaatttaaatgacaaataaaaatgttatagcgtgccgaaatggctggcgccaaagtgggtggttcccaaaaaaggcccctccaataaattcaattcataaatttcttccgcaccctccctccctgtttcgttagcatttcataaattttggttagacctccaaccaaaaaaaaaaaaatatccgagggccaagcattgggctggtggtgtgtatg

SEQ ID NO: 105410 - DNA, 430 bp, Heterodera glycines
  Promoter: Source sequence=SeqID_30262; Location=1430..1859; Strand=-; Gene=SeqID_60684
agcaaaaaattgaaaaataattatttaatgacagaattgtccgatttggcacgccgttgtgccaaaacatgcgcattttgttgcgaaacgccgcagttcaattgcgtggacagcggcggcacggtgattgactgcgcgacgcataagaccaaatgcaaagagccgagttggagaagggtaattaatgtgctaattaggagtatcttattagtaggcactcttttttgactgacaaccgagtttcgggtcccaaaattggtctttaccagaaggaaatccgtttttaaaaaatttgtcttcttctactctctatgaatataaattgcccgttaattatttcattttaattgcccgttaattgttttattatttgattatccctttaattaattaaccaaatgccgttctctccctgatttgtcaggtgatg

SEQ ID NO: 105411 - DNA, 1003 bp, Heterodera glycines
  Promoter: Source sequence=SeqID_15961; Location=383..1385; Strand=-; Gene=SeqID_80316
attttgcttaaattattagagccactttttggcagcactttcagtttaaggctttaaagttatctcaaaacaaaaaagcgcagatgaataaaccaaaaaattgaattgaacacataaacaacagtttagcgaaataaagataaaagcatgcaaaaactgactgatgaatgaatgaacgaatgttctgggatgcagaagttgttgtggtacttcgttaaagagaatgaataatgaatggcctggacacaggggaaagcgagaaaagagagctgcttaaataggcaaagttgggagaagaggacacttttataagggaaacaaaaggaaattgaaaatggcgaaaatttgcgaaatattttttttttacaaaatttcaatgttttttttgaaaaaagattcgaaaaattctaaggatgaaaggaatcgaagaaaggccaatggcaatggcaaaaataagccaccacccggaaaatgctttaaattttaaatggcagtgtttggcttttgcgtaatgtttcttaattttcaaaaaaaaaatcacaaatacaaaattccaaattatgtagtacagcaggaaattctcttgtttggtatctttgttacacaaaaaataaactgaaaccatacctaaatacatatttagcaggcgaaagcaatttccaaatagcttttgttaaattattaggtaattagtaaaaatagcgctgaaaaataaaatgcggttttgtgccttttgaaaaacttaatggtttatggattttttaaaaattttgactcctaaattcaatttaatttatgtccaacctgtcctgttgaatgttactaagtttgttgtacatttgtcacctaatttttaaatttgccattttagagaaatattattcaatttgataaacaaattattaagccatcatccatccaatcgctcgtaaaacacactctttgttgctatcatctttatcattttcatctcaattgttttcgccatttgtccattggaatg

SEQ ID NO: 105412 - DNA, 184 bp, Heterodera glycines
  Promoter: Source sequence=SeqID_17876; Location=2272..2455; Strand=-; Gene=SeqID_82424
tcggtaattaccataacaattacccttaatggataacactcatttgctaatcgtttcttttgcactaattgttttgtttctccatgctccccattttgttcctttttacgcttttccccttgtcagaatcggtgtccaagtggtgtctccgtcctttggcattcagtccgtcggctggggaatg

SEQ ID NO: 105413 - DNA, 1003 bp, Heterodera glycines
  Promoter: Source sequence=SeqID_215; Location=229..1231; Strand=+; Gene=SeqID_77990
atattcgtttaaatatttttttcggtttattggattcaagactgtaagcatcaaaggaagaagaaattgaattcccaagtgccaactaaggaagcagaaaattaggaaaattacaatttgaaattaaaatgtacactatattttcaataataattatataaatcatatattcatcaaatattttggtgtcagatcgatttgaaaaataaatatattagttatttttaaattattaataataaataaatagatttttcaaaatgaaagtggatgcgataaaagagtgaaatacaaagctatccaattaaataaaaaataatttccaagtaactacaaaatttaaaataaaattattttatgtcaagaaaaaagttcactaatatgacaaagaaaatgaaaatttaatttaaatacaaaataaaattcatttagtttgaaaaataaaatagtcataaaaacttaattcatatcttatttgaaaaaagccataattgaaaaatataagttcagagaaaacaaaaatagaatgaaaacttctttatttgaacataaaaataaaagaacttacaattagatggcattttggataatttgctttaattattttaaaaggaatttacattgttcaataaaatgataatttttcttatttattctagaaaacatgaaattttacttaaaatgttattaaagatactaataaaatatattacatcaacttaaaaaaatcaaaaaattcgaccaaaatcagaaaatatgacatttgctttattaaaaactataagacaaatgcaaataaaatggtgtgtaaaaacataaaaaatagtgtaatgtaggcattaactcgggataaaaccgattgcattgcacgtgatttgaattaaattgcatcttgacaactaaagtattaaacgaaaaagaaactataacacaatttatctgaattttcaaattaaaatatttgtgtttataaattttgctttttttagaccctataaatatg

SEQ ID NO: 105414 - DNA, 120 bp, Heterodera glycines
  Promoter: Source sequence=SeqID_39104; Location=1..120; Strand=+; Gene=SeqID_67748
aaattttaaaaaaaattttcaaaaaaatcgctggaagttttttatttttttcccttgaattttctaagaataatttttaaagattttttcatgaaatttttttaaattttttccaggatg

SEQ ID NO: 105415 - DNA, 932 bp, Heterodera glycines
  Promoter: Source sequence=SeqID_3781; Location=2748..3679; Strand=-; Gene=SeqID_51853
tacgaatgtctgaaaatatcaaatccatgccttttttatattaaaactaaaattggaactgaataagcagaaagggtagaaaaatacgcaataaatatgcatatatcctcaaagaggcattaaaaatagaccgaaaatttcgatttcaaattttacaagattgtaaaagctgattttcttattattttgtattgtcagatatagcttttttctttggcatccaaatctaacaatcttggtatcattcgaaatgctttattagccttaaccaaaagcgaaaagattttcaaacttagaaaactcttattaataaaaaaacttcaaaaatttcgactttttgcaattttcatgtataacttttttggtaattgtctaacggcgaatcaatagcttagaaaaagcttctaaacatgttagctttcgaatgatatcaacaatgttggatttggatgacaaagaaaaaagctatagtggaaaaacatgctggcgccgaaacgagcgcgccgaaacgcagtggaccccataaatgatacagcatgcaaattttaaaaacttaaaaaaaccgaattttttcaaacttgaaaacacgcatatttttgcaaaaattttgaagtataaaatctatgaaattttatagactattagcgcttatgttttggtaaatttttccctggtggcatctttcaccgtctccgggcctaaatccttaatttacttcaaatatttactcaaaactctaattactaaatggatataaaatttaaatgcttttttgtaatctaaaaaaaattttttttttctttttataaaatttcgaaatcaattcgtcctttctcaacagaaatattcttacattaattgattttttctctccatcaactttattttaatatattatattcatattagcttctcttttttttagcaaaatg

SEQ ID NO: 105416 - DNA, 542 bp, Heterodera glycines
  Promoter: Source sequence=SeqID_42693; Location=365..906; Strand=-; Gene=SeqID_70520
tgattcaatgcagaaaatttatccaaataatggaaaaaatttccattgtttatcaaattgaaaaaaaatatttttagtttttttactattaatttttggagaaatttattagaaaaaaagtggcagaaatttttgcttttttagataagaggagcaattaattgttcttaagaagacaaaattatttagaccaaaaaactcgttatttagctatttcttgaaataaaataaaaattacaattttttaaaataattttatttcgccttcgtaaaaactcacagccttattaaataaaaattgtcatatgaaaaaggaattagcatttaaaataaagcacaaatttatgaaaaatatgtggatcacaacaaatgattaaaacatattaaggaaaatttgtaatataaaataaaattttccatttttgattaatccccatgatttggggtgtaatcaaggatgtagcaacaaaaatatttttttgtgaatggtgccgtcaggaaaattttaaattagttttttagaatttttcagaatccatatg

SEQ ID NO: 105417 - DNA, 221 bp, Heterodera glycines
  Promoter: Source sequence=SeqID_14200; Location=1..221; Strand=+; Gene=SeqID_78214
aaaaaccctaaaacggctgaagagagtattaaaagactgtattaaaagaaaaaaaagtgaaataagctaaattactattaatttttctcgaaaacaacctaaaaaatgagcaagatatttgaatttcggcgacccaaaacagaagatattttctaaaaatcccttccattcttcagctttccaattacaattttatttcttcaaaatgtctttctcacatg

SEQ ID NO: 105418 - DNA, 176 bp, Heterodera glycines
  Promoter: Source sequence=SeqID_8349; Location=604..779; Strand=-; Gene=SeqID_67765
tttttggtcataacttttctgaaacttaataaatttttttgaaattttgcagaataatagaaaacacttagcgctaacgaatgacaacaagattttaaaatttcgttgcctttgagcaaagttatatgaaaaaatcttttcatttgatggttttttgactaacacccattttgatg

SEQ ID NO: 105419 - DNA, 51 bp, Heterodera glycines
  Promoter: Source sequence=SeqID_30577; Location=1506..1556; Strand=-; Gene=SeqID_60986
tgaaaaaaatcgatttttttgtttcataaatatttttttcagaaagtcatg

SEQ ID NO: 105420 - DNA, 197 bp, Heterodera glycines
  Promoter: Source sequence=SeqID_8767; Location=1712..1908; Strand=-; Gene=SeqID_69156
tttttgttggtaaaattaagaatgatttgcgaaatcgtgtggaagttcaaaagcgtgccgattttatatgttttcattcgactaggctccgcccacttttcgacagttcgaagctccgcccatttttcgcttcccaaccttcacctacccaaaatcaggattcatttgcaaaattttcaaaaaattctatcgaaatg

SEQ ID NO: 105421 - DNA, 283 bp, Heterodera glycines
  misc_feature (76)..(76): n is a, c, g, or t
  misc_feature (126)..(126): n is a, c, g, or t
  misc_feature (148)..(148): n is a, c, g, or t
  Promoter: Source sequence=SeqID_3228; Location=1..283; Strand=+; Gene= SeqID_83783
ggcaaatatatatgacaaattcaaattttattttttatgttttcttcagcaatatctatcgaaaaattgtaaattntaataattcaaaatgatttcagaaattgctattgaactattcattaatcncaaaaaatgctcttgtaaattntgattaagtataattttagtgcttatatgtggaaaattttgtttaaaaaataaaaatcaataaagttaaattttatgggagattttatgaggaggcgcacgcggccaaattgtatatggcgtagcaagaggaatg

SEQ ID NO: 105422 - DNA, 85 bp, Heterodera glycines
  misc_feature (16)..(16): n is a, c, g, or t
  misc_feature (35)..(35): n is a, c, g, or t
  Promoter: Source sequence=SeqID_41149; Location=1257..1341; Strand=-; Gene=SeqID_69342
tgagaatgagttgctnatttatcaggcaagagatnaatcccattagaaaagtcttaaggagtttagagttgataatgtaaaaatg

SEQ ID NO: 105423 - DNA, 280 bp, Heterodera glycines
  misc_feature (50)..(50): n is a, c, g, or t
  misc_feature (65)..(65): n is a, c, g, or t
  misc_feature (101)..(101): n is a, c, g, or t
  misc_feature (121)..(121): n is a, c, g, or t
  Promoter: Source sequence=SeqID_45117; Location=1..280; Strand=+; Gene=SeqID_72483
atagataataaataatgtaatattagatttaattgaattgttcatgttantaaaaaatcaaattngagcattgactaataatcatttaattattatgactntaattaatagattttaaatntaaaatcttgtaatgttaaaaaataactaactttattttcaaaaattttacaaaaatattaatatattcacaaaaagtattgaattagaatttttttatttgttagaaattattaatcactttttaatgtttgatgaataattctaaatctaaatcatg

SEQ ID NO: 105424 - DNA, 1003 bp, Heterodera glycines
  Promoter: Source sequence=SeqID_10211; Location=1090..2092; Strand=-; Gene=SeqID_73335
gtccggggatagaaatgggttgtaggtttcgtgatcagctaccccgaaaatctcttaatttagtgttttttatttgaaaatgaaaaaaatgtaaaaaaatgtgggatctgaacggaataagagccaatcatacgcattagtaaactattcaaatgatagtccttttttatcaatacttttggattaagttttcgtgtaaatctaacgaattcaatgcaattttcaatgccatcaaaaattagaaaccaaaaaccagtttttttttttttgaagttcagaccaattttatttactgaattcataggtttaaatcttaaatgtatttgattcgtctaaaaccttttttctgagttggcttttgcgacaactttttgtcgcatgcgattgactaataatcgcaaatttattttatatagaatttaaaacaataaatagcgtaaaataatatcaaaattaaaaaaaaaaagttaagtattcctccagaatttcatttcattcatgtatatagaattaaaaattatacttttatacatacataatatgattttcttttcatttttacctaattaggtgtactcatttaaccgggcatttgcaatgtaaacgctaaattgtacatacataaaaaagcgaaaaaataaaaatgtttattcatttaaaaaataaaagaaaagtgttttttgagggcaatatatgtagcttaagaagaacaaatgtttatgcatttcgtagttttgacttttgcatgttaaattacgcaagctttgaaattccaaaaaaagccatttaaatttaaacagaaaacacaattaaggaattccaattttgtttatttgtttgacaattgtcttacaaaaatatcctgaaatattaggtaagaccttcaaccatgtattaatacataacaattttcttttttgacagattaaattttattataaaatttcaatacttttgcttcgtcttatttttgtcagtgtttttgttcaccaacagtgaaatg

SEQ ID NO: 105425 - DNA, 669 bp, Heterodera glycines
  Promoter: Source sequence=SeqID_108; Location=9374..10042; Strand=-; Gene=SeqID_70626
actgacgggttccggggggggggggactatatttttcaaccacctcaaaagaggggctttttcagcgctctaatttaaggggaaggggttgtattttaaaaaattacagtattatgttttgtttttttggtgtaaacgctcatacgaaaacggccgcatgaaaacagttgcagaaaatgttaaggcccgtctcttacattgtcttacattgcctggtaaaatttaaattaacgcccaaaaaggtggcgttttgtattcaaaaaatttactgaaaaaaagttagttcgtcatttctgtttctcatctttagaataattttagtattacctcggtctatcggaggtgtgtactttgtctgtacctagttttttttaatgggaaaatatttttgttccacataggttattcgtccgaataagacccaattcacacgtttaggtcacaatttttgaatggtaacaatttttaagggtcaaaacccaaaaaataagtacccaattatcagaaatttagctgttattgttgcatcatatctataaagagaccattgtcggggcttttaaggcatatgtacatttataacaaaaataaacgatatgtataattaacacatttttaaaaattttatttctcagatttcttgattcaattacgctgatcaaaaaaatg

SEQ ID NO: 105426 - DNA, 147 bp, Heterodera glycines
  misc_feature (42)..(42): n is a, c, g, or t
  Promoter: Source sequence=SeqID_6292; Location=1..147; Strand=+; Gene= SeqID_61040
aaaaaatttccaatctgaaattgacaagaaaaaagaaaacanttgggctttaaaattattgtagaacgagaaaaaaaatgtcaacaaaaaccacacattgacgagcaattcagtgctgccggtccaattgctgtgcttgcaattatg

SEQ ID NO: 105427 - DNA, 1002 bp, Heterodera glycines
  Promoter: Source sequence=SeqID_18559; Location=237..1238; Strand=+; Gene=SeqID_83187
accatggggatatgattggtctatggatgctcttaagtgatattcttctattttatttcacattttttgttaaaataattattaaatattattattcaacaattcttttgtttttattataattgcttaatttaattatgaatggttggttagttttgctgactatttaattattttaatacattttaaaaagttttgttttttcattgatcaaaaaagttatgtggccaaaaatatccaaaaaaacaaggggttttttgtgttccttagtcataaccttttttaaacaacaaaattttttgaaattttgcaaactgatagagaacactttgggctatcagatgatatcaacaattaaaaattggttgattttgagcaaaattataaataatttttcatcaaaaattttcatattgatggttttttaattaacgccctttatttatgatgttttttgttatattattttttaaccaatttaatgtatatggtgaaggaaaaaaatcttgagttaataatttcgagacggagagcatataattacaaattagcatatgatataatatggattaaatttattaataaaaataaaaaccatttattttttattatttttatcaattttttttttgtcacattttccgttcgtttcgttttccatgtgattgcatttgttatcgccagcagaaacaatgaaaacaaactacgaatatattcttgcccagcagcaagtttaagctacagcagcacacaacattatttcgcgcatttcggatgatcaatcaaagaaagaaatcgttgtttaatctttttcattaatgttgtggctattaatggcggacattactaattacctaatattgtaatattttcaaacaaaaactatgaaaagataaacgaaaatcaatttaaaagggaattaatgccatgtgaataattcattcattaatacattaataatatttgaaaatcacttctctcttaatcctcttctcaaaaatg

SEQ ID NO: 105428 - DNA, 159 bp, Heterodera glycines
  Promoter: Source sequence=SeqID_20327; Location=2304..2462; Strand=+; Gene=SeqID_50840
agaaaagtgtcattcccattgctaacttattaattcgttttcgatctctaaaatcctactttttcacttttaatctacaattgaggtcttttatctcccaaatatctgcgtgataaatggatttaaatgattgcttttcaattctaaaggccaaacatg

SEQ ID NO: 105429 - DNA, 125 bp, Heterodera glycines
  Promoter: Source sequence=SeqID_40834; Location=1149..1273; Strand=-; Gene=SeqID_69080
aaataaataaataaaatttagttttgccaaatccgctattgtttgagcttttcacttattatttatattattattattttttattctcatttcagataattaaaattggcaataaaccacaaatg

SEQ ID NO: 105430 - DNA, 385 bp, Heterodera glycines
  misc_feature (90)..(90): n is a, c, g, or t
  misc_feature (128)..(128): n is a, c, g, or t
  Promoter: Source sequence=SeqID_23738; Location=1109..1493; Strand=-; Gene=SeqID_54429
gaaattttttgacatttttttcaattttacaaaaaaaaatttatttcgtaaaaaaatttcaatataatttttttttaacaacggcttttngagggggaatcccattgggttttctgttgttgttgttntgaggctggcttcaatgtcagataataccgatgctggaggcgcacattttctaacatatttttttgctttaaaagagcatggaaaagggtccctgggattttcttgcaaaaaacaatcccggacaccgaatttgaacaaattcgaaaatgcaaaaatcacatttcgggtacaaatttctcattcgtacaatttttgagtttttgccacttctgagaataaattttcgttaattttttttctagggtaaaaaaaaatg

SEQ ID NO: 105431 - DNA, 351 bp, Heterodera glycines
  Promoter: Source sequence=SeqID_2508; Location=1522..1872; Strand=+; Gene=SeqID_80126
aacttggaagaatttaacggcgagcatttcaaatgcctggatgccgcacaagcggagagtggaagattcaaaggttgattaatttcttcgagcaattaaacaagttacatttttgttttcatttaagcctaccgttttcttggacgctttatgctggactacatttggaatgccgactaccccgaagctgttttgaagagcctctttttgatgtgcctgtcatactctttgaagggtgcttcggccatgaacatcacggcaaaccatctgattttcctcttaacatcacggcatcttgactacgaaatagcagtgcacttcaaaaacttcaagaaaattgatgacaaaatg

SEQ ID NO: 105432 - DNA, 93 bp, Heterodera glycines
  Promoter: Source sequence=SeqID_28572; Location=905..997; Strand=-; Gene=SeqID_59176
ggacagagaaaggcaacgggaccaaaaggcaagaccccttttccaaaactcgacaacgactttttctgtccttcagattttcccccgccaatg

SEQ ID NO: 105433 - DNA, 981 bp, Heterodera glycines
  Promoter: Source sequence=SeqID_2325; Location=3240..4220; Strand=+; Gene=SeqID_79137
ggtttatttttcattttttgcacatcaaactcaaaaacgatactgcaaaaaagaaacacgggccataagtatattcaaaatttggaaatttttccattttctgcccatcatttttgaaacttttgacttttgtcatgcctaccataacatgccgagtataaaatcttacggatttgtaagaaacaacccccccccccccgcgttaaggcattcacatcatcaacattcgcaaaacgtgggagaaactgttgttcgccgcccgtgccatcgcggccattgaaaaggttctaaaatttgaattttcgactttttgttcgaatttaggttccgggattcggaattgggcgaaatagaagtcgttttcgtgatcagcgacccagaaaacccctggaaacatgttttcatgatttttgaaatttaaaaaaaactcgaaaaatgttcgaattcgggttcaggatttgaaattggtcgaaatggaggcccggattcgtgctaagcgcctcaaaaacccttaaaacgtgttataagaatttccagaaaaaaatataaagaaaaaatgttcgggaccaataatcttggcgattgccaaatttttttcgctccaatacttttgaccgtgactgtaattaaaattgatattttaaaaattaaaatcgaaattactcacaaaaaaacaaacaaagaaaaagtgcgattttttattattgcatcattttcaatcgtttcatcaacaaaaattattttttggcattttgttttttcgcgttaatttgaatggcccttttttgtgacggaaactcaaatagtatatttaagattaaaaagagcatgaaagcattgcttctcttttctgtttcaattttcttactcaaattgctctgtttgttgcccaatttcgacttcattctttcttcccaaactcatttccatcttccccctttttttccagattattacgatttattttctgcctccaacatg

SEQ ID NO: 105434 - DNA, 477 bp, Heterodera glycines
  Promoter: Source sequence=SeqID_40386; Location=1016..1492; Strand=-; Gene=SeqID_68738
ccggtaccggtaaaaaaccggaaattttagacaaaaaaaatttttggacaaaatttttcaaatacaaaatttttattcaattttcgcgtgagttcctgttttttagcattagaattgttcagaagtatatgtatattcaggttgaccaagtttttttttttcaaattcaggacatacagtcatggtcataagtgttgtcccatcatgctttgaaaaaaataattgcgtataaaattgtcattttccaatttcaacagataagtagcataccattggatagcattttttatgggctttccaatgataccatatttgcatttgtgacataaacatttatttgatttattttaccatattcacaatttgatcaaaatataggtggtcaaaagtgttgtcccatttcatttttaaaatattgcttctctggatcagtattaaaaaaatctaaaaaaattcaggtaagcataactttggatg

SEQ ID NO: 105435 - DNA, 384 bp, Heterodera glycines
  Promoter: Source sequence=SeqID_10372; Location=275..658; Strand=+; Gene=SeqID_73560
attgggtgctacggtattttaatttgatcagaattaggcaaagtcttcgtccactttggccacattggtcgcctgtccgcgcaaagccgttgcgatcatcgacgccaacacggacggcggcggtgttccgcaccacaacgacccggacacggactcgctgggcttctacctgagctcgccccggacgcgcaaagcgattgccgactttttcgcgaaggcggcaaattccgccagcggcgaggagggcgacggaagcaacgaagacgaacagacagcgaaggcggatgaacgccaggaggtgggaaagcggaacatttgcgagtcaattaaggggaaaatgggtttctttgtcagccggaccattcgacgacggcagccgaaatg

SEQ ID NO: 105436 - DNA, 220 bp, Heterodera glycines
  Promoter: Source sequence=SeqID_7233; Location=1440..1659; Strand=+; Gene=SeqID_64212
gaacagaaaaataaccctgtcacattttgcagcaaaacgccaaaatttctctattttcaaattttatttgtgtttatgcagtcagtttatgtttaacaaaaaaatcgtaagactcaaaaaattacccaaaaatttttgtctaattaaataaccgtgtcttaattgcattaacaaatacctattttcttccagccacccaagcaatgttcgtgccaaaatg

SEQ ID NO: 105437 - DNA, 493 bp, Heterodera glycines
  Promoter: Source sequence=SeqID_21319; Location=1043..1535; Strand=-; Gene=SeqID_51914
agagtggaaacaacaacggtaacagcaacactgacagaccagaaacaatacaactagaaaagagacaacaacagcatcaacaacaacaacaaaagcaagcgaagaaaaaagggccaacaccaagtcaatgcattcaacaaaacaccagctttttcaagcagctgagcaactgtcgctcggcacgcgcacgtgcctatcgtcagctggtgagtggggcgagcagtgagcagttgttgtgtctggtggaaagtgcgttaaatattctccgtgcacgtgtcccgctcaggagcactcatctgaagcacttgcgcgctcaggcccaacacgtgcgtgcgttgggccgtgcgagaagcggacacggggcacgtcgactgttgctgagacagcagaccgggcgcggcgtcccggccttggctggcttggtggccagcgttgtgcttccactgctggcggataagctcatgagccgcaaagacagcatcatccaaacatg

SEQ ID NO: 105438 - DNA, 104 bp, Heterodera glycines
  Promoter: Source sequence=SeqID_4771; Location=1752..1855; Strand=+; Gene=SeqID_55665
acgtcgagtcattcccctcatcccgcactgtcaatgacttttggagtctcgaggcgatcggcatcacggacgacccgaatcagaacgacgaccatatcgccatg

SEQ ID NO: 105439 - DNA, 545 bp, Heterodera glycines
  Promoter: Source sequence=SeqID_18459; Location=1..545; Strand=+; Gene=SeqID_83059
atctgtacaaaaataattttctttaattttcatttaaggccttaagagagttacgtcaattatcaaaaaggttcggcttaatgtcagatattcgtgtgggttctataataagttttaatcacttaaatataattttaatatattataaaatttttaaaaatgtatgggattttaccgcattatgagtcctttaagaggataaaattgttattattcaaaacacgctgattgtgatgggtttagcctttttagcttttacaacaaataaaaatcaaattttataataatttgggcgtgggcaaactaaagagagagcaaaggagagacggctagaagggagtgtgggaaaataagagagagaaaagactgttagagaagcgacgtgagaccggttgccccccgcactcctttaatgacccccctaattaccccgtctccctataatatcattaaattaatttaattatttataataatttattttcattacattgatgactaactctaattacatttctttttctgtcattgatcagtcaggaatg

SEQ ID NO: 105440 - DNA, 212 bp, Heterodera glycines
  Promoter: Source sequence=SeqID_5437; Location=1..212; Strand=+; Gene= SeqID_58032
tgaattaagccaatccattgacctgatcagaccattataatccattaatcaatagctgaccaattagtaatttttgatcattttaccaatgtctggtcactttcatcatctttttatctttccctcttccattcccattcattaatcaaccgcacactgcagatgaactgctccaattcacaccactcggcacaattccgttcaccgccatg

SEQ ID NO: 105441 - DNA, 251 bp, Heterodera glycines
  Promoter: Source sequence=SeqID_27929; Location=870..1120; Strand=-; Gene=SeqID_58594
atgagtatagaatttattttcagaaagtgtcaacagacttttggaaaatatatttgcaatttatcaacaattttgagaagtgagttagaaatgataaacttcacgattcaaaccaattttcgttgctctaattaaccgcgataaaaacattcgaatcaattaaatagcttctgagataataaggtttatcataaaatttcaattaaaaataaaccctcaattattggtatgaacgatactttccaaacatg

SEQ ID NO: 105442 - DNA, 666 bp, Heterodera glycines
  Promoter: Source sequence=SeqID_11206; Location=888..1553; Strand=+; Gene=SeqID_74565
tatcaaactgtaaatgtccaaatcactttataaccacttttatcgtgtagaggcatagtcgatttactattttgaattttcggcttcttttggctccgcgccaaaagtgatcagaaaaaaacgatcaaaattccgaaaaatcgatgaaaatggtcaaatttgcaaaaattcctaaaattaatttttacataatatttggacaatttgcgtcgtcgcacttcaccaacaattctcactgatcttgatcaattgaattcaagacattctcccatcatttatagggttaaataaatcagattttaaacaatttttttgcggcgcattttttcagaaaacttggggaacttgggtgggcccggcggtgccgataggcgccgctggggaaaattttgaaaattttagtgtaatttgttaacagatttagtaattaaaatagtaaattaaatgaaaaaacggtaaaataaagtgtgggcatatgggattgaacccatattaaaaaaacaacaaaaatctgaagtgtgcactgggctttaccagtggcgatgctttggacaatttgcgtcgccgcacttcaccgacaattctcactgatcttgatcaattgcattcgatcgatttcgctcttatgtgctctggcacgattgatgatcaaattctgtccaaatg

SEQ ID NO: 105443 - DNA, 235 bp, Heterodera glycines
  Promoter: Source sequence=SeqID_7036; Location=698..932; Strand=-; Gene=SeqID_63647
tccgtttggccctctcctcggcgtcatccgtcggttgtggcggcggcggcggatgcgtcgcacttcgtttggctcttgttttggcactgcctatccccgaggcaattgtcgtcgtctctgatcaatgatcaatcgcctttttctgctgatcctttgctttcccttctcttaaccaaccgttgctgttggttcgcaatttgcccacttgggtcagtttcttcagcggcgcactatg

SEQ ID NO: 105444 - DNA, 57 bp, Heterodera glycines
  Promoter: Source sequence=SeqID_9493; Location=706..762; Strand=+; Gene=SeqID_71622
attgtaaaaagaggggggggggggggcaactaacagaaactttttgcatacggaatg

SEQ ID NO: 105445 - DNA, 56 bp, Heterodera glycines
  Promoter: Source sequence=SeqID_22952; Location=953..1008; Strand=+; Gene=SeqID_53648
ttattattatttttcgtgcccccccccccaaaaaaatggtatttactccggaaatg

SEQ ID NO: 105446 - DNA, 210 bp, Heterodera glycines
  Promoter: Source sequence=SeqID_18643; Location=1336..1545; Strand=-; Gene=SeqID_83296
tctaaaatcgctcaaactcgtcaatatactcatcgcgacgttcttcgctatcataaccagtatcaacaaacgaaggcgtcattgtacctttgccgaaataaaaattcatcgaaaaataaaaaaaatgtgttataatattcataaatatattaatttatcgttttacgtttttttaaatagcactcaatcaatttgttcagagtcaaaatg

SEQ ID NO: 105447 - DNA, 1003 bp, Heterodera glycines
  Promoter: Source sequence=SeqID_8435; Location=3395..4397; Strand=-; Gene=SeqID_68059
tttgcgtcatcaaaatattgaaaaaattgattaaaaacattgagaaataaatccaaaaataataaatattcataaaaaatgagtaaattaaatgaaattattaataaacctaaaaaaattattaaaatattattatagttaaagtaagtttaaaaaatatttggattagcaaattcttctttaatactcctttcaattggatgttgctctgtaacttttaggagagtcattgtcaggaagttaacgaagataaacttgtgcctcacctcataaatctgttttaccccaaccattggtcaaagcgtgtgttggcattcctattgcgaagctgggcaatgtgttcatctcttttgccaaagctcgcttctgaccgaaaaagtataacataaactaacaaatttacagttcaattttttccctcatttcatgattttgccgaccgttgtttggcttacattgatcggaatgcggacaccttgttcaaatcagaggcatttttgcaaattgaccagaaattattgttcaaaattctgtgccgggatcagttggttgtaagccaagaaattgccatatggaatgccgtaaatttttgcattttgtaaaaatttaaaattttgcttttttgggtcgattcttaggggtgtattttttgaagaaatttttaggtcgattcttaggggtgtattttttgaattattataattttggacaaaaggcaaaaataggttctttcaaaaaatttttaggcttttaggctctaaaaataaaaacctagaaaataggctctaataactcgaaaagtagcttaacaacatcccaaaaaaccatgtttttagtgcgtttcaggccacggggagctcaggaaaaaataggcttttgcctaaaaatcccagccctagtgaggaccgtggaaccaagctactttaagaccaattaattgttgctgtctgattgtgagatcgaaaaactcttgactttagagacttttttttgtatgaaaatg

SEQ ID NO: 105448 - DNA, 240 bp, Heterodera glycines
  Promoter: Source sequence=SeqID_19509; Location=1557..1796; Strand=-; Gene=SeqID_84233
tgtaaaaaaatccgaaaattttgaaaaaatcgaaaaattccttttttcagcttcatctccgccgattgttggctcgaagtgttcgctttacttccgccttctcagcttggcctcggaatcgctctgatcagtcgccgatttgaccgccgcgtggacgaacatttcaaaacacgcaaatggatattggacaaagaattttggattcgagagaagaagcgattgtttggcaggaaggaaatg

SEQ ID NO: 105449 - DNA, 428 bp, Heterodera glycines
  Promoter: Source sequence=SeqID_14128; Location=1..428; Strand=+; Gene=SeqID_78124
ttatcgttcttcgggtgaaataatttgataaggccctttttgcatggccaacagccaacggaacaatatgtaaattaaaaatattttgaaaagaaacttaaatttacttttatgaacatcaaaatttgggtcaaatactaaaatttaacactgattgtgcctgaatttaaaaaaggcttgctaactctaattattatttacacttaaattaatgaaaattttcgcgactcctttgcaaaaaggtctattcataccaagtgcccacttcttttaaaaacaatgtttaagttccattatcttcgtttttacgaacactttaatttaattaatttctgttatttccttttactaaaatttaaattagtaattactcaaattttacgattattaaaaaagtgacgtcataatttttcttgcgctgaaaaatg

SEQ ID NO: 105450 - DNA, 595 bp, Heterodera glycines
  Promoter: Source sequence=SeqID_8292; Location=2715..3309; Strand=+; Gene=SeqID_67599
ttccggcctatttccgaatctcgaacccggactcgaacaaaaaactcaaaagtacaaaattttggcgctacttgcaaagagcactattttgaaaatgttttcacttttttttggaaaaatttttttttgttttttttatgcagaatttgtttttttaacatggaacgtattgcatactatttaataaactgaaaaaaacattttaaaagaaaatttagcgctagttaaaaattgacaaattttgagttttatcaaaaaccaaaccaaaggggggaccctattgttttgcaaaatttttttgagataaaaaatcgtgaatatattttttattcgccataattatgctgttaatacttaatattcatcattatgtgtcaaaaaaacaaaaaaaaatttttccaaaaaaaagtgaaaaaattttcaaaatagtgctctttgcaagtagcgccgaatctctctagcaaaacttgctcaatttatttcgaaatgaaattctttgcttatcttttctctttttgtcttgggtgatttcaaccgttttatacaaaatttaggcgtatatctatttaaaattaaatatttgtattaacagatg

SEQ ID NO: 105451 - DNA, 84 bp, Heterodera glycines
  Promoter: Source sequence=SeqID_21682; Location=1060..1143; Strand=-; Gene=SeqID_52295
ttggtccatcccaccaatcagaaaatgccgaaagttgatttgaaaaattttggcaattttcaacaaaattaccgtcaaaagatg

SEQ ID NO: 105452 - DNA, 453 bp, Heterodera glycines
  Promoter: Source sequence=SeqID_15833; Location=469..921; Strand=+; Gene=SeqID_80158
ttttcttagctgtaacattagaaattaagtcgattttattctaattcatgataagcatccaaccgctggaaatcttttctatttttgaaatttttaccaaaatttgtgaaactttttttggtatggaaatgaaccaaatacgtgggtaaggaaacggtggtaaggaaacggttggtaaggaaacggctggtaaggaaacggttggtaaggaaacggtggtaaggaaccggtggtaaggaaacggtggtaaggaaatgagtcgatcccagacatatatatatatatacagtatactttaacaatgaaatcctgtttttaactgcttcactgaagctggggcactacataaaatgccgttacataacaaatatgattttgatgaatttacgttaacattcactaaataagtttggtgttaatctccattaattcagaataaatattgttaaaatg

SEQ ID NO: 105453 - DNA, 205 bp, Heterodera glycines
  Promoter: Source sequence=SeqID_40701; Location=348..552; Strand=-; Gene=SeqID_68954
aacgaacgaatggaggcggcactttgccattttgggggaagagaaattgcggtactctttcagtttaatatgcctataaatgtattcattttacattgtgtctggtttttgcagaagagtaaataaatgaatattaaagtcttttaaaatttccatgcttaaaaaaacaatgtaaaatgaatacatttataggcatataaaaatg

SEQ ID NO: 105454 - DNA, 220 bp, Heterodera glycines
  misc_feature (6)..(6): n is a, c, g, or t
  misc_feature (103)..(103): n is a, c, g, or t
  Promoter: Source sequence=SeqID_15181; Location=1..220; Strand=+; Gene=SeqID_79380
tggacnaatacaaccagtttcgcccagcgctacaacagacttttgagtgggtacggcgctgaggtttgtttttagcattgtaaccttttttctataatcagtntaaatcgttaagcatgtttacgtgccaaaattgctgacggaggtttcaaaaagactggaagcggttccagttcaaaaacgcaaaagggggtccgaaagggctcaggccgaggagatg

SEQ ID NO: 105455 - DNA, 110 bp, Heterodera glycines
  Promoter: Source sequence=SeqID_20613; Location=1631..1740; Strand=-; Gene=SeqID_51170
ttgcttatatgaattgtatacaaaaaaactttttgccccttcctagtgatttgtcttatgctctagacatatttatctacttttctataatcagttcaattttagaaatg

SEQ ID NO: 105456 - DNA, 357 bp, Heterodera glycines
  Promoter: Source sequence=SeqID_33761; Location=936..1292; Strand=-; Gene=SeqID_63725
atgatttattatataacaaataaattaataataattaataaatttaaatatttcaatcatttatacttttggtaacttcggctcatcatgacgtgctctatttgccttacaaaaagcaaaaagattttctagtatataaaaaaaaattcaaaaattttgaccttttttggtttttgatgttataacctttttatcaattttttaatcgcaaagcaatagctagaaaatcttctaaatatgttaagttttcgaaaggtaccatgatttttgatttggtcgacaaagaaaaatatatatagtgcaaaaacattctggggcccaaagttgagggcccaaccgtgccggtctaccgtaatg

SEQ ID NO: 105457 - DNA, 167 bp, Heterodera glycines
  Promoter: Source sequence=SeqID_13806; Location=1895..2061; Strand=-; Gene=SeqID_77736
atgagaaaagggaggcaaagagcggcggatccgccaaagtataaacgccgtgtgattttgcccttttcagcagcaattgggggacccctttggcaatgccctgcagtcccttctcttctccgtctcggtcgagtcgcctctcagcgacggttcctcttctcccaatg

SEQ ID NO: 105458 - DNA, 258 bp, Heterodera glycines
  Promoter: Source sequence=SeqID_3092; Location=631..888; Strand=+; Gene=SeqID_83160
tttccacttacctaaattgttaggaaattcctttgcgacgaatcgatttttattttagccatttttaactttgtgtgttcaaatgtttgtccatcaatgtctttactatgatatcaaattcagttcattagttttataaaaagtaggtgcttagtcgacctctaaatgcatcagtgtctgtttcatacttttaaagcgtttgaggcatttatattgatataatttgtagctaaaatattacttttgacttttcaaatg

SEQ ID NO: 105459 - DNA, 412 bp, Heterodera glycines
  Promoter: Source sequence=SeqID_24982; Location=1..412; Strand=+; Gene=SeqID_55717
gacaaggggcgggcgcgaagcgcatgcccttcgaggtgcgcgagcgaggagcggagcgacgagcgagtgtaccgagcaatacgaacctggcctcttgcccggtagccacgcacggcggcgcacccggggagcgggggggggggggttaattataattttcaaaacaatttcacaatttgttactgaaaactccgcgcacaatataaattatgttgtgtaatttgcttacgaatacacactgccaaaaaaacattttttgttaaatttcatttatttattatttttatcataaaaaatagattaacttaatgaaaatatacggtaactgattatacggtcgacatcggaaaacaattaagcagatttcaaacggagaagttaattaaacaagcaaaacaatggataaaaaatg

SEQ ID NO: 105460 - DNA, 1003 bp, Heterodera glycines
  Promoter: Source sequence=SeqID_7805; Location=3031..4033; Strand=-; Gene=SeqID_66021
ttaaatatttataccatgccattttattcattatttcttttaaaaatttgtttttttcttacactaataaaaaaaaattatagtacaaaaatattctaaatcgtttaacgttttggtgattcatcaaaattcaccatccattttcgttttgctttgatggagtatgatgataatttctgtccctgggttaacaccaactatttttataaatatgtttataaatcaatcgtaatgagaagaatttaaaataatattaataatttagtttaaaccaaatttttgattaattaaattaatggacatccttaaactcttcacccttttttggcttcctttgcttctccataatttttgtgtggaatcagccgacgagggtaattaattaattaattaaaattaattaattaattagttaataaattaagtataactaaaaatttaataagcatctactaataattttcccaattacgaagcaatagttaatgacggacaagtgggccagagccgtgaaacaaggaacgcgaaaaaatggaaagactggaaaaccggcaaagaaaccacctctcgaaatgtgccagttgtgtttgatgaacacggcgaaatgtaaataaaaaataataattattaaaaatgaatacacattattttattggtgaatacaaaaaaaaaaccagctgaattgggaaacatatgatttttagttttgataaggtaatcaagtatcagtaggtcttttttaaacttttgtatatgtttattttaaactaattttttaatcttctcatatgcataaatcctaatatgcgcaaaaatatgtttgaaaacctgcacaacccataatctttttaatttgctaaatttttcatgtttttgtccccactcgttctgtttttcaacaaaaaaaaatcgtcatatcttttgtcaaaattcttggtttcaagtggtggcccttaagatgctctatctttatgctaaattcaaaaattatatttcagaaatg

SEQ ID NO: 105461 - DNA, 129 bp, Heterodera glycines
  Promoter: Source sequence=SeqID_35552; Location=1..129; Strand=+; Gene=SeqID_65093
tctgtttcttcaaaatttaagaaatttgtgcaaaccctttaattttttttaaatctttttttttttgctcgaatttactattcttcaacattttgtatgccgatttccttttttttacagatacaaatg

SEQ ID NO: 105462 - DNA, 146 bp, Heterodera glycines
  Promoter: Source sequence=SeqID_37414; Location=1..146; Strand=+; Gene=SeqID_66494
tggaaataagcttaatagggcctagttaagctgtaaaaaaatttgggggcgatttgaatgagaatagaaagagccaggttcgatgaagttttggtaagccaaaaaaaaatccaaacatttaaaaatctataaaaaatttaaaaatg

SEQ ID NO: 105463 - DNA, 1003 bp, Heterodera glycines
  Promoter: Source sequence=SeqID_5224; Location=879..1881; Strand=+; Gene=SeqID_57316
aaaaaccgaaaaactattggatttttgatgaatatgaatagaaaaatttatgaaattactgtaaaaaatttaatctataaggaatttaacaatgaaaatatttagttatttaataaattcaattaaagttttcaaattcattaaaaaagaaacaattaaatttattctataaaaattttcctataaaacaatcatttaagattaaaggaaaaatagtttaaaattttggtatttccaattgatatttaaaagtggccatatcgtggaataaatctaactgtgaaaaggagcaaaagattaattagaatgctaaatatttaattgattgtttgaaaaattaaaatattaaatggaaattaataagaattattaggatggaataaaaatattttaaatgaaaaatttaatttttgagtatttaaacgaatgtaaagagctcttgtaattattatttataaatattcattatttttagaattttattcaaataaatttatgtaaataaaagaagttatattaagcttttttaatatcttcaaaaatatttaaaaaagtgcttctaggttagattatatttaaaacaattctaatataatgagtttattaaaataatttgataaagaaaattgaaaaaattaaaatgtaactaaataaatcttgtcatatatcatatcgaagtgaatgaaaagtcaaaaattaataaaatatgaaaaaataaaaattaaaaatgatattcgaatcgataaaatttatttgttttacgaattaaaatagtttatgtgatattttccactttttaatacattattcattaaacattaaataaatatacgaaataaacttacacttaaatattgaaatgtttttagtaaataataaactataatgaaaaaacaatttaaaaataaaaataattgtcgataaaaatgggtgacggagtgacgacgaggaggaaagcgttggcgaggaagaggggatgaggaggaaaggaagacgagaaatg

SEQ ID NO: 105464 - DNA, 397 bp, Heterodera glycines
  Promoter: Source sequence=SeqID_14382; Location=412..808; Strand=+; Gene=SeqID_78417
atggtgtgggattatttatgaggtcggaataatttttgaaaacgcaatttttatgtcgttttgtcttttgaaataaaatgcaatggattttttgttttaccgcatgtgtggccgagtggttaaggcgttgcgtttatatcgcaaagggatatttcctgcgcaggttcgaatcctgccgcatgcgtaccactttttttgttaaccaacatacaattaaaagtagggaccagtagaattttgctaaggccgaccggactttgaaaatataccgggacgttcccgggatcgggactcccggggccctaacccaacttttgaccgggatctaggactttttcagaaaatttgaaaaaaaagtttaaataattcaaatttttcaatatgttctctacaaatg

SEQ ID NO: 105465 - DNA, 211 bp, Heterodera glycines
  Promoter: Source sequence=SeqID_20154; Location=2043..2253; Strand=-; Gene=SeqID_84939
attaattaaaaaataaaataataatttatttttaatttataaaataataattttttttaattaaatttaaaataacttgaatattaaataaatacaaaaataacattaaaataaaataaaatctaaatattttataaagaaaaataaaattatgcacttttggtcgagctttttgcaataaaagaaaggaagggaaaagggcattaaaatg

SEQ ID NO: 105466 - DNA, 226 bp, Heterodera glycines
  Promoter: Source sequence=SeqID_2878; Location=3896..4121; Strand=-; Gene=SeqID_82113
ggtattcccagctcttaaataaatacgggttaggtaaatagttattttttggaaaataaaagcgaattgtttttgtttgtttgttaaggaggccctttctcactacacccgcgctattataaagaacccgaatgatccgacttactttacaaatagagcactttgcaatttaaatcttaaaaaatgggactccgcagcggacgactgcagaaaagcgctttacatg

SEQ ID NO: 105467 - DNA, 107 bp, Heterodera glycines
  Promoter: Source sequence=SeqID_38696; Location=1..107; Strand=+; Gene=SeqID_67428
aaaaacatttgaatcaattaataagttctgagataataaggtttatcataaaatttcatttaaaactaaccctcaattattggtatgaacgatactttccaaatatg

SEQ ID NO: 105468 - DNA, 130 bp, Heterodera glycines
  misc_feature (20)..(20): n is a, c, g, or t
  Promoter: Source sequence=SeqID_12435; Location=1..130; Strand=+; Gene=SeqID_76045
acgctgccgctgcgacaccncggaggtgcacgccgcccgtccaagcttggaagacggcgtaaaagaacaaaaggaaatgactcagatggcataaacacttgtccatttttctattgttgatattctgatg

SEQ ID NO: 105469 - DNA, 134 bp, Heterodera glycines
  Promoter: Source sequence=SeqID_11337; Location=4543..4676; Strand=-; Gene=SeqID_74721
agtgcgtggaattataaaagaaaattaaacaagctcttcacttatcatttgaaccaaaattgttaaatgagcatagattgaattataatgtaaaattggtcaacgaaaaaccaaaagtgccaattaacgaaatg

SEQ ID NO: 105470 - DNA, 209 bp, Heterodera glycines
  Promoter: Source sequence=SeqID_6896; Location=2352..2560; Strand=+; Gene=SeqID_46323
aaatgaaggattgctgttgattaatggaaatcacgcgataaagatttcatcctcattttatatgaattctctgagtcaagttaatttcgataaatccattgcagttttgttgttatgtttttttgcacggatttcttagtaaagccgttcatttcgcttataatttatttatacgtcccctaaattcatttttgatgaagcctaaaatg

SEQ ID NO: 105471 - DNA, 777 bp, Heterodera glycines
  misc_feature (101)..(101): n is a, c, g, or t
  Promoter: Source sequence=SeqID_31756; Location=1..777; Strand=+; Gene=SeqID_62062
tcaaaataaataaataaatactgtgcaattttatccgagtcattttgtgtcgtcactttttaaatcttaataatacctcggaaaatttagaactgctaatntaaaatttattatttttgttatactttctttttgtgagcagttcaataattgtcgccatacagtttatcattggatcatttatgattattcgggctgccaaaatcatgtacaaaaagcggtcacatttagtgaaatatctatgaaatatttacaaaactgaaatatgtactaaacgtaataaaaattttaaaatggttcttttttggtaaaaaattctttgtaaagggtgaaaatttcgaacttttggatttttgaggcatttaattaagattttcataaaaaattttgctaaaaagattcttaatatgtgcaaaagatgtataaaaagtaaataaaagttacaacccttctgcttcacattagtcctcaaattatgtttttatcgaaaaataaaattctatgcaggttagttgggtttcactacagcactcacaacaaacacaggccttacgctgaataatttgtattatttttctcaacaaaaatttttgctttttagaatatattaatttgttcttgagaattctttcgcttcatttgtagttttgtacacagtaaacacactttctaattgtcattaatggaacttaattattcaaaactgggccaagaagatgcctatttaagctgcaattatcaaaaataaaataattttcttcggttttcccaaaaatg

SEQ ID NO: 105472 - DNA, 1002 bp, Heterodera glycines
  Promoter: Source sequence=SeqID_17893; Location=1302..2303; Strand=-; Gene=SeqID_82443
ttttcgcattttagcgcgaaaagtgagaatttaattcattgttaagaattgggtcagaagagtgaaaaaatattttgaaaatacggaaaaaaccattaatttaatgtatattttttctatttctgaatttttcgaaactgctttcatgtatgaatactattagtggaattgtactacatatattcctttatattcactgccctactgatatttttagaaccagctaaattggttaactttaccgatgaatttcgtaaagatcggttagggctctcagggtgactattgaaaagagtaaaaacttggtttcattcaattggcattatttcacccaggataaattatatcgatgtagaacctaaagtgactcgcccggtgggactcgaacccacgacctaattaatgggtctttgattgaataatacgagaaaaggtagaaatatttggttaccaaactaccgtattcctgggagtactattcttgcgcttgtttgttagagaattctagcacagaaagtacggaaaataatggaaaacccctgtcggaatttgattccttcaactaacttactctgcccagccctactcatagccttcaaaatgataccaatttaaaaatttctttgatttccagaaagtcgaaaaataattttatttccgtttaggcactgactgatcatcattactcttccagatgggcgattatcaaaagaaggatttgaaaagttaaaattttatttcaacagaaatgtcaatttctatgcaaataaatgagcatcgtttgtatatttcattcttttttggaaaccgtttttagaaaaggccaacgaattaaatgagtatttattattatatgaaaatctggcgatgaatcagctaaaaatattatgctaaatcactaaaaatggttttcactttcattttgctcatttttaaaaatgaaattcaaatataaagtaaacaaatattttttagtaaattattaacaatatttccgaaatg

SEQ ID NO: 105473 - DNA, 233 bp, Heterodera glycines
  Promoter: Source sequence=SeqID_25157; Location=1125..1357; Strand=-; Gene=SeqID_55885
cctgaaatcagcaaattaaatttattaaaaattttccaaaatgataatttgcaaataaatgaaagcaggaaaaatttttgtctttgttccaactcgtttcaaaatgttatgaacgcaaactatggtttgctgcgatttatgacaaaattttattggccatttttcattttatcagttaaatgcattcgaacattgaacaaaagggaatattttactgataaagcgataaaatg

SEQ ID NO: 105474 - DNA, 106 bp, Heterodera glycines
  Promoter: Source sequence=SeqID_10025; Location=662..767; Strand=-; Gene=SeqID_73076
atttaaacaattaaattatttaaaaaaataataattaaaccaattttaattcagtcctttttttaaattttttaaacctttttagaagttgaaagtgatcagaatg

SEQ ID NO: 105475 - DNA, 1003 bp, Heterodera glycines
  Promoter: Source sequence=SeqID_4284; Location=3123..4125; Strand=-; Gene=SeqID_53880
aaaaagaatagaggaaatttgtaaacgcagtcactcatgcctaattaacaattgtttcgctaattgaccaataattagttgaattacggattctctaaggatgaaactgaggaaacaattaagaaggaattaagatggtaagggagataaatgaggaaggccccaaaaatcattacaatctgaaattttggttcgaaatggaaaaacgacacaactatttcaacattaaataattaaaatattttatttttctgttcatttggtcaaatttcctgctgctttcagaatgggtcgaaagggtttttctgccggaaaatttgcggcggatgcgcgaggcaagggaccgaacgctgcgctccctccagcggatgggcgtgcgctgcttgaagccgcgggcgggctttttcgtgctggccgacttttccaaagtcagccgctgcccgtccattttcctcaaataattgtgcttttgagtaactgtaaaaaaggcattaaattatggttaattggtaattagacaaattaataattcctgccggaggtttcacacatacattttttttggggggggggtcgcaattttgaaaattttcttaacaaattcattaaaaagtccaaaaaacattccccggcggcgcctggcggcaccgccgaaccccaaaattcctatttttcttaaaaaattggctcaaaatcgcaaaaattggccattttttggtgaaaatctgttaacaaatcacacccaaagagcaaaaatttttctcccggcggcgcctaacggcaccgccggcccccctggtcccgaaaagttttttggaaaaagcgcgccgaaaaaaacggtttttgaaaggcaaaaaaggtcatctgcggccgaccccccttcgcaaaaaatttttccgacccaccccccttttttatgtatggattggattaacaattttaacccaatccccgtattgtttagcgccaggttgcctcgtccgtgctcaccacgcctggtatg

SEQ ID NO: 105476 - DNA, 176 bp, Heterodera glycines
  Promoter: Source sequence=SeqID_25717; Location=637..812; Strand=-; Gene=SeqID_56460
ttttttttgtcgagaaaaatttagaatgattcgccaaatggggtggaatttcaaaaacgggccaattttatacttttcaatcggttaggctccgcccacttttcagttcgtaaagttcatccgtccaaaatcacgattcatttgcaaaaaaaaatcaaaaaatttccaacaaaatg

SEQ ID NO: 105477 - DNA, 346 bp, Heterodera glycines
  Promoter: Source sequence=SeqID_14558; Location=3944..4289; Strand=-; Gene=SeqID_78631
cacttgcatttccatttgcaagtggtttccctttcgggaaatgtgatgagtgtggcctcacttgttacaccataggaatcgttgtgacagtgccacccgaaatccaaaagttcgaaatatgctgtgcagaaagctgcatagttctgcaagggccttgaacttcgaactaccaatcgaagtcctactcaacaatcatcactgtgaggccagattttggactgactcacagcacaccttcacatcaaacacgacctgcccggcagtcgatgaatgtgatctcatcgactgctacttttgtttcacacaacttgtgaatccaacatgccagcccgtcattgcggcaatg

SEQ ID NO: 105478 - DNA, 1003 bp, Heterodera glycines
  Promoter: Source sequence=SeqID_550; Location=3685..4687; Strand=-; Gene=SeqID_56029
agaattgtaatgaatcccaaccatataaacatggttaattgactgggcaattttttaaagactttacagctcgaatttgattataatttacaactatgcttttaaattagacggctatattatttacatattaaaatatttttatttccttaatttgatggccaaattttttggtgcccaattttataatgcccaaactttccggtgccaaatttccccttgcgttttagaataataattttcctctgataataggaaacatgcaaatgtgaattgtatatccaaaaatgaataaattgttttgagtaatcgtgggagtttagctaaattaagaagcatattttcgttgcgtctttaattttaaattcagtaggtgttggtgcacaaactcttgaaggcaacttaaaacaaatggagaaaaatataaaagtatttttaatattctcctgtccaaaattaaataaaaccgaatttttgaaaattttcgaaaataaaaattttcattgcgtctattatgaatttgctcaaaagcaaccaaactttaaaactacaattcacatttctatgattcatatcatccgagaataaatactacaggcaaaaaaaaggttgacagtattaaagcccttttctcattgatattctaattcttctattaaatctaaggagacaaatttattgttcgaaaactttcaaaaattcgcttttattcaagaaaaggctggaaaatattaaaaatataattaatatttttctccagaatgattccgggttttgttatagaagatttttaggatgtttgaagattttcagcaccatcacctaatgaatttaaaaaattaattacacattctaaaatttgttctgatttagtctaaacccccaagagtaccgaaaaggttattcgtttttagaatctatcagctaaattttgcagtttcgttctcagtaaattatggaatattaattaaagctaaaaatttaaaaaagccaccaaaaaatg

SEQ ID NO: 105479 - DNA, 90 bp, Heterodera glycines
  misc_feature (74)..(74): n is a, c, g, or t
  Promoter: Source sequence=SeqID_10648; Location=3110..3199; Strand=-; Gene=SeqID_73890
tttcgtataatttcaagttcaattagtattttgaatttttttttcttaatcctttaatgacgttccgttctttntaatttttgaagaatg

SEQ ID NO: 105480 - DNA, 1003 bp, Heterodera glycines
  Promoter: Source sequence=SeqID_2297; Location=706..1708; Strand=-; Gene=SeqID_78976
agcaaaaacttttttatttgttgaccaaatccaataaacttggtatcattcgaatacttttaacaagctctattggctgtccaaaaaatacaaagatataccgacatataaaaaagctataagtaaaaatatgcaaaaattctgactttttggtagtattcatgtttcaatttttttataagctgttcaatcgcttagaaatagcttgtcaaaagcttctaaacatgtagagctttcgaaggatgccaaatttataattctactattatttataagtataacatttatgctgacttaaaacttacacttacacaattcgtcagtttaaaattaacacaatttacttcaattaattatataaagattattaatgaatacagcataatcatttgtttttgaattaaatttttatactaaaattaaacaattccatacatactgtattggtgatttttgagcaagtaaagtgcgtccaatttggcattttataaagtggcattccgaaaccccaaattgtcaattttctgcaaattttaaatcaattaaacaattaagctcatttttaatttttgatttgactgtactcaatcagtcaccataataaatttcattatgtttgagcaaataaaaagccaaaaatggaaaaaaactttctctataaacaaaaaaagcaataaaatttgtggatatttgagcaattactaatttctttttttttgttcatttaaacgaacagctatgaaaacatttaaattatgaatttacagaaaatagaaaattattacgtaaataaaataataactaattcgcattttcactacattttaagtcaatataaaaggaatgccaaaataagagaaatgcatcagtctcacattcatttattaaatatgtttaataaaaatacaccattaaaattgaaaaataatgattcgtcacttaactaaattttctttaaataaattaataaatgaattttagtatagaagtaatttaaaaaatg

SEQ ID NO: 105481 - DNA, 118 bp, Heterodera glycines
  Promoter: Source sequence=SeqID_16195; Location=2000..2117; Strand=-; Gene=SeqID_80559
tcttaatagcataaaaatttctcggcttccgagccaaaaaacccgagaccgagaaagaaaacagtattcaaccgtgatttgagtcttttaattttacatttttgacagagttaaaatg

SEQ ID NO: 105482 - DNA, 240 bp, Heterodera glycines
  Promoter: Source sequence=SeqID_11928; Location=483..722; Strand=-; Gene=SeqID_75446
tttcggggacggatgggctaaccgcttacaatcagcaatttttagggatttatttcgggcattcacccttcccgaaattaaaatttttccaggaaaaattggcaattagcccctcccagtgtcatttttatcaccggatattctttggcatttttgtcagattggcaccgtttgcttgagctgcacagtgccaaggaacgactctcctatttgacttttttggtcaaacgtaacaaaatg

SEQ ID NO: 105483 - DNA, 257 bp, Heterodera glycines
  Promoter: Source sequence=SeqID_18874; Location=2722..2978; Strand=-; Gene=SeqID_83579
ttttgggcacaaattttgtcagtttactcactgctgacttaattatgacggtatattttaaaatttcaaattttttttttatttcctatttttcagcctccaatttttgctataaattgtggcacactttttttgtggttgttgtcattttgggcacaaattttgtcagtttgctcactgctgacttaattatgacggtaaattctgaatttcaaattatttttattttgatttaatttttcaatttttagccaatg

SEQ ID NO: 105484 - DNA, 97 bp, Heterodera glycines
  Promoter: Source sequence=SeqID_8253; Location=1701..1797; Strand=-; Gene=SeqID_67456
tctttctcctctctcagacaacgcatcaaaaaaatccaccactgactacccgtacaccgctcttagtgaccaacttgcggcaatctcccaacaaatg

SEQ ID NO: 105485 - DNA, 284 bp, Heterodera glycines
  misc_feature (128)..(128): n is a, c, g, or t
  misc_feature (211)..(212): n is a, c, g, or t
  Promoter: Source sequence=SeqID_543; Location=5244..5527; Strand=-; Gene=SeqID_55815
catccatattttatgtaaaaatatataaaacaaagtacctttaatagggaaaagcgaaaggagggcaaaccgcagcgcactttaaaggaacgactcaggaccaacagcccaacgaggccaaacaaagnccaccgaacaagaccaaacgacatcacccacacaaaaaagcccaccaaaggagagagagagaacaccgactccgagccggagnncagaggaacgggcgggatccgccgggacaggaagcatttggtgtcgggaataaccccgaaaatggcaaaatg

SEQ ID NO: 105486 - DNA, 157 bp, Heterodera glycines
  Promoter: Source sequence=SeqID_14839; Location=1..157; Strand=+; Gene=SeqID_78995
tctttttttattataccctttcttattattattgttcatcacattttaattcatgctttaagtacaattccattagtgagttacttcattatggaaattaattttataattcattttaattaattagattaaggacaataggctaattgcaattatg

SEQ ID NO: 105487 - DNA, 105 bp, Heterodera glycines
  Promoter: Source sequence=SeqID_10322; Location=1..105; Strand=+; Gene=SeqID_73502
tttttattttaaaaaataaataaaattatttaaatagtaatgtaagtaagtaaacaaattttatttccccaggatttgggattggacgacgacgacaggaagatg

SEQ ID NO: 105488 - DNA, 212 bp, Heterodera glycines
  Promoter: Source sequence=SeqID_29306; Location=1737..1948; Strand=-; Gene=SeqID_59817
ttttcgggacagctggttattaatgcaaaaccttttggcacatttacccaaaacatttggtttggattgtgactctaaattatattttccccatcaatttaataaagaggaaaattacggtaagaatatttttgtcgttacaaaaaaaaaagaatttaggcaaaattttgacaaccctcccgccttttgaggattattttcctgatgaaatg

SEQ ID NO: 105489 - DNA, 61 bp, Heterodera glycines
  Promoter: Source sequence=SeqID_7821; Location=386..446; Strand=+; Gene=SeqID_66072
gtcgcagatagagaaagaagcattggccatcattttcgccgtgcaaaaattccaccgcatg

SEQ ID NO: 105490 - DNA, 360 bp, Heterodera glycines
  Promoter: Source sequence=SeqID_1002; Location=5851..6210; Strand=+; Gene=SeqID_65809
atataccgcaaaatgttattaaaaatttggagtttttgaagaaattatcaaaaacaaaatctcaaaggaaacgtgaaataatatttaaagaagcaactaatgatcaaattgcattattaattgaaatttgttataacatattaaagggatattttttgcttaccaaaaaacaaaaacatagacttataccttatgttaattttataagaaaattaggaagagttagaacagaaaagggtgcaaagaaaattattcaacaaagtggaggagggtttattagctttgctccattacttttacctataattatcgctgcattaaaatatggaaaataaatttattcttgttccttccgacatg

SEQ ID NO: 105491 - DNA, 1003 bp, Heterodera glycines
  Promoter: Source sequence=SeqID_15699; Location=342..1344; Strand=+; Gene=SeqID_47308
cgtattctttttgattggaaaatatgagatttatacacgtacatacatataagtgggggaattctccacctacaaatgttatttaatttattactaatcactagggatgggaattttatgcaaatgcatatttttttcctggcttctacatgctctaaatagtaggaaaaaccctttcttttttgtgtttgcgtataaaaatcggacttttatttgcatatttttgcatatttcgagatttttgtgcatatttgcatattttggctttttgtacatatttcgccattttttggaaaatttgttaacaaaaatgcaataaaaacggaaaatacacccctaagaatcgaccgaaaatttttaaaaacacaccactaagaattggaaattttctcaaaaattcttcccccaaatttttttttcatgagaaaatttttgatttaaaaaatgtcaatatttgctaaagagaattttataaaagaaatgtagaagcgcattggcaagtgcattagtaaaaaatttttttttattgaatttgcacccctaattttcaattttttagtgcatattttacgatttttgtgcatatttggtgcatatttcacgactttatttgcatatttaccgtatttcctcgattataagccccggggcttctattgttcaacccccctccaaagggggcttatattcgaggggggggggggcttcccgtataatcgaggaaatacggtatgtgcatattttggccacttttcgtgcatattttttgcatccctgcaaataagggtctggtgtgagttaagtcatactgaaatgtcagtactgaaatgactgatctcagaagaaggtgatttttctcatttctcttccttctttcgttttattcgccatcgccacgttcacgtttaaaaatgtttctacaatgttaccaaccagcatctaaaacattttaaagaaactttgtttttttaatattttctagagagtacataaaatctcaatg

SEQ ID NO: 105492 - DNA, 1003 bp, Heterodera glycines
  Promoter: Source sequence=SeqID_2393; Location=3842..4844; Strand=-; Gene=SeqID_79501
agaactccttcatagaggcttcaaaccaagctaaaaacatgtttttcatgcgtttcaggcctccaacagtacaggaaaaaaatatgaatttccatataattacaaaccctattataagcattttatggaagtctgagctcgaaaaatcgaagttgcacttcacttcggccaatgctttcactgtgcatctcttaaattttttgcttttaaattgctctttttgtgacgtggttttccaaaaaactttttgggaacattgggggagggggtcggtccggcagtgccgataggcgctgccggaaaaaatttggaattttgagtgcgatttgttaaaaattttgtcaaaaaaaatgattttgactgaggatttttcgaaaaaatgtttaagatttgaagaaaaagttcgaacattttgccaaatatacctaatttttcaaaaaatcatgcatttttgtcacttttttgtcaaaagaccacaaaaatacgcaaatcctcatttttcaaaaaaatcctttttgaccctctaaaaaaccacaaaatgagtaaaaatactcagatatcgcagctctggataaaagcctttttttattttgttttattgaacaaccttagctcactatcattaatctccatagtatataatagcgaatatggacataaaatacggaccaaaaatcgctaaatatggcaataaaatggcaacaatttctcaaaatttcttcagattcattaaacttaaaattttcaaaacggctaaattagtattagaaattattttaaaagaaaaaattgtaataaagctaaattattaatttagcaagaaaattaagtaaaaaatcgaacaattttcatttttaatttattcttagtataaattcttattttatagtaagtcatatattttttttaatattctcgaaataatttcctaaaatttgctttttgaggaattttccggtcttaaaatactaaaatatgggaataatgccaatgggaaaatatg

SEQ ID NO: 105493 - DNA, 391 bp, Heterodera glycines
  Promoter: Source sequence=SeqID_7304; Location=1..391; Strand=+; Gene= SeqID_64408
attgtggttttttggaaaattgtatcctctccccccagggagccaggaaccgtcctttgtttgacgaattcgaaatggccaccgactgtttaactaaattatttggctatcactttttattgtacatgtttagaattcctttctcttgcgcttcgtgttggtcaaatggttgtattttctttcttttttatttattgtaatacatataaataggttgaagccgcgaaatgcggaattccaattgatatacagcagctccccgaactttattccaatgcgactgctttgccaaaatcagccacaagaaaaatggaaacaattaacgaggagactttgagtacagtcattacattaaacataataaaaattgccactaaaacacagaaaaatg

SEQ ID NO: 105494 - DNA, 163 bp, Heterodera glycines
  Promoter: Source sequence=SeqID_10964; Location=505..667; Strand=-; Gene=SeqID_74272
ttgccaagggtgccggagaacggtaattgtgataatattctaacagttcttttcttttttcgcagacaccgtttcggggaaaaccggcgaaagtgacaatctctccaaaagaggggccaattttttgcacacgaaagtgcattcggcccaggaattgacaatg

SEQ ID NO: 105495 - DNA, 1003 bp, Heterodera glycines
  Promoter: Source sequence=SeqID_25479; Location=1702..2704; Strand=-; Gene=SeqID_56212
aattattatgatatagatcaggccagtttatgactttttaaagatttttctatattttaaaattacaccatttgtaataacaataaataaaactttccaactgaaagttaacatagaaaaaccaaaattgttaactattattttgttttgctttttcattttataatttttacaccgaattattaaagtcataaaatttatatgagatttgtctctttcagtcatagctcaactaaagaaataattactttcaaaaaatgaaaattcaaatgtataaaagaaaaatttgtaatcgaatgaatagaaaaatttatttattgaaaaaaactcaaagatgataaatagaaatattaacaatttaactataaattgcccaaatgcgtaaacagcttaagaaaaaaatatatgtaacgtgtgaattcaataataaaaggaagcaattagataacacgtgaataaaaaacaattaattaaataaattaattatcattatgaactaaatattgacaatgaaagccgtcgttagtggaaaaaaaagaatacaacatatatcaactttaagcatatttcaatgcaattataaaataaataaaaccgaaaaaccaaaaaaaaatacaaaaatgataaaattaaaatatatgacttaaactacagattatcaaataattttttaaatttttccggttatagaatggaataattaaatttttattcaaaattagcaaaattttaaaaaattataatcataaatgcttatattgcagataaatcaataaaaataaaaagattggaaatttaactgattttaatatattattttaatgtttctataaatttaattatttttaattaacaaattctaaaaataataataatttcttaatgaatcattaagtaaaaaaccaaaaataaatgtgacaaaaaaacataatttttaaaattttgatttataagaaatttacagttaaacaaattatgtttacagcaatttttaataataatg

SEQ ID NO: 105496 - DNA, 78 bp, Heterodera glycines
  Promoter: Source sequence=SeqID_4386; Location=2638..2715; Strand=+; Gene=SeqID_54250
agtaaaactttgtttttggtatataaacttgtgatttgacattagttgtttccaaacctatcagttttacagaaaatg

SEQ ID NO: 105497 - DNA, 108 bp, Heterodera glycines
  Promoter: Source sequence=SeqID_1022; Location=1..108; Strand=+; Gene= SeqID_66275
tcggcactgtgatttgcggggagcagattcagaccacgacgggagttactcccgattcgtcggtattcgcgatcccccccatgtggggaggacgagcgggatcaaatg

SEQ ID NO: 105498 - DNA, 422 bp, Heterodera glycines
  misc_feature (49)..(49): n is a, c, g, or t
  misc_feature (86)..(87): n is a, c, g, or t
  misc_feature (91)..(91): n is a, c, g, or t
  misc_feature (94)..(94): n is a, c, g, or t
  misc_feature (100)..(100): n is a, c, g, or t
  misc_feature (114)..(114): n is a, c, g, or t
  misc_feature (116)..(116): n is a, c, g, or t
  misc_feature (120)..(120): n is a, c, g, or t
  misc_feature (124)..(124): n is a, c, g, or t
  misc_feature (152)..(152): n is a, c, g, or t
  misc_feature (159)..(159): n is a, c, g, or t
  misc_feature (161)..(161): n is a, c, g, or t
  misc_feature (163)..(163): n is a, c, g, or t
  misc_feature (165)..(165): n is a, c, g, or t
  misc_feature (169)..(171): n is a, c, g, or t
  misc_feature (180)..(182): n is a, c, g, or t
  misc_feature (185)..(185): n is a, c, g, or t
  misc_feature (197)..(198): n is a, c, g, or t
  misc_feature (219)..(219): n is a, c, g, or t
  misc_feature (226)..(226): n is a, c, g, or t
  misc_feature (237)..(237): n is a, c, g, or t
  misc_feature (249)..(250): n is a, c, g, or t
  misc_feature (256)..(256): n is a, c, g, or t
  Promoter: Source sequence=SeqID_328; Location=1..422; Strand=+; Gene =SeqID_82462
ctaagtatatgtaaacaaagggaaggagatctctacaggggtttagtgnacgactgattcctttaattgagccctcaaagggagannttanaantaatgntagtgaggaggtantntgtngagnatttttggaaaaattgaatttatatttnaaatttntnantngaannntgagtgggnnngtnagaagggatttnnaaatattgagaatgaatggangggaagnagaaatgatgnatagagagattnntaaatntattccagcacctcttttccaatttcggagcaacaaaatccgagattcaacaacaccgagccgccgaaccacccggaaggcaactttagaacatgggctcccacaggctctaacagagaacccataagtcccagacagaggaacaggaacaactgggataacaatg

SEQ ID NO: 105499 - DNA, 86 bp, Heterodera glycines
  misc_feature (78)..(78): n is a, c, g, or t
  Promoter: Source sequence=SeqID_30273; Location=1430..1515; Strand=-; Gene=SeqID_46201
atcatcagtggcataaaatgtatgcgatgatgtaaattatatatgcccatgaaatgatgataaacaatcattagatanaagcaatg

SEQ ID NO: 105500 - DNA, 101 bp, Heterodera glycines
  Promoter: Source sequence=SeqID_706; Location=2158..2258; Strand=+; Gene=SeqID_59402
tgtgttacggggaaaggtctcgagagggaacctctcggggcccatcaaataatcagataaaaaaagaggtgacaaaatcctctcatagtcatttgactatg

SEQ ID NO: 105501 - DNA, 129 bp, Heterodera glycines
  Promoter: Source sequence=SeqID_5915; Location=185..313; Strand=+; Gene=SeqID_59674
tttttgtattttccaatagaatttttcattttaagacatacaacaacgatgccgtctttgctgaaaaaagcaaaatgatcacttctatggcgtttcttcctgtccaccatctccctgctgctctcaatg

SEQ ID NO: 105502 - DNA, 59 bp, Heterodera glycines
  Promoter: Source sequence=SeqID_23220; Location=1..59; Strand=+; Gene= SeqID_53939
aagaggtacaactgtgattagaagaggtacaactgtgattaggagagagaggtacaatg

SEQ ID NO: 105503 - DNA, 109 bp, Heterodera glycines
  Promoter: Source sequence=SeqID_29449; Location=2025..2133; Strand=-; Gene=SeqID_59947
tttcactttttaatttcttatttcacttttcagcttgtggctacgccaatttttggcccaaaatgttgtgccgagtccgattgtgcccgatgtgcccgacctgcaaatg

SEQ ID NO: 105504 - DNA, 318 bp, Heterodera glycines
  Promoter: Source sequence=SeqID_30893; Location=776..1093; Strand=-; Gene=SeqID_61271
ttttgagggggggggggcaggttcggatccggacggtgtaaattattttcgttatatttatggttatttttaatgtttttaattcatttaaaagagtgtttgctttataataaaaaataaattttttaatttaaattaaattattttttttatgaaaaattttattaaaattaattatttttttaattaaataattttatatatttttttttatttgagtttttcagaaattaatttcatttcaattattataaacttcaaagtttttttaataataaaaagaggcatttattttacaattttaaaaaattattaatg

SEQ ID NO: 105505 - DNA, 320 bp, Heterodera glycines
  Promoter: Source sequence=SeqID_4284; Location=1784..2103; Strand=-; Gene=SeqID_53881
aggagcaaaatggacggacaacaaatggacagacgtgcaatgtgtgagagagagaagaaaggctgagatttgggagagcagaaaaacaaaaaaatggttggatgaataaatggaaatgagtttttgcgcgtattttttgtgtcgaatgaatttttgtcactttttcactgcatacatattttttttgtttgcgaccatacgtactctcactaattttggtattgattgataaacaattttgaaataaatgactaaactgattttaatgttaaaattaaaaacaaaaattttttttcaaaagcctccctattttcccaatg

SEQ ID NO: 105506 - DNA, 658 bp, Heterodera glycines
  Promoter: Source sequence=SeqID_42704; Location=1..658; Strand=+; Gene=SeqID_70532
ttcactatttactactaaaaatggaaatttaatttttttttcccttaaatgtgagaagcatgaattacataaattttacttccttaatattattctcgtcgtctcttcttttcaaattattttgggtaataaatattatatttttgaatatttcggcacatatttcaattaataatttcaattaattttcctaattattagttcctccatttgggctgaacctgttgctgctgcactttgctcaattgcacaataaacccacccaaaatgatgacaactttgctgctgctgaactgccacgttactctctccccaatttttgctgttgcgcgttcgaacaaatttatctaactaataaacaattaatcactcacaaattgcctaattagcgatgagttagtgaacgcatgagtgaacaacaacagcttgtgcactaaatttaaagtaaaatttcattgaaatgttttttgccctccccctcggtttttttgggcgaccaatgggcggccttttgctgaatttgtgcccccccctacccaaaaaatggaggccaaaacgcagaatgcactcctataaaagggggggtcaaacatgccaaaatcacgttcatttcccaattggcccccaatcgccggacacaaaaacccacccgaaaatg

SEQ ID NO: 105507 - DNA, 682 bp, Heterodera glycines
  Promoter: Source sequence=SeqID_18147; Location=2581..3262; Strand=+; Gene=SeqID_82734
aaagggacggagaagaatttcttctccggagttttgctcgtaattgaccgggggagctaactgatattccgtttccctacggggaaaaggatcagcgaaatgctgatccttaatccccgccttcttttgttactgtgtgtaagggggggaaaggggtactgtacgttacactattttaaattaaactaatgagtagtgtagaacacaaaaagtaaattactcatattatggtcaccgatttgtatgttaaaaagaagaggatcaaataagattgataagaatttggaaagaaagtcagaacccaatacaacatcaaagttattttccgagacccatgagtcttcttctgtgatgagtaattttaaggagtgagtttgagacgctatttcaatgttagttgaaatttgccgatagtttgcaatggaaggaacgacacaccaacacataggggtttggggaaggagtaaaatttggacttttgataacatgccattcggacatgagtaaatgagatgtcagattttaagtcaattttgcagttaattaaaacagagttgactttaagttggatgactgggaaaggagggctttggttacttgctttttgaagctacgaaatggtgttccaggaggaaaaaatatttgtaatggatagatgaacagaatagttataattgaaatg

SEQ ID NO: 105508 - DNA, 441 bp, Heterodera glycines
  Promoter: Source sequence=SeqID_7653; Location=1..441; Strand=+; Gene= SeqID_65520
cgtccttgcagattttcgctggtgtgaaggccgtgatgatcaaagttgccgcgttggggctgacccccaaacatttgggccattcgcttgaacaggtcagaagagaacactaatgacggtgacagcggcgggttgaatataacgatttttttgaaaattcccgaaatttttaaccttttttttacaaattttacatgctttgaatagcaaaaaaaaaagtcgtcgccggagaaaattggggacattcgtacgaaaaatttgttatgttttgaaggtcccaagttcaaatccaacatcaaattaaacaaattttaatgaatgcttaacaaaagtaaataatcttggctgagcaaagagtcgagactctcgcgatgcattaattataaaaattctttaattttcaattatatattttttgtttttccccgcattttgcagatg

SEQ ID NO: 105509 - DNA, 1003 bp, Heterodera glycines
  Promoter: Source sequence=SeqID_3491; Location=1752..2754; Strand=-; Gene=SeqID_84886
tcaaaatttcaataatttttcctcttttctccctttaccggcgacccactccccgaaagggtcatccttaacagtgtaaaaatttctcggtttccgagactaaaaaaccgagaccgggaaccgagaccgggaagcgaaaaacccgagaaatttcccgagtcgggaatcgagaaccgagactctcgcacatacctatcgcccccccccctaaaaaagtcggaaaagacgaacactgggattaaaattttaatctgcttaatgttgttgttgttcggtctgctaacgcttaccgtaccacgcccgaaacgactgacaatttcgttctcctacagtaccaccccctaaaaaagtcgaaaaaagacgaacactttcggagcgtgtaggggagagagggaaatgggggattaaaaacaaaaaatcgctttaatttgttgttggtaagtctgctaacgcgtaccgtaccgcgcccgaaacgactgacaatttcactcccctacagtacccctccctcccctaaaaaagacgaagacttttggagcagaaggagaggcaaatgtgggattaaaattaaaaatccgctttaatgttattgttgttcggtctgttaacgcttaccgtaccacagccaaaacgactgaaatttcgctccactacaataccaccatcccccctaagaaagtcgaaaaaaacgaacaccaatttttgctctcctacagtaccaccacacccttaccacccgttacagtcggtcagactaaagggaatattttgaaaaaatttcctccatttagtttttgtatttatttgttcaggctttgaggatgagttagtcttgcaaggctattttgaattgcttttctgtcaaggcaaaaacaatatccaagacttttttgagtatgcgataatttgcagtaaaatattttctctttttgccgaatttcacaaaaaagggacgaagaaggacgaaacagagaaattgtggaaatcgttcattgaagtgatg

SEQ ID NO: 105510 - DNA, 857 bp, Heterodera glycines
  Promoter: Source sequence=SeqID_23415; Location=1..857; Strand=+; Gene=SeqID_54122
ttgttctgtggaagaatttcaattaataatttaacaatttttaaaatttcaaaaagttaaattaattaaatatttaatgcatttatttcaattctatattgtattagcattttttaaaatttttttgcttttctgtcattttgaatatattttaatatttttgtgattttttgaatgattttaaattttgcatttttgctaaatttttgctgttcggaatagcataaaatatgtgcaatttatatgaaatcggaatgcttcttaatgctttgcaattatttaaatttttatttaaaattaaattcaatgaatgctaaattttactttccatatattaaaatattttaatgaattttggtttatttgcattttccaaaatattcttaaatatccaatttaatccataatttagtgagtcccattgattttgcatttatttataatttttgcgcaaatttcgctaagtctttgttaatgtacataataaaaactatttatttaatggtgctttattcattcattaattatacaaatatatgtatttttattattcttattaatcctttccttaatattctctatatgatattgttattttaaaataaaataattgttaattgcctttaattttgcatttatttatgtttttgtcattttgaattattatttttttaactttttctcgtgttaattgttgaatttatttttgattttataataatttaatcagcgcatctttttattagtattattatttttttgtaaaatttgatttatatttttttccttttcttggatttatgtgggctaataaacaccaaagatgtcataaatatggaataaaaagcccgaaaatg

SEQ ID NO: 105511 - DNA, 88 bp, Heterodera glycines
  Promoter: Source sequence=SeqID_29621; Location=1157..1244; Strand=-; Gene=SeqID_60091
aaaaaggaaaaaaaatttgcagtcaaaaatttatcgaatttctccaattttgtttccatatttccgaaagttattcggtatcataatg

SEQ ID NO: 105512 - DNA, 522 bp, Heterodera glycines
  Promoter: Source sequence=SeqID_1545; Location=3089..3610; Strand=-; Gene=SeqID_74362
aaaaaaggctaagaaattgaacaaaatccggcaaaaggattgggggccaaagagtatcaccacttcttatttattgtaaaccgtggctcgaaactgagccaaatttttcaaaaattataaaaaatatccatatgtaaaggaaattttaaaaatttacaaaaataaaattacatgtattctaattactagggttataaattgtatgattttgcatattaaatttagaaaatcaaaaattttttcaattgtcaaaaaaagctccttagcagcaattgttttggtgttttttaaactcaattctgtatttttacaccaaatttggcatttttttttgagggttagaagccattttgggtaatttttaaggcatatttgtgaattttttggatttttagggtatatttgggggatttttaatgcatattttatgcgcatattacaaaaatttaaaatgacaaaaaaattttagagagcaaatcaacaagatgcgacatctatggaaaagactgtgcagtgatcatg

SEQ ID NO: 105513 - DNA, 262 bp, Heterodera glycines
  Promoter: Source sequence=SeqID_8539; Location=1977..2238; Strand=-; Gene=SeqID_68443
atgaagggatttggtgacctgttttggcctttggtcatcagctcattgttttacgccgttgttggaatttatggcgcttaaatctccgctgcgaatgttttgtttgcttccattatgctttatagtttttgcaacgatcaataacaaatgtttgaaatcaaaataaatattcattcgaatgctatttattgcacaaataccttaaaaattagtaaaagggaagaactaatttcacgccattttaagaccattgtccgttatg

SEQ ID NO: 105514 - DNA, 94 bp, Heterodera glycines; identical to SEQ ID NO: 97954
  Promoter: Source sequence=SeqID_40082; Location=470..563; Strand=-; Gene=SeqID_68518

SEQ ID NO: 105515 - DNA, 1003 bp, Heterodera glycines
  Promoter: Source sequence=SeqID_42; Location=733..1735; Strand=+; Gene=SeqID_55511
catttgtcccgaaagatcatgcttaaacctttttgattgcatactgaactatatcaaaactaaatcttcctgggcaatacgacggattagggttgggcccccgaccatcgggattggaattcggggtcatcggggtcagcaagttcgggatcgggttcgattaaatcgtcggggtcgggattcgggagcccaaccctacgacggatgtttagaatattctttagtgtaaatccgatggctttagttcaaccgtttagaatgaacaaggaaaatttatcatacctaaatactaacactatccaattttgacattaattaaaaaaaattctcaatagtgtcgaatttactcgatgtcgaaatggtccagtgtcaggaaaacagtgaaagtttttgaaatagttcagtgtcgaaaattctgtgtcgaaaatgtagtgtcgaaattacttagtgtcgaaaatactcagtgtcgaaattacatttaaacgcgtcgcacatagttttcctatttttagactttaatttccgagcgcattcaagtggcctctagggccaacatgattgcgttctaggaaaactatgatttgacgaaacaaataaaaaaaaaaataattcaataaattgaagatggagtgtcgcactcgcacataattttccaaatcgaaaattctgaagcggacgcaagtgcccactgacaaaggagagtgttcgggtgatggtggaacttccaaatgaaactttgtaggtgggtagaccacccctgggttgtattgccaaattttttttctagctgcggaataagcttctgtgccgagatatgaggctttaaatatttaataattatattatattaaatttaaaaggagaagcaacaagcgaccggttggcagggtggttgtgtgtcacgatttcatttttgtaatggaaagttcgagtcccccctacgcaaacatttttttttattgtttttaataaaattacatatttagataatttaattataatg

SEQ ID NO: 105516 - DNA, 100 bp, Heterodera glycines
  Promoter: Source sequence=SeqID_27444; Location=1..100; Strand=+; Gene=SeqID_58141
gctttttctccatcgctccgacttatccttgacgcgtcaccgataattgggtgtcatgtgaatgggcttttcctcaggtggcaaatcgacacggccaatg

SEQ ID NO: 105517 - DNA, 158 bp, Heterodera glycines
  Promoter: Source sequence=SeqID_39258; Location=658..815; Strand=-; Gene=SeqID_67867
aaaaaactgggaaagcagatttttgtgagtatattcttgaatatttttttgtttatctgttggttttagcacagattttagttctttaaatctatagactttaagttttagtttgatgccaaaaatgtggatattgtccaagcaagaaaaaagttatg

SEQ ID NO: 105518 - DNA, 467 bp, Heterodera glycines
  Promoter: Source sequence=SeqID_44956; Location=913..1379; Strand=-; Gene=SeqID_72360
agtgatttaatgaagttgctgaaaagactttttttgatcagcattaaaagttactttaatgggaattttttcagaatttttgacctgcaaatattgagatttaaaaaaaaataaaattttatgccaaacatatggtacacctagaaatgggggtgaatgtatttcaactaactcccaaccagtaacagctgacacttttcttcaagtttggtatcattggaaacacccacttaaaaaaaaattcagaattgcttttgacctttacccaatttgggcctttcaaattaatttcaaaaaaaaattatgctaaactaaagaaacacataataatttaaacatggaaattaacaaaatgaactcatatccctcattttaaatacgctgaatatttcaataaattaaaaatagtttgaaaaggttattactacataattatttcaataaacaattaaataattttagatatg

SEQ ID NO: 105519 - DNA, 327 bp, Heterodera glycines
  Promoter: Source sequence=SeqID_13422; Location=1..327; Strand=+; Gene=SeqID_77306
ataccagagtcaaatgaatcagggcctgccccaattcttgaatatggaaacaatgttaatcgggtggaaggcacaaggtcatcaaattttgaaaatgtaaagccgacaatatcaaataattctggcctaggcacccgaaatcagcctcaatcaaaaaactttctaaaacaaaattgtttggtgatccaagaagaggatgtgtaccgagaaaatgcgttttttggaaaaattgactcggatcttgagatagaaaattttgttgagcatttaaagaaaaacgtggacgaaaacctaaaagtggaaattcccaaagtgggaaaagttatg

SEQ ID NO: 105520 - DNA, 271 bp, Heterodera glycines
  Promoter: Source sequence=SeqID_13144; Location=1722..1992; Strand=-; Gene=SeqID_76950
ccaaaactgccgccccatattgacctgcttattgcctgtaaagggcaatccgttatctgatagacagttacgggctgagcagtgtagacgatctgtacacctgtttgaaagaggaaattaaaagcgggcctgaaggtgggaattgtctctatcccaacccactttgtgctgtcgactgtgtacacatttcaaacgctgaccatccgaatcaacctgtgcatatcgacgggtcgctcgaattgattgctgacgttgaactgtactcaacatg

SEQ ID NO: 105521 - DNA, 313 bp, Heterodera glycines
  Promoter: Source sequence=SeqID_15130; Location=1400..1712; Strand=+; Gene=SeqID_79319
tttgtgccatcaaacttgtgcaaatttgcatgaatttttgacgtcggaccgttgctaaattgatgaccagctaaggaccgaattttaatttttaaataaaaattatcaacttttttttcttttgtgattttaaatttaaaaattttttaaaattatttttgatattaaatgatccaatttttaatccttttaagcatttaatttgaccttttaagggtcgaatttaaatttaaattaaaatttttttttcagtttttagtttatttgattttaatgttttttttcgaattaaatttgccaatttaaaaaaatg

SEQ ID NO: 105522 - DNA, 208 bp, Heterodera glycines
  Promoter: Source sequence=SeqID_11161; Location=1255..1462; Strand=-; Gene=SeqID_74511
agaaggaagggaccaccaataggcgaaggatccaatggatggccaacccaattaagggaaacggtcgattcgctggtcgaggagagcggatgccgcattgaaaatccgttgtcgcagaaactgcgcgactacggtcagtttaatcatttgcagaaatttggggcggagaaatgtaggcaaatttggcattcaacatttagtgcaaatg

SEQ ID NO: 105523 - DNA, 516 bp, Heterodera glycines
  Promoter: Source sequence=SeqID_11859; Location=1927..2442; Strand=-; Gene=SeqID_75357
aagacgcgaaaaaaagatcagccgattttatttaaccgtatatttacttttatttaactttttgtcactttgaattttgtaatttattcgttaactttgctgacataaaaattaacacaccgtttaaaaaatgagtcagtgcaaagagaaaaatctcattttagcgtatatttattattcatgaggaaagaaaacatttaaatgtgactaataagcacattcatcacatggcttccatctcaatggacgcgtcttcatccgtcatttgtttgccttggtcagcaatgcctccgccttcgttaccatttcctcgtacgcactcttcgccttcaccaatttctgcgtgacaactgcgccctccttcagatcgtcgatgtttttattggcactcttctaaaataggaaacaatttgagtaaagatagcaaattttaatgttaaactagagtcaatgcgtttttatggcaaaatattcgcgtgttaatttgatttattatttctcaactttgagttgatg

SEQ ID NO: 105524 - DNA, 528 bp, Heterodera glycines
  Promoter: Source sequence=SeqID_27616; Location=161..688; Strand=+; Gene=SeqID_58297
aagtgccgaaccgccgaaggagggatgaacagcatcagacagacaataatatgtactcctcagattgtgcccgaagcaatgatatgaaaatgatatgtttttctaaatttagaaataaaacgatttgccattttgggtgccattgccaagagtatttaatttttaatttccaataaagtgcccttctcctcctcctatctctctctccaccacttcttttggcacttttcttctcccaatggtcatcatttccatggaaacagaaggaaacccataaagagagaaggaaggggtcagcaaatgcctgctggtgaacgctgcccgtcaaaatcccgatgcgtcgaaatcccgacgcgtcaaaatcccgatgcgtcgaaatcccgatgcgtcgaaatcccgactaagccaaaatgagtcataatcccgacaaattaaaaaatataaatttatttatttttgtacatctatttacatgtatattatatattatatatataaatatatcataatagccttataaacaaaatg

SEQ ID NO: 105525 - DNA, 846 bp, Heterodera glycines
  Promoter: Source sequence=SeqID_9659; Location=3375..4220; Strand=+; Gene=SeqID_72228
ttttttgcttaataaaaagaaagcaattaatttattttatttttttgtttgaaaattagtcagacaaaaaggaaagggagagattggtttgagttaggggctggcggattaaccaaaatcgggttgacctaagaatcaaaaaacatggggcagtcagagaatgaaaatataacgaggagttgttgtgggataaattataatttagggaccggatttataagtttttactgattttttctgcgaccttgccgtttttaatttaaaaattacgcttaaacaaaacagaattgaaaaactgtaaggaaacctaacatataatacttattgtttgtatatttggttcccaaattctgaagggttctcgggaggcactaaccagggatctgacatccattatatccaattttgaatgtctaacctaaattcaagcaaaaaagcaaactccgaaaaacttagttttctatttcactcgagttcgggtaagagatttgtcaaaattggtataagattcgtgattagctactcccgaaaacccataaaacaagttttcacgaaaaaaagggccctcaccctgtggtttttttcggagtgccccaacagcaaaaaatgcagatatgaattcccagggaaagaacaaattgaaaaattttttaatgggtatttttaaattaaatttgtcacttttttaatctggcataatgttaatagttaaaaaatttgaacgaaatatgactacttctggtagataaaaatcagtgctatcacttcaaaatcacaaattccttttcaaatatacagacagaccagaaataatcttttgaactttcctttttgataattgtaatg

SEQ ID NO: 105526 - DNA, 153 bp, Heterodera glycines
  Promoter: Source sequence=SeqID_13743; Location=563..715; Strand=+; Gene=SeqID_77663
cagtattttcttgggcctattcaattcaattaaaaaaaatgaattttttttacatttattttctaaaaatttaaattttctttctcaagaattggatttttatatttttttaaaatttatctctgggattttatttgacaattttccatgatg

SEQ ID NO: 105527 - DNA, 432 bp, Heterodera glycines
  misc_feature (47)..(47): n is a, c, g, or t
  Promoter: Source sequence=SeqID_28901; Location=424..855; Strand=-; Gene=SeqID_59468
atatttgcacaatgtaattgcttagcctttcataataaaattaaatntaaaattaaattaataataatacttttatgtatttttttaaatttctacttataaaattttttgtttgtccttgaaaaatcccgaatcaacattgaagaattcggaaaagtgtctgggtaatttgaaaatccccggatttggccacctggtatgggtaaacagaccgcagctcttgatattttttgaaatatcgagattaagcatcccgagtccaaccttggctggcctgaccctatctttgaatcggggcgaactgcccgccaacagcaggagaggcaaaaaacggaaacaatccaattttaattgccgacctaattattccaattttaattgtccacctaattatttctaattaattttttgcagtcaattggcatcgacatg

SEQ ID NO: 105528 - DNA, 473 bp, Heterodera glycines
  Promoter: Source sequence=SeqID_4009; Location=1..473; Strand=+; Gene= SeqID_52791
attgtcttatttttgcgaaagggcgagagagagagagagatagagaggggggggggggagaaagacgaagagataaacagtcattagtcatgaatttaattaaatttcataattaaatattttatgcacttaaaagggcccaaagatagaatctgttgatgacatttggcaagcatcaaattgtgaagatgaaaaggtggcaaatgaagcagtgcaaagactgtcaaaatgccccatcattgagcaaattcatatccgacagttggccgtattttattaccaacacgagtttttttcaaattttttgcatgctaatgcctacaattttccaataatcaaaaattcaggtgctaattaaatacaatagactatccacttttataatttttgcggcctaattacccttaattatctccctatttttctcaggtttgaatttgtccgaaaacgcttctgacttttactatgaaatg

SEQ ID NO: 105529 - DNA, 1003 bp, Heterodera glycines
  Promoter: Source sequence=SeqID_14517; Location=939..1941; Strand=-; Gene=SeqID_78569
ataatgataatgatgaagaccggaccgggggacctgcagaaccgaatcaatcccccgggtttccgattttcataaacttggcccgggactcgagactggctcgcccttagtcgaaatagagccccaaaaattaatccacgaccgagatttgcttcaagactcgagaattgtcccgggactggataccgagccccaaaaagacatgaattttttttcaaatcgacactcaagcatccagcccagtttatcgagagccataacctagcggtagggacacagggggaaacggggggaatgaatgaatgtgtcacgcgggggcggctgggcgggcactttgaccacgaaaagcggaaattcaattcggcaaaaatgtcgtcaaaaccgatttggtcggtccatttggatcgctgcacaaagcaggggggaggggggggggcccacccacccacccactcactgatgcaaaagggggggggggggacgacggcacaaaatgccaaaaatataattccaaaattttttagcagtttttgcagctttattttgagggtgacgggggtactcaatttgtttggtcttttacggaaataaaatgacaaaaaattctccacaaaatgctaaattttaattgttgttaacctgaagcatagacaaatgcaaattaacgaccttatttggtctatagtgggaaaaatgccaataatttgaccaaaaatatgaccaaataccaatttaaaagaaaatggatgacaaattttttcaagattaaaatttaaaattatttaacttttaaattatactattgatttgcccacgaatttccctgtgggcattttgattgggaaaaaatttcaacaatttgtcgaaactatgacaaaataaattttcttctttcaaattactcttaattttatacttttttcagattttcctaaattaatttgcctattttatttatttttttttctcattctcattaaaatggccaattttggccccaatg

SEQ ID NO: 105530 - DNA, 88 bp, Heterodera glycines
  Promoter: Source sequence=SeqID_10232; Location=1..88; Strand=+; Gene= SeqID_73376
cacatttctaaactgattttatccaaaacttttttcataattctttcagtgaatatattaaagaacaattcaaattttacaaaaaatg

SEQ ID NO: 105531 - DNA, 397 bp, Heterodera glycines
  Promoter: Source sequence=SeqID_18248; Location=2100..2496; Strand=-; Gene=SeqID_82843
aaaaattggagcctgacgggattgaatcccgtcgaaacgggatttctcgggatctcgatcccggctttttgaaaaggcccgagattatcccgccttatgccaatcccgaattccgactttttcaaaattccagtgccctaaaaaataaaattgcttttttaaaaataaataatttgcatttatttcaatttttattgaatagattaactttttcatttcatttagaaaaaaatagttaatagaatgaatgcaaattttatatttaaataacaattaaatattttattttcaattttctctccggtcactttcaatgcttagctaaaccattagtgatcatcataatttatttctaattgttttttcagttcgtccatggctgaaccatgacgacatg

SEQ ID NO: 105532 - DNA, 768 bp, Heterodera glycines
  Promoter: Source sequence=SeqID_7926; Location=1..768; Strand=+; Gene= SeqID_66398
ccctttctttttttcaaagataatttgtatcagacagccgaatttgcctaaaataaatttcagtttttcttgggagcctaaaattaccaaaaaaaaaacaaaaagtttttcataaattgtgatgggagcagcaaaccactgaaaattttgaaaaagggaaatgagataaaagaagtggtgggaggggagaagggacatcggaggctttaatttatgcacgaaaccatcgatcgcttttacaaaataacattttgacatcctattccaatttttgggacaggaaatttggacgcgatttattgaatcgcgtgcagaaaccaaaatagaatcacattcatacatatttttccattattctcaaaaaaatgaaaaaaaaattttcatttgatagacaaagtggcatactttttaaccacatactttttaaccattttaaaaaccgatttacctaacctgatgctctaaaaaattcgaaacaattcgacaacgtatattactatatttttggtaacattcgaacgcaacaaagtctgacttgagacttttgaattggaaacagaaaaaatcccaaattgctctatcgccgaaatgcaaccaaattattttaccaaataaattaaaatgacctagtaagtatgtatctatgactttacgaaatacatatacggtaccatattacattattatttgagtcctataacaatacagtacaccaaaaaagccccttaaatttccattattttttagatagatttggccccgttgatg

SEQ ID NO: 105533 - DNA, 555 bp, Heterodera glycines
  Promoter: Source sequence=SeqID_23749; Location=859..1413; Strand=-; Gene=SeqID_54447
tgatgatttcaagaatatgattttagattacaataaggaaggacatgataaaatttttcaaatatgaaaaatttggcccgtcacgagacagcatgattttaacacgagaattacgaaaagaatataagcccgtttaaaaaaggaataataggaacggattgggagattattccatatggttattggtgaataaacagaacaataaatttataaactttatttttaatgttgtttctactgttaaatatttctattttataattaataattatacatttagagtttagatgtgtcaagattatgaatattggcatgataaagcacgagataatttttttgggtttattattcttgcaatttttttaagcttaataataatttgtgttgttttaatgatcatcgattgttttaacagattttttacaacggaatttaataacaatgaatttgaaaataaaatttaagaaaattgggtatttttttctggttttgtcacaaaataaaatattttagtgataatttaaataaaactttttttagcaacaggtgtaaatg

SEQ ID NO: 105534 - DNA, 129 bp, Heterodera glycines
  Promoter: Source sequence=SeqID_17062; Location=2356..2484; Strand=-; Gene=SeqID_47413
aaatagacggtagcgcgcctgtcaaagggcacacacacacatgaaaatctataaataggcacgtaaatggatgttctgtctacttgacgttcacttaataaattcagtggcataaaactaacaataatg

SEQ ID NO: 105535 - DNA, 328 bp, Heterodera glycines
  Promoter: Source sequence=SeqID_30731; Location=350..677; Strand=-; Gene=SeqID_61133
gatacagaatttctttctttttaacagatggtacgaatgacgaaaaatcaacaaaaaaagtgaaagattttgaattttattaaaaaaccaaaggggggaggacccttttgttttgcaaaattttttgaaataaaaaatcgtgaatatacttatattcgccaaattatgctcaatgcttaatgtgttcatcattctatatcaaaacaaacaaacaaaaaaaaatgtgaccaaaaaagtgaaaaaattttcaaaaaaggtcactttttaactagcgccaaaaattttaattgcccctttcatttggtagaaaaagaaattcgtcattatg

SEQ ID NO: 105536 - DNA, 270 bp, Heterodera glycines
  Promoter: Source sequence=SeqID_12519; Location=1842..2111; Strand=-; Gene=SeqID_76167
tttttaggggttgaattaattatattgaatttaaaaaatcaaaattattgaagtaatttatttatttctgaaatttccctcctgggttttttaaaaaaattcaaaattgaaaaatttctaaagatttaaaaatttaataaataattttccgaaaatactttatgtataataatgcttgatcaacctgaaatttcaataaatccctttcaaatttttaaaactattttttaatttattgaaaatttcagttattttggcctccaagcaatg

SEQ ID NO: 105537 - DNA, 991 bp, Heterodera glycines
  misc_feature (100)..(100): n is a, c, g, or t
  Promoter: Source sequence=SeqID_29868; Location=408..1398; Strand=-; Gene=SeqID_60336
atagaaaatgttatatattccatatttaatcattttctaatgcttttatccaattttaattggcaatctttgtcaaatttctgttcatcaatttaaaatntaaaaaaaaataatgatgaaatttaagctgattttgtttgatcatttcattttggttgaaatgaatgtttttattatctacagaatgttgaacagggggagaatcatgaaaagccgaagaatatcaaagaggaataatagttgagaaaataaatattattaaaaacaaagcaattaggcatttaatgaagtcattttaattaattaattataattcgatttcttattaattaatggtctaaatttcgaaattgaaactgccatttaaatcaccgctaaaatggaaatgccattccaaaaatttgcccgtttttataactttcttcgtcatgcgcctcgggttaattttaatagaatcaatcacccacccattggctattttcccaaatttaagtgttcgtctatttcttttccttatgttgggatcaaattagggcaagaaaataaaattttgctctactatttcttcttttgtctcattcctttgatccttcattatatttattagtcctatttgatctttcttttcgcaattttggtaagtaattttacatttttcagaaaattcttcagatttatgtaattaattaattaatttttttaaaacctattctatttttaatagcaattaattttctccaatttttatcaaatgaattgcaaactacgaatagatggacagtaatattttgctgcggaaaattgcaacaattagtcaggttttatcacgccatagttgtcatggactcattttaaacaaactcataagtgcggtgccattcctccacccaagacttttgaaattaaaacgggtaattaatgacccaaccaaataataattaatatttcaatttcttattattctggtcattaataaactgttgcaataatg

SEQ ID NO: 105538 - DNA, 181 bp, Heterodera glycines
  misc_feature (31)..(31): n is a, c, g, or t
  Promoter: Source sequence=SeqID_16055; Location=1501..1681; Strand=-; Gene=SeqID_80414
cttctgaccattttcgggcacttgtaaattntggtgaaataaattaattattggaggaagtcaatgaaaaaacaaaaataaatacttttttaatataataagtacaggggcgaagacagcttatttgttcgcaaatgccattgctaacgctaaccagaaaataatctttttcagcctaatg

SEQ ID NO: 105539 - DNA, 53 bp, Heterodera glycines
  Promoter: Source sequence=SeqID_6654; Location=1605..1657; Strand=+; Gene=SeqID_62345
tggcggcaccggcacaaccaccatcaaagtgattgaaaggtaacggcaaaatg

SEQ ID NO: 105540 - DNA, 59 bp, Heterodera glycines
  Promoter: Source sequence=SeqID_40397; Location=249..307; Strand=+; Gene=SeqID_68746
agttttactacaaattattccaaaaatacaaaaattcttttaggaacaaaataacgatg

SEQ ID NO: 105541 - DNA, 396 bp, Heterodera glycines
  Promoter: Source sequence=SeqID_10128; Location=343..738; Strand=-; Gene=SeqID_73219
aaaaagtctcgtgttttcagtctcgaacagcactattttgctgttagttattccacttccaatcgttgtacacaaattattaacttacaaaatttatcgtcttatttgtcgttaaataaatgactttttatttttattaaaaattttgtatttcaactagagttgtatgggaccgggtactgaaaaacacgtacaactgagtacctaagtattttgaccgggaccgggaaaaatcccgttaaaacttttttttgcgccattgtacaaatctgtggccaaataattatttgaagaaggtaggcctgatcgccatcgccaaattttggaatgtcaaaattggcatagccgagatttgaccaaaatttagaccgaccagaaaatcggttaagagacatg

SEQ ID NO: 105542 - DNA, 1003 bp, Heterodera glycines
  Promoter: Source sequence=SeqID_4799; Location=1504..2506; Strand=-; Gene=SeqID_55765
aacggaattcgcatttcctccagtgatatgttcatatcccattaataattgttattttaactgttttacaaaaagaaaattttaaaaataaatttaaaaacaaatatattgcctaaaaattttcaaaaaattctctcgaaagtgattttggtaaatattgatcataggccccaaactcaaaaatgcttaaaaacagtcagaatcgatgtaaaaaggtttgaaatgtgttggaaaaatagaattaggggcgcgcttgccctttttcaggatgaaaagtgccgaaaatggagtgccaaacaattcgaacaacgaaccctactcgaaaaaaaccgaaatttaattttcgacaaaaaacaaaatttgtaccacatcttactgtggaaagtccaagtaccttaaggactacagaagagaatcaatgacgcagtcacctttggacagttattaaaaagaaataaggaaatattcgatggggtgcgatcctttcaaaaaattactctcgtcttctacccccccccctctctttttgtgcactgtttcgttttaaaaattggttccgaaattttaatgtgttaaaaaaaaatttttttttatggtctgtaaaccacataagtaccggttttgctacccctatgaaaatgtcatggtcccggcaaaggaaagcacttttctagtgtagttttaggagctgatcatgaatctggcgttaaattgatatatgataagactcgttatttctttttcgaaaaatctgaaaaaatcaagatgaaaatcattgatgaaatcatagatttttgtagttttgacgtcagcttctttcccaaattccctgtttattttggcctctttcctgaacgtgtccccataatgtcttctctgatatccaaatttctcgcaaatcgtttcccccgatgagtccgattcgcccaattttatgagtttagtcctaacaataaccgtttttaaagattaataaacgtattatttttctgccttcaacatg

SEQ ID NO: 105543 - DNA, 442 bp, Heterodera glycines
  Promoter: Source sequence=SeqID_965; Location=757..1198; Strand=+; Gene=SeqID_65066
ttttgttgaaaagcggactatgatttattaatctcgtgaatgacccaaaaagcccaaaagagaaaaacggcacatttaattcacttaattattgcatttgtcctcaggctatatgtagtaatagtttagcttttcaattttgctttttgaattgttcagtaaagaaaacccactcaaaataaacaaaagttgtttgaaaagctttgtttcttttctcaattacatattgcataaaatgaaatggaaagagcattacataataatttaatttttacaaaaataaaattggtcaattgagggaaacaaaaagaaaaaagtgaatggcgaagagggggggggggggcgaatagctgaagctgacgaactttgtgccggtgctgttatggtgcgttaacaaccacaggacccttttaaccggcaccattaatgagaggagccaatg

SEQ ID NO: 105544 - DNA, 289 bp, Heterodera glycines
  Promoter: Source sequence=SeqID_33457; Location=371..659; Strand=-; Gene=SeqID_63520
tttatccttccccaattacacgcccatcctcactaatgaccagtcgccgcccattagtcactctcattcaatcattttcctgcaacatttctgctttttttcatttgtttaatgggtgtaattcaattgcttattaatgattcgctcgctgcccctttgatcagtggtcacttaaatggccgtaattgcgaaaaattggctaaactttccaaattaattgcccctaattatttataattttaagaattttcctcgattatctctttttacgtaattttcctgcaaaatg

SEQ ID NO: 105545 - DNA, 87 bp, Heterodera glycines
  Promoter: Source sequence=SeqID_45271; Location=1..87; Strand=+; Gene= SeqID_72600
tgtttgttttcacagaatcccaaattaaaaattaaattaattgcctgatgcgcccggtggaaattgccgactccgaagtgaacaatg

SEQ ID NO: 105546 - DNA, 1003 bp, Heterodera glycines
  Promoter: Source sequence=SeqID_8065; Location=828..1830; Strand=+; Gene=SeqID_66868
tttgtattttattaagtaacggaaaaaaaattgttttgaaccgaatttatataaaaaagaaatgagacgtatttattttgtgctaatttctttgattttggcacaaaaattatataataaaaacagaaatattgagcccaataattttttatatattaatctgcataagtgcatattgatgtgtatatattagaacttaatgcctaacaaattaactcaaaattccctaattattccagacggcgttttgtcggcagcgcctgactcaaatttattttatcgtaaaaagcaaattcaaattgctcataaatatgcattttattgcgatctctatttttcttattatttctagtgatttacataatatttgtattaaatgaatgggttttaatatcatttccttattatgtctacatatttacataatgtttaacgccatggggattatacattattatggttacatatttaaaaaatattaaacgtcacgggtccgttttgtatattgattgctctagattgatatattcatttccgtattatgcccacatatatacgtaatatttgttgggttttaatattttttccatattatgtctaaatatttacaaaatatttaaatgtttaacgccatagagattattccttattattcaagggattttgtttaatttctctagctcgattatattcacttccttattatgtctacaatgtttacgtatatttatattgaatggatattcctattgcgtcacaaccggaaagaaataatcgttaaattaataaagaaaataattaattaatttccctacatagatatattttcttcaaatacatgcatacgcatataaataatgagttgatgaaaaattttatttattttttatattaatttaatagcatgaaaatatttcattagagagatcagttaattattttaatatattcaaataaaaattttatggctttagacagcggaaaaatatttttttaaatgatg

SEQ ID NO: 105547 - DNA, 82 bp, Heterodera glycines
  Promoter: Source sequence=SeqID_12001; Location=237..318; Strand=+; Gene=SeqID_75524
gcctttgtcttttatcccaccgattgttcccccattggcactttctccccaattgaccccccaattgtctgattagaatatg

SEQ ID NO: 105548 - DNA, 516 bp, Heterodera glycines
  Promoter: Source sequence=SeqID_23605; Location=1456..1971; Strand=-; Gene=SeqID_54302
aaaagtgagaaatagccgccgggactcagttggccctcggagaaaaaaacctatagtttttccgaattctcctcaaaaagttgtaagacccttccactactttcagacccgtcccattagccgttaagctcaaattagtttttgaaacgaaactcaaaacctatataacatatatataactagcgggtgcgtgaaccgtcggatctgggcttgggataaagcgcttcgcgcttcttgagcttcgctacctaggctgtaaagcgattcaaattgatcgaattggttggagagatttttttgaatttttaaaaaattattatgggtttttagtccacatcgaggcacaagacgggcgcttcgcgcccgtttttcaaattttgttggccttacagagattagaagaggtacaactgtgattagaagaggtacaacagtgatagaagagctacaactgtgattagaagaggtgcaaaagtgataaaagaggtacaaactgtgattaggagaggtacaatg

SEQ ID NO: 105549 - DNA, 122 bp, Heterodera glycines
  Promoter: Source sequence=SeqID_36601; Location=1..122; Strand=+; Gene=SeqID_65872
ttgcctttgtgccaccaaagttgctcatgctgtgccccctcctacgattcatttcggcattttagaatcaattaattaacatagaattttaatttaaactttaagaattgtccgtgtccatg

SEQ ID NO: 105550 - DNA, 971 bp, Heterodera glycines
  Promoter: Source sequence=SeqID_13858; Location=545..1515; Strand=-; Gene=SeqID_77805
cattttcgcaactgtagatcctttattagcctgcaaatttcaaaaagttgcttttctaaacatttttggccataaattttttgaaacccaccgaaattttttgaaattttgtaggctaataaatagggcccggatttttatgtgctaaaaatcctgaaatatgtaataaaatatgtgctaaaaaatgctgaaatatgtgctaaaaacccccaaaaatgccaaaatatgtgctaaaatatgtgttaaaaattgaaaaaataagtgtgtttttgcataaaaattcccaaaaatctcattctttatcatttttagcccatacaacgcaaatcaaatacatttcgaagtgtttggggtaaaattgtctttttttgataaatcatttctataaattgaaagttccagcagagaacttcgaaatccaatgacgaattaatgaattcgagatttcattagtttctacaatcgaagaaaacattttttaatttgaaaattatgttaataattaggaaaaaagtcgatttttagggggtgtatttttcaattttcttgtatttttattgcaatttttctcaaaaatgccaaaatatgtgcaaaatatgtgccaaactccaaaatatgtgctaacatattttatgtgacaaaacgccaaaatatgtgtttttatgtttttataagtcgctctaaatcaaaaattgttcggagataatgctatttttgggcttctctcgccataactaagccgcaaaaaaaatatgtaaaaacataaaaatccgggccctaatcatgacacataaacaaaaagatacaaaaacattcatcaatcccttttcatggctataaaaatgtttgttttttcgctttgtctcgcatttgaaaaaaaaaataaaaatttctaacgcaattaattattctgctctttgtgtgacatcattcggaactcggccaaaattgtgctaattgccacaaaaatg

SEQ ID NO: 105551 - DNA, 392 bp, Heterodera glycines
  Promoter: Source sequence=SeqID_21531; Location=1..392; Strand=+; Gene=SeqID_52141
agacggcgagaactttgtgccgcttgatgcaattggtaagctgcagatgtatgtcagagtttgactcttttcttaattggactttgccgatcgtgcgaaattccgcattagggcccgtaacaaggtgttcacgctgccgctgcgacacccggaggtgcacgccgccgtcccaagcttggaagacggcgtaaaagaacaaaaggaaatgactcagatggcataagcctggtggaccctcgcccggagaatgccccttcgccacgcggaaccaaagagttgaagaggaaactcgcacagaatccgcttgccagtagcctactcaatcgactgtttgttgggtctgggttcgtcggacaagtcaaacaaacgagaggatttgttccctcaaaatg

SEQ ID NO: 105552 - DNA, 462 bp, Heterodera glycines
  Promoter: Source sequence=SeqID_19791; Location=1..462; Strand=+; Gene=SeqID_84530
ttggtactttcctgtttggaaggcacaccacatttacaatatgcaacaaacattgttcaatattaaaagaagacttattttgaaggcataaaagcaacaatttccgccaaaatttcctcaaatgcagcgacgttacgtcgctaacagccctcgcgtcatagaaattcgcataaatacgaatcaaacaattttaaaaaaatggagtgtgccttcaaaacaggaaattaccaaatattttaatatgattgaataaacaaaaaattctactttcttcaaattgaaaatattaaaaaatataaaagtagaattttcaagaattattgcggttctggttgactccactcataattattttaattattttttaattagactaatttccattaagctaattatgaatgggtatgagatatgtctgagcattaaaaatagaaaacgggcgaaagtatcgcacaaacaatg

SEQ ID NO: 105553 - DNA, 389 bp, Heterodera glycines
  Promoter: Source sequence=SeqID_1413; Location=180..568; Strand=+; Gene=SeqID_73381
tttctcttctttatttaattgtgtcttcaccaaaattggaataaataaatatttattctttggtcaagtgcaaaggcacaacaaattggcgacgcccgtggcagatatttcgacatttaatttcttcaaagaaatttcgtctgttttggatttgttggatttgcttttagcaccaacaaattttttccaaatttcatcggagcgaacttcagccagtcggcatttgaattttccaaattgttcgtcatccctactgattagcttttagcaatcagtagaagttagcgctgctgataatttgtctaggcgacatttattagctcatccacgcgcacccactcagtttgtatctaggcgctgcaaacataagagtggtaacgacaaaaatg

SEQ ID NO: 105554 - DNA, 135 bp, Heterodera glycines
  Promoter: Source sequence=SeqID_7884; Location=5842..5976; Strand=-; Gene=SeqID_46494
ggcacgcccttttttgagtgatttggccaaaatttgtgccaaattggacagattccgcccccgagcattgacttcactttgccgtccccgtccatcggtttgagccaattgccggtggttgatccgccatggatg

SEQ ID NO: 105555 - DNA, 77 bp, Heterodera glycines
  Promoter: Source sequence=SeqID_25728; Location=230..306; Strand=+; Gene=SeqID_56472
cgtaagtcacttttttgttttggccaatgaaatttttcttaattttcccactccccactttacagtttccggtgatg

SEQ ID NO: 105556 - DNA, 452 bp, Heterodera glycines
  Promoter: Source sequence=SeqID_18655; Location=1..452; Strand=+; Gene=SeqID_83313
gtgaaactaattaaatcttaaaaaatattaagcgaattattggggaacggcactacaacagtttgccgcagtgaggccaaattttctatttggaggagaaaaaaagattgaatctttgcttggcgttgtggaccgattaggcacaattgcggcatacttttttgacccaacttacgcagaagaattcaataacgaatttgacaaattgtttcaagaatggcccgagccaaaattaattaacgagacggaagtgagtggcgaaaaaacaacatttggccaaaaaattattgaaactgttctgcaaattagaaaaaagtagtccaataaaaaaggggaaagaaaaggttgaggaggactgttcatcagcagcagaacaggaatcactcgtcatagatcgggcaaattttgaaaattttttgaaagaaaatttggaaagcctaaaaacggaaatg

SEQ ID NO: 105557 - DNA, 246 bp, Heterodera glycines
  Promoter: Source sequence=SeqID_27039; Location=434..679; Strand=+; Gene=SeqID_57767
agaatttttattaggtatttaggtttcattgaattattttatttttttaagtgtccaaaaactattaataataaataagatatttatgttattctaatgaaattaaatttattgaagatcactcttaaattcaatttaaattaaaataatatttgaatgcgtcaacaaataagggtgttggataatccgactgatgatagcaatcaacatttttaaataataacattattatttagatattaaatg

SEQ ID NO: 105558 - DNA, 1003 bp, Heterodera glycines
  Promoter: Source sequence=SeqID_9351; Location=954..1956; Strand=-; Gene=SeqID_71094
tattaaagaagaaaaattaaacttttaaataaacaaaaaaattatttgaatgaaaaaataaatataaaatttttctcaattttatttattagaaaacttatttaaaattatttacctctatagtttggttgttccttgaattttctcctccacttaagaacttctgagtccaaaaatatgtttttgcatcaataattcgaaatgggaaaattctatttaaaaatgaatgacaattggtatgcatgattattagggctaggatttttatgttttaacatactttttttgcggcttagttatggcgagagaagcccaaaaatagcattatctccgaacaatttttgatttagagcgacttataaacacataaaaacacatattttggcgttttggcacataaaatatgttagcacatattttggggtttggcacatattttgcacatattttggcatttttgagaaaaattgcaataaaaatacaagaaaattgaaaaatacaccccctaaaaatcgacttttttcctaattattaacataattttcaaattaaaaaattttttcttcgattgtagaaactaatgaaatctcgaattcattaattcgtcattggatttcgaagttctctgctggaactttcaatttatagaaatgatttatcaaaaaaagacaattttaccccaaacacttcgaaatgtatttgatttgcgttgtatgggctaaaaatgataaagaatgagatttttgggaatttttatgcaaaaacacacttattttttcaatttttaacacatattttagcacatattttggcatttttgggggtttttagcacatatttcagcattttttagcacatattttattacatatttcaggatttttagcacataaaaatcctagccctagtttttattatcccgattcgttttttgcctgcaattttctaattcataatttcttgattataaaaaacgtaaacaattatatttagtgccataatg

SEQ ID NO: 105559 - DNA, 1003 bp, Heterodera glycines
  Promoter: Source sequence=SeqID_2752; Location=1173..2175; Strand=+; Gene=SeqID_81414
gacctggacctggatttcctggacaaaaatccaggtccaggaaaaatccaggctcatcgtgacctggatccaggcctggacctggattttttgaaactaattttaaaaatcaaaaaaaggtttaagaaaatcaattaattgcttataaatagggctggaatttttatgtgctaaaaatcctgaaatatgtaataaaatatgtgctaaaaaacccaaaatatgtgttaaaaaccaaaaaaaggcctaaatatgtgttaaaaatgcaaaaataggagctaaaaattggaaaaaccaatggtatttttgcataaaaattccaaaaaactcattctttatcatttttgcccgcacaattgcaaataaaaaacatttggaggtgtttgagggtaaaattagtccttttttgataaattgtttttaaagataatttttccatcagttgagtaagtgccagcaagaaacttcgatatccagtaacgaattaatgaagaattcgattttcggtacacgaaataaataaagaaaattttgaaagagcctataaatatggcaagaaagttgatttttagggggtgcattttttaattttttgtgtttttcttagatatttttttcaaaaatgccaaaatatgtgcaaaatatggccaaaccccgaaatatgtgcgatatgtttttatgtgcgaaaacgccaaaatatgtgtttttataagtcgctctaaatcaaaaattgttcggagaaaatgctatttttgggcttctctcgccataattaagccgcaaaaaaaatatgttaaaacataaaaatcccagccctaattatacgaaaaacaacattcacttagtgatgtttaactttttttctgcatgttaaatccaccccaaattttgaatatcgatagagaaaaaaaaatctacatagtgtaatacagccattttatactttatacactttttcatgagatatgttaagatttgtaataaaaaattattttgtgattcaatg

SEQ ID NO: 105560 - DNA, 1003 bp, Heterodera glycines
  Promoter: Source sequence=SeqID_5856; Location=450..1452; Strand=-; Gene=SeqID_59454
gattgactaaaaggatggatccatccctttaagattgactaaagggatggatccaaaaatattgtctccatccctttaccatggatccatccctttaagattgactaaacgtcttttttactattttaaaaataatgtctccatccctttaccactgactaaagggatggatccatccctttatgattgactaaagggatggatccaataataatgtctccatccctttaccactgactaaagggatggatccatccctttaagattgactaaagggatgcctaaagggatggatcaatccctttaagattgaccatacggattttttcatccctttaaaattgactaaacgtcttttttactattttaaaaataatgtctccatccctttaccagtgactaaagggatggatccatccctttaagattgactaaagggatggatccaaaaatattgtctccatccctttaccatggatccatccctttaagattgactaaacgtcttttttactattttaaaaataatgtctccatccctttaccagtgacaaagggatggatccattttaaaaataatgtcttcatccctttaacagtgtctaaagggatggatccatccctttaacagtgtctaaagggatggatccatccctttaagattgactaaagggatggcctaaaggtatggtccatccctttaagattgactaaagggatggctaccattttgtgtgagggggggggcagtactattagagtgttgagagactgtgttaaagagagaaactaaaaaagtttcataatgccaatttttattttttttattattctagcaatatgtaaacaataagaatttgtcataatacatcttacgtaatcttcagattttcatgacacatatttttgataaaattatgaaaaatttcgataagacttgtaagctcatttatttttgcaatttataatatatttattcacagacaagattcctaaaaaaatg

SEQ ID NO: 105561 - DNA, 468 bp, Heterodera glycines
  Promoter: Source sequence=SeqID_5770; Location=4982..5449; Strand=-; Gene=SeqID_59173
aaatcggaggaggaaatattttcttcatcagaaaaaaacggaatctattaattcacttttttaagatatatattttttaaatatacatgaattaatttaagcctggaacatttttaaaattttaccttttttaaattttgctcgaaggtctttgaaataaccccaaaaaaacccaaataaatttaggttttttaaatttattaaaaatcattttgattgatttaattaatttttatttgctcatttatcacattaatattcaaaattattatgaaacgactttttatttcaaaatgaaaaccaaactctgcataatttttacattataaattttagacaatttgtgcattaatttttcattttatttcttttcctctttttatttgatttccatttccccatttatttttttcgtatttatttcattttttcgcttcgctttcgttagtcttttcgcctttaaaaatg

SEQ ID NO: 105562 - DNA, 724 bp, Heterodera glycines
  Promoter: Source sequence=SeqID_2486; Location=2644..3367; Strand=+; Gene=SeqID_80012
ggtgggcggggggtcagatgggtatggaaaataggacattctatataaaatgtttccttgagtaatttaagatttttttatcagattgaaaaatgttttttttttggttttctcaatttttgtcagtttcatttctgtataatgttataatatattcttacaattatttttaaactatttatatctatttatattcctttccattttaatttcaaattaattaaggaaaagttaaattacttaaattttaactattatgcgagacaaaagaaataattgtgcacagaatattaattaaaaatttgttattttttatctctcttgatgaatttttacttaaaccctcattaaaatgcccaaaattatttttatttatttattcaaaaataaaaataaccaaaagaagggctgtgtcacttacacttttggtggaaataaggtgaaatgggaagtactgataaaagacaattgaaattttgactggagaagcagaaagtagaaatgtcagacctccaacaaagggaaatttggttttttataggggttggagaaaaaagaaatttttttgaggaaaatttttaaagaaagtttgaagtaggatgttttgttttttaattttatttgaagaaattgttggaggtctgggtgaactatttattgaaaagatgagggtattgttttcgagcgattgatttggtgaacaattttgtcgttgttggcaatg

SEQ ID NO: 105563 - DNA, 110 bp, Heterodera glycines
  Promoter: Source sequence=SeqID_14149; Location=91..200; Strand=-; Gene=SeqID_78149
ggtcggaattcatttattattatgctttattaaaaaataaagttaataataataataataataattttctacagataatttaaatttaaaaacaaaaccccctcaaaatg

SEQ ID NO: 105564 - DNA, 271 bp, Heterodera glycines
  misc_feature (11)..(11): n is a, c, g, or t
  misc_feature (30)..(31): n is a, c, g, or t
  Promoter: Source sequence=SeqID_7781; Location=2475..2745; Strand=-; Gene=SeqID_46472
ccattgtctcntgtcggtttcaccggtgcnncttattatttggaaatgaattggtggaaaggtgacgacgaatgacctaaaaaggttgataatgcttttgtttttgggttctttattttgtttttttcaattttgatttaataaagcaaatttcttgctcttttcatttatttatttatttttgtttaatttgcgatttatttttccattttaaatgatcataataaccatttttcacaacaaaggcatttaaatcgtaacttggcaaatg

SEQ ID NO: 105565 - DNA, 858 bp, Heterodera glycines
  Promoter: Source sequence=SeqID_16213; Location=465..1322; Strand=-; Gene=SeqID_80579
atttttaaaccatagtcagaaattagtaaaagaacgtcaaatataaaagattgaatttgcttattgcgctaaaaaaccgccgcacactcgactacggcggccagtaggtgggtgagactacggaagaagtccgcgcgtgatccgcaggcggttgaccgattggcgggggcccttcgggcacccgcaagccaccgcctgtggcgctcgtcagacgtcttcctccgccctccgtctcgcctcactacttgctccgtcttcgcatgctcccttttgcgaaattttgcttttaaattgttatttcccgttattatttttcggcactgaaatgtccattttcactgggacttagttgtcccagtgctcagatggcgtcggttcgataccttgttttttaacttagctcatcaagagctttcgaatgatacaaaatttgtgtaaattttgcgctttgccgcgcagtttttttttgatggtttaggcgttttcagcacctaagaaaacctataaaagtatttttatgcaattttgagtctgggacctatgatggatattttaccttttaaattttttagtaaattaaatctcggttttttgttcaagtcagggttcgagtttcgaatttggcaaaaatgcatgtcataatcgttttcagcgacctctaaaacccctagaaatatgtttcccttgtaatttatgaatttagaatttttgttcgaattcgggttcgggattcggaattttgaaaaataaatgtcatattcgtgatcagcgccccaaattaccctagaaatgactttttatttgaaaatttcagggggggggtcacaaaaccgaaaagaacctctaaaataaattatg

SEQ ID NO: 105566 - DNA, 805 bp, Heterodera glycines
  Promoter: Source sequence=SeqID_7433; Location=1..805; Strand=+; Gene= SeqID_64801
taaataaaaaatcacgaatttgacgcaaaaattctcatctaatttgccgttttcgttgacacaaattgaccgaaccctgtgttaattgtacaatagtaataatattatataaattttatttgtttaaaaattttattatatgcacacataaaataatataatataattgattaccattaatgaagaaatgaatcattgcagcatcatatgatatgtatatgaattggcataatccaaaaaattatgggctttttttcggcaaatattactccaattttattcgcattagcatttattccaattcttctttccacactaataatgagactctccaaatctaaatcattttttattcaaagttataactttagttatgaaaaatttaaaaaatttttcgaaaattgttgaaaggggggagaaggagtgagtgaagcggcggctaaattttatttttttttattgaaatttttcaattttttgagcactgaaaaaattatttaaaaaattcctctcataaatatttgcttgaattttttcaacccattttgaaatttttaaggcaaaaaaagaagctttgaaggatgtcaattaccgaaaaaattgacgaagagatagtaaaactgaagcaaacaaaaaaaaaacaatttttaaaattcgagcttttggaaaaatcggcgaaataaaattttaaattattaattattcctattaaaattagtttttgattaatttcaactaattttgaacatttaagcatcattcataactttttgtataatcatttttatagcattttgaaaaaatg

SEQ ID NO: 105567 - DNA, 409 bp, Heterodera glycines
  Promoter: Source sequence=SeqID_1094; Location=3506..3914; Strand=-; Gene=SeqID_67696
aattagggttcggaccccgtgggcgggggtggcttttcgcggaggcgggggatgcgggggtcagagtcgcgggggcggtggcacgataattccgcccccgcggggacgggttcgggggtttgatttgaattagctccaaaaaatctcacaaacaaattaatttttatgaatgatgtgttggctccacattcctttagtcgatgtatcgcctcgattcaattccttttggcataaattacacagattttgtctaaagaatgaccaaatttattgatttatgctaatttttttaagaaaaaataggttttttgggggccggtggtgccgataggcgccgccgggggaatttttttttatgaattttgttagaaattagcaaaatttttcagaaatttcattcttttggatg

SEQ ID NO: 105568 - DNA, 127 bp, Heterodera glycines
  Promoter: Source sequence=SeqID_35881; Location=795..921; Strand=-; Gene=SeqID_65334
ttacgtgtcgaaagtcacttcggattttggtattgcgccaaattcgctctctaaaaaaatattttgatatatttattaaacggagattgcttgattgtgagaatacaaagcgaaatgcggcggcatg

SEQ ID NO: 105569 - DNA, 323 bp, Heterodera glycines
  Promoter: Source sequence=SeqID_11084; Location=292..614; Strand=+; Gene=SeqID_74418
ttatcccgtatggggcggggaggtcggcatcggcaatatactttaacagccattgattctcctttgtctaggcttttcacgctgtttttaatacatccattaaattcaatttaatatacctaaatgaacttttcattcctttttcttttgtctagattagatgtcttcttaaagtattgtctaaaatcgctttatttgcttgtaatagattcttattgtatacaaagagggttctgtttacaatgtaagttgtctttcaaaattaaatcgcattgaaatgacataaaacttattaatgctttagtggaagagggttcgaaatg

SEQ ID NO: 105570 - DNA, 1003 bp, Heterodera glycines
  Promoter: Source sequence=SeqID_910; Location=5637..6639; Strand=-; Gene=SeqID_63770
caccctttcattcaatgagtcaaccaaaccatcgattaatggctgaatgaatggaggaaatttttcttccagtaaaaaatcgtggagacgcttgatcgtcggcagtatcacagacgccgttgatttttcgcgggataacttaaaaacatttttttatttagtataaacttaaaaaatattttactttttgagtttccacatcaaaaattttaagaattggacaaatttggcgcaaaagttcgaagtctttgaatgaaatggacggcaatgaagaagaaattatttccatctcggccatccgaggtctttttggtgcagataaaacgccggcatttctttggtctctttcaaattgcattgccatcaacacttttttttgctctttgaaagcggtcaacattcgattcggtaaatcgagttccatctcgtcggaactgacttaaaattagccgaaattgaataagaaaggaaaaaattaccataacaagttgccttttcggcatattcaattgctcctgatgtctccccataggcgctaaaaataaaagcctagaaaataggcactaataactcgaaaagtagcttaacaacacccgaaaaaaaacatgtttttcgtgcgtttcatgccacggggagctcaggaaaaaaataggcttttgcctaaaaattgcatccctaccaatcactgctcaaacgttgccccaatacatttggaccgacgcggaggtggtcaaaaaagtgccaaatttatatacggaaaatgcgtcagtgatactgtattaacactggcttttccggggatttgagatttttcggtgctggaaatttgggattagattccaaattttgggaaaaattatttaaaataaaattaatttttaaaaattatgacaaaaatttaattaatcacaggggcacgcggcactatcagtaaaactaataaaatgggataacggattgccattagttatttttaaaaaaagcgcagattcaaaagcgtatg

SEQ ID NO: 105571 - DNA, 791 bp, Heterodera glycines
  Promoter: Source sequence=SeqID_21891; Location=1374..2164; Strand=-; Gene=SeqID_52530
tcatcgcaaaatccatgaggacgttttttcacttacagctcctcgatgaaattcaaattataatttatatattcaaatcaattttatttgttatcaaaattatcatcatcaaaaatttaaatcattgatatacaaaactatacgtacaataaaatcaatgaaatttatgcatattttttagttggtaaaaggggattcagttcaattgaaagagatcggacctaatcatgatcagattcataatgaagccttttttccctaaaaagcggttttggaaactcaacttgcacattttggctcacactttatttaaatacacggaaaaactgaaagtcgtcattgcttcaacaaaaaagaacatttaaattatttttagactaaaaatacgaaccgaaaaaatttgaattttcgactttttcttcgaatttgggtccggattcaaaattggtcgaaatggatgccggattcgggaacagcggcccggggccgggacacgtttttccaagactcccggtcgcggtggtttgtccaaaaaacgggaccagggccgggagtcccggcaaaatcccggagaggccccggtccgtccggtctctaatttaaggcatacatttaattttaaattagaaaattttggctcaatttattatgttgttttacaaaaacatttgcaaaactgttttttttttttgattaatcaacaacaagatttcgggggtcgggtcggtgggggaggttaaattgtcgggggtcggaaaccctgatcaaaaaattatttataccagattatg

SEQ ID NO: 105572 - DNA, 151 bp, Heterodera glycines
  Promoter: Source sequence=SeqID_15716; Location=901..1051; Strand=-; Gene=SeqID_80036
acaccacggatcaataaaccgtttagatatatatatccaatggaaattaataaatttgatccaacaagttttggattaattaatttttaccctttcatattatagaatcgtaattttatttaattatttctcagattgttgttgccaaatg

SEQ ID NO: 105573 - DNA, 89 bp, Heterodera glycines
  Promoter: Source sequence=SeqID_341; Location=3250..3338; Strand=+; Gene=SeqID_83238
tgtagataattttaatttttttggatgtgacgaatattcttttgccttctttctagaagataattgctcgcgcaaagtccgtcagcatg

SEQ ID NO: 105574 - DNA, 349 bp, Heterodera glycines
  Promoter: Source sequence=SeqID_29002; Location=1..349; Strand=+; Gene=SeqID_59570
cacacaccgtccgaaaaaacgagatgtgtaccaataaatagagagtgccagagaaaaacattatctttttttctctaattttttgtctccttttggcgtactatctaatagtttcattattaggaaaaacaacatttacttcgctacgtttcattatttttctctacgttaaatcaacaccaaattttgcatatcgatagagaaaaaaattttgcatcgatttctatgtttattatcatcgcttaaatgttgtcttaaaaagttataagataaaaaagttaaattattattctttttaaagatttaatggctaaaagaactttattacggaagcgacagaccaaaaatg

SEQ ID NO: 105575 - DNA, 138 bp, Heterodera glycines
  Promoter: Source sequence=SeqID_5250; Location=477..614; Strand=-; Gene=SeqID_57454
ctggtccagcgatttgcgtcgtgtgcatttttgtcttctctttggtggtcacttttgtttcacttgcggtcggtggaaaaatttaaaaacttttaaaattgattttaaatgaatgcgatttgccattggcagacaatg

SEQ ID NO: 105576 - DNA, 1003 bp, Heterodera glycines
  Promoter: Source sequence=SeqID_1822; Location=1472..2474; Strand=-; Gene=SeqID_47044
aatttctattaatattcgatgatttagtccaaaaatgattaattgtttgaaataattgaagaaaatttgtttgaaaattttcattaatttatttattaaataaaaaaaccaaataattttgtattattttcacttgatataaattaaaatttgaattttttttaaatttttaaaatttttttgaatttttaaaatttcccggttggtcccggttcccggtttttcttgcggtcccggtcccgaaaaaaaatcgaggtcccggtcccggcttctcaggtcccgacaagtcccggtcccgttttggcaaaaattcccggtcccgtggcactctaatttggaccaaagtttataagacatatattcgtcctcttttagaatatgcgcctgaaatttggaatccgacatacaaaaaagatataaataaattagaaagatgccaaaaatattttacaaaaattgcattatttaaatgcagacttccttacataccttacaaacaaagacttgatttattcaaactttagaagaaaggagaaaaacaattgatttagttcaggcattcaaaattattaatggtctcactcatcttaaaaaagacatattcccacaattttctggtcacatcccttataatcttagacgtaaagttgtgttaaaatcacaatccagtaaaacttcaaattcttttatcaacagaacggccttaatatggtctaaactcaacaaagatataacagatgctccatctgttgacagtttcaaaaaacgtataaataaatggattgagttaaacaaaaattcagtctgtaaaagagctccttggacttgatattaatttactaaaatctaacgtgtaagtggtcaccccttcgttggatattttatttcttctgaataaaaaaaaaaaaaaaaaaaaaatttgttccacatattataactttttgttgttttctcaaaaatttatttccagttgtaaaatttccgtttcagcttatcaataatg

SEQ ID NO: 105577 - DNA, 1003 bp, Heterodera glycines
  Promoter: Source sequence=SeqID_2930; Location=2718..3720; Strand=-; Gene=SeqID_82394
taattttcaaattaaaaaatttttcttcgattgtagaaactaatgaaatctcgaattcattaattcgtcattggatttcgaagttctctgctggaactttcaatttatagaaatgatttatcaaaaaaagacaattttaccccaaacacttcgaaatgtatttgatttgcgttgtatgggctaaaaatgataaagaatgagatttttgggaatttttatgcaaaaacacacttattttttcaatttttaacacatattttagcacatattttggcatttttgggggtttttagcacatatttcagcattttttagcacatattttattacatatttcaggatttttagcacataaaaatccgggccctacctatgaccaacggctccaattttttaaattagctactcttgaaaaacgaagaaaaatttttgacctcctaactacttacaaaattttacatggttttacacatttggacccaaattctctgtttaaaagaactaacctaaatactcgaaataagtcttttttccggttaaatgttaaattacaatctaaaaaatcttccaaatcttttgttaacagatcagtcaaggcctggaatgcccttgataaaacgttaatgtctagctccttaaacacctttaaaaaattattagaattgactcttgattctgaaagcaccaatgtataaagaattattaacttttgaggcattttattgactttgacctcgattttattttcatataaatttttcgttattgtttatttttaacctgtgatctcacttgatatttattcaattactctgtgactattttaccgtgatcagtcatcagagtaagtggttcccgcccttctgatggcaatttttttttttttttttttttctttatcgatttatctatcagctacgaacataaaagtgaatttattgggaatacaaagaaaatggtcaataaatgaattgtttcattctttcaggatttctctaatatg

SEQ ID NO: 105578 - DNA, 1003 bp, Heterodera glycines
  Promoter: Source sequence=SeqID_20394; Location=501..1503; Strand=-; Gene=SeqID_50914
ttgcactttccaaaaagggaaaagcttggataagaaagtgcatatgcactttataagttttacaattattattttatataatcacaaaaaattattttattaataaaatcaaacaagaagatgtggcatttagtcatatgaatagaaaatgtgacatagacattggataataaaaatttacaagtgcttatgcactttcatccaatgctactacctatgagctatgagcatattcactgaatagggaatattatttttacatctgtatacattttatatagtgaatataattttgtatatacatttttgcgaatataatttcgtatatacatttttgtataccttttttatagcgaatatatttcatatatacactttgtatatattttttatagcgaatatacttttgtatattttttacctctgatgtattagggtattgaataagctctgtcatagcaaaaaaaaatttctatgctgatttttttttaaattgtcatcatcaaatatgtagttaagattaatttgcatataccattcgaaagagaaaactttagctattttaagcatttttataggtaattagcaaaagaattgttttaattttagcaaaattaaaaggaacatttattattcacaattgaacactttcacgatgccattatatatcatttttaatgaaaaaaaagattttatattggtttttgtttgttttgggaacatcaatattatgagatctcatcagtctcgggtctagaaaattttagtttcgagattttgtggattaagtgttgctcggtctgtttcctcctgctggcaaagactcgggctcagcaggccttgaagttagagtgctctgctatctttggggtttagggttttcgtctaaaaaagtccgtttttgagtcctataaaattctcgatcagggaatgtttgcgtaagttagagttctctgttgtcttgagttttaggaaattttcagtcttgggttttgggctcatg

SEQ ID NO: 105579 - DNA, 739 bp, Heterodera glycines
  Promoter: Source sequence=SeqID_14400; Location=1..739; Strand=+; Gene=SeqID_78437
ctgcaggtcactttcattataaaaaaggaattttgtgagacttcgaccgaaactcaattcaaacaaagtgaacgggattttgactaaaatttgagttcatttcaattaaagtataaataattatttcagtttgcaaagataaaagcaattagaagaattttgaaatagttgaaaaaattatgtcaacgaggcaaaaaggttttaaatttcggcaaaaaagtaccgattgagaaaatttaaaattttaatttcataatatcttaacacaaataaagatttgaaatcgttatcagacctttgaattattaaaaaatgcttttttgaaatgtataataattattttcttcatttatctcaacaatattataaacttttgtttccgctttattctttgaattttaccgaaacatttgctgtggcggcgtgtaggggggtgatgtatattataagcacaaatgttcttttcatgtttggcgatgtataacattgatgcttatttttacatatttgatctgataaagtgaattgtgccaaacaatatgtcggcacgaacacacataaaaaaaattgtttggacatttattaatggaatacaatgaataaagatgggtctagggataacacaatagaagaaaatggcgaattattggacaaagtgatagatttgagaagagaggcggggacagggaaaaggggccaggccatagaccacattcataattaacttttcctaaaaatg

SEQ ID NO: 105580 - DNA, 89 bp, Heterodera glycines
  Promoter: Source sequence=SeqID_12894; Location=1306..1394; Strand=-; Gene=SeqID_47087
ggtcagctgatcatcccattttatcgataaaagaggggcggggcgggaaaaacacgtgaaaacgaaaagttaagtttggagcacggatg

SEQ ID NO: 105581 - DNA, 93 bp, Heterodera glycines
  Promoter: Source sequence=SeqID_21807; Location=2491..2583; Strand=-; Gene=SeqID_52435
ctgatcagcacgccaaatcaccatcatcaccatcaccagcagcagcatcaattggttgatcagctgtttgtggcagccgctttccagcaaatg

SEQ ID NO: 105582 - DNA, 164 bp, Heterodera glycines
  Promoter: Source sequence=SeqID_6546; Location=1..164; Strand=+; Gene= SeqID_61958
ggaaaatgaaatgaaaatttacacgacgattttcccgtctcaaaacgccgcacgattgatcacttatgtaaacgcaaaaataatcagaaaagcaatgatcgaaggcaaataattaattacttaatttaattaaattatcatgcattttagcgctgaacaaaatg

SEQ ID NO: 105583 - DNA, 685 bp, Heterodera glycines
  Promoter: Source sequence=SeqID_17907; Location=1..685; Strand=+; Gene=SeqID_82457
taaatcagagtcccaagttttttttttcaaaataagacaaaatggctcaaaaactaagattcagacctcaaaaataatatttttttctaaaactaatattagcgcgaaagaaaaccaataaaataattttattaacataaatcaattgaatattttttcccgctgatcatttttttcattttaccgcatatgcacttttttgcgtcgcttttttccaaaaaacttatttttaaaaaatttcagaaaattgtaaaatgttctttaaggcattttgggcaattacactatttgttaacagattttcaccaaaaaatgaccaatttttacaattttgagccaatttttttaagaaaacaaaagatttgggggccggcggtgccgataggcgccgtcgggaaaagcctgaaaataagggcaaatcttacaaataaggacatttttaatttctaagacctagcacctccaaataaggacaaatcttacaaataaaaacacttgtgaacttatgctaaatccctaatgttcattcggttattttaagcctgacaataaaccaatcgagtggattttgcgaattgtcgatggaattgccaatccgatcagtcgctttccggaattggaatatgtttgttctaaaaaattatgaattaaaagcagaatttagcgcaacaaaaaaatcagtatg

SEQ ID NO: 105584 - DNA, 287 bp, Heterodera glycines
  Promoter: Source sequence=SeqID_40540; Location=321..607; Strand=-; Gene=SeqID_68837
tggcgaacggttgcacgagcagttcagatgtgtatgaagtgaattgttgttggaacggaaatttaggggcagaaattttggaattgttttatcgttcattttttcttgttttatatcaaatgaatttttttgccaaaatttgttttattttcctatttaattgacttttgtgtctttaacataacaagatttactgttttcatcacagttcaaattatttgtgctttcattttattcatgaaataataaatgtgatcggattttgttctgaactgcttctgaccatg

SEQ ID NO: 105585 - DNA, 1003 bp, Heterodera glycines
  Promoter: Source sequence=SeqID_21736; Location=887..1889; Strand=+; Gene=SeqID_52336
gctgtcattcatttttgaagaacttttccgagtctcgacaaatgttgaaacattcgaaagtgccgaaatgtaacaaccgataaacaactttgccaattgtcagctttgttgcatcaatgatgcctcaatgctcaatgatttttttttacctcagggaaataattgattaattggtgattaatcgccccttccctccgttcgcaatttttgcccctttgcccccccccccccccccatttgccattttcttcgttcatttgttcgtttttcattctttccttcgccgtgccttcgcttcgcttggcttccgctgcctcggaacaaagaacagaaaaagttgggaaagcagcagcagaacccgtcccatgtccacgtccaagaatcgttttgcttatgaatggcgtaacattcccattcaatcattcattttccatcgttcctttggttgcgtgtgaactgagaaccatccccatcagaaacggacgaaaaacaattacctcgttaattgattcgccctacccaattcacgagggtttcgtttaaagtggttaattatgtgctttgataatggttgatgggcactgtccggggttaattattccgtaatcaatcgttacatgaacagagagagagatggggcgaaggagagagagagagagagagggcagagagagcgagaaaaacatgggaggggtctgtaacttaaatgcctgtgctttcgaataccgtaaaactgtgaattggttttgcgtgactaccatggtccattcatgtctattcaaaattctgcttgtttggcgttatgtttattttattccatatgatttccccgaatcccctggggcgctttttcttttccgtgtttttatttggcctgactttttcatttctctttccccatttctcatcgcttttccctaataattttgttcaaatttctctcccccacagattttcatcttcacaaatctcagcttgtcaacaacaactcatttaaaccatg

SEQ ID NO: 105586 - DNA, 203 bp, Heterodera glycines
  Promoter: Source sequence=SeqID_16263; Location=1815..2017; Strand=+; Gene=SeqID_80649
accatcaaagcttgaaactccacaaaattatcgaaatgctttttagcacccggacaaggcacttccgaccgcccccctcctcctttgcctccgcgacaccaccgccgaagtgccaatggccacaacagcgcccttcctactgtaacgtattaattaattagttgcttttttaatttatttggcaggtcgaagttcgaccgatg

SEQ ID NO: 105587 - DNA, 1003 bp, Heterodera glycines
  Promoter: Source sequence=SeqID_7511; Location=2553..3555; Strand=-; Gene=SeqID_65076
aagaattttagacccaatgaaagcgtcaaatatatttatcgagaattttatttttttttaatttaaattattctttctatacatcttttattttttgcaatgtttaatttcttttattcactttttatttttcctctccttgtcacacttttcttccttagaattaatttttgctcttagttttttctcagtttctcttttatttttacatttttataattcccctttattttatgatgtttaatgattcttattcactaaaattctggtaatatccgtttttttcagggtttctttatgttcttttttctaagaaatgttatgatttgggggtagtgtcttattttcatctaaaagaggaaatttctgaatttggctaatttctaacaaaatccattaaaaattttaaaaattttccacgcacattcacccgagttttttggaaaactgtgccgcaaaaaatgttaaaaatctgatttaatggatccagaatgtctgatatttatggtttgtttatctcctccccaaaattgttaaaagcgataatgggagacgaaaaatataataattaaataacatttttgatcggataattttaaaaataactgatttaaagcaatttcgcaaaatgttcttatttttgaccctaaaaacaaaactcatagcaatttttctctgctgaaatgtacattttatttacaaaatataaaatttttatttaataaaatgaattcagttttagtagtttagaagattaaagcatgcattttcttattaccagtttaattatgtttattaaattgtgacggaggccggagaatagatttgaactttgatcgaattaaaatggattacttaaatcgcactttttagcgtattgggacatttgcggataatttttgaaaaaataaaagctattcttgaaaaaatgaaaaaaattaaaattgcggcaccattaattctgctttttgttttactttttttgcgagtgacaaacaaaatg

SEQ ID NO: 105588 - DNA, 225 bp, Heterodera glycines
  Promoter: Source sequence=SeqID_12093; Location=2024..2248; Strand=-; Gene=SeqID_75650
ttgatggtaaggaaatgattaatgataaaatgaacaatattccgggaaagagctaaacataaaaagggttaattgttgcacttattttctaaatttacaataaattgttttaaattagagtggtacgggaccggatattttgggcaaaaccgggaccgggacattttggatttaaaacgggactttttggatgggaaaaccgggaaaaaacaggtcaaaaccatg

SEQ ID NO: 105589 - DNA, 105 bp, Heterodera glycines
  Promoter: Source sequence=SeqID_594; Location=1987..2091; Strand=-; Gene=SeqID_57149
atggtatggaaaatgccgatcaaaattatgatcaaaggcaattttccataattttggcatcgtttatggcttttgtgaatatacattgtgtgtacacagaacatg

SEQ ID NO: 105590 - DNA, 207 bp, Heterodera glycines
  Promoter: Source sequence=SeqID_14577; Location=1..207; Strand=+; Gene=SeqID_78650
acaaagtgcttaaataaggacaaagcttacaaataagaacatttaaaatttgtaagatttgaaccctcaaaataaggacaaatcttacaaataaggacaaagggtaaccctggtttagtgtataaaaatccggtctctataatttattaaacccaatttaaaaataattatttgcaattaatatactgtgattcgggtttagccatg

SEQ ID NO: 105591 - DNA, 71 bp, Heterodera glycines
  Promoter: Source sequence=SeqID_8457; Location=3844..3914; Strand=-; Gene=SeqID_68136
atgggttgttttaagataaacaatcctgatgagcgcagctattgttattttatgccttacaagcaacaatg

SEQ ID NO: 105592 - DNA, 322 bp, Heterodera glycines
  Promoter: Source sequence=SeqID_25913; Location=1733..2054; Strand=-; Gene=SeqID_56683
ttaccccgaccgtccctaatcgcaatttcaacaaattttataacacattcattaaattcaaattttgccgccgccaaaagatgtcaatggggcgcttaaagtcacttattcttttgtgtccaatattccctgcactaatctttgctgatcgccccgagccaaacaaagaaagataacatctgtatgaccatttctacaatgaaaagacgacaaattgacaaaagaaacaaaaatttggagaactaaagtggatgggaagggggggggggttaagcgatcgggccatactccgctggtcatttctccgaatattcgcgccatg

SEQ ID NO: 105593 - DNA, 362 bp, Heterodera glycines
  Promoter: Source sequence=SeqID_10735; Location=2604..2965; Strand=-; Gene=SeqID_73983
aggcgcctctctcgtcaagcaattaagacggaaattcccgatcccgtaagtctgatgaaagtccgatttgggtgcagagttttaaaaattccaacaaaaaaaattgtttttttttttgaaaatttctgttttttgaattaaatctttttggacaatttgttgagggcgggtgacaactaaatatacacatattttttgttcgaacattttttactagtaaaaccccatcatttttgtagcagttgtcgcccggcctggagacgtcgttgcatgactcgttgaaactgttgctgaccaaccatcataacccgcaccacgaccagcagcagccgcaccgtggagttcagcagcaacagctgatg

SEQ ID NO: 105594 - DNA, 527 bp, Heterodera glycines
  Promoter: Source sequence=SeqID_13092; Location=1722..2248; Strand=+; Gene=SeqID_76882
tctttccccgactgcttctacacctcctccaaaaagactcacaatcagacttgatttttgattatttaaaatttaaatactgacatttcatctcgttttgtattatggacatgatgctgcttaaccgttcagattgcaccgtttaaatacagacgggtttttgttttgttcttccacgcttatttgctgcttatatatttattattattaaaatagaaatacatatatttttgttttccattagttgatataaaatattcagatatctttcacacttacaaataataaccataagatcgaattaaagcggggggcgtgtggtgtaaggatgtgtcatattgagacctatattttcatggattttgagacaacgggactttttgacgacggccacaacaacccgttgaccaaccccaatcggtccaatgagacggccagagaacgtgcccagaggttggacaacctcatcaagtcaggtgagagaagagattgggctgaaccgcttgaattgacaatgaatcattatg

SEQ ID NO: 105595 - DNA, 553 bp, Heterodera glycines
  Promoter: Source sequence=SeqID_21022; Location=1..553; Strand=+; Gene=SeqID_51601
aacaaatttaatcgaaaaaataaataatatttcattgaagacagattatgagcatgaacattaattaaaatgattgatcttgttttttcataaatcaactaatttcacctgttaatataatctacttaattaatcaattaattcatgccttcctctattccgtttaatttaccaataatttcaggatttgtttgactaattaatggtttggagtagggttaagccccgacccagagccccccgaccccgacccccgacatttttgggacctattccccgacccgacccccgacatgtcgccccacgaggtccccggcccccgactttttgccccccgacactaattcgggggattgggtactccgagcgttttaaaaatttaaaagttatgcaaccaaaacatttaaattttacctatcactacgccaaaataagtttttttctcactcttttagaaaaattaataatatataatttgccaaattaaactttacacagatttacaattttccaggaatttaatagattttcacccaattgattacttttaatg

SEQ ID NO: 105596 - DNA, 372 bp, Heterodera glycines
  Promoter: Source sequence=SeqID_34596; Location=1..372; Strand=+; Gene=SeqID_64346
tcttttttctttttttctctttttccttccttcgtttcttcttgactatctctctatctctctttcttttttcactttttttctaactttggttgtctctgcttgctctctccacgtcccttttttgctgtctctgctcttccttttctttatgcttttccctccggtgcccataggccacgcccactgccccgggggcgatcactttcgttggtgggggagaggccaacaaaaaggccgtcccgccgctcgacaccgctcactttcgacttgacgaccacggccaaaccgattcaagaattgctagggaacttattgaacaatttcagcctttcatttcatttcgtattcattaattagccgataaaaatg

SEQ ID NO: 105597 - DNA, 147 bp, Heterodera glycines
  Promoter: Source sequence=SeqID_36702; Location=877..1023; Strand=-; Gene=SeqID_65955
aaaattatcagagtgcggaaaatcgcatgtcatctaagcctagcaaaaaatggtctaagtaaatatcgtaattacgctcaaaaagcttctcaaacaattttagcgcttccaattccttctacaatcgcctttatacatcccattatg

SEQ ID NO: 105598 - DNA, 64 bp, Heterodera glycines
  Promoter: Source sequence=SeqID_17704; Location=2006..2069; Strand=-; Gene=SeqID_82237
aaatttttagaaactttttttgaaattttaatttttttaaaggaataattccctgctaccgatg

SEQ ID NO: 105599 - DNA, 142 bp, Heterodera glycines
  Promoter: Source sequence=SeqID_3320; Location=4928..5069; Strand=-; Gene=SeqID_84196
tttgagattgtaagaaatgattttgtgaatttcttaaaataagtaaaatgaaaaaaatccttaaagattttaattatttatatatttttaaaaaatttttgaatgtttttaataatttatttgagttttagggacgaaaatg

SEQ ID NO: 105600 - DNA, 977 bp, Heterodera glycines
  Promoter: Source sequence=SeqID_6903; Location=2075..3051; Strand=-; Gene=SeqID_63246
caaacccgggaccgggaccttttcgggttgaaaaaccgggaatttttggctgggaaaaccgggaaaaaccggaacaagtcctggtcccggtcaaaaccgggacttcggtactcagttgtactcagttgtacgtgttcaggtcccggtcccgctcaactctaataaaaatacagagatggtcaaatgtttttatgaaaaggtgcttccaattggtatttgctttgataaaagttttcaatgaaaggttttaaaattattttttggcattttttatagcacttttttgggcttccaacgacatcgatcattaatttccccaactatgtaattttggactcagagcaacattgccttagtgtgccacacccttttttgggtggtcataaattaataatataaattattttgagattttgtatatattaattattaacattttattgtaattttatttgaaattttgtcataaaaatcttttttcaaaaatgcaaatcaaaaatcaattttaaaataagataaaaatctatttatgcttaattagttgattttcggcattttgtttttatccactgttctaaaaaatgaatttaattaaattatgatgccgggaattggtccaatttttaatactcagtttgtcatttttaagactgaatttaaagttctaaaaatgatgaattttttcaaattaaattcacgtgaataaaaaagtgggttccaagtaaaataaaattgaaatcattttttttatttgcgtagctttcattaacggatgcaacgtaaccaaagcggaggcgatcgtcactaaagagcagatgaataaataaatttatgtaatttaatgaaggttctattgtctgtttaaacaaagaataaagcgtattaaaatttaaagtaaaagaaagtgcgtataaaaagcgaaaaatgcatgcaatttatcaattaaattttttaataaaagaataattagcaaaatg

SEQ ID NO: 105601 - DNA, 1003 bp, Heterodera glycines
  misc_feature (60)..(60): n is a, c, g, or t
  Promoter: Source sequence=SeqID_14863; Location=573..1575; Strand=-; Gene=SeqID_79015
taaatgtcatcgcgtaaaaaaacatttttatttcatttctattaaaaagtgtctgaattntaaagaagtaaggatttttggaattttcctaattttgatccgtagctgattttttggatatttttcaagacgatttcttgtaagattattttttttataaaacaactattcgcactgtatgacacgcccaatctttttaatttgcttttaaattgctttaaaaggtctattgaatttttttaataaaattttaaaaattaattaaatacatttgggcagggatttgagataaagctgaattgccaaagttggattgtgtcatagtatcattaaatattcatcgccgaaacattgaaatgatatatttttaaaaatttgtcgtagcaaatgtgaataaaaacaactcattacttcattcattcgaagtaatcaatttaaatcacccaattatattaagatttgcttcttatgatcatttattttgtttgatgtacaaaattaaagacatcatagtggaactttaatttaaaacccaaaatgtaaaatattatttgcctattttgaacaataaaggacaagtgtatttttgcaacattctacatttctttaaagactgctgatttttttatttccggaaattttagccatattttcagagtttcttttttgtattattaaagagaattttcggatattgtgcatagtatattatttttatttatgaagctttaatttacccatataagttaaaaaatatgtagtgatgtaatttctgcctatttaatgcgtattttattgaaagaaaatagtcagaaaaaatatcaataaattaaatatattatattcatatttttatgattttatttaaaaattctttctatattttatttgattttctataatttaattattttttaaaaattaaataattaatttttctgtgttttcaatttgaattacttcctttaataaaagtttaattaattttaattatttaaagatg

SEQ ID NO: 105602 - DNA, 321 bp, Heterodera glycines
  Promoter: Source sequence=SeqID_4152; Location=1..321; Strand=+; Gene= SeqID_53380
aagtaattcatggggcactgagtcaaaaagtttctgaaaatcaatataaatacagtcaacatttttccattttattattgcctcgtcccaatctttctcaaatgttattagttgactcgtagtagacctatttctaacaaaaccaaattgaaattccgaaatttttttgttttttaatagaaattgtaaaatatttttgcttaaaattctttccattaccgtgcagagtgagcaggttaatggaaattggcgtatagttttcgagattatttttgtcacccttcttaaaaagcggaaaaacaattggattcctggcagatg

SEQ ID NO: 105603 - DNA, 134 bp, Heterodera glycines
  Promoter: Source sequence=SeqID_10345; Location=606..739; Strand=+; Gene=SeqID_73524
cgtgggaatgtcgcggctcgaatttagccgcgactgtccgatgatcggacagttgtcgaatggaaagaaatgcggggggagaaggaggaaaaaacaggagaacgggaaattgggcgatgaaacgatgaaaaatg

SEQ ID NO: 105604 - DNA, 54 bp, Heterodera glycines
  Promoter: Source sequence=SeqID_19133; Location=2185..2238; Strand=-; Gene=SeqID_83875
gaatggaagccttcatgtgcgcaatgtgtctgactttttccgacgacaaacatg

SEQ ID NO: 105605 - DNA, 112 bp, Heterodera glycines
  misc_feature (45)..(45): n is a, c, g, or t
  Promoter: Source sequence=SeqID_24649; Location=1..112; Strand=+; Gene=SeqID_55384
tggaacgcaattccgcagtcacgaatttcaaaaattcacaaaatntaatggaatagaacaccttttttctgctccatatatgccgcaatcgaacggtcaagcctaaagaatg

SEQ ID NO: 105606 - DNA, 64 bp, Heterodera glycines
  Promoter: Source sequence=SeqID_17656; Location=174..237; Strand=+; Gene=SeqID_82185
ggtaatttgtcaaatttttgttttttacaaacatacttatgttattagcctaacgatcaacatg

SEQ ID NO: 105607 - DNA, 406 bp, Heterodera glycines
  Promoter: Source sequence=SeqID_460; Location=1..406; Strand=+; Gene =SeqID_53207
agaaggagtgagatatagacggtaagagagggagagagagagagaggggtagacaaggaggtgatcaattggaagggatgagagagagagagggagaaggaaagggggagagaggggggggggggggcttggtcacttgcttgacattttaaaaagaggaaaagtgcaatttgaatagaaaaatatttttgacataatgcccgtccgggtagcaattgtcggactgtctttaataaaagtgccgcatttaatggaagtaatggtatgacaattcctgaaactattacaatacaggaacagctgaagattctcgaagagattttcaaaaagacgacggtatggccttaactttgctcatgtcgcggcatttcccttgctacccaagcaatatccggacgtgaacatg

SEQ ID NO: 105608 - DNA, 65 bp, Heterodera glycines
  Promoter: Source sequence=SeqID_36848; Location=599..663; Strand=-; Gene=SeqID_66069
tctcttccgtccttcgattttcctcgcccaccaaaatcactttgccgacatcgccgccggcgatg

SEQ ID NO: 105609 - DNA, 1003 bp, Heterodera glycines
  Promoter: Source sequence=SeqID_10985; Location=218..1220; Strand=+; Gene=SeqID_74293
aaattttgcttatattttttaaaatatttgtggtttagtggttagtgcttcagcactaatagaaatctttgttatgagttcaacaccggttgacgttttccttaaataaattttttttttcctttaattaattttttttctgattaatacagggtttcttcgtgcccccgccaccgcccccgcgactctgacccccgccaacccccgcccccgcgaaaagccacccccgcccacggggctcgaaccctaatcttaagaaaggaaaaattcttcttatctgtaacaaaagcgcaaggaattcgctgtagaattttgtgtacagcaccaaaatatgaatttacttatttttctcactaatctcaaaaaaaccaaattcgtttccaatgttcaaatgtgtgtacaactttaatatccttttaccgtgtcaaaaaattctgctgcatcaactgcaaattcaaaatgggtccgtatcgttttggcgccgacgttttggcgccaagctataataaaaaaaagaaaacacccaaatttaaaaattttgtaaaacaacaaaaaaaaacgtatttttcgcgaaggtaatactgccgatggttggttgccccccttttttgaagaaaatttttttgttttcaaaagtcatgaaaacatgcttccaatggttttcagggtcgctgctcacgaaccaggcatccatttcgaccaattcggaacccggagccgaaattcgaacaaaaaatcgaaaataaaaaatttcaaaattctctttttgttctaaaatagattaaaacaaccaaaacgttttggcgccgacgatttggcgccatgtagggaggaggtagaaatgatgagaaatcgttataatttttctgacgaagtctatcaaagagccggatttaattcttcatttactctttttcgctttggcttatgttctcttaattttgtatttaagtaatgaatcgtcaaattgatacgaaaaaacaaaagcctaaaataacgcatg

SEQ ID NO: 105610 - DNA, 1003 bp, Heterodera glycines
  Promoter: Source sequence=SeqID_16364; Location=1786..2788; Strand=-; Gene=SeqID_80755
ttttgtccccgtaggggatgaatgaaaacaattagcaaaacgtctccctcccccctacggccacttgccaccgaaatgttgtaaaaaatcttttctcatttcaacaaaatcaaacttaaagtgtaaaaaaattgcggctaatcgtttgggagtcgtgtcgtatccccacttttttaaatgatgaaactgcaaatttggaactccgaaatttttcattttcctttttttgccttatggccgaaacgaactgcaccctcgccgggtgcaccccaaaattcggctgctgaatttaaaaatttttttaaaaatttttaagagatttttggaaaaattttcaaaaaaacttactaattaaacaaagttttaaaaaaaaattagtcatcaatttttcaaaacttttttagaaatttttatggaatttacctataaaattttggattcttatatgatttctaagtttaaaaataaataaaaaattcggtgtgaaattttgtcttgttccgccctccccccccccattagtgctttttaattatcacttaatactcttaaaattaacaccatggctcctcatcagggtaaggcggtgctgcgctgagccgtgcgtcgcctggcaccgatgcattggcggcggcgccgcgtgcgacgtgcggatgacggcactgacggggtaaaatcgaatttggattaaaatcgaaaaaaatcgaaatgggggaaaaattaaaaggaagataacccgaaaaaaaaccgcggaccgcaagcggtggatgaattatgaatggatatggattgagttggggatgatccgtgccacgaatgcatatactttttaatttgctttttccgtgcctcaaggccgaaccaccccccccccccccgccccttcatacatttatttatttatacatttcaaaatacatattttcatatacctatgtaattcccctaacaaataaggtgaagtggtgccgcgcttacgtcggtgcgttggcggcgccgcatg

SEQ ID NO: 105611 - DNA, 733 bp, Heterodera glycines
  Promoter: Source sequence=SeqID_30284; Location=1..733; Strand=+; Gene=SeqID_60703
gcagggctcggatctgttcttatttataagaaatgttctgatttcgggctattgttcttactttgttattatttcttaaaattcttcataaatttagaaatttatggcataaatgttcttattttacctataaattttaaaaaattaatcatttcgtcactgctcgtttcatctcttatgagaaaaattattaaaaattatttatttaaaaaaaaaagttctcagtcacgaaatacagaaaacacattaattaaaaatgagaatttgaaaaatggaaaataaatgaaaatttggaaggaattaagataatttaattaacaagacttcttactcctcttctactattcattttttaataaaatgattaaatatttgcatataatttagtcatttaaaacaaaaaacaactcgttgttctatcattgaaacaagtgcaacaagaaatttatattcagaagcacagatttggcttggaaaattaaaataaatgtcttataaatgaatgaaaataatttgaacatttttaaattaaaaaaaatatataaatcaattaagaatataacgattaaaatttaaatgaaaaaatgaaagtcgcaaaaaaattattggacaaacattggcaatggaaaagaataacaaaagaaaagaatggttgaattaaacaattacacaaaatatgaaaaaataatattaataatatttaaaataaaaataatattttatagtaaaaatg

SEQ ID NO: 105612 - DNA, 177 bp, Heterodera glycines
  Promoter: Source sequence=SeqID_40813; Location=649..825; Strand=-; Gene=SeqID_69051
tttcttttacgtgttcaaagtatttttttatgggtattgattattagatgatgttcagccgtattatggcgttattaatgagacattcacacataaaaattttggcaatttaagcatttccgttttgcgaaaattcactatatttatcaattttcttttttttgctgatgaaaaatg

SEQ ID NO: 105613 - DNA, 84 bp, Heterodera glycines
  Promoter: Source sequence=SeqID_44405; Location=1317..1400; Strand=-; Gene=SeqID_71891
aaaaagaattgcattttcttggacacattgtgtcatcacttccgtgggtcaagctccggtacgttcagaagcgatcagcttatg

SEQ ID NO: 105614 - DNA, 225 bp, Heterodera glycines
  Promoter: Source sequence=SeqID_12093; Location=2026..2250; Strand=+; Gene=SeqID_75651
tggttttgacctgttttttcccggttttcccatccaaaaagtcccgttttaaatccaaaatgtcccggtcccggttttgcccaaaatatccggtcccgtaccactctaatttaaaacaatttattgtaaatttagaaaataagtgcaacaattaaccctttttatgtttagctctttcccggaatattgttcattttatcattaatcatttccttaccatcaatg

SEQ ID NO: 105615 - DNA, 267 bp, Heterodera glycines
  Promoter: Source sequence=SeqID_3852; Location=369..635; Strand=+; Gene=SeqID_52138
attgaaaattataataaaatcttttttttaaagctaagatttattattaaattttgaaaaattttaaaacctgaaaattggtcaacaatttgcaatgttggaaaggatcacgagaaaaaagttactaatgaaccggattattctttgaaaaaagactttgtaacattgaaagaaattttattgcgccaattcgaccaaggaaattctctgaaacttgaaagatatattggcgttttgttaatggaatacaaaactcaaaaacaaatg

SEQ ID NO: 105616 - DNA, 95 bp, Heterodera glycines
  Promoter: Source sequence=SeqID_12764; Location=601..695; Strand=+; Gene=SeqID_76474
ggtcctattcgtttgaaaatccaaataaaatgaataaattgtctcagatttcttccgactcgcaccgacgcgcgttgggagacatcgccggaatg

SEQ ID NO: 105617 - DNA, 214 bp, Heterodera glycines
  Promoter: Source sequence=SeqID_42715; Location=132..345; Strand=-; Gene=SeqID_70544
tttgggtaactatcatgcataatttatgttaattgcgagacaattacgctaataaatttatgggttggcttttatttccgaaacatttaattgacttaaaatagcggctaaaactgctcatatttgaataaatattgcgaacggcccatacttctttcctttagctttccaccaccaccgccattttggccccacttctccgtcttccgccatg

SEQ ID NO: 105618 - DNA, 1003 bp, Heterodera glycines
  Promoter: Source sequence=SeqID_66; Location=3379..4381; Strand=-; Gene=SeqID_60277
caaaagcttaggctcgggaaaatacacccctaagaaatatttaaaatgaaagaaatgggctatttataagaaagtgatgtatgaataaaaaaataattaccaaaaataaaaatatttttaataggcaaatttttgtcattaatttcttttaattcgtgatcagcgagcgaccgacccataaaaccccaagaaattccaaagagggcgcgctatatttatgaaacatttcgcccattatgataaaatattgattgcgaatgggaattcgtgaaaataaaaacgaaatttgattaaacaaattttaacctttgaaaaattttgtgtaaatttcagaatttgaccccaaacccaaaattgctattaagaaatggcaaaaaatttgcgaaattttctcccgccgacgcctcttgtgaagaaaataatcgcattaaaattttcaaattcatcgacgccaaaatctgtcgttaccccaaatttcaatttagttttgttttaaaacgcttctaaatgggctaggtattttggaagcaaattgatcatgaaaaaatataacccaaaaaattatattttaacaatttcatggagttgaaatatgtcactgaattgaataagagaaacatgacatggacaatcattgaattaatcaattttgaagttgcatgataaaatcattttatgagataatattatttaggaccaattcacaattttagcagctaattaagaatacgacgttacttttttaatatcttttcggaaaaatcaaacaaacaaaaataaagaaagtcaactatattcaaagcatacgagaaaaaaaacgaaagatatttggaggaaaatgagaggaaaaggaagaagaaaatttggatgaaaaatcagaagaaaaaagagaaaaaattagaaaatttaataaaatgaaaaagaaaatctagcaaaaaggaaccaaatattcaaaaagaaaatggaataaattgaaggaaagcaaaaaaaaagtgaaaaaatg

SEQ ID NO: 105619 - DNA, 121 bp, Heterodera glycines
  misc_feature (35)..(35): n is a, c, g, or t
  misc_feature (66)..(67): n is a, c, g, or t
  Promoter: Source sequence=SeqID_10417; Location=2692..2812; Strand=-; Gene=SeqID_73613
aattagacttgcatttagtagttaccaaaatacanaattaaagaatttatttttcgctttgaaatnntaaaaatataaaaatttaatcaaataaatatattaattataatgactgataatg

SEQ ID NO: 105620 - DNA, 488 bp, Heterodera glycines
  Promoter: Source sequence=SeqID_5057; Location=2698..3185; Strand=-; Gene=SeqID_56748
ggtgggtgggacgaatattagcgcagcggttaccagtagaacatttaccgtggccggaaaagttattgagctacctaaattggaagggccgttggttaaagtccaaccctgcgggtgcgttaccgtttatattctacagtatataacaagaaatttggtgccattttctcttaaaggatatcatgcctgattaagccaaaaaatgatatttaaaatgctaaaatttgggtctcaagattccccaaataaacttaatcctctaatctaatacaacacgtgtgactaactatcaggagattatggtaattaaaatcatgttcctaaaaccgtgccatcgagcaataaattttgtgatttcctaacgactttcggaacgagatcattaattgagggataccgaaaaattaatacgatataaatactgtacaaataggcttgtgtcggcacccatctcactgcattggttgtggaccagcggcaaccccatg

SEQ ID NO: 105621 - DNA, 149 bp, Heterodera glycines
  misc_feature (80)..(80): n is a, c, g, or t
  Promoter: Source sequence=SeqID_32734; Location=863..1011; Strand=-; Gene=SeqID_62997
ttagcgtgggacgaactcagtttttcaatggcggtgggcaaagtgcggccccattggtgcagtgccatgcccggggcganagtcagacagttgggcagcaacagcacggcccaccatgcaccgctgcagtgcgtttgttcatgtcaatg

SEQ ID NO: 105622 - DNA, 166 bp, Heterodera glycines
  Promoter: Source sequence=SeqID_1580; Location=1..166; Strand=+; Gene= SeqID_74608
agttgaaataccgagaatcccggaaattctgatttctgaaaaagaccatgtggaaaatgaggaaaacggaatagtcagaataagcataaattcggtaaaaaatgaaattgagagagatttatatgactttacattaaatacaaatccaaaagaatttatagaaatg

SEQ ID NO: 105623 - DNA, 837 bp, Heterodera glycines
  Promoter: Source sequence=SeqID_30427; Location=331..1167; Strand=-; Gene=SeqID_60835
cataatcttagcaaaattcgatgcgcattcgtcaattttgcgctctggttgtatgcacatttgcggttagaatacaaaaagtatgcagactatgttcaaaaacatcgtcgtttatgcgaaggcaaagatgtacataaatcccatcattactcttccattctcgaggataacaccgtgacagaggggtggctactgtacatttcattatacgatatggtatcaattaaaaaccagacccttggcttcggggggtactgaagtcaaaaattcgatttttagggtgtgtttttcttttttcagtcgatttttagggggtgtattttttgaaattccgaattacgggatgtattttacaaaattttcgccaaaaaattactattttttgccatttaggtttccatttttcaagaatatggtaaaatgggggtccagcgatgccgataggcgccgccgggaaaattttttgagtattttaatgcaattttgttaagaaaattgcttaaatttcaaaaattttactaaaatcttttactttttttgggtttcggggcggggtgagctttagcccactcagccccccctccctgcaaactgtttcaagcaggtttatttttgtgaaaactaagtctccgatggtcccgaaatactcgaaaaaaaaatccaacaaaaaaatacatattatataaaaaaatgggttttcaaaatgaaaaataaatagaaaaataaaaattttggtcacccaatgccaagttttaagttctgctaagtttgagctggaattgttccgacaagagccattgtggaattatgcacaagtgatcagaattgacacaaatg

SEQ ID NO: 105624 - DNA, 56 bp, Heterodera glycines
  Promoter: Source sequence=SeqID_11952; Location=856..911; Strand=+; Gene=SeqID_75474
ggtgaaaagggcaaaggggagaaaatgaaaattaaatttggtaatgccatctaatg

SEQ ID NO: 105625 - DNA, 1003 bp, Heterodera glycines
  Promoter: Source sequence=SeqID_2835; Location=1346..2348; Strand=+; Gene=SeqID_81853
aaataaataaacaatcccaaaactaaaacctattgatttaaacctaaacctattggatgggtgtgggagtgaacctaaatctattgaaggcttttattgattaataaaaaataaattaaattaaaaataaattaaataataaattataaataaattaaatacataaatttaaaaaaaaaattttttataatttaaaaaataattgaataaaaaagctaagattcattctctctctcactatctttcttttctttctctctctcactctctctcttatctctctctctctctctctctctcactctctctcttttttctttctctctcttatctctctcttttctctcactctctcactctctctcttttttctttctctctctctcattctctcttctctctctctctcactctctttcttttctttctctctctcactctctcttatctctctctctcactctctctcttttttctctctctctctctcactctctctcttttttctttctctctctctctcacattctctctcactctatctcttttctcttgctctctctaataccacacaaagatataaataataataataaattaattaaaaaattaaatttaattaaaattaaattgttaaaataataatagttaaaaaattaataaataaatttaaaataatagataaaaatttaaaaataaatgaaaaaaatataaaattaattaattaaataattattaaagtcaaatcgtattggagggacggacgtcagctgtcgtgccctttagggagggaagcgacgccgggtcatttgagagcacgcaggggccatttgagcgctcgcacgtgtcatctatgcgcccgcaggggctatctgagcgcccgctggtggtcatttaaccgctaatgactgaccgtggatggcataaaatgttagtcagacggcgactcattttagtgtagtgtggcatagcatgaacaatttagttggcaacctgtcaaatg

SEQ ID NO: 105626 - DNA, 114 bp, Heterodera glycines
  Promoter: Source sequence=SeqID_27455; Location=27..140; Strand=+; Gene=SeqID_46048
gaaaacgaagagtctgtggacgacctcgaccagtttctacacgactgtgtggcgattgacgatagcgatgttaattttgatgagacagatgcaagagatgcggaagaccaaatg

SEQ ID NO: 105627 - DNA, 733 bp, Heterodera glycines
  Promoter: Source sequence=SeqID_388; Location=1..733; Strand=+; Gene =SeqID_51070
tagagtccggcgggatcgggactcccgcggggattttacgggagttccccgtccccccccggcccccttttttcggtgaacgggatttttaacgggagcgggatttttacgggattcccgttcgggactcccgtcccggaaaattttaactcccgatcccgctcccggaaattttttttaccggactctagtattgaggtacataattttttaaaattaaaaagattagtaaaaacatgtaaaaattgaaaaaaaattaatataaaagcggctgctcctccgccatttttcattattcattcgccattttcgtctcttcaatttttctccctgacaatgccttcaaaaatgacactttgtacattttgtgcatttcttcttggctttttcccttttccttctcattttttagtcggttcgttgtgccaatgtttgtcgggtgttgtgccattctttggctttattgggaccgcttcaaaaaatcaccaaaacaactaggcgatcaaaataagaaatttaaaaaaaatgggatttaatttttcagttgcatctccggcgaaaagagcaagttttaacgacttacatattacacaaaaatttgcaaataaataggacccttataatgggaatctgctaatttcaccaacattttcaaatgcttaaatttttctgttttgctaagctaattgaaatccgtcaaaaactgtgcttaataatttgccacaacaaaatg

SEQ ID NO: 105628 - DNA, 102 bp, Heterodera glycines
  Promoter: Source sequence=SeqID_13399; Location=4482..4583; Strand=-; Gene=SeqID_77287
tagacgaaaaattaacttttgaaattgcgcttatctggagcttatgcttggcaacctttaaagcatatttggcctcttgttgctaagggaattgctgtaatg

SEQ ID NO: 105629 - DNA, 499 bp, Heterodera glycines
  Promoter: Source sequence=SeqID_31047; Location=352..850; Strand=-; Gene=SeqID_61417
aagaaaattttaacgaattggattatgattcaaatttattttttttagcccgtaaattgtagaaatgtttagaaaaattgaatttttagaattaaaattgtcatttttatttgttaaaaatattgaaaaaataaaacgcaattctttgaacaataaaaaaaatttgctttatatttatcatgggattaattatcaataaatattaaattttaaacaaacttcatttttacacgaaaatatatattaaattaatcaaaaaaaatctttatttttgatgattttaagccgaatattgcagccttgtgaaattaatagatttttaacaaaagtttcaaaaaatttgtaagaaatacagtagtaattggggctgtacagtaatttaacggaatttcttatcctgtattaccattattggaagattaatataatcagaattttccgagaccaaaagcatttttatccctcccccctgtttaggccaattcttcctgacccaatg

SEQ ID NO: 105630 - DNA, 151 bp, Heterodera glycines
  Promoter: Source sequence=SeqID_5202; Location=2846..2996; Strand=-; Gene=SeqID_45995
tgtgagtttgttttttgctgctatttataacgaaatttatgcgaccgaaaaaatagaaaataataagccgaaaattgagtatataaggcggtcttttcaacgttaaggacacatttcataacggacggacggctgctagcaacgcgcgatg

SEQ ID NO: 105631 - DNA, 61 bp, Heterodera glycines
  Promoter: Source sequence=SeqID_43682; Location=1649..1709; Strand=-; Gene=SeqID_71302
gcaaagtgagggtgaagggcaaagacacgttgaaattgtgaaaggaaagatcacggcaatg

SEQ ID NO: 105632 - DNA, 945 bp, Heterodera glycines
  Promoter: Source sequence=SeqID_6686; Location=6561..7505; Strand=+; Gene=SeqID_62493
ttttggagcagcaagtgaggcaaaagtgggaaaggatcagttggacgaaaattggttcacttggacctctcggagatcgaatctcaaaaaaagctaattaatcttccatttcgttttgttccgagtatttctctttctgtcccaatttctgtaaaccgttttcaggcatccattttcggcattgaccagaacattaggtcaacaattagcgaaggtgcactgacaacatcaaatggaaatggtttgaccacttttgaccaactgatggcacatcgtgagcatttctttcgaacactccgacggcaaaaacatcggagaatggccaagaaaatgtacgaaaaggcgcgggacagagcggaaaggggacgcgttttgttgagcaatgagcggggcattggtagggcgaaggaaaagccaatttaaaacaaaagaaacacattttggacaccaaagaacgttcctcaatcattctgatgccaattgatcagccaaaagtgctaaccgcagaaacttttgcgagcggacgaagtcgacgagtgaaaggcgaagcgcaagcgaacggtggccaaatgagggctaattagggagcaaatctaaattattaaataaaaaggtggggcccacacggagagaaagcccatcaacggaccatctgcggcaaaaaggccagcgaatttgcaaattgcgactgacaaacacgcggacgcaaatgcaaatgcatcgcaaaacaccgtagtctacgggccaatgtcagttgggcaaagggatacggtacatcgacctgtctcgagaagaactgttcgcggatcttatgttttcttgtgtttgctgttcagctttcccgccgactattggcaattgcccccagcgcttttagccgcgcggctgaggcgtttcagcaaggcggacattatgcgaagccttcggcaaaatgcccgacggatg

SEQ ID NO: 105633 - DNA, 695 bp, Heterodera glycines
  misc_feature (6)..(6): n is a, c, g, or t
  misc_feature (15)..(15): n is a, c, g, or t
  Promoter: Source sequence=SeqID_7348; Location=3393..4087; Strand=-; Gene=SeqID_64549
agaaantcgaccccngctctatccaatggtatataatacataggcattttcccactcacagctcggaatgttcccttgttaacatgcactcacgcgaaaacatgcgaaaacatactggcccgaaaaaaatgatatacaccaccccaaaaatcgttgcaaagtcatgaaaatgcaaccccctaaaaaatgaaaaaaatgcggcaaaatttaattatatttaaaatacattaatcatatgacctaatcaagacaaagcccaggtcagaagagaaagtgtttattcaaaaaaaaaaatttttttttcctctctccaaagaagaaggacaaacaacacaaatatttatcgccggagggaaaggcacaacatcagcagggggataatgatgatgttttggtgaaatcaattgatttttgttcaataaaattataaaaatattatgtaaattgcacataaaattgtaaaaaagaaaaatatgcgcatacatttttccaaattgttgatgaggataaaattttcaaaatttttcttcaattacgttaaatttcagtgaaagccctctcaaaataaaccaaaatttaaattttgctatcattcaatgcccctaaatgttttctatttttctataaaatttatttcataaaattcgttactttgggaatatttgtgtcagtatttgaatgggacgcggaaaatg

SEQ ID NO: 105634 - DNA, 99 bp, Heterodera glycines
  Promoter: Source sequence=SeqID_30599; Location=458..556; Strand=+; Gene=SeqID_61001
aattttattctattgctaggctcaatacttttgaaggttctaaatcatttcttattttaagctaaatcgcattaaagctattattctgtgccttcaatg

SEQ ID NO: 105635 - DNA, 209 bp, Heterodera glycines
  Promoter: Source sequence=SeqID_15147; Location=1118..1326; Strand=+; Gene=SeqID_79339
agtgaactgttctttgtgaggacacggtgcgccaaatcggaactttgaaattgagtcgttgtcaagaacgcactcagtaccacgatgggacaattcgtccatttgttggccaaggaaaggcaacgttttcgtttggcaaccgatcagcgtttgggcatttctttctttccaaagacggatcaaagaatctgctcggattggacatgatg

SEQ ID NO: 105636 - DNA, 122 bp, Heterodera glycines
  Promoter: Source sequence=SeqID_32329; Location=1833..1954; Strand=-; Gene=SeqID_62642
tgatgttacttgcatcgacttgacgttgagtgctgttgatcgtgaaaattgtttggagcaagggataggttaatgcaaaaacaatattcttttttggaactttttattcagaaaagccaatg

SEQ ID NO: 105637 - DNA, 72 bp, Heterodera glycines
  Promoter: Source sequence=SeqID_4659; Location=2096..2167; Strand=-; Gene=SeqID_55259
attagccaatttgggtttttgattggtgtcaaggaatactctccgcaggtcgacgaattgttggcaaacatg

SEQ ID NO: 105638 - DNA, 79 bp, Heterodera glycines
  Promoter: Source sequence=SeqID_8828; Location=1192..1270; Strand=+; Gene=SeqID_69344
ttgaagtgtaaattgcacctgccaaataatttattcaattataaaattaatatattaaagtaattaccaaaaccaaatg

SEQ ID NO: 105639 - DNA, 530 bp, Heterodera glycines
  Promoter: Source sequence=SeqID_19429; Location=409..938; Strand=-; Gene=SeqID_84150
ttgtgttcaggagacgcacgccatttgccaacgaatttttgaagcaaatggcaaaagtgtggcaccgccggtggcatttggaaggacaaaaatattccttaaagtaaaacatttaattaaaaataatttattttaaaaaatgcaattttttgtttctgtcattttttgataattctaaattttattctccaaattttagtccgaagctcattttctgatggaaaatttgcgcaaagagcggctccgtcattgtgccgttttggcccaaaaaattcttcgcggatgggcaaaacttcaacagttcgcgcgcctccgatgggccgcggtcgtttttcagaagaattggcgcactttcacacagaaaaagaattaccaaaaggtgattcattcgccaaaatatttaaattcaattttaaatttaatttcattccattttattttattttcaatttccaatttaatttggaatttatttttccgatcattcgcggcttcgtccgcctccaatcgctcgtccgttcccaccaatg

SEQ ID NO: 105640 - DNA, 521 bp, Heterodera glycines
  Promoter: Source sequence=SeqID_16364; Location=766..1286; Strand=-; Gene=SeqID_80756
attttgaagattggacttttgagtttcaaaatatcgcttttatttaaagatttaatatttaattaaaacaaatacatttaattttaaaaaacatatttttacaaaatgatcaatcgaagtctttccctgattaactctttttgcctaattttttttctctctttttgaaaatattttaattgtttttcagtttaataattgatttaataatcaatttaggctaattttacgggtgttatccccctttttaattagcgaaaatgcaaatttacaagtccgaaatgcgtttttttcaaatacgtgcccagaaaagtttagaattcccatctgctggaaattcaaattatatacataagtttttatttttccattccacatggccgaaatgacttccccccccccccctcaaacaaatataattagtgtattttaattatcacttaatactcttaaaattaacaccatggttcctcagggtaaggcggtgctgcgctgagccgtgcgttgcctgggcaccgatg

SEQ ID NO: 105641 - DNA, 305 bp, Heterodera glycines
  Promoter: Source sequence=SeqID_28422; Location=308..612; Strand=-; Gene=SeqID_59049
aacttaaattaataaaagtcaaaaaataaaaaatgtatttacggaaataaaatatataaatcgaatatgcttaaagagtaaattaattcactgccatcatttttttcatttagtcccatttgaacattcgcaaaagcttttccacaacagagagtcgaaaaatgacagtgaccaactgggcaccaaaattgaccaggaaattaattaattaaatgattaattatgacgaaatgttatttgtacatacgtgaattaaggtttcatgtaaaatataattaaaacaaaaacattttgaggtgtttatg

SEQ ID NO: 105642 - DNA, 728 bp, Heterodera glycines
  Promoter: Source sequence=SeqID_4041; Location=3755..4482; Strand=-; Gene=SeqID_45705
ggtaaaagcttctaattcattatcaactatttaggtgtaaaacaatgtttcaatttttaattaaataaaaaataagcaatttgcgccgaaaattgacaaactaaagccattctcataatgctattttgaaaaaaacgaaaaaaaaacttttttatattgatcccaaatccgcaccgtccatataattttgcagaaatttgaattttatttaaaaaaatatatttaattttattgtcgaaacggcattgtcgaaaaggtattgtcgaaacggtcattggcgaaacggtcattgtcgaaatgtccgggagccattttttatttgcttgacaaaaataaataaaattattcatgttgcgaaacggacaaatgtgcatgtctaggaatatgtaaatcattgttggatttcaaatagatatcttttcgagtttcgtaactttttgattttaatttttaactttcgcgcttgatctctaactaaactgaaattatttaattccatatcattcgaaagctttaaattgaaaatattttcttaacaaatgctaagcaatttgatgcatataaagaagttcaaattcgtgctcagcgcatcaaataacccctaaaaatataggaaattccagtatatatttttcggggggattaaagtggaaaaatatccaaaaacttaccacaaacaattcaaaacatagttttaaggctcgtataagacaacattattaattatg

SEQ ID NO: 105643 - DNA, 527 bp, Heterodera glycines
  Promoter: Source sequence=SeqID_13763; Location=1871..2397; Strand=-; Gene=SeqID_77682
atggacggtaaaaaacgaaaaaaatttccaaaaaaataatggcaaaaacaaaacgccaacacacgcaaaaacaaagtatatgcacttacactgttaaatgccttttttgtatttttttattttgatcagccataatacgcttcattcccaacaaaaatgaacaaatttggtatctaaaaaaagatttgaaaaggagaatctttttctaagtaaatgctaagcaatttgacatctcagaaaaaagttgtgagagtttcaaatgttcatcacgttataactcaagtcctaaactgctgatttcaaccaaaatgcgaaaactaatcattttctattgattctaagcgttcaaagtgattttgtagcctataaaccaaaattgttagaattagcgaatttgatgttttttcatgtgttagagacatgaaaatagtacgccaaaattagaggaaaagaaatgcaaaattttcatcatcccttaactttaaaataggatagaaattcattaaaactttatagaacattcgatg

SEQ ID NO: 105644 - DNA, 1003 bp, Heterodera glycines
  Promoter: Source sequence=SeqID_17917; Location=874..1876; Strand=+; Gene=SeqID_82473
tgctgaccgatccgatcagcgccaaagggggacgagaatgggaggggggaggggtgacaaaattgaactggtactgttggatgttatacagcgatttgctgcttgcttaacggcaccaccgacaagattttggtgaagggcttgtcggacccctttgagcagctccgaacgggcgggagttgctcgacaagattggttgtgaagggggcttgtccgaccctttgagctgctccgaacgggcgggagttgctcttcgctcttgactcgatgaaacgggttttgactcccgtttcctgcggcggatgctccggctggcgggagactgaggccgaaccgcgagactccggctgcgggaatctgaactgctcgaatacggaaatttaaaatttcgaatccgggttcgcggttcgaaatagagccaaaagaatgttacatttgtgattagcacctcgggctacccctaaaaataattttcacaaatttaaaaaaaaaaaatttttcgggaccaatgttctttaccattgcccatcaataatacaaagactttaaacctcttgctctggaattttactgtgtgaaatgtccttttgagagttactgtatgtccttgaatttttgtattttgaagtgacagtaagcacaaagttcgtatgcgttatgaccttttttactgtctgtcttgtgtaagctcatttaccaatttcgaaattcctttgtttgcttttttctcaaaaaatttaataccttggtaaaatgctttgcctttgtattgtcacaaactgtgcataaaaccattacacgcaataattttgttaaaacgatgcccccccccccctcttttgggataaaagttttgttctaaaaaatcgtgaaaacatgtttatgtggattgattcgcgggcggggggggggggggaggtttcttcggtaaaatgcattgtttttaaacattttccagcaagcattcttcctttcctgtccgttcttttccaattgacaaatg

SEQ ID NO: 105645 - DNA, 368 bp, Heterodera glycines
  Promoter: Source sequence=SeqID_6862; Location=564..931; Strand=+; Gene=SeqID_63138
ttttgttattagaaggtgaatttgatatttgtcgaaatttcactacccttttataagaaaattcccatgggcagacggacaattatcggaactaattaaggcaatttgattggacagagaacattaatgagttttgtgagtcaaaggtgactctcactcagcagttgtgctcaaaattcatttttatgcatttattagaaatattagttgttggttggttgcaaattggttgcacataaatacttaaaaatcatcatttttatttatttggcaaaaaaagaagcaatttctttcttggcatattattaaaatgttttttttaatggcattggaaaggcaatgacataaaacaacgaaagaatggaatg

SEQ ID NO: 105646 - DNA, 94 bp, Heterodera glycines; identical to SEQ ID NO: 97954
  Promoter: Source sequence=SeqID_23200; Location=1192..1285; Strand=+; Gene=SeqID_53910

SEQ ID NO: 105647 - DNA, 122 bp, Heterodera glycines
  Promoter: Source sequence=SeqID_15086; Location=1649..1770; Strand=-; Gene=SeqID_79260
ggtgccattctctcccgccccgccccaaaatttacttgtaaatgtcaggcgaaatgaccaatttgtcgaggcggtcgacctcagttgccccgaattcgccgtggtgcgcgctcctttcgatg

SEQ ID NO: 105648 - DNA, 55 bp, Heterodera glycines
  Promoter: Source sequence=SeqID_32501; Location=187..241; Strand=+; Gene=SeqID_62804
ttccactctctctctattaaattagcattaatagccagatttgaatttaaaaatg

SEQ ID NO: 105649 - DNA, 216 bp, Heterodera glycines
  Promoter: Source sequence=SeqID_37264; Location=461..676; Strand=-; Gene=SeqID_66369
attgttagtccttttgttgaatttttagaaattctatccgtcatatcggcttttggaattttaatgagtaaatcagtaaccgtaaatgacattctatgcttcttttgttggatacacgggaagaaataatagttagtccttttgttgaatttttagaaattctatccgtcaaatcggcttttggaattttaatgagtaaatcagtaaccgtaaatg

SEQ ID NO: 105650 - DNA, 270 bp, Heterodera glycines
  Promoter: Source sequence=SeqID_1522; Location=1816..2085; Strand=-; Gene=SeqID_74214
tctgattttttttttcaaattatacactttttaatagagatcggatacgttcggacatgaatacagattttacgggaccattgcccataacccgtactttctcgggctgatacggtttttacgggttaagggtttttagcccgtaaacattttgtgttttataattgcaatttaattgctgggaatgcacattttcatttgttatttcactttctaattaattaccagaaaacaatgctttttataattgtttttcaattccagaaaatg

SEQ ID NO: 105651 - DNA, 150 bp, Heterodera glycines
  Promoter: Source sequence=SeqID_10916; Location=2044..2193; Strand=+; Gene=SeqID_74220
ttgttgttgatgaaattttgcaagactgatttgattgtgcgagaaaatcttggcttaaatagctttaaaaagtgggcgtggcctaattttccggggagtataaaagccccggcaatttgtcagctatgtctcatttgttctgctacaatg

SEQ ID NO: 105652 - DNA, 66 bp, Heterodera glycines
  Promoter: Source sequence=SeqID_24579; Location=387..452; Strand=-; Gene=SeqID_55307
tttttaattacatttagatttaaaactctatatataacttttaattttgttaatttaaaaaaaatg

SEQ ID NO: 105653 - DNA, 559 bp, Heterodera glycines
  Promoter: Source sequence=SeqID_17077; Location=1229..1787; Strand=-; Gene=SeqID_81504
aggaacggaacgggtatggatacgataatatttatttgagtaggcaaacttttaacaatgtataaataaatcatttgtcagcgtttattaaattggtaaacattttaaaccaatcttggcctgaagagcagcgcactgccacccatgaagcacaagacgacagggcacctaaacagctcggaaaattagttatgtaaaagcgcgaaacctcaagttctgaaaggcaaattacatttgctgccaggataaacggagctttgtgtaattgaagcaaccgccctggttaacagcaaatttaaaaaatatttatttggaaaaaaatgtgaggagagaaggattagaagaggcgtgacaaaaagaatgaaaaatttttaaaatgatttgccaaatcggtcgggtgtttgaatcgaataagctttccggttattgatggtaagccacgcccatttttcgactttaggtccctgcgtgcttgcacacttaagatttacaaaattgaaattccaactgaaattcggaatcattttacaatttactcaaaattttttttgataaaatg

SEQ ID NO: 105654 - DNA, 82 bp, Heterodera glycines
  Promoter: Source sequence=SeqID_28594; Location=655..736; Strand=-; Gene=SeqID_59191
cctgaaatattgccaaaaatcaaatcagaatcatttgtagaaaaaaatgagcaaaaaataacgataccacaactaaataatg

SEQ ID NO: 105655 - DNA, 107 bp, Heterodera glycines
  Promoter: Source sequence=SeqID_6983; Location=560..666; Strand=+; Gene=SeqID_63493
actcattaagaagcgcgtcaaacggcagcaacagcaatggcgttggagtccgcaacagcagcgctgggtgccaataaacattgcgaatgtgaacattgctcagaatg

SEQ ID NO: 105656 - DNA, 291 bp, Heterodera glycines
  Promoter: Source sequence=SeqID_36440; Location=214..504; Strand=+; Gene=SeqID_65749
ggtaatacaagcttccttttttattgaatataaaaaaattcagaaaaaccaaggcattacaaaattttttggcaatgaagacccacaaaaaaaggcggatgaacaaattgcaaggctgatgataagaacgaattgctcttttttatttgttgaggcaccggaattacagaatttgttctctttagcctatccgaaactccaagtaataattttctcccatttttactagtgaaataattttttaagcttcgcagcaaagattattttcggagaaatgtaattcccaaaatg

SEQ ID NO: 105657 - DNA, 199 bp, Heterodera glycines
  misc_feature (20)..(20): n is a, c, g, or t
  Promoter: Source sequence=SeqID_23429; Location=1850..2048; Strand=-; Gene=SeqID_54137
caactcctttaccttaattntggccaaaatcacaagtccataagaatggtggatgggtgaaaattacattttacccctggtaactccttttctgaaaggaaatgaaattcgttcacatggaaaaacggtggtaattggtgccaaagaaagtctggactctttctgttttccccttaaccagttttcagtgcgcttgatg

SEQ ID NO: 105658 - DNA, 338 bp, Heterodera glycines
  Promoter: Source sequence=SeqID_43759; Location=399..736; Strand=+; Gene=SeqID_71357
taacgtcgtgctttcctcttcactggctcgaccatatgtgtgagctgaatcagtgaacgctttgacccaaattgagcaaaaattgtgcaaattttgcacgtacaaaaaattacagtcccttaaagttggatgggttggaagaaagggaatagaaaaagagtagagcattcgctatttcttaatccttctatctatgatcatctgctattattctttctgaccattggtcatacctttctccctcatctctcttcgtctctcttttccatttgatctatcttcacatcattttttgtattttttttaattggcaaagcaaacgtttctcagagagaatg

SEQ ID NO: 105659 - DNA, 256 bp, Heterodera glycines
  Promoter: Source sequence=SeqID_22781; Location=1..256; Strand=+; Gene=SeqID_53477
tttttgctccccataattgtttgagtaccccaaacgtacacttgaaaaaatcgatttttttgttttcggggcagtccccccgaaccgatgcgcccagatttatggggagaccgaatccttcgggaatagcttccctatagcctgtactttaattctgcgttggatttttgctccccataaatgtttgagtaccccaaacggacacttgaaaaaatcgatttttttgtttcataaatatttttttcagaaagtcatg

SEQ ID NO: 105660 - DNA, 410 bp, Heterodera glycines
  Promoter: Source sequence=SeqID_5500; Location=1..410; Strand=+; Gene= SeqID_58260
ccgaaattttcaaagaaacatagtattttgctgcgccggcggacccactgtccccaaagttttttggaagcgcgccacaaaaatgtagaaaagcaaaaaaaaaaaaagggtcatcgcccggggttacccccccccccaagccgaaatcctgggaccgtccctgagttcagggcctactggacaactaataataatagaacttaaattattccgactttcaactttaggattcctacaattaaaatgtttttagctggacttatgaaaatttttccgtataaaaatgatccccgcttgacttcttttaatcccttaaattttgagcaaaatccttttttttgtcagaaactgacaacagacactacgcccacgtggattgtccgggccatgcggactacatcaagaacatg

SEQ ID NO: 105661 - DNA, 114 bp, Heterodera glycines
  Promoter: Source sequence=SeqID_2134; Location=1334..1447; Strand=-; Gene=SeqID_78030
aaaaatattttaaattaaaaaatgaatttatgcaaaatgagaaacattcacgaaaagaatggaaagatttagagcaaacattaagcaaatatttggatttattatagaacaatg

SEQ ID NO: 105662 - DNA, 136 bp, Heterodera glycines
  Promoter: Source sequence=SeqID_5240; Location=7805..7940; Strand=-; Gene=SeqID_57405
gctttaacaaggaagtttggaaaaaaaacccttgagcgtaaaactaaaaatgtgcatgtagttgaatgtttgttgtttttctatttaaaaataatttttatttgcacttttaatagcacctcttgcgtgcacgatg

SEQ ID NO: 105663 - DNA, 1003 bp, Heterodera glycines
  Promoter: Source sequence=SeqID_21091; Location=192..1194; Strand=+; Gene=SeqID_51677
ttatttttaattgcgagttttcggccattgattgaaatggaaatgattttacctaaagtctcccgaatttctgataaataatcccgatcagtcgtaaagaaacgcagaaagtgatcagtgttccgatcgactcatcccctcctctgatcggcttacataatccaatcccgcccggaggtcccgacaaatctgattaattactctcaaatggctgtggaaatcactttcattaacttcagtttgaagatcatttagtcaattattaatttttaatttttaaccctcacagcccccaatttttttttcaaaaattccaacaatttttcgtctttttgtgccccccccccctcgccccccgtgtgttcgaccttaatcagcgcaagcgcatccgaagtgtcaaacaggcgccgattatttgcgcatccccaatttttggcgcggcgcctcaaggctgaggtgaagtccccccggggggggggggaataactaatgttttttttccaaattaaaaaccacacacaaatcgaatgttttttttttgttgatcagagaaatttttttttattacattttactattttttcaccaaaaactgacaacctaaaaatgtgcaagaaattttcaccgattttttaaaaatattttaaactaaccctttctgaggtctttggaaaaatatggaatttcaaaaaagcctcaaaaaacttagaaaggttagcgcatcaaatttcggtgtttcttcagggacaaaaaaaaaatttattatgactcaaaaatttatttgagaatttcaaaagtaaatttaaagcctcataatttttgaatgaaattctgtgcgaaatacttttgtttctgatcagttttgacactttcttaagaccatttgtgttctgatcaagaagcatttatcttgataatttttgacaaaaaatatatatttcaatattaaaatttacttttttagcggtgcaaaaataattaaaattaaattattttttaaatg

SEQ ID NO: 105664 - DNA, 1003 bp, Heterodera glycines
  Promoter: Source sequence=SeqID_3414; Location=1390..2392; Strand=-; Gene=SeqID_84587
tgaagcaataatcagataaagatgatgtaaaattttgatcagcggaaaaatgcatatagcaaattatttctgattttctgtcctctaaaatttgatatcaataaagtgatcgtaaacatatgagcaccaaaaaaaagtgattgttgcaaataaaaaagtaaatatatttcgaacaataattatgcacacgattttgcctatttttactcagtggcttctgaaaccaatgaaaaaacaaacctttttgttggctgttgttaatctacttttcgaggtattagtgcccgttttctaggtttttcttttcagagtcgaaaacaaaaaattatctccataattaattaatttcttttcttcataagaattttaatttgaagaattatttgccccaatagtgacttgacttaattttattacttttgcaataaattttgtcattttacactgataaatttgagacttttttagtgcctgttttcaactgcttctttttgggttttaggacctactaactacatacttattttgcatgtttttagagcctaaaaatcgttttcctggaaataatatattatttcgtttaacgaatgccaccaatggaaagccaattaaaattttattactttcgcggtattagaaaatgcaatgcttataatcaatataagttaacaatttatcttaatttaaatgctatttcatttttatttcaagatttgttctaatattttttgaatgttttgcctttatataatatttattggttatttcatatattttggcgtatttctagttaatgtgcccaatcattggccattctcggtccatggtccataactttttgccatttagctaaaacataagagtaaatttaattgaaaatttagggcgtggcctattagccctgcgcaaaactgtgcgtatttatttccacatttctaccgatttattcaattttatttttttgcattatttaagctatcatttattaaaaatataaaaaatg

SEQ ID NO: 105665 - DNA, 224 bp, Heterodera glycines
  Promoter: Source sequence=SeqID_28737; Location=405..628; Strand=+; Gene=SeqID_59312
gctgtagtctttgacgtttttttaaataggccaaagactcattctctaaaattaaaaagaaaaagacctaaattatcatttctataaagtagaattctccgaatggaaattttaaccagaaaattgacaaacaaacatttataaacattatgccaaagagattttcgtaggaaaaagaacaaattttgtttatatcataacccggtaaaacccggtcaaaaatg

SEQ ID NO: 105666 - DNA, 257 bp, Heterodera glycines
  Promoter: Source sequence=SeqID_23805; Location=1054..1310; Strand=+; Gene=SeqID_54508
aattgcggaagcgataaatgaattccggaggcatttaatcaattcgcctacagattttacattcacatgaaaataataattattttaatttgggattttgaaaaataaaagatgtcataataattagttatagattttcattaagctgacgaaagctttgccttataaaaaagcattgaaattttaattaggcgccataaatataattctaatgaattaactgctttctccaaataattacacctattattacaatg

SEQ ID NO: 105667 - DNA, 382 bp, Heterodera glycines
  Promoter: Source sequence=SeqID_1459; Location=1170..1551; Strand=-; Gene=SeqID_46872
aaagttctgtcttgaaaatttgaattaaagacattttgccaaacataattattaaatttttcaaatttcggccgtttcgctggtaaaacccaagcccgttttagccggtcaaattgactgggcccgggaccgggtttagccatttgaccgggaccgggccgctcgttcaaaaaagcccgttttaccgggcgtccagggctcgtttttttccaaaaaaaacggcttcgtgaccgggccgcccggtaaaagcctgccgggcccgtccgggctcgctctaatatttttacatatgtacgcctaaagtgcaatagagctctgttttctaaattttttaactttttgtatttaaagtttaaagctcaaactttccttattcgtgatg

SEQ ID NO: 105668 - DNA, 134 bp, Heterodera glycines
  Promoter: Source sequence=SeqID_18668; Location=437..570; Strand=+; Gene=SeqID_83331
cgttggcggcgctgcccgatgacccaagcgatccggtatgatttgaataaagggattttttgaagaaatttttcaagtttccacgccatccaccggcggacagtgaacccgaggatgacaagcctattgggatg

SEQ ID NO: 105669 - DNA, 131 bp, Heterodera glycines
  Promoter: Source sequence=SeqID_20428; Location=1083..1213; Strand=+; Gene=SeqID_50963
tttcccctttagacacttttatttattttttaaaaaatttaattgactcacgaggagtctcagaatgattttaattaaatattaatcaatttttattttttatacataaaatttagaagcacaaaaagatg

SEQ ID NO: 105670 - DNA, 876 bp, Heterodera glycines
  Promoter: Source sequence=SeqID_1238; Location=3853..4728; Strand=-; Gene=SeqID_70471
ttacaattatcaaaaaggaaagttcaaaagaatatttctggtctgtctgtatttttgaaaaggaatttgtgattttgaagtgatagcactgatttttatctaccagaagtagtcatatttcgttcaaattttttaactattaacattatgccagattaaaaaagtgacaaatttaatttaaaaatacccattaaaaaatttttcaatttgttctttccctgggaattcatatctgcattttttgctgttggggcactccgaaaaaaaccacagggtgagggccctttttttcgtgaaaacttgttttatgggttttcgggagtagctaatcacgaatcttataccaattttgacaaatctcttacccgaactcgagtgaaatagaaaactaagtttttcggagtttgcttttttgcttgaatttaggttagacattcaaaattggatataatggatgtcagatccctggttagcgccccccgagaacccttcagaatttggggtaaccaaatatacaaagtattatatctaccgaatttgcaaaaattgaaagaattttattatgtagtgaaaatgtgtaacaaaagttggctgccctgtcagttttggtgtgaaatttttgtttaaaagacaaaagatattgatcatttatatcctaagcagtaaagcagaatgtttccttatactttcaattctgtttttgtttattgcctctatggctctgttttaaaacgcttaatttttaaattaaaaggtcgcagaaaaaatcagtaaaaacttataaatccgggccctaattaggtataatttatcccccaacaactccgcgttatattttcaattttctgttacaaaagtgggtgccaataaataatg

SEQ ID NO: 105671 - DNA, 416 bp, Heterodera glycines
  Promoter: Source sequence=SeqID_9378; Location=1..416; Strand=+; Gene= SeqID_71177
gacccgtttcgagtagaaaaccactacccttttgcttttattacctagaaaataaactaaaaatgcattactccacgtccgcatctacacagactgatcacggcccgtcaaccgttccaaaaactcactgctgaacatgcccttgggggcaggaaaaaagaaaaattcagccctggtcaggctccagcccaaccctgggttttgtccatgaaaatccaggtccagatccaggcttttttatcaaaatatcattattttgcatccagcattcacacccacactaaaaaagcgcaattaattcattttaattcaagggtaatatatagtccaacccttagccgattacccatttaatgctccttctatttttagaagtacactgccgcgctcgtcaggcctgttagctgggcagaatg

SEQ ID NO: 105672 - DNA, 840 bp, Heterodera glycines
  misc_feature (9)..(9): n is a, c, g, or t
  misc_feature (17)..(17): n is a, c, g, or t
  misc_feature (22)..(22): n is a, c, g, or t
  misc_feature (31)..(31): n is a, c, g, or t
  misc_feature (54)..(54): n is a, c, g, or t
  Promoter: Source sequence=SeqID_37579; Location=186..1025; Strand=-; Gene=SeqID_66612
aagtacccntaaaatanctcanttatttatntaatgtttattgtaggccaattntagaatttgcatcccccgtttttaaatccgcatttgaagaaaaatattagaaaaatagaaaatgttcagaaaacttttttaagaattgtttttagacgctcaaatttttatgttgacatacctaactacgacgaattgctttcaatttataacatggagtctctccaaaaaaggagattaaaaattgatctaggacttttccatgaaataactaatggatttgtccaaattaaatataataaacctcaacccaatttttctagtagactgggtaatttaattaagccaactttttgctcaactaatgttagataccattcattttttgttcgtgcttctcgcttctataggttattacctaaagaagttaggttacaaaattcaactgttttttctaaacttcttgactcaattgatttggatcgttttacacatttatgaaccactctcatatgtgaccattttgctttatcttattgttgtttttattttggcggcgtcacgctttgcgtataaaattattatgatgaattaggagggatcaacttgccatttttaaggggaccagagcgtttgggccccggggtcgtttgggccccaacccaaaaatagaaaaatgtgcttttttaaaaattaagattctaaaaactaagcctgagggatccctcgccacttggcataagttaggtttaattaacactcgctcattttttacaattttacttattccaaatcctattattttttaatagttaaccaatttgatgtacattcttttcagaaatg

SEQ ID NO: 105673 - DNA, 73 bp, Heterodera glycines
  Promoter: Source sequence=SeqID_5886; Location=316..388; Strand=+; Gene=SeqID_59559
ggtaagttttcgtctgccattattttccattaatcggaaaataataattgatagctgatttcagctgggcatg

SEQ ID NO: 105674 - DNA, 267 bp, Heterodera glycines
  Promoter: Source sequence=SeqID_19542; Location=1001..1267; Strand=-; Gene=SeqID_84275
tcgctaaattaagaaaaaaaaggtagaaaagagaggaaaaacaaataagaatgacgctggaatgatatcatccataatgtttacgttctcgagcaatgacctacttttagttggcttggtccatcactcaagaacaacaaacatgagggaccattttataatatggagaaaatatctgtagagaataaagacggggtaatggccatgggatgggggaaggtatataaaagtcgaaatttatggtcaaactcattcatctaaaaaatg

SEQ ID NO: 105675 - DNA, 384 bp, Heterodera glycines
  Promoter: Source sequence=SeqID_14167; Location=150..533; Strand=+; Gene=SeqID_78172
ggtaaggaaatggaaaaaagaacggagtttttgtttaccagcagaatttgtgagagaatcgtacaaaataaaacgggaggacaatcaaaatttggtgaccgtttttttcccggaagaggaaaattacgaagggatttaaccaaaatgtaacaacattaaaaagtcaatttagctcaaagtcagtgaattgaaagaaaaagttgaacacttcggaattgagaaaattcaaatggaggcgaaattaacggaaaaggacaaaatgttggctgagatgaacaaaacacttgcagatttacagagtgtgctcagagtacagttttacttgtgcaaaaatgcaataaaataagaagtaaatttaaggaattggcggaagaccaaaaaatg

SEQ ID NO: 105676 - DNA, 464 bp, Heterodera glycines
  Promoter: Source sequence=SeqID_22620; Location=1630..2093; Strand=-; Gene=SeqID_53295
ttttccgatcacgatctataaaattaaaaattacattcccagaacaattacaaattatacatggagaatattttttttttacaaaatgataaaaattctataaaatatggcaaaatgcaattataaaatcaattattgatgaattaattttatttcattttttttttttgttattcattcatgtaataatttagagctagtaggatttttaggtgctacaaatactgaaataggtgctaaaaactctcaaaatggcaaaatagttgcgaaaaataaattttggatactgattttgagaaaatttttcatttcttaggggtgtattttttgttttattgcaattttgctaaggaatttatggaaaactgtcaaaatagttgctaactctattagtaatttgaaacgagcagaaatttcaaaaattatattttttttttttttgtaaatttttgacgcaaaaaatg

SEQ ID NO: 105677 - DNA, 65 bp, Heterodera glycines
  Promoter: Source sequence=SeqID_2615; Location=380..444; Strand=+; Gene=SeqID_80736
ggtgtgccaattgaaaaaagaaattattaattttataaatatttatttttaagtgcttgcaaatg

SEQ ID NO: 105678 - DNA, 746 bp, Heterodera glycines
  Promoter: Source sequence=SeqID_7758; Location=3071..3816; Strand=-; Gene=SeqID_65847
tgtttttttgggctgttgttaagctatttttcgagttattagtgcctattttctaggcttttatttttagcgcctaaaaagcctaaaaaaatttgaaagagcctatttttggctattttggcgttttgcccaaaattattaacaaaaatgcaataaaaacgaaaaatacaccccctaagaatcgacccgaaaattttcaaaaatacacccatacagaaatgaaaaacttttcaaaaattcatctccaaaatttattttttatgttcttgacaagaatttgtgctttaaaaattatttatctcaatactgatttggcctaatttttttttacttttttgaataaaattttgtcattttacaccccctaaatttgaggatttttggtgcctattttggggttttttagagcctaaagcctacctattttggcagtttttagagcctaaaaatcccatccctacaaatcactacaataggataatcgtaatttttttttttattaatatttgcaattaaaaaagcatataacatttttaggtttattttttcaaatgaaataaataattatattatttgttgaatagaaacttgaatgagatttaatttttgttttattgaaataaataatttattatttattgaatcggaaatttgacagtaaatttaaaaaaaattattttaattttaaataattttttttaccaataaaatgccgtaaccattcgccgatgttcagcctgaacatg

SEQ ID NO: 105679 - DNA, 310 bp, Heterodera glycines
  Promoter: Source sequence=SeqID_24015; Location=390..699; Strand=+; Gene=SeqID_54718
aaaagcggggacggcacggatttctatcattatttattttttaaaaaaatttaaatgcaacttttattttttcttatttaataagaaaaagcggtagaatttaaaagttgcaaatgatttttatgtgcaagcaatttattggagctgataaatgctgttgaaaaggtgcaaataataattattctattaaataatttaatttcctttaatctttcgttgtgttgtaaaatttatttattcaccttaaataactttttgagaaaaatatatttgttataacttttttaaaatcacaaaaaataaaattatg

SEQ ID NO: 105680 - DNA, 879 bp, Heterodera glycines
  Promoter: Source sequence=SeqID_34607; Location=318..1196; Strand=-; Gene=SeqID_64353
gccaaatatttcatcaaaattttgtcgaattttgccggattcgattaaaagaaaaaaataagaaaaattaaacataaaaaatgcatttttacgatttataaattttttttaaataataattttattagtaaatttttttaaattttttttttttgaattttttttttacatgaaatatttttgaataaatgtaattttttttttatataataatcaattatttttttttgcacttaagtaattattttttaattatttttgcatctttacatatcctgaaaaatcaggacattttaatttttttgtgctctgccctatacggctcaaatccaacaatactcgaaaaataatttttctatttttaaaagatttttctttttacctattttatgttaaaaataatattttttaaatgcatgatcactttcgaacaataatgactaattaaacttaaaaaatgaaaaattgaatgaattaatttcctaattttaaaaatcaaaattcaaattcccatgtgtttgctatgtgagtaagtaacccattaaaagttttctctcgtcagctgtttgtcattttttgttcgttgatttgttcttttgttccggggtcaaattcacacttttaaatcatcgattaaccaaagattagctgcaattttcactaaaattcatttttttaaataaataatattaaactaatattataattataaaactaaaaagtgccaaaaatagcaagaattatatatgagtttaaaaatgtaaataatattatatttatttttataaatttttcaccaaaatattaaaataaaaatattttgaatcatttaattaaatgataatttaaaaagaattaagaattattacaaaaagtatg

SEQ ID NO: 105681 - DNA, 217 bp, Heterodera glycines
  Promoter: Source sequence=SeqID_20641; Location=1..217; Strand=+; Gene=SeqID_51191
agaggaagaagaaattgagcagatgaatgatgccgagggatactcagaaaatgaaaaagtaaaaaattaaataaattaaaaatgcaaaaaaaaataataattttctttcccagcagaatttctcatctccgaagaagcaaatggtcgaagtgaaaacgccctttttcgaaggcgggcgcctcaaaacaatcatttcttggctttcctacgcaaaatg

SEQ ID NO: 105682 - DNA, 257 bp, Heterodera glycines
  Promoter: Source sequence=SeqID_19970; Location=1..257; Strand=+; Gene=SeqID_84734
tttttatatacttaagtaaaaaatttaataaaattatacttctatagaaacacctagagctattgaattataccaagaattattaatttggttgaaaatggaccaagttatgaatttatatgtcttacatttttttgttttcctaccacatggcggtttttaggaaacgacccagcacgtcttagaagcatcaaatgctaaagacacttttacgtgaaaatgtcaaaccaatctaaaaatactatttacataaaatg

SEQ ID NO: 105683 - DNA, 85 bp, Heterodera glycines
  Promoter: Source sequence=SeqID_26732; Location=1..85; Strand=+; Gene= SeqID_57506
tttcagtaaattaaacgaaatttaaatggccaaataaataattacaaaaatgaagaccccacggctttcctagaatttagagatg

SEQ ID NO: 105684 - DNA, 591 bp, Heterodera glycines
  Promoter: Source sequence=SeqID_10617; Location=1944..2534; Strand=-; Gene=SeqID_73849
ttttatttgaatttgctttaatacacccaaaattgcgttctcacaggaaatctgttaagaaatctggccaagattttcaaacttttcccgacggtgcctacccgcgtagtcggaccctaccaataaaattttttttgaaaataagatggcaaaaaattcatgatggaaacaccgttgaaagggattatggacaaagaaaaataaaatatttaattattgtttacttgtttttttcataaaatgaatagttttttttcaaaatgttgattgattttaaaaaatttcatctggaatcccctgatttttttaatttaaagcaatttttaattgccagattttgcaaataatttttttttgttatttaaaaattaattatgttttacttccgacttttgcaaacgatagaaaattttatgacgtgaataaaatcatacgcctctgtctcttttatatgaaaaacaaaataagaaaataaaatcaatgtataaatatatttgttataatattaaaaacatatattttcccccatttttacattttataataatataataataatataacaataataattttcaatttagaagtatg

SEQ ID NO: 105685 - DNA, 783 bp, Heterodera glycines
  misc_feature (34)..(35): n is a, c, g, or t
  misc_feature (38)..(38): n is a, c, g, or t
  misc_feature (50)..(50): n is a, c, g, or t
  Promoter: Source sequence=SeqID_21346; Location=1..783; Strand=+; Gene=SeqID_51948
tcggaagtataatttttaattattttgaattttnntanataaatttttgnagtgtttaaaaagatttaaatttcatccaccatcacccgccttttttttgtttttctttgccagaggcaccgtttaatctttggttctctggtgcttagctcttgtcctaataggacaaataattagcatggcttctcagaaagaatgttcattaaactgctcataattttcaaagtctcatgatttgtttcacttttttctttctttctcatttcctttttcatttacttaaaaatttactgcttttgtcacacttaccttttttctctcccatccccattctttcccactctttttccccctatctctctctctctctctgttgttgctttctctgtcagtctttctgcccaattgatccaatttctgtctttgatttgagccaatcttctcgatctcttcttctttctcactcctcgcaatctcgcgaagttggaggcacagagaaaaagaaagtgggggggggggcgagggatggccgggcaccacaacacagcctaacccccggctgaatctgctgcaatcggtcggccaatggtatcgaaggagtgtcccttcccctcccctttttgttgttgtttttccatatccctcccctttcccgcgtcattttaataacagtgaaaaaacgactttacattgggaaaggagtgtaataaataattaattactaattacgtcttcactcccatttttaaaatcatttttgatcattctttgctattttagatg

SEQ ID NO: 105686 - DNA, 287 bp, Heterodera glycines
  Promoter: Source sequence=SeqID_17671; Location=432..718; Strand=-; Gene=SeqID_82200
ttgactcaattgctgctgaccgggccggatcgggatgaattccttcggcagaaacgatgtgcccagaaacttaatttggggacaaagaaatttgcatttatttaaatgaacacggagcccccagtcttggaggcgaccaaagaaaagttttaggagagcatcgtgctcctccaaagtgggcgtgcccacgataaaatcgtccaaatacccgaacactccgtgaaggccagcggtgagttcgtccatcaatttttgaaaaatgcttggcgcacttttgactccgaatg

SEQ ID NO: 105687 - DNA, 618 bp, Heterodera glycines
  Promoter: Source sequence=SeqID_29013; Location=196..813; Strand=+; Gene=SeqID_59581
ttttcatacggtacagcactttaggaaatgacatccaccattcttaccaaagtttggtacttttccgttttggggcctaaatttcaattttaaaaaaaaaatcaaatctagaccccaaaacggaaagtacccaaaaattttttatcatcaatcggcagcaactgaaaaaaagagttttttttttgattcttcattgtttaaagatttttttattattattttggtttttctattttttatttttggtctaataaatattatttttttaatgttaagtgggttctgttttgctatcaaaattacaaaaattataccaaattcaaaaaaagagataaagcaaggacccggaaaatttttttttaaatttttacttgcggatcagtgaattttatgctgctccatggtggccaattttttatgaaacaagcatgcaaagggatgagtaaagacgaaatggaagagaaaaaggaagaaagggaaggaaacagagaatgcggaagaaaaaaatggacgaagaaaaaaatatggaagatcggggagaagaagaagtaatagtataagagaacaaggaagaacgggaagatgaagaaccggaagaagaaatagaagagtaaaatg

SEQ ID NO: 105688 - DNA, 69 bp, Heterodera glycines
  Promoter: Source sequence=SeqID_8677; Location=1422..1490; Strand=-; Gene=SeqID_68829
atttcaccaataattaaaatcattgttgtttttgtcttacgttggtttcaggtggtcaaattcggaatg

SEQ ID NO: 105689 - DNA, 104 bp, Heterodera glycines
  misc_feature (46)..(46): n is a, c, g, or t
  misc_feature (67)..(67): n is a, c, g, or t
  misc_feature (81)..(81): n is a, c, g, or t
  Promoter: Source sequence=SeqID_13276; Location=1..104; Strand=+; Gene=SeqID_47119
aaaaaatttttgcttaagacaatcttaaaaacaagcacatttacanagttataatttgtgttttttnttattttttttgtntaaattaaaggttttttacaatg

SEQ ID NO: 105690 - DNA, 1003 bp, Heterodera glycines
  Promoter: Source sequence=SeqID_1861; Location=1232..2234; Strand=+; Gene=SeqID_76421
gtcagggctcagattacaaaatgccaaaccttcaaaatttagcgcttttcaatttatttttattttatttttgtacatttatttccagcggaagttcgctgcacctttttccccttgcagcaatccttcaaaaaagaacattaaaaaatagtaccccaagataagggggcttgagacaacgcttttacccgacaatcggaatttccccgggacgcgaaaatcccgcaaaatttcatgaaatttggcacactttcaattccggtcgctgtttaacgacaaaaaaacactagacggactttccctaattccgaatttcacttatcccccgaaaatgccgtgccctctccccgtccaatccgccgcccaatgcgttaccgtatggtccgagtcttgtgctgcacatgtgaaaagctccaaccctgagaaaaaaacttttaacttttacagattggctttttcattaaaatgccaaaatttgagtgccaaatttaaattttaaatgattgcccacttcaccgtaccgttctcggacggacatttgtccgtgttcagaaacaaagctgtaagtatttttttgctcaacacatcaaaattctgcaacagtaaaacaaccaattaattgctaattgccaaaaattaatgtgtttacgcatcgactctcgcacgattttggcactctcttggcacggcaacagctcaaaaagctttcgttcggattcttaacggagacgaacatttatgaattgataaatggacacaattaattatttattctgttggttgggccgctacgttttgatgtttagtcattttcacattgttttattttatttcgggtaaaaatgtcctgaattatgcacaagaataattaaaacctgaggagtacaaaaataaattaaggatatacaatgtaaacgggcattaatccaaaaatatattttttggtctaagtaaaaagaatttaagcgattaaaagtgctctcatatccttccttttgaaatg

SEQ ID NO: 105691 - DNA, 955 bp, Heterodera glycines
  Promoter: Source sequence=SeqID_14419; Location=164..1118; Strand=+; Gene=SeqID_78455
ttttctggagaattcttccatttcatcctcttcatattcggcacccttcgctttgatcagacaaagcgcttcaaacgggcattgtcaaaggagaacacgttatcgtccaatggaattttcacctggagaaaaagcggagggggccgtgaataacagaattaaaaaaaaatctttgatcatttttaaaaaattctaaaatttgtccaaaaaaatcgctgaaaattattttaatttttcaaaacataaaaatctgttataaaagacctagacatttttttctgagttttcttttatatctaagaaaaattatttaattttcaaaagaatattctaattgtttaaatgctgtaaacagttggactctactgcactttaagagtccaatcaattgacaatacctggtttttatacaataactttgttcatgtttgaaccagggacggtcaccagattgggtgtttgtggggggaggcctaaagactcctaggcagcaatgtcttttaaaaaattggggcttgtcaaaacccaactagagctcgaaagttgctagtcagtctaccaactactgaagagatctgagatttcctaataatgttctccatcattttgggacttgttttgctgatattgttttcctactcttcattgcttccagttgtatggtggttaggatttttttctagaaaacttgatcagcttatagaaagagcattaaattcggttaaattggatggaaaataattttctgaggtttttattttgttggagtcgaaaaagttgagccgcaaatgtcgtttttcgctgtggccgcaaatgtccgggccgcactgcgcaacgcgacgttgtagctcgaaattggcctcgcaaagtgcaccgttcccagcagcatggattcgtcgagccggttgtcatcaacgagatctcaacccgaagcgttgtcatccaattcgtcatg

SEQ ID NO: 105692 - DNA, 278 bp, Heterodera glycines
  Promoter: Source sequence=SeqID_12632; Location=631..908; Strand=-; Gene=SeqID_76300
tgcgattgagcagaagcgaaattagccgatcgctttagtcaaaaattccagaagaaaccattcgagcatttcttctcacaaatttatataagccaaggtttaattttttgttttttcattggcatttccgttgatttgtccaagtttccattaatcctaaaaataattttttaaattgcagaggcggtcccttcaaatggcgttgcaatttggacgcattgtctgacaatttggaacatattttcgaccctttgatttcccgcgagagagttaccatg

SEQ ID NO: 105693 - DNA, 238 bp, Heterodera glycines
  Promoter: Source sequence=SeqID_12912; Location=1887..2124; Strand=-; Gene=SeqID_76653
gtgaaacacttttcaaaataggtcactttccacagagcgccgaaaattcttttttttttgttttttttttactaaaaatattaattttgaatcatccaatgccattgcgttattttatttaggctcagtgtttgcaaatgccaaagaattgtttgccctcacattggaccaaattaatggcattggcggcaccaaagaattgttggacaaaatttgtgaaaatattaataacaatatg

SEQ ID NO: 105694 - DNA, 810 bp, Heterodera glycines
  misc_feature (24)..(24): n is a, c, g, or t
  misc_feature (70)..(70): n is a, c, g, or t
  Promoter: Source sequence=SeqID_1944; Location=2321..3130; Strand=-; Gene=SeqID_76931
agcaaaaaaaatacgtataaagcntaataaactgactttattatttttgtttttaaaaattactgattcnagtaattgaaaaatcacagtaataaagggataaatttgcgtaattaaaaacacatatgcctagccctggtctcgacagccgattatctcacgcccatctccccaccctctctcaataattcgaacaacattgtgatattccgattgctggtggttcctcttgccacattttcaaatgtatttttttattaatgcatgcccctcaatcccaccccactttaagctataaaatttcacttttgcccttttatcaatttgagtgttcacagccgagtttccgagaaaggccatcacacttatctcttcagtaaattgctgtgcgtcacgtcgcctatcaacaggtcaccgcctcaaattactgacctttcccgactcctgcttcatatttaatataatttaaaacctaaacaattttcctggtgatgtccagccttcattaatttaaaaaaattgagtcctgactcgcaaaaaagttcttttaattacgctgtaaagtgattcgaaaaggaaagcaaaaaaatcagcaaaattttaacatttaatataattttttttttaaaaataaagccttaatgttatatgtgaaaactgatccataaaattgcctaaagttaaaatttctatattttattaatatggaattaaaatacatgctatttactaatgaatcccaaattaaatagaagattatgaaagtccgcccttgtcccgttcatttcaaaagtagaatattttacaatg

SEQ ID NO: 105695 - DNA, 91 bp, Heterodera glycines; identical to SEQ ID NO: 100405
  Promoter: Source sequence=SeqID_42310; Location=688..778; Strand=-; Gene=SeqID_70227

SEQ ID NO: 105696 - DNA, 1003 bp, Heterodera glycines
  Promoter: Source sequence=SeqID_6178; Location=116..1118; Strand=+; Gene=SeqID_60608
tccctgcagcttctgagaatcaccttattcagcaaattatcttgtgattatttttgaattttggttgtcgtagaaaaatgacggaaatcatttgaaaatggcaaaattaaatttgcattagcataaccttttgcatcattcatagtcaatttttggggaataaaatcggatatttaaagcggagaatttatttttttaccattcacttttaaaaattgtttattaattttatatttattagtataaaattttctccatttgatttgagctttcgagaactttatacttcctcttttagcaatttcagtttttttaaaaacgaaaaaaacacacacagcgagaatcgacctaaaaattttccaaaaatacaccaacttaaaaatggaaatttttaatttgtatccctcgtcatttaatttttcttcaataaagttttattttttaaaattcttattcgtttataagaataaaatcgttaataagaattttaattaatatcattgggcttattttatctattttataatatttagtaactgttttgccactttcttacgttttttacctaaaaagcatagcttaataataagacaaataaatctgccaataataataataataataaataataataaaatttctaataaaattgattaatttcaacaattatttccgtaaacaaaaatttgtacatttttattaatatatccgtctgtatcttttagcataataataattattattcatttttctaaaataaaatggcattattcttcgcttcttcaattttatttctcggatttttttggctttttgccaacatttcgcttttttgttctgcgccaaatccaataacaaatttggctataaaccaaggtttggcatagcggtttcattgctaaaattaaaaagtcatttttaaaaaggtccaacattttttggaaaatcgccaaaattttcggttcaaatgaaatcggaagaacaaaaaagccattccaatatg

SEQ ID NO: 105697 - DNA, 91 bp, Heterodera glycines
  Promoter: Source sequence=SeqID_8634; Location=1785..1875; Strand=-; Gene=SeqID_68733
ggtcggttggccgggattagagaactgcaaccactcacatgaataattaattgatcatttattatcgcttcgtttatttcagtcacggatg

SEQ ID NO: 105698 - DNA, 1003 bp, Heterodera glycines
  Promoter: Source sequence=SeqID_6572; Location=772..1774; Strand=+; Gene=SeqID_62057
ttcaattatttgtgtctaatattcgataaataaacattcaattatttgtgtctaatattcgataaataaacgttcaattatttgtgtctaatattcgataagtaaacattcaattatttgtgtctaatattcgataagtaacattcaattatttgtgtctaatattcgataagtaaacgttcaattatttgtgtctaatattcgataaataaacattcaattatttgtgtctaatattcgataagtaaaaattgtttttcttaaggacattttcaatttttgatttttcattttaatttcggatcgtggtaaagtggtacttctgctattaatattaaaatgtatatttttattaaatacaacatatttcttaaaataaagggtcgtctaagaagtggggagatctcctaaaaaacttttctgttgatttttttatttggaatacataaaatacaacaaaatgctgaaaaaaaaaattaattttcacttgttttcggctaatttagagtcagttttcgtgggtttaatcggtttataatgacgtcggattttgtgttataaaaacacaacttgattttttctacttaaatggtttaacttaatttcttttctcttttttgtaaaaggctttctaagaatttttggaagcaaaatcaatttttacctatgtgcctccatgcctctgtaaccggggggggggggggggcaaggggggcaactgccgcctccccctgagatgaaaatcgatatttttttaaatttacctaattttattaacaatttgagccaaaattttctaagttttccccagcggcgcctaacggcaccgccgagtctcaatttccttatagccaaaatttagtctcaaagtggccaaaatttggctaaatttcctgttaaaaaaacactggcaaaaattttgtgccggaaaagcaaaaaaataaataaattgttccattatcgcctaatcctttcccttcctttccttaagtcgaaaaatatg

SEQ ID NO: 105699 - DNA, 407 bp, Heterodera glycines
  Promoter: Source sequence=SeqID_2994; Location=380..786; Strand=+; Gene=SeqID_82679
atcataattgccggggaacaatccaagggtggggggggggggaaccggaaaaaaattcggggttgagaacccgaagaaaaaaatttttttttctggcccttaaaatttgtgttgagtgcacaactgtaagccccccccccccccacccgtcttgtgtttccgctccgaaaaattaaaaaaaaaaattttcaatgccacactaacaataagtttttctaattttttggtaaaataaaaatgtaacaaatcggattttatgtgccaattttttgagggattgtaactctgtgccgttgtttttgttttttgtacaccttcactttctagtgtttgtccacaaattgtattgtttttcccctccgtctgcacaggtggacaaacagaagcgccagaccaagttggacatg

SEQ ID NO: 105700 - DNA, 780 bp, Heterodera glycines
  Promoter: Source sequence=SeqID_7910; Location=1..780; Strand=+; Gene= SeqID_66350
ccaattcattatcatataatatataaagccaaggagcatttcatatttttgttttgaatactcactgatttgcatttgctgaccatttctcataaatgcaattagcattttatcgtctccctaattaaaatgattagacaaaattaattaccctgattgattatctaaccgatggatttgcagcagggatgggccaaattgaaaaataaaaagcgaaatgcgaaaagcgaaatttgcgaaactgaaaaatgcgaaatgaaaaaaaagcgaaatgcgaaaagccaaaatatgcgaaaatgcgaaaagcgaaatgcgaaaagcgaaattttttctacaaatttttaatagttaaaatcataaagcaaaaatcattttttaaaattttattccaaatttaaaaatcaataaaacgctttattgaggcgcgctttttccaaaaaaactttttgggaagagggggcaggcggcgccgggaaaatttttgaaaatttgattaaaatttgttgacagattttcaccaaaaaatcatcaaattttgtgatttttgtatcatttttctaatgagaaataagagttttggcgcgccgctgagaacagtttttcagcaaattaccaaaattttgatcatttataaacagtttttcactgaaaattagccaatttataggtaaaattttgaaaaattttatgggaatttaatccaattcttaggggtgtaaaagtcgcatttcgcgccaaaaagcgaaatgcgaaaagcgaaatgcgaaacgccaaaaaatg

SEQ ID NO: 105701 - DNA, 351 bp, Heterodera glycines
  Promoter: Source sequence=SeqID_31036; Location=1..351; Strand=+; Gene=SeqID_46241
gggtccactgcgtttcggcgccagcatgtttttggctataacttttttctatctaatccaaatccaacattgttgatatcattcgaaagcttaacatgtttagaagctttcttttcgtttttaataaagctaatagagcatgttaagagctttcgaatgataccaagattgttggatttggatgccaaagaaaaaaagcttaagtggaaaaacgagctggcgccgaaacgcgtgggtcccatttattcatgtggttggaaaagagaaaaactttaaagtatgtttctaatttaatttataaataaacgggggaggattttgttaaaaggtcggtcatttaaactttagatg

SEQ ID NO: 105702 - DNA, 76 bp, Heterodera glycines
  Promoter: Source sequence=SeqID_14596; Location=1144..1219; Strand=-; Gene=SeqID_78673
ggtgtgaatattcaaatgatattacattgtcagtgtctgtattcgttcgtttcagtttctggttggctctgtgatg

SEQ ID NO: 105703 - DNA, 697 bp, Heterodera glycines
  Promoter: Source sequence=SeqID_29156; Location=1..697; Strand=+; Gene=SeqID_59699
tataattattattattgcatttaacatttttgttttgaaaaaagcggtgatttgtcaatttaattcgtttatttcaatatttgtcttattttttggattaatggacgaaagaatcaaattgcaattttcatcagagacgacggagtcgagaatgggtgaacaataattatttttatttattttttgaagatttctcgacgattttttgtccgggaagagtggtgggatcaacaacagtaaaaaaatgaattaattgcttgattgatgcgattatgagatcaattgtcgggcgttgttatgtatttaaatgttgtatttgatctttgttcattcacaaattaattaattaattaattagggctttttaccgatattttcatacatgaaaaatagagggtgggtttcagcgttttttttttgaaatccctccttagggtgcccaaatttctgctggtggggttacttgtaggttttgtcaccccctctcccctgaaaaaaaatttttttaaattttttctagcctcattttttgcgttaataacgcgaatttaacatttattttttaaccataaagtttgtcagtgatttacgtgaaaacgtgaaaaaaatttgaaaatgaaaaaaaattcaaaatttaaaaaagattattctataattattaaaacgcgcaaacagtgctaattacaacaaaaaaatg

SEQ ID NO: 105704 - DNA, 206 bp, Heterodera glycines
  Promoter: Source sequence=SeqID_23174; Location=1720..1925; Strand=+; Gene=SeqID_53877
agtcagtcacttgggttcaagcgttcttcctcccgtaaaattaatttcgaaattccttttaatgggaaattttttaaaacgaaattccatgcgctttacttttgggtctaccgtcagttccgtattcttttcctcaaccttatttttaagccatttcagcaattcattcttgctttgtttagagccgtgatcagttcattgaaatg

SEQ ID NO: 105705 - DNA, 205 bp, Heterodera glycines
  Promoter: Source sequence=SeqID_34854; Location=234..438; Strand=-; Gene=SeqID_64554
ttggttcaaatcctccagcggttattcctttattgtgcacggactaaggatgaacccacaaatgtttctgatcattttgatgatcaaaaatacgagctttttaactctgaagtccgttgcaattcattcccttttttaatttttttttaaataaatttttaattttgtttttttccattaaagttttctaccggtggacaaaatg

SEQ ID NO: 105706 - DNA, 597 bp, Heterodera glycines
  Promoter: Source sequence=SeqID_181; Location=1593..2189; Strand=-; Gene=SeqID_76517
ttccctccccccccccccccaaaaaaacactatatcgggggctattgaaatcctttaaaaagaactatttaaaaactatcataggaataaaaaatggaaaaagtaattaaacggataaaatgttattattaaatgaacacatcggatcggaaaagaataaatgccattccatttggatatcaatttgaaaccggagtcccacagtagcggcaatttttcacaaaattaatttcttatatttaatttcaaacttttatgaaatcttttataagccgtaattgtcattggacaaaacgtcggctattcagacaatttgttgcaataggatatgttaaacagccacgaagcaaagtcccatcgaccccccccccccgccatctccccgctccgatcatcacactttttcatttctcatttacatttaaatatgtgtgctgtgttgcgcccgctcaaccttccgcccccatcgcccgtcgtcccacccttgtcccagctatccaccagctgctgaaggtgtattctttggctgttggggttgttgacgggtagcgtcggcagcggtggaaattaacaaatgcacattgaaatggcaaaatg

SEQ ID NO: 105707 - DNA, 68 bp, Heterodera glycines
  Promoter: Source sequence=SeqID_5451; Location=1595..1662; Strand=-; Gene=SeqID_58096
tggtcgcaaagcagaccggcgtttgcactacatatcatggtcgctaagctgaccgatatgttgccatg

SEQ ID NO: 105708 - DNA, 230 bp, Heterodera glycines
  Promoter: Source sequence=SeqID_45383; Location=1288..1517; Strand=-; Gene=SeqID_72685
tttggaccagcaaaatcgctgagttccgagaagaacttttttagaaaaagttctttggaacaatccttggttacggtgaatccatggagttccaaggccgaggaggcccacatgcccacattgtggcgcaaacagacctggacgcagttccatatgtcattcaggaatacatatgggcgcacattccatctttgcctgataaagatgacgacacgcccattgcaaaaatg

SEQ ID NO: 105709 - DNA, 174 bp, Heterodera glycines
  Promoter: Source sequence=SeqID_12380; Location=785..958; Strand=-; Gene=SeqID_75987
aatggccgagttgtgagagcattatttgatactggggcagacgtcacatacattaagtcatcaactgctgataaataccttctgaaggtccgccggggggattttcctcaagctcgagcagctaattcgacagcaatccgttttattgggtcaacaaatgtagacatcaaaatg

SEQ ID NO: 105710 - DNA, 234 bp, Heterodera glycines
  Promoter: Source sequence=SeqID_19240; Location=1683..1916; Strand=-; Gene=SeqID_83986
gcccgtgtttgttgagccgtccacttcggtgaaggtccaacgggtgcttcattccgaggcttatgtaaggtcagccagcggtggagaggcgggcaatggatcaatgatggcattggcattttaaaaactcaattttcaaggtacattgagtccatgtacagcaacaaagtgcagcggacggtcagcaaatgggacaagaatttgcaggcgactcaacggaacaccacggcaatg

SEQ ID NO: 105711 - DNA, 112 bp, Heterodera glycines
  Promoter: Source sequence=SeqID_36713; Location=1113..1224; Strand=-; Gene=SeqID_65965
cccacccctgtgaggtgtagatattcttcaattttactctctctagctctgtttatgaacagtctgtatctttgttaggttcattttttagttctacaatattgtcttaatg

SEQ ID NO: 105712 - DNA, 262 bp, Heterodera glycines
  Promoter: Source sequence=SeqID_17722; Location=438..699; Strand=+; Gene=SeqID_82258
aattgtgctcaaaatggtctaattatttaattttggaagatgataaatttacaaaaataatatttgaatgagaattaaaaaacaaaataaaattacattaaaaaaaattagtgaaattaatttgaaataataaattatatatttgcttgattatgaaaatggcaattttgaatttaaaaaaaaatcagaaatatgtcattcgaaaatgcacataatcttttttttataaatattatgtgtatgttcttttttttgcagtatg

SEQ ID NO: 105713 - DNA, 119 bp, Heterodera glycines
  Promoter: Source sequence=SeqID_941; Location=3904..4022; Strand=-; Gene=SeqID_64605
tataacttttttatttgtcagtcaactttagccattctggcatcatttgaaagctctatgtgtgctctatatttacatgccaaaatagaaattaatgattcaacaataaaaaagttatg

SEQ ID NO: 105714 - DNA, 308 bp, Heterodera glycines
  Promoter: Source sequence=SeqID_10369; Location=1..308; Strand=+; Gene=SeqID_73548
gcaataattttttgcgccagcgccggcagacggcccttcgctggccgactgagtaccaccggcgccggcgccatcatttgctgtggccgatgattgagtcaatgccttaggcgagggaggatagcaatttttgaaataaaattgccgaaaattttaaatttcagtttaaaattattgaaagaactaagccaatggaagaaattgagggctcgaatctatggaaaataaatttttaaactgcatatggagacaaaattttggcaaattttttataattttggaaaataaaaaataattttaaagagatg

SEQ ID NO: 105715 - DNA, 217 bp, Heterodera glycines
  Promoter: Source sequence=SeqID_3166; Location=3822..4038; Strand=-; Gene=SeqID_83499
ggtgttatttgagactatgttcaaatcccccaaattaattactaatttcattaattatcattaatttattgctgtcagtcgtttttttatacattttcttttaaaagttcagcaattttccatttaacgttgtttttttttttgctggagttgtgccaattctctccccccacccctcttaaattttttcatgtgactttattgtgttgttcggatg

SEQ ID NO: 105716 - DNA, 187 bp, Heterodera glycines
  Promoter: Source sequence=SeqID_41272; Location=1..187; Strand=+; Gene=SeqID_69438
tggcctatttcgcgattttttaattacaagccctagcttctattttactaattaacccattaagaattaacaagtttcggtcgaagcatctttttggcaccatttgactccgagccaaaaatagtcaatttttagagaatttagttactcttattaaaacaacctttttgcatctgttttcctaatg

SEQ ID NO: 105717 - DNA, 456 bp, Heterodera glycines
  misc_feature (41)..(41): n is a, c, g, or t
  Promoter: Source sequence=SeqID_45526; Location=808..1263; Strand=-; Gene=SeqID_72807
tttcagagcagtttgtgaaaaaatatttatgaattaatttntgctaaaaaaataaaatagtgaagctttaaaaattaataaaaaattttaaattcagaattactggagttagcatcatagcagtgcttttccttgtctttttgatgccctcgcaaaatctggttcgcttctgatcagtttataaaaaaaaagttaagcctaaaatttttcgcaaatttaaaaagcaattaaaaatttttagattttttattcatctccctttttgatagtgaaagcatcagagagccttatttaacttttaattaacatttggtgcgtttcagagcacgttctaaaaaatatttatgaattaattttgcaaaataataaataattaatgaaaaagtcagaatttcgaaaaattttaaaaacaacaagcgttggcattttttcaggttaagttagtcctttacaatg

SEQ ID NO: 105718 - DNA, 214 bp, Heterodera glycines
  misc_feature (99)..(99): n is a, c, g, or t
  Promoter: Source sequence=SeqID_9219; Location=261..474; Strand=-; Gene=SeqID_70659
ttgtacgggatgaaaaacataaacaattgatgcctgatgctaatgctattttgagaaaattacaaaatgctgatttcaaaattttacgtcccccccccnccctcctccatttgaattgatgacattttttctctctctttttttcgaaaaaacaaattacggcaaaaacccatcatttttcatcattgatgtgattttcagtgatcaaaatatg

SEQ ID NO: 105719 - DNA, 129 bp, Heterodera glycines
  misc_feature (24)..(24): n is a, c, g, or t
  misc_feature (32)..(33): n is a, c, g, or t
  Promoter: Source sequence=SeqID_30295; Location=789..917; Strand=-; Gene=SeqID_60711
aatatcgaaaattctctaaaaatnttatgacnncaatcaaaaaaagaaaaaaaatttgcagtcaaaaaattattcgaatttctccaattttgtttccataatttccgaaagttattcggtatcataatg

SEQ ID NO: 105720 - DNA, 734 bp, Heterodera glycines
  Promoter: Source sequence=SeqID_8270; Location=1145..1878; Strand=-; Gene=SeqID_67510
tttcgacatctattaaaaaaacatttaagtaaataaatgattcaataaattttaggacaaaaaaattataaattatttaaaacttaaatatttcataataaaaatattttcaacaaaaaattcgaatatctctgactgataaataaattcgtaaatgttctcatttaaactgcacaattagtgttcggggcactgccgccgaagtttgaatgacatgacataatgccaatcgatttctgttccatttcatgttccttccctcgcccataaatatgctcccattcccctttagattgtcttcccttcattcattttgcatttatatttgttccccaaattattgtgactttcttttccttctccaataaataaatatttaattggacttaaacaaatccctcggaccgaacaattggcgcagtcagctaaaaagcaaacgacataaagcgcatttgttattcatttattacatctccaggcgagagtaatttttggatttcaacattctgccgccggtcttcaagtggacgaaaacaaaccgtccacatttcgaccgccgactttcatcgcgtcaaaaaaccaatagaccctaaaagggtgaggttccgccaggtgcggttttcaacgcttcaaaaaaccaatagaccctaaaagggttgcggttccgctatacgcggttttcatcgtccaatttcaacactcaactgaaaagcgatcgataaccaccgacaatg

SEQ ID NO: 105721 - DNA, 1003 bp, Heterodera glycines
  Promoter: Source sequence=SeqID_15105; Location=491..1493; Strand=-; Gene=SeqID_79283
tctttccacgttttgacgtcagattttatcataatactcaattggctttttttggattgaattcagagtgtctgtggatggatttggctgcctaaatttatttttatctaattatttttggagacccaaacataaaagagtcggttttgttctgccaaattcaaaaatagcatttttttaaaaatttgtttacgaagtcgacgtttgtgctgtccatgggcaatctgtgctcagtcccttgttcctccaattcgatcattttttcaatttgtcacggaattcgttcatcaccgatttttttcgcatcaaatgattgtgtttttttcttttgggtttcgcctacgctcagccacagattaaaaggattattaaatctgcgttttgtgttgccattctcacctccaacaaacaaagggaagggatgagaatggcgtcgtcctcccctccctccccgcccacttacaatgcttttcctccgtccattttcctctcatccgatcgatcattcccttcccccgtctgtttcagtcccacacttgcgcatgtgggaggggagaccgaccgcgggatattcccattcctaccaccagccgcgcatctctcgccgaacttttgcctgtttatttacataagaactgaatgcggggggggggggacctccccggcgaggggcggacaatcgctcgacgagtggctcaagcggaaagtgcgcgggggaggcattgttccccctcccaccgcttttgctgctgccgatagttcgcggcggttcattcgacctcaaaagaggggaaaccgggggagaagtcaattccgaccgcaaagacccatcgaacgcagcgcaaacggaaggcgagtcgcgacaactcgggttttgccgcaattctttggcacattttgcctcattttcgcttcacttccccctattattgttttttttcttttacccgttcattagacaaaacgtaattatatattttagaaatttaattaagcgaccatg

SEQ ID NO: 105722 - DNA, 1003 bp, Heterodera glycines
  Promoter: Source sequence=SeqID_43839; Location=157..1159; Strand=+; Gene=SeqID_71420
tttgaaaattcattgctcagtgaaggtttggtcaatttaagtgaattaaagctctaaaaatagagaaaaatcaggagaattttatgggatttatttgggttttctaacatcaatatgaaagaagttattccagaaattctggaaattttagatttttcagaaaataattcagaactcgcttctgaaaagtcattctgtaaaagtaataaactacaaaaatccgcaatttttttctctattatataaattttatttcacaattttatcactttcttacgaattgttacaaaaataaaagtgattttgggattcgggaccaaaggggggtgcacatgatttttgagtgaaaaaattttttcgacaaaaatcttccaaaaacatgtctttaggggttatttgtgccgctgatcacgaatacgtgatcagattttacttttgacatcgtttagacctcagaatccctgtgtgattggggattctgaggcatcatttttggggggaggaatgaggcatcacaatttgtaaattttttgtttttttttctaagcaagtcatggtttttacggcattttaaaaacgcatggtgaagtttggctgtacctgagaaggtatgcgctctctacattgcgaaacttgggcatgggccgaagccgactgagtgacgaagtgaatttattaatttttttagctttatccacgacccgaggccccggattttttttttgccattttttttaagctcaaaaccgactgtctatttccgtcgataatacccataacaaatgaacggtataaactattcaagccgacctcattaaccctattttccgactttggaatttggcaatactatcgaccctgatattctttttttggcattatgcagaccgattgcaaatgatttcaaataccattagccaaaattccggaaccccgaagaagcttcctacaaaagggcggaatgcacttaatttaaaattaaattttaatgcttttttagatg

SEQ ID NO: 105723 - DNA, 771 bp, Heterodera glycines
  Promoter: Source sequence=SeqID_2733; Location=1659..2429; Strand=+; Gene=SeqID_81331
aagtccgcgaagctgtcttttcgtcaacggggagaaattggagcgaaaatccgtcggaaattcgatagcgtcatcgcaaaaaaccccgggatttgatacaatttgcgatattggaaaaattctttctggtcaaaaatcaatttcggtatgccccccaatctgatttcactttacaaatacgctcccttgacttcatgtgatgttgaacgatcattttcaatttacaaatctattttgactgacaatcgctcacgtctatcgtccgaaaatcttgaaatgttacttatttgcaatgtgaatctcaataatgatttggcataatattttttgctttttgaataaaattttgtcattttacacccctaaatttgaggatttttagtgcctattttccattttttagtgcctattttggggattttttagagcctaaagcctacctattttggcggtttttagtgcctataaattgcatccctatttattatatgctgtttggatcttaatacaaacattcgaataattagatttttaagtcaaaaatccgtcctaataaatggaaattcagagaatctatctttgaaaatccaatttttatttatcaaccttaagaaactaatttaaattaatgaattttaaaattattactataattttaatgcacattttttgtttttcctttgaaatgtcgacgagtaaaggtagaatcaggcatataaaaataaaagtttcaaaatttaataatattttgaagaattgaattgttggatg

SEQ ID NO: 105724 - DNA, 96 bp, Heterodera glycines
  Promoter: Source sequence=SeqID_9937; Location=1714..1809; Strand=+; Gene=SeqID_72974
ggtcggaatgtttggcttaacaattgctacacaacagtgcttttcaacgtcttcccttttccaactctttcagaccagcctttgctgttgtacatg

SEQ ID NO: 105725 - DNA, 145 bp, Heterodera glycines
  Promoter: Source sequence=SeqID_6866; Location=4812..4956; Strand=+; Gene=SeqID_46319
ggtacatcatcatttcaagtcttgtttgttcagtttcgacttaatttgtatgctattttaccaaaagttgtaacgaaaaacgaaatttggcgaaaagcgtagattatttgtctatctgccataatgaacaagcattttgcagatg

SEQ ID NO: 105726 - DNA, 606 bp, Heterodera glycines
  misc_feature (200)..(200): n is a, c, g, or t
  Promoter: Source sequence=SeqID_2864; Location=5620..6225; Strand=-; Gene=SeqID_82031
ctgatttgtgacgggaacatcgtggtgttggacgaggctggtcagggaccattcgtgcaagtctgctcaacttgtcgggctctctgtgagataaaaaaggtttttgttaccggggaccggtaccaattggcggtcaacatgcaaagcgttcccgagccggttagggtaggatttgggtttgacacagttctgataaattnggacaaggctaaagcggtggataggacaacactgctgacaaattaccgttctcattggcagattgtggcctgtgttgagcacatggcgtacaaaccccacggggaacgccttcagcctgggccgggttctttcaggatgctaatcgatttttggaaaatgccggtggcggaatcccctcttttattgatccaccaggaatcactaatggaaccggaactgacgagcttttcggcaacaaacagcggacaaactcggacagtactggacctcttggccttgttggacggattccccggcagcatccgcataatttcctttcatgctgggcaagctgcgcagattggcactgagctgaaagagcaagggtttagtcggtccattgtctctgccactgcagacgcaatg

SEQ ID NO: 105727 - DNA, 353 bp, Heterodera glycines
  Promoter: Source sequence=SeqID_29334; Location=1423..1775; Strand=-; Gene=SeqID_59846
acaataatgtgcgtcatgtttttgataaaacattagtcttttttgtgtgactttcgtgtgacacaataatgtgcgtcatgtttttgataaaacattagtgtttgttgtgtgactttcgtgtgacacaataatgtgcgtcatgtttttgataaaacattagtgtttgttgtgtgactttcgtgtgacacaataatgtgcgtcatgtttttgataaaacattagtgtttgttgtgtgactttcgtgtgacacaataatgtgggtcatgcttttgataaaacattagtggtttgttctgtgacttttgtgtgagagataaataaatgtttttgacttttaattttttaaagcaatg

SEQ ID NO: 105728 - DNA, 60 bp, Heterodera glycines
  Promoter: Source sequence=SeqID_27466; Location=900..959; Strand=-; Gene=SeqID_58160
acttttttgaaaagcatttttgggcatattttgccagaatggaggaagaaatttgaaatg

SEQ ID NO: 105729 - DNA, 141 bp, Heterodera glycines
  Promoter: Source sequence=SeqID_2681; Location=4113..4253; Strand=-; Gene=SeqID_81058
ggtgaattttaattaatttcactttaattaattcataaaacattgttttctcttcaaaaggtcttcgcactgtcttcgcaaaatgcgcggctccattaaatgttgctggaattttctactatgaaattacggtcacaaatg

SEQ ID NO: 105730 - DNA, 259 bp, Heterodera glycines
  Promoter: Source sequence=SeqID_21273; Location=1734..1992; Strand=-; Gene=SeqID_51867
aaagtatttgccaatttttcaccaaaattttcaatttgagcgatgtccaaaattaatgtgcgaattcgttccaatttctcattttgtgccgtttccatcgtaaaaattttccaaattaatgcatgtaatgtgtctttgtatcggaaatgagtgacgtggacattaaactctttgatggccgaatcattgatatgatttattaacacttgtttgtaaatataagcaaaattatacaggtcactactatcagcgaacaatg

SEQ ID NO: 105731 - DNA, 237 bp, Heterodera glycines
  Promoter: Source sequence=SeqID_33164; Location=1..237; Strand=+; Gene=SeqID_63312
attaaaaagttgtagaaaaaatttcgcttttcgcatttcttattttcgcatattttggcttttcgcatttcgcttttttttcatttcgcatttttcagtttcgcaaatttcgcttttcgcatttcgctttttatttttcaatttggcccatccctgctgtcggcacagccaaccctaagcacatcgaatttaattttaattccacatttttcaaaaaatatttaatttatttagatg

SEQ ID NO: 105732 - DNA, 286 bp, Heterodera glycines
  Promoter: Source sequence=SeqID_9919; Location=1949..2234; Strand=-; Gene=SeqID_72946
aagaatggtaccgatgactcacttttaatgaaaagcatttagcaaagtgaattcgtagagactaaaaacacctcttctctctctcatttattgttgaagagcagtgataaaaaacatcttttacataaaaataatttattaatttaaaaatgaggctaaattgttataaaaaaaaatctaagccaattatcagaaggaaggatttacccaagggttttcaactgaaaattttcaaaatcagcacttaaggtaaaaaagctgcttttagaaaattatattccaaatg

SEQ ID NO: 105733 - DNA, 287 bp, Heterodera glycines
  Promoter: Source sequence=SeqID_18959; Location=1..287; Strand=+; Gene=SeqID_83689
taattaaaatttataaattatgaatttacttagaaaaatctttgacgtacaaaaaagattaaaaatgtttgggttttaatcgaaccaaattttgcccattaatagtatcataatttaattgggtaggtaaaaagtaaaatgattttttacagtaaataaattcaatttttttttgttaaagtaaaacgttttaaaaaatttcttttgcactgtttttttgacttaaaaatttatcatttaattaaaaatgcattaaattttattgaacccggaatcaatattatatg

SEQ ID NO: 105734 - DNA, 1003 bp, Heterodera glycines
  Promoter: Source sequence=SeqID_11203; Location=346..1348; Strand=+; Gene=SeqID_74556
cttcacatacgagtattttttattgcaagcatattaaaaacaattatgataaaattaagcgggattatcctgcgacctagcaaatccaaaagaagtctgagtgctaacaatttcaattttgtctctcttagccacgtccatgggaattgcgcatgactcaagtttgcaaacagcgagcccaagttttttgcaaggatagctgtggctgggcaacatgtgtatgaatttcgaatttttaggtctatggttaagccccgttcctcagggagagaaattacttgacaaaatttttcatgataagctggtgaagttcatttattttggagtgcaacaaacgacatttacaattccccggattgatcgggggatgaattctattttggactattaattgctttatttggaaaaccttaaggaaaagtagtggaaaaaaattatttttcaatttctttcaaaacatgtttgacagacacaatgttaaataggtgtacaaatatttattatttattttgaaaattaaatgaaaagaaaaaggagcataatatataattttgaccattatttgcttacagatttttaacccaactgctcgttttcgggaacgtaatgaactcttatacgcttttgaacaagcaggaagcgaaataaatgctatgtttgaaggcaagcagcgtttttttgacgaagatcattgctgtcctggcagcgactaccttttcaaatgttgtgaaatggtatgcacaaattagcagtaaatgtttttttttaaattaaccaaaatttgaaacattaaatttttgatagaccgtaagaaaattttcaatcattggaaaattcaatttttaaacattgacattcttttttatagttgttttttgtaaaaataaaaattgtcaaaataacagctctatttatacatttgtgcaaacgaaaatcttctgtttatgaccatgaaagtatactactaattttaattttcttttgtattttttttattaagatg

SEQ ID NO: 105735 - DNA, 384 bp, Heterodera glycines
  Promoter: Source sequence=SeqID_23591; Location=286..669; Strand=+; Gene=SeqID_54279
ggtaaggaaaatgccaattgggttctcgaaaacctcgagctcggcactcaattctttcaagatttttttttttagaatttgacttttttgatagatagaatttttttttacagagaacaagttttttaaataataatagcattaaaacacaaaaattcaaattatttaaatgaaaattaaaatatgggggaggagggcaccaccggggaatatttatttaaaaacttcaaaattttagtattaatttagacaaatctgaaaaattcttggcattgaaaaattttcgcatttaccgaaaattcaataaaacatgaaaaaccaaaacatttgggagccctgtttttataaaaaagcaacaaatgttaggttttgtcctccaacatg

SEQ ID NO: 105736 - DNA, 465 bp, Heterodera glycines
  Promoter: Source sequence=SeqID_19442; Location=1435..1899; Strand=-; Gene=SeqID_84165
ttttgatgttttagtggacaaacatttcaatggcacagaaaagaaaatttggaggactatcgaaattcacaaagattttggtgcgaaaccaaaactgtgtgtggttattggtgacgactcggtacttgtttatcaccagtttactcggaactggtttttttgggttgaaatttcaaaaaaaaaaaaattatacgataactttttagtccatttcaaggcccctggtaacgaatctgacattcctttcgactaaattttaacccacaaagtcgagctcaaatttcccaaattcgtatggctctttttgatcaaaaaagggtcctcgattgctgaatcgggtccgtgattaggacatcggcgaaacagatttcagatctataatcagcgggctttcaatttttttaaaaaacttttttgaaaatttaaccaaattttagtcttatcgagattctactatacaatatg

SEQ ID NO: 105737 - DNA, 1003 bp, Heterodera glycines
  misc_feature (529)..(529): n is a, c, g, or t
  misc_feature (543)..(543): n is a, c, g, or t
  misc_feature (596)..(596): n is a, c, g, or t
  misc_feature (609)..(609): n is a, c, g, or t
  Promoter: Source sequence=SeqID_15825; Location=374..1376; Strand=+; Gene=SeqID_80150
attttttacttttttctaaattttctaaaattatttaaggattgcaagcacattctgttcaattttgatgaagtaaaaaagaaaaaatgataaaaacataaaataaatatttaattattgacatatcaaaataaattattaactaacagtaaataataaatcttgaacaaactccaatctaattcatatattttttaaataatttaaatgctcatttgatatttattaatatttcctttttcatagataaataattaatattattttatgctagtctatttttaaaatttacatttgtaagaaaaaaggcttaatatatttaaataactaagtattatcatataatcatcaaaattatggaataaaaaatagattcacaatttttttatcattacgataaagaagttaataatagacctagattggtaaattaataaaaaaagcagtgagcgtcgagctagaacagcgtcgggaatcccgacatggcttcacggacacccgcactatgactataagaaatttataatanaattcacaaattanataatcaaaacgttgaataaatgcataaaaataaagattttataaataagaanattaactaattanaacaaagaaaattaatgcaaaaaaataaaggtgtttttcaaaaaagtaaactcaaaaataaagaaaaaatattttaatacattgatggaattcagatgcaaaaatatggaaaataaattgttacaaatacatattaaaacaaaaacttctgaaagcaagaatcgagattgcttggcgtcaacactaaatgtcaagattaaaatgaaaaaatagaaagtttattaaaaatattgataaaatatagtttcaaaaaatgtaacaatacctaaattttccattcctaattattaaattgaacaatatataaaatcatttagcaaaccaaatttaatgtgctaatttaaaaaatattttaaataataaaattcatgcttccagctgataaattgacatg

SEQ ID NO: 105738 - DNA, 502 bp, Heterodera glycines
  Promoter: Source sequence=SeqID_40247; Location=1..502; Strand=+; Gene=SeqID_68646
aaataaaaaaatgggataaatattgaagtagtttgtcccccttagtcgccttcagcgcacatttgtagtgggattttgggcggacaatccaaaacttttgagccgcaaattgagggggcccgtcgattttggtgaatttgcttaaaagcgaaacttgataatgagccagtttttcattgtttcacctgctgattgtccaatattggtctcccttgcccttcctcttcaacaaatccgatagttttgttgaggactgagcgccaaaactcagatgaccgaaatgacttttggcgatttggttgttttctggacaaaagagcaacggcagaagcgacggaaatgccgaaaagcaacgattgaaaatggggaaaaggtggcggagaacggcaaatccatcggcgattttgggcctggcgaaaaagtgcttcggaggcctaagacagggtaaattttaaaaagaaaaagcggagtgaccaaattgagcagatacggcaccaaaatg

SEQ ID NO: 105739 - DNA, 913 bp, Heterodera glycines
  Promoter: Source sequence=SeqID_7780; Location=2453..3365; Strand=-; Gene=SeqID_65938
ttatttatgtatgtatattttggtttttccgtgtctcattaaaacattgtacccccccccccccgaattccaaggagtctccgctccacttgctccacccttttggccattggttctttgctcgacatcgtttctttgctcactttctccgtcacttttgtcgtcactttgtctggccacaacttcatctcccttttcacctgttacttcctccaacttctgccaaatttgagcattttctcctccgtttggattgttttctttgtcggcttcgaccgattaatcgccgttctctttccgttacggtaattttgcataattaatgtgtaattattaaccaattaatggatcaattagttgcaaccttttggagaaacatctccttctttacatctctccgatgcttttcgtcactttcggttacagcatttatatggttgtgatggctgctaattgggcactttttacatatccggattggtcaattaaatcaatcaattaattaattaattattgttttttattaggcccgttttgtgcactaacagtgacgcgttcgcctttggcatggcggcggaaacagcgttgcgaaatgggctgctgattgactgcacttccttcttattttatattttggttgcaattgtgctcgttttccgttggaaaaaaatgagtggtccgtaaatccagcgttaaatcgcattaaattagtaattaattaaataattaattaatagtcaattttaggcacaaaattttttataaatatataagctcaaaactaagtgaaaattgtttttcttgcttattttagcattaacacttcctgaaaatgtaggcatttgcctaattttgcttcctaattatttaattaataattaattgtcgtctttttactaaaggctccgaaatg

SEQ ID NO: 105740 - DNA, 970 bp, Heterodera glycines
  Promoter: Source sequence=SeqID_28605; Location=790..1759; Strand=-; Gene=SeqID_59203
ataagtttataaatatctacgacaattttttaaaaaacaattcaatctattattggcatttggggacaaaacggcggggcacagattggaagccaaaccaaaaagatgccaagccttccttctcttcctcttccattacactctctctctatttacatatttatctattggttttatctcactcactctatttatttggtcttcggttggtctttcccattaccactcacagaagagatgactcatacaaattatttttaaaattttatttctaatttaaaaatacttgaaaattttatagaagattttttaattatataaaatttatttcccacctgggtgtatacaaggctcgttagatcatgtcctctgaatttttcttttaatttttacttgattaatttgaggcgctgaacatctaagactaatgagcaaagaataaattcaaaaagattaatataaaatgcaaaaataaataaataaaataattatctgtgactgaatttgatcggcaatgaatggtgtatgaactgttcaatttaatataaaaacgtcgctatgtatgacattggtaaacaatttgtcatattcagcgccaaaaattataccaaaaaacatatttattttaaataatttgaaaagaataaatgaaaatttgaaaatttctcccaaaaatcataattcggaattcccgcataactttagcaagtatcacaaattttctatcgaataagctaaaaaaacaagcatggttttgtaaaaacccggcactgaaatggccattttttttttttttttgtaaacttttttagatttatatgagaggtattgttttggtacaaaaaagtgtctgcttttcctagccctataaaaaaagattgatttgaacttattaacattcaatttaggttaattgtcgcctgtgactcaattttcaccaatttatctgatcgattgtcttttgatcatg

SEQ ID NO: 105741 - DNA, 154 bp, Heterodera glycines
  Promoter: Source sequence=SeqID_42149; Location=1..154; Strand=+; Gene=SeqID_70111
tttagaggctcaaattgtttcgctaagcgagaaggtaacaaacttagaggaacaaagaaatgactggccttcggatgacgaaagtgtagactcaactgacttaggcggaaaaccaaaaaaaagtggcaataaccaaaacacctcactggtaatg

SEQ ID NO: 105742 - DNA, 750 bp, Heterodera glycines
  Promoter: Source sequence=SeqID_17993; Location=544..1293; Strand=-; Gene=SeqID_82556
ttgcacctttaatttaattcgacataatttttataaaaattcttaatttatttgttagctcatcatttaggctatggctaatcattattgttttttgaccttatatcaaataatttcattaattcgttttttaaatctcttaaaattaattaatttttcctaattattttattagtttattaattcattaattactcattttgagataggggagagttacgtcgagaatatttgctcacctaacttgttatttcaattattttttcagattttttgggttgaacaattttgttttttagtccattcatgatgctttgattaactaatgaatgattagcgttattgagtttacaaactaattgcagaaaagaaatgcatttaaagaaatgaacaattcaaatgaattcactcatttatttaaactcaaaataacctttatatataaaaaatatttcttaattgaaattatactcaatttaaataaaatgataattttcaatttcaaaatctatcactcatcagatgatagggaacattttgaattgagcaattaaaataaattgtccataatttaagaaaattgaaaaatggtactgacaattttggcaattttttgcttggcatttctggcaaatacgatatggcaaatatggtgctggtccccctggtggctacccacatgacaacaacacaacaacaacaacaacaacaacaacaacaacaacaacaacaacaacaacaacaattatg

SEQ ID NO: 105743 - DNA, 456 bp, Heterodera glycines
  misc_feature (106)..(106): n is a, c, g, or t
  Promoter: Source sequence=SeqID_12162; Location=1..456; Strand=+; Gene=SeqID_75734
aatatggtaatgtgtctgatctcagtggggcggtcgctgatcattctgtgcccgatcagcccgaatttgtcttttacttgaaattattttatttatctttcatttntagttgaaaaacagtggaagagtttaatataaattcacttcaatcaattttaattttcattattttacaatttaaaataaaaattcaaccaaatcgattatgattaaaatcccgaaaaaactgactttctcggctagattttatttataattgtaatttttgaatttttctttttatcagggctccgaactgaaaatggccgacaaaaaaccagcatttggggtcaaaaataattattttgcaaaatactccaaataaaatcaaaaaaatgttcgttttttgcgattttgagccagtttttaagaaaaaaaaaagttttggtgtccggcggtgccgataggcgaaaaatg

SEQ ID NO: 105744 - DNA, 1003 bp, Heterodera glycines
  Promoter: Source sequence=SeqID_19586; Location=563..1565; Strand=-; Gene=SeqID_84325
aatgggcaaaaaactatagaaaaatgtaagttattaagattacaaaaacaccaaaacaattgaaattgattgcggaatgccaaatgaagcattttcttggccccgcccttatttttggtttttttgcacctaaaatagggacccctaattttaaagaatttcaccgaaaatgggcactgaacggaatcgtgtgaagaaaacaattggaacttgcaaaaaatattttaccatttttcaagttaaataaaaataaattatttattttttcttcagaaatatttcaaatcatcaaatcaattatggaaaaatttgagaaaattagcgcagttttttgctgccttttttaattttttgcctttttcatgcctttggaatttttgattttttcggcccttttttggcgatttttttgtctaaaactgtcatcccatagtaatactaacaatgttcaatttagttgacaatgaaaaaaaaacttacccaaaagctcgtccagcggcatctcaaagagtgataaaaaaaaattacaagaaaaaatggcaattacgtgtaaatatggcattttaatagctgcttaaaaaattgccacaaataatttaatgaaatttggaatttaatcatttaattaatgatgactaataactatttaagaaattcggaaacataaaagaaaaaaagtgtttgcttaacaattaattcacattatttttggcttatcagtgaaatcaacagaaaatgaaagcacaaaattgcttaaaatcacaatggcaaaatggcaaaatggtaattagtgataagggactaattgagaatgagaatgctttcttcattcactgtttgactcttttaatgagaattctccgccgtaccaaaacgagagagattcctcctaagaaatatggccattttcttccaaattttgaaatattatttattaattaactaattaattaattatttttggttgataatttcccttttatctttttttggtgattctatg

SEQ ID NO: 105745 - DNA, 182 bp, Heterodera glycines
  Promoter: Source sequence=SeqID_22793; Location=814..995; Strand=-; Gene=SeqID_53490
ttatgccgtttagctcttgtcccaaaatataaactaaaaagacatttgtactcattatatatatatatatatatatatatattaaaaagcaacttatccttccccctcccccctcccgcacatttcgcatattgacatatataaagtttttagcttccgaatttttgaataatcattcaatg

SEQ ID NO: 105746 - DNA, 69 bp, Heterodera glycines
  Promoter: Source sequence=SeqID_45013; Location=469..537; Strand=+; Gene=SeqID_72406
ttgccgcattttattggtaaaaaatatttaattatttgaaatataaataatttattgaattttaaaatg

SEQ ID NO: 105747 - DNA, 326 bp, Heterodera glycines
  Promoter: Source sequence=SeqID_1327; Location=1819..2144; Strand=+; Gene=SeqID_72639
ataatttttgttttgataattttgtctcatgtttataacatttaatattttaaattaatcaaatttgtttcattttttttagaatgtcaaagaaaaatttccaagaaacttcaaaagaaatccgccgctcgaaaaatacaaaaaattatttcaaaaacagtcctaatttggaaaaatgtttcgaagaagtggagagtcacataaaggaaaataaaaaatttgggataaaagagcacgtgacaactttctattttaaatgccccgaaaatgaagatcccgaaaaaatgtttaaaaaaatcctgaaaaaattaatgggggatgcaatg

SEQ ID NO: 105748 - DNA, 120 bp, Heterodera glycines
  Promoter: Source sequence=SeqID_26675; Location=962..1081; Strand=+; Gene=SeqID_57435
ggttttgattttgatctttttttaaaaaacatttgaaatgttcatatcgccaataattaaccaaactttgccagtgtataattatttttacaaaaacaaaattacagtatccatgacatg

SEQ ID NO: 105749 - DNA, 248 bp, Heterodera glycines
  Promoter: Source sequence=SeqID_29572; Location=268..515; Strand=+; Gene=SeqID_60053
tcgacagtaccagtgcggtaaatggacagctattggcacattggctgatcaaggcgcttccgaatgaaatccctaaaattgttcgttgttcaattgagtcatccgaaacggcgggtgatttgccagcaaaaattggcgcaattaaatcggtatataaaaaattgaaattatttctgtttgtaactaactgttaatccctttaggcattttcaaaatcttctttttctgccaatttcataatccaaatg

SEQ ID NO: 105750 - DNA, 571 bp, Heterodera glycines
  Promoter: Source sequence=SeqID_2150; Location=5863..6433; Strand=-; Gene=SeqID_78097
atattttaaatgtctaacaaaattatttttttatatttccccaataatttttatattatctccaattaaatttatctttttgaaatttttgactaattacctaattaatataaatttgaaggtatgccctgcgtaaaccatcacgtctctattcgtttttttcgaaaaattgtttaaatttttttaattaattagaaatattaaagctgataattttaacaccaagctgatgatgaatgaagaaattttgaatgcttttatgaaaaattaccaagaaaaattattgccaatctctgagataatattgcattttttgtgattagctaattgttattatattgattagacaaaaagttttcgaattttcaaataatgaatttgtaatttatgtgaaattattaccgagatttattcacaaaatacataatgaaaaaatacataatcaaataatttcgtatacaaattaattaaaaatcataaagtaataatttttttttggtccattagacgaaaaaataactgacaaaataacacaacaaataagttttgatgagttatttggccaaggatg

SEQ ID NO: 105751 - DNA, 239 bp, Heterodera glycines
  Promoter: Source sequence=SeqID_2253; Location=1963..2201; Strand=-; Gene=SeqID_78733
tagttggtgggcatgccctccaatgtgatggcttgggccggaaggttaaaaaaacacgtgtagggggtgacctatgcgcgtttttaaccctccaaaaatggcccaaatcattgctcaggagaggggtcatgcccgattttttattgagtggccattttctttgtatttttttatcaatttcatttgttttctgttttttaatgaaataatcaaagtcaatttaagaaaaaaaaacaatg

SEQ ID NO: 105752 - DNA, 336 bp, Heterodera glycines
  misc_feature (9)..(9): n is a, c, g, or t
  Promoter: Source sequence=SeqID_8999; Location=1090..1425; Strand=-; Gene=SeqID_69955
tttcagcancaatagtcgaacttagaaattattaaaaaaaatcttcgaaatttttataagaaaatttcaagacaaagacttagaaaaaattttcagcgattttttggaaaagtgtttttcaaaaaacatagtaagtaattcatcattaaattatgaaagaatcgttagactaagattttttcaaattacgtaaatttgaattatttattttttaattttttggggtggaggacggcgggagggaatgagctgttccccctctaatgaccccaattatgcatgcgactagtcaattaagcaagccatcatattatgaattaattacctatcgccatg

SEQ ID NO: 105753 - DNA, 145 bp, Heterodera glycines
  Promoter: Source sequence=SeqID_31551; Location=348..492; Strand=+; Gene=SeqID_61881
ttttctggacagaatttcattgagcttcgtctggcagcaaaaatccttttgattcctacgtttggaattggtaattttttttaaatcagcataagtttcaaatattatttgaaaatataattcaggcggaattactccaacgatg

SEQ ID NO: 105754 - DNA, 328 bp, Heterodera glycines
  Promoter: Source sequence=SeqID_44978; Location=288..615; Strand=-; Gene=SeqID_72378
ttcggaagtgctaaacgcttatttattgcctttttaagagggaagagaggagcttgtgatttattaaaaagcagtgatggggttgtacatagcaggaaaaaacaattacaaagcttttttgcattagtttatttgaccctgaaacgtaaactcacgaggatatcgaactttgaacatattatcaaactgaaactttgttatctatccacaattcttgtttaatatagcattttcaacaattttcttacattcacttttctttttgcacatttacaaacacataattttgatatttcacaacacatgcatttgaatgcgtttggccatg

SEQ ID NO: 105755 - DNA, 95 bp, Heterodera glycines
  Promoter: Source sequence=SeqID_17980; Location=2225..2319; Strand=-; Gene=SeqID_82545
aggagattgaaaaagccaaatctccaattggccaaaatcaaaatgcgccgcgaagatcagcacgcgccaagagggcacctcagcagctgaacatg

SEQ ID NO: 105756 - DNA, 60 bp, Heterodera glycines
  Promoter: Source sequence=SeqID_1493; Location=1..60; Strand=+; Gene =SeqID_73933
tcattagctgctgggatgaggccaaaatcgggtgatcatttcgacgtcacaaccaaaatg

SEQ ID NO: 105757 - DNA, 140 bp, Heterodera glycines
  Promoter: Source sequence=SeqID_3250; Location=6782..6921; Strand=+; Gene=SeqID_83911
tttcagaaagacaacaattgtgctagatgttaccctattttatactcaaaaatctgggccacgcccatcaaaatttgactccgcccattttaagcaaattgaaattacccgtccgaagccaaattcatttcctcaaaatg

SEQ ID NO: 105758 - DNA, 401 bp, Heterodera glycines
  Promoter: Source sequence=SeqID_5383; Location=2632..3032; Strand=-; Gene=SeqID_57838
aaatttcttcaaatttattgggttgaaattgcatatgagatacatttccaaattttttggctcggtaaggcgctttgacaaagacgcaattagtcggtcaacattcggaattggtctcgaattttttcggcaattacgtgcaatcattttaaaagaaaaaaacataaaagctaaaatttattaatttttttagcgcaaaatcaaccacaaaagcgaaattttcgcttttttgcttatttttgacataaatttattaatttttaagaaaatttaaatttattcaatattctcgagaaattttggcgaaaaaatgattttttgaaaaatttttcggtttttgggctcaaaaaggctaatttagctgctgggggccgttctaatagaggtttttttgaaaaatg

SEQ ID NO: 105759 - DNA, 185 bp, Heterodera glycines
  Promoter: Source sequence=SeqID_1277; Location=6888..7072; Strand=+; Gene=SeqID_71323
aacgcagtttatgtgactaatattttgtacatttgtaaatgcctcgtcctaaattaaataaaaaaaaaaaaaaaatctttacattaaacattttggttgattgggcccatccacaaattagtaaaaccttactttcctcttttagaatttttttttccaattgataaaacattaatttcgccatg

SEQ ID NO: 105760 - DNA, 184 bp, Heterodera glycines
  Promoter: Source sequence=SeqID_9399; Location=1..184; Strand=+; Gene= SeqID_71271
cgttcggttggaatgccaaagtgtgaggtcggtcaaggcgaacagggattttggtgccattctacatgtcgcagaactcgatccagcgcttggaaatgctgaattgggctcaatcacagtgaagacaccactgcaggcacttttggcggtgttccttttgaaggccgggactgtcaaatcaatg

SEQ ID NO: 105761 - DNA, 256 bp, Heterodera glycines
  Promoter: Source sequence=SeqID_3131; Location=1..256; Strand=+; Gene= SeqID_47534
caaaacagaaaatttaattgaaggtgaagaaaatttcttaaatttatatgaaatatgatactagtcgtcgaaaactacaaaaaaaaaagttgcacaaagcacatacctatgtacctacctatgtaggtatctgttgtcaaaaaataggacttacctactcctctcaaaaaattagcctggtcgaaaatttttaaatttggcattatgttttaaaaatctctaccttgttttttttatgttcactaagtttaggatg

SEQ ID NO: 105762 - DNA, 1003 bp, Heterodera glycines
  Promoter: Source sequence=SeqID_5913; Location=427..1429; Strand=+; Gene=SeqID_59654
gaaattgggcaaacctatcgggccgcttactcaagcccgatttaggcattggagagttggccaataaattaaaagaaacaatgcgagacaagcaaatagatttggaaaggccgagacccaaacagaatttagagacgaatttattgcttataaaatgtcctggtgaaaagaggtgaaaaccaaggaaatatgtgaaatgtccaggaataagtggtgaaaagaggggcaaaatattccataacaggtgtgaaacatatgaaaaaatatgtcataacaggtgaaaatggtaaaaaatgtttcgtaatgtaattggtatggggtgacaggtattgttgtgttattatgtgatttaatggtcagtttttcccaatcatatttcaaaagcggcattttgcgcccgtgccaaccaaaaaaattggtgccagccaaaaaaatacgcagcagtgaaataatgtgacggcttccttttccatttcgtcgccgaccaaattcaaatttgactctagcgtaccgttttccctctcacctgtcaatcaaatttcaatctttcgggactctatgcgcttcgttttcccttctggcggaagtcatgcaccaaaaaacgtcccctctcggggtgccatccccttcccacctgtcaatcaaatttcgtagccagccaaaattcaaattttggttctctcgcgtgccatccttctctgctggcgttcaaattgcttctttcgccggtcttttcccttctttcaccacacacaccactgaaaatcgatcacactcttccgctaattactccgccccttcgcatttgtgccagaattggcgtcctttcattcactcttctactctctcaaaaaatcagctttttcaaccaaccttctcgcccagctaatttcttttttattatcttcaatttcctaatttaattcgtgtcagcgcagcacgtacttgcagtgtttgtgagggagaagaacgggaatgtgaaatttgtgaagggccaagaatg

SEQ ID NO: 105763 - DNA, 278 bp, Heterodera glycines
  Promoter: Source sequence=SeqID_19558; Location=1426..1703; Strand=-; Gene=SeqID_84287
aggtaaattcttaataaatgttcaagaagaaaattatattaggcaaattaaaatcaattctataaaaaattgtgaatgtccatggatagctaaatggttgagaaacatggctgggcgtgactggatttccagttatggaaacccgtaatccgtaattattggcatcagtttctcaattaccgaattccgtaatccataatgacgggggggggggggggtccaaaaacgccgtaatttccagtaatccgtaattacgccaagcagccctgttgggaatg

SEQ ID NO: 105764 - DNA, 342 bp, Heterodera glycines
  misc_feature (18)..(19): n is a, c, g, or t
  Promoter: Source sequence=SeqID_24026; Location=1581..1922; Strand=-; Gene=SeqID_54729
ctgtgggcaaatagccanntttgtgggcaaacctcttcgatgtttttcaacaaatttcgggtggtcattactccgtgcgtttgtggcaccataaaattgaattttatttaaacattatttattttttattcaactaaaattaattttatttcatttttatattcatatttttaatacttgaattttcttaattttttaaatttaatatcgcttttttaaatatttttcactaaatgaattattttgaaatttttttttccatttttttttgtttgttttcaaattatttttaaaaataatattttccatttttaaaactcattttaaaaaaatgttcagatg

SEQ ID NO: 105765 - DNA, 102 bp, Heterodera glycines
  Promoter: Source sequence=SeqID_2628; Location=4106..4207; Strand=+; Gene=SeqID_80792
ttttttccttttagccttaattaaacaattttttgaataaaaaaatgacttaattgattgaaattgacctttttatatgcagatttcacatgcaaccgaatg

SEQ ID NO: 105766 - DNA, 147 bp, Heterodera glycines
  Promoter: Source sequence=SeqID_217; Location=8152..8298; Strand=-; Gene=SeqID_77995
atatttatcaaacacactgttactggtagaaccaatcaaacgcacgcactaataaccaggagctcgcctgatcagctggagtacaaaggaatttaccgcgttcgtgtgattccgccacgagggctacgcatccctgtgctgcccatg

SEQ ID NO: 105767 - DNA, 66 bp, Heterodera glycines
  Promoter: Source sequence=SeqID_13001; Location=1..66; Strand=+; Gene= SeqID_76772
gaagaaagaagcagaaacagaagagacttttgaaaaaggaaatacccatctttggccttcgagatg

SEQ ID NO: 105768 - DNA, 79 bp, Heterodera glycines
  Promoter: Source sequence=SeqID_22832; Location=1333..1411; Strand=-; Gene=SeqID_53540
ccaacaattctattcgacttggacattaattcaatcgaatcttgtaacttcgaattttatctgctgacagataaaaatg

SEQ ID NO: 105769 - DNA, 616 bp, Heterodera glycines
  Promoter: Source sequence=SeqID_17090; Location=879..1494; Strand=-; Gene=SeqID_81522
ttttccgacttacagttcgggtggttcccttgtaagaatgtttaatttggatgcttcttgaaaaagttatggttcactaaacttgcaaaaaaattttatggtcgtgtcttttttttatggtcgtgagaagtgcaatagagtcaaaaaatgtttagccctgtcctgaaaatttaaaatcgagtctaaaagtcgaaatttccgttctctgctctatagccggtatgcggtaacatgtgatttcgtcagaagtgatttcgtcagtacggggtttcgtagtgataataatttttttacaaaaatttcaataattcataaattaaattcgttcataatatattaaataatatgtaaattcaaaaataaagattatttacttgattattaaagacaaagcgaaacaagcagaagctgtaacatgagggtgcactttacgttcttcaccaactcagtgaagatggacttcggaagtattggcgatgcgagttttttgggcctaacgacaaatgcaaaggtgtatgcaaaaataaaataaagactatttttcaaatttagggcgccttcacactgatattaatggtaatgtcctcaaataattagaagccacacatgcgacatg

SEQ ID NO: 105770 - DNA, 1003 bp, Heterodera glycines
  Promoter: Source sequence=SeqID_19983; Location=485..1487; Strand=+; Gene=SeqID_84749
aactcattaggaaagggaaggaatgcgagggaaatggcacggcgcaatgccattgcatccacccaaagtcccaacatccatttcttaccatttcattttgtaagttgttggccaatgcaacagaagaagagaagttggagatgttgcggtgtcgtgtgctcagccgaatctgtgccttaatcacccgctacagtaacgtcgaagttgcggcgcccccgggcacaccgaaggcgcggagtttgagtgtgtcgagagcggacttggaaaacgtcgggagtgaggcggaaaggaacacggaagagggagatgatcagcagcagaagagtgggagtgatcggagggcacgaaagacggaggacggatcaatgaaaagggcggacagcgcgggttcgacgcggaaaaaggagggcatcggctacggcacgggttcgacaaggtcgcgatggaagtaagtagcaatggcatcaattgcattgtgccatccgatgaaacgcggacaaattcagaccaataaaatgggtggttggaagcttttagctaatttaattgcttacatttatccccctccccctaaaaagctaagtttcgaaacgaattcatccgttgtccgtttagcattgcgcgtacagttgaggagcgttctctgcacgagcagcatctgatcagtcttctgtccgcgctggtcgcctttctttggggtggtcaactgtccgatcggctgacagattgggaaatggcacaagcgcacaaagggggcgaccggcgccgctcaaacaccgcacttctgctggagaaaatgcctgcccatttgctggacgaggcggtcgctcgacagatcagcgcgtcggcagtgtttccactgatcaacgcccatttgagtgagttggccaaattaaggcatcgatcactgatcggttgccatcaatgggaataattttgtgatctttaaaatgccgtcgctctcttaggcaatgattcggtgttggacgtctcccaacacatg

SEQ ID NO: 105771 - DNA, 385 bp, Heterodera glycines
  Promoter: Source sequence=SeqID_8192; Location=3601..3985; Strand=-; Gene=SeqID_67265
ggcgacgacgatccattcgatgacattttagctcaaattcccgcttttatgcctcctaaatattttttgcggtgctttaaaggacgatgacgatacattcgatgacattttagctaaaattgcggcttttatgcctcctaaataatttttttgcacaaaactggcgctttaaaattttggggtgtggccgcataatggaaaagtatcctgttctcattatctccaaaatctccggaaatttatatatttttttatttgtccacaagtataatagttatgcaatttgttatcagattcggttttccgggatttatttttaatggccggggcattgattaaataatagcaattttcccataatttcagaattgggccggtgcccatg

SEQ ID NO: 105772 - DNA, 1003 bp, Heterodera glycines
  Promoter: Source sequence=SeqID_3204; Location=449..1451; Strand=+; Gene=SeqID_83690
aatatgttggaaacgatgtgatagtgttcattccgttggaattgcaaatgtcaaaaccgatttaatagatttttggatttcttaaaatattataattcaaaaaggtttacgacattcaatttccgaagttttaatttaacttcattcctttagattttctgtttagtcgtgttcagtttctgtttcctcccagaaagtttccttaaatcattttttattccaattaataatataatttaatattgtattctcaagcacatgcttctttttcttgactgtttaaagcctgcgcattgcattcacctgaatttatcttttacattgtatcatctaaatagctcatttaaatcccagtttttcctcaatatggagagccactaaaaatgatttctgatcaaatactctcatatcttcattcattatctgattagaaaatataccgtcttgaattagaattcaccttgtggcaattttaaaagaaattgcagcttcttatatttcttactcaatgaaattatgcgatttaatatataacctttaacttgcagcgaatgtggtcaaagttcagcttttaatttcactgatgcgtctttatatattaattttcttaaaaacactgcataccttttaccattcttagaccaaaattagcgcgtggccagtaatttcagcgcatttcaatggccaaaatgagaaacgacgcaaaaaacaacaacgcctttggcttcagccagagctcatttatgagctgctcctttttatgctgcctgacaaagtttggagtgttagacgcttgctgagaataagcgcgatattttatcggttaatcgccggctctaaaaatgttgaaaattggcgaaagccatataaggtcctaggccagtgtttaatggtaatcagtattataatattgtggtgttttttaatttttaagcaagatgatcaattattttacaaaaatccagtgaaaaataattttaactaatttaaatttaagagcatg

SEQ ID NO: 105773 - DNA, 900 bp, Heterodera glycines
  Promoter: Source sequence=SeqID_5526; Location=1..900; Strand=+; Gene= SeqID_58343
aggccaaactgacagagtggtttcagaaacgaagcatttcaacaggaaaaccaaaactttccttctaatcgaaattttgattttcaaaacagaaattatattcccacaagtcaaaacactcaaaatttcgaagccacgggtgcaaacagaacccctctgtttcagtcaaacaaaagagctcaaaacaaggaatcgaatatgatcatggtgaaagaagtaatacctgaaaattcggattcgaaaaccgtttcccttaatcacgtgggacacggagaaattccaacatatgaaaaattttttaattctttgattttacattcaaacgaatttccatctcaaaatcccgccaacgctgaatgttccgaaagtccaacgacggaagtgaatattgtcggaatgaaggcgatcggtctaatcgattcggcagcagaaataaatgcagcaaaccccaaatttttacacaaaatcgccaacgaaaaaggcgtggatttgctaaaatggggtttttgcccaaacaaaggaaattcaaaattgtcttttgaagttgcttcttttaatggtggaaaaatcccaataattggagtgcttaatgttccaatgagaaggggaaatttcgaatgtgaaataaattgtgttgtcacgaataattcctttccttacgatttcgtttttagcctgaaagcattaaactcactaggctattacatcggaaacacacttacaaatgaaatcttaaatttcaacgaaactccgaaaaattacaacaccactttactgaattctgttcgcatttcattctgtaaaattattccacctttttcatcatcttttgtcgattcatttattgaaaatgtgtcgcatttgcccgaaaaacccgaattcattatagaaaaccaaatg

SEQ ID NO: 105774 - DNA, 213 bp, Heterodera glycines
  Promoter: Source sequence=SeqID_10481; Location=1740..1952; Strand=-; Gene=SeqID_73692
ttcgaaataagttttttgttctgaaattattttttttttttaaattaaaattttaataattttcgaaatttcaatccatattacttatctatattaaataatgaatttgttataaatataaatttattactttttacatttgcatacttgcccaaaattataataataatattaaaatttagccgtctattcctatttcagcagaagaaaatg

SEQ ID NO: 105775 - DNA, 268 bp, Heterodera glycines
  Promoter: Source sequence=SeqID_7058; Location=5145..5412; Strand=-; Gene=SeqID_63701
tgtagtcagtttgtgatgaagcattgcgcacaaaatcattagcattgattttcacgtctcatcgacggagaaataaattgcgaaagaaaagaatggatgagaagaaaagaaaagaaaagaaaagaaatgttgcacattcaaaaatattaattaatgataattatagtgaaaatattaatttttaaaataataatactaattaaatgtttaatgagtaattacgaccggaaaattgcaactgcttttgtaacttttcatgtgaaaaatg

SEQ ID NO: 105776 - DNA, 416 bp, Heterodera glycines
  Promoter: Source sequence=SeqID_8207; Location=296..711; Strand=-; Gene=SeqID_67309
ccttaagtggtaaaacaacaaaccaattaattaattaatcaaacaattaattaactaattagccatgtcgtggcactgctattaactcacatagtaaaagctttgccgtcccaccaccaagtcaatgacgaccatttcccagaacagcggggggtctaaatagtcgtacagaaagccatccgaagtgatgtgactttgagccttaagcaaaaggaggggagagagtgccaaaggaaaaataaataaaaaagcaatggcccaattaaaatggcttggccaatgtccaaatttaaaagagacaaaatgccaaattgcgttggacggaccaggtcaagttgccattcttggttgtcgtagaagtctatcaaggacagattcttggaaaacagtgagtatttgatagagtcatttgaatg

SEQ ID NO: 105777 - DNA, 120 bp, Heterodera glycines
  Promoter: Source sequence=SeqID_2171; Location=2526..2645; Strand=-; Gene=SeqID_78262
tgttggccttattttcaggatccggcaaaaagaagtacatgctggagctcaagaaaattggtcctcatttgttggcagccgctttgcgcgcgcctcatttgtttgaatagctgaaggatg

SEQ ID NO: 105778 - DNA, 140 bp, Heterodera glycines
  Promoter: Source sequence=SeqID_30068; Location=905..1044; Strand=+; Gene=SeqID_60515
aaagcattgatcgaaacatttgatcaaatgaagaagaaatttagaaaaaaatatcattttgttgacagaaaaataatgtgaattttggaaataaaattgcaaaaagattgggcacttgcagaaccaaattatacaaaatg

SEQ ID NO: 105779 - DNA, 171 bp, Heterodera glycines
  Promoter: Source sequence=SeqID_14441; Location=427..597; Strand=+; Gene=SeqID_78477
cgtaaggcgttagtaggcgaaatgaatgtttttggggttggtaggcgaaatgtcagtaggcgatatgtccgtacacccttaattgaacatgaaaaatcttttttttttaaatttacaaaaatttaaaccagcggaagagttgggaatttgtaaaaaaacattgaaaaaatg

SEQ ID NO: 105780 - DNA, 914 bp, Heterodera glycines
  Promoter: Source sequence=SeqID_3869; Location=629..1542; Strand=-; Gene=SeqID_52230
atcgcagacggcaatggtgctggttgttcaagtcaccaagaataaacaccaaaatatgaagctgtaattttcataaattttatttttctataaatttaatttttctttttcgtctcaaaaaagtaaaaatttttgaatttttcaaactttttttaaattttcaaaatatgtacgtacttttatgcatgtttgtataattaagttatatgataagtgtgtgataataacacatttgtttttgctgtagtgatattttgactttgaccattcgatattattttaatttattatttttggcattttgtttagttatttttgttgagctttttcatttgcgttttttttagtcgttaattgtagtaatttgttttaataatgattcgtggtaattgcggatatttgtgtgctgtggaataatcttgtttgtgttttaattgtgcagtcaattgcatttattgcgaattgactgagtcggcataattggaaagaagccgaacgaattggtcaaagtccctaataataatattgtccccaatctctcctgtcctaattaaagactgttcccgtgcccctgccctaattaatctaaggcaaataagcagcgaacggcgagaagttttactatttggcgctcctggacagaacacaaggtaacaacgacatcggttcaaatttttggaggatttcggcattttatcgatctctgggggagacgataaacttttcgacttttgatattgttctctgggggagacaatcaacatcaacaatcgttctctgggggagacgaaacaaaaacgcttaaaaagaacaaacaaaaaccaattgtttgttaagttctctgggggagacaaattcggaaatttttcgacactcaagtcacctggggggtgcaaatagtcgattttgaaatg

SEQ ID NO: 105781 - DNA, 53 bp, Heterodera glycines
  Promoter: Source sequence=SeqID_5589; Location=1834..1886; Strand=-; Gene=SeqID_58568
tttttgaatctctgcaggtccttggcaagtcgtgcaaacccatccccatcatg

SEQ ID NO: 105782 - DNA, 406 bp, Heterodera glycines
  Promoter: Source sequence=SeqID_39524; Location=622..1027; Strand=-; Gene=SeqID_68079
cgttttgcgctcgagctatttatcatcgggcttgtcaatccaaagcgaaacaacaaagatgctgttttgaacgaataaagggcataggttattttgaagaagtgtcaaagaacatgcagcaataagcctgcaaaatctaataagtggaaaatacatgagtatagaatttattttcagaaagtgtccacagacttttggaaaaatatatttgcaatttatcaacaattttgagaagtgagatagaaatgataaacttcacgattcaaaccaattttcggtgctctaattaaccgcgataaaaacatccgaatcaattaaatagcttctgagataataaggtttatcatataatttcatttaaaaataaaccctcaattattggtatgaacgatactttccaaacatg

SEQ ID NO: 105783 - DNA, 53 bp, Heterodera glycines
  Promoter: Source sequence=SeqID_33898; Location=800..852; Strand=-; Gene=SeqID_63821
aggaaaaaaatgggagaagaaaagcacaaccaaagcaatggccaacggcgatg

SEQ ID NO: 105784 - DNA, 146 bp, Heterodera glycines
  Promoter: Source sequence=SeqID_28748; Location=1..146; Strand=+; Gene=SeqID_46129
tatatcatttcgccaaataaaaaaagcatatagaaccaaagcaaaagctacctacctaattcccatttaatttcgcagccaattttctataattttcaaaaaaatacaaaatttaaattttaaaagctaaatatttataaaaaatg

SEQ ID NO: 105785 - DNA, 552 bp, Heterodera glycines
  Promoter: Source sequence=SeqID_3031; Location=2102..2653; Strand=-; Gene=SeqID_82855
gtgttacattattacaatattatgcaaatcaaccattttacaattttggaatatttttttaggattttgctgaatcgtcggaatggaatgcacacactttgcctgctcggttcgttgtttatttgttaccaaaaattcgtcaataattaattgtaaatattttttgtcagatatcaaagtgaaggaacaaacggcagaaaatttgatcaagtactccaacataatattttatgttttttgacaatggggaaaaatgcaatttttaaatttaaatccggtcaatgagtcccatcaacggatttgttttgggttcggtgttttggacggaaacccgcaaaagccacacaatgccgtgactcgcatgcatttttgtccaagaaattcacatttttatgaaagattcaagcgtttttttaatatttgatacaaattcccatgccaaaatgtcgcgaaaaattgtttgttcgatccgtcaccaaaatttttgaaaaaaggaaaatatttaggggcaaccgcatctttgaaccccctcattttttgacgtgtccaatg

SEQ ID NO: 105786 - DNA, 294 bp, Heterodera glycines; identical to SEQ ID NO: 99762
  Promoter: Source sequence=SeqID_31789; Location=473..766; Strand=-; Gene=SeqID_62083

SEQ ID NO: 105787 - DNA, 241 bp, Heterodera glycines
  Promoter: Source sequence=SeqID_10093; Location=1..241; Strand=+; Gene=SeqID_73159
cattggcattccagtgttgtgcatgcgctggtgtttctgcaaattggtccagggcatccgaacacgctctggattgttcatgaatcatgttgcacattttgtgggtgtgtttgtgcccccgatggtgggtttgtcatttgctgttggtaatatgccctccacggctgttgatttacattattccatggattcggccatttcccggattgcatattagtttggtgttggtgagtccaccatg

SEQ ID NO: 105788 - DNA, 137 bp, Heterodera glycines
  Promoter: Source sequence=SeqID_18140; Location=919..1055; Strand=-; Gene=SeqID_82729
gaagcagtgagaaaaattcataaggaaatagtgcactgtctgactgtctggttacgcttttttaaaatttgaccaaaatataggacccaaactgaattagtaccttcaaaaatattttgaacttacattccagaatg

SEQ ID NO: 105789 - DNA, 382 bp, Heterodera glycines
  Promoter: Source sequence=SeqID_6452; Location=2852..3233; Strand=+; Gene=SeqID_61634
tatttggctttatctcgtttcattaatctgattaagggtgccaaccccgaccccgccccgaccccgaaccccgacattttaggccatttttcggggttaaccccgaccccgaccccgacgcttccaaccccgacgaaccccgaccccgacccttaaccccgactcggggtcggggttaaatatacacccctaagaatggcattttcgtgggggaaaaggcaaaaaagttataagaaatttgaatgttgtctttgaaatgacaaaaaattttgaaattagaacattttgccaatattaataaaattatctaaaaataaatagaaaatttttctcctttctgcatttttcaggttaatatattgtacctaatttagataacatg

SEQ ID NO: 105790 - DNA, 1003 bp, Heterodera glycines
  misc_feature (71)..(71): n is a, c, g, or t
  misc_feature (140)..(140): n is a, c, g, or t
  Promoter: Source sequence=SeqID_18684; Location=697..1699; Strand=-; Gene=SeqID_83350
aaggttttctatgtaaaaatgcacataattagtgaatgtgaaagtgcttattgttagaaactaatcagcgnaagaagttgaattaaatttataaatataattaatattattgtttgcgctaattgatctgcagcagcagntgatcagtgagcaaaatggggaggattaattgtccatcggcggagtgtacaaatatgaaaatggcgaccaaaattatattgtacgctaatgatatggatgaaatgccattttgacattgtaaattccctcccaaaatgccgtttgtacaattgcaaaatgaccggttcatttttcctcctccgctacgagtcctgctgaaacacattaataaatgacaaagcattcactaatgttcaaatatacacaataaaaatcttttgaaaaaccgaggcataacatggaaaattcaaacaaaaattattagaagtaaaagggagagagagaggagagagagagagagagaaaatgggtaagagtgcgagaaggaggtgagagtgagcgaaaagagagagagagaaaggggtgagagtgagcgaaaagagagagagagaagagagagaggagagagagagagagagagaacacagagagtgccgttacaagtgctgaacaaggaaaagaatagagaagcaaaggcaaggagtgtgcacagggaaaagcgagacagtgtcggcagacacagcacaatacccctccggggacgacgaaaagcgttgagaacgcaatgaatagagaaaataatgagtgagatggagagaagagagagagagaaagggagagggagaggagagagcgacagagcaaaaggaaaaaggcagacaacacgacaaaggagaggagaaaacggccatttgctgttgttacactgccgggggacgagccaaaccaagtttcaaagtgccggtgcgcagcggcgttttcgttcaatgctaatcagctaattgctcactaattaccccaaataacaaactgtcccctgatg

SEQ ID NO: 105791 - DNA, 163 bp, Heterodera glycines
  Promoter: Source sequence=SeqID_696; Location=671..833; Strand=+; Gene=SeqID_46121
atgcaacggtcaaattgaggacgatgggtcgcacacgaccattgccgtgcccaacgcacaactgatcaaagcgccccttatcactggcgaaagtgcgcttttggctcccgtcctttaccgcggcattgcgctggtcgcggatgaactgggccctttgcaaatg

SEQ ID NO: 105792 - DNA, 347 bp, Heterodera glycines
  Promoter: Source sequence=SeqID_29167; Location=1..347; Strand=+; Gene=SeqID_59709
taaatgtcaaaaaaatggtaggacaattaaaaagtgacaaatgaaggaaaatggacagaagaaaagaatgaatttgatgaatccgaaccaaaaaatggacaaaaaaaaagttcaaatttctgtatgactgagaaaaaatggcatttttctccgtatttaagcggtgaattccccatcaaaatcatccattcattcaattgctgcactcacttccattcttttcccccatcggtcgaatcttcatcctgctgctgctgtacaataaagataattcccgtcagtttttttttgttttgtttatttcggttttcaaaatgtattaaattttgtgcccttttttcaggatg

SEQ ID NO: 105793 - DNA, 180 bp, Heterodera glycines
  Promoter: Source sequence=SeqID_34865; Location=1..180; Strand=+; Gene=SeqID_64566
tcttcggaacaatccttggttacggtgaatcaatgggagttccaaggccgaggaggcccacatgcccacattgtggcgcaaacagacctggacgcagttccatatgtcattcaggaatacatatgggcgcacattccatctttgcctgataaagatgacgacacgcccattgcaaaaatg

SEQ ID NO: 105794 - DNA, 394 bp, Heterodera glycines
  misc_feature (12)..(12): n is a, c, g, or t
  Promoter: Source sequence=SeqID_10778; Location=768..1161; Strand=-; Gene=SeqID_74034
aatgtgcttttntaaaaattaagattctaaaaactaagcctgagggatccctcgccacttggcataagctaggtttaattaacattcgctcattttttacaattttacttattccaaatcctaatagttaaccaatttgatgtacattctgatttggacatttttcagaaatggctaacccaattgcaaccaaaaaacaaaaagtaaaattgtcttacgaaggccacctttaccgggaggggtcggtttagtctgaccgttttagtcagagggtcggtttagtctggttagctgttttcacccacaaattaattactttttataaatttcttttgtttgtcaatcatatacataaacataactttaaaatgtctgtttagctacaaatcaaatg

SEQ ID NO: 105795 - DNA, 542 bp, Heterodera glycines
  misc_feature (132)..(132): n is a, c, g, or t
  Promoter: Source sequence=SeqID_45394; Location=1..542; Strand=+; Gene=SeqID_72692
tttttggcaaattttccccaagaaaaaagcaaaaaaaaggggaaaaaaacccccccttaaggttcgatctttttggaaattaaaaaaatacaccactaaaaaagagatttttcaaaatttcggaaaatattntagttattttgtccagttccgaaaattttcgcttaaacagaatgaggttattacaaaaattttgggttgtatttgatttgcaattgtgaagctagatttaataaaaaattggcattttttaaatgttaaatccattttttggcagtttatagcgtatttttaagtctgttttagcaaatattgaatataaatacatttttcggaattttttaaggtttaaaagatatattttggcagtttttagtccatattttggtacatatttggccattttttagatttttagtccatatttcgggcttttttagtccatattttatgtccatatttgacgttttttagtccatataatttataactctagtaataagtagggatgatatttttatgtgctaaaaactgccaacatg

SEQ ID NO: 105796 - DNA, 919 bp, Heterodera glycines
  Promoter: Source sequence=SeqID_13175; Location=921..1839; Strand=-; Gene=SeqID_76998
atctatctcacactcctaaatcacaacgaaggcgaatctatacccctaatttttttgaattcagtactgaggcatgggcatgtaggatagtaagaaaatctgtgtcaaaatttacctcactaacgggaatcccaatcgaaaaatttcacgaatctgaacttcttacggttggattagatgaatgcaaactcatgattaaccataagaaatgctatttgggttcactcattcacctcgatggactttatcataccaataatcagattgaccttacccctcgctcttggcttttcggttcattctcatgggaacgaatctttagcgataattgttatcttttcaaaacgctagtaacttctcgctttggcgacaaatccattcattctcctattggtgaactttttaactgtccttacgaaagaggcaattgcttaatgagtgataaaactcaattaatttgggaacctgaatcgggaaaaaattgtgaatatcgtttttatgggtcattcaatgggcgtgttcttaacaatacttggctagcagacgaaactcaattagctttaactgacgcaccagggaaatcgacagtgcgtagctgtaatagtactctgaaattaacagaacaaaacttagcctattttattgtaaagaatggtcgtcagaccaaaagaaaaagagcattgtatgggcccacgcattgtagccgaaaattgtccgatcattttaatccatcaaaaatcatcggctcaaatggaaagtatctcattttcctctcacaatcccgagcaacgggaaacagctcttggatttttgggaataatccagggaacctttccaggcttaattcaagttgtgtgtttttaccaagcagagaggaaacacatggtaagtgaaatcgaacggagaaggtggccaaatg

SEQ ID NO: 105797 - DNA, 452 bp, Heterodera glycines
  Promoter: Source sequence=SeqID_8912; Location=588..1039; Strand=+; Gene=SeqID_69625
tgtgccgcccccccttagccccccgctaattgtcccttattccagccttaattactccctaatccttctcccctccttattccctttgcccattttcaccaattgaaattgcgagcgttgaaaagagtcgcgcgttgcgcgacggcactttcggctgctgttcgttctgacactgcgtcaactcgaggcagacaatgcgcgagtgaatgtgcgcattgagcagtgccaatgcggcggaagcggagagaagcgcaaattgaaaagtgaagaaaagcgcggcggaggaaggccaaagggaagggagcggaagagaaggcgcggaagagggggacaaaagcgaacggagcaaaaagggaacatggaaagcgtggagaagcaattgggcgaagagcaaagcgatcaatgccggatcagaacgcctgggcgagatgtaaaacgacgacggcaaaatg

SEQ ID NO: 105798 - DNA, 106 bp, Heterodera glycines
  Promoter: Source sequence=SeqID_19258; Location=1305..1410; Strand=-; Gene=SeqID_84000
aacggccatcattatcattcccaaagttttgggcaataaatgtgaattcttgtcgaaaattggatttttgagtttttgttcgaattcgggttcgggattcgaaatg

SEQ ID NO: 105799 - DNA, 624 bp, Heterodera glycines
  Promoter: Source sequence=SeqID_11993; Location=827..1450; Strand=-; Gene=SeqID_75515
tccggtgctaccagtgaaacgtggggggcccttcccaggatcgctgtagtccaaatattatccagaaatcctttattgttccatctcaaacttgggtaattaaacctttgcttgtgaaatgtgaaatgaatggaaaatacaaatgacggatcgaaatggggaaggatggaactgatcgaaatgggaaaggatggagaaatgatgaaatgaaatgataaaatgctcgggaaatctcggaaaaggatttagcggagaagagaccagagaccaaacggggaagtgatcggaaatccactttacaatttcaaaaaaaaattatttgttaagtttttctttgaaaatttttcaaaaaaaccagtaatttataataaaatgttcaaacattttttctccttttaattctcttatgaaaaattttctaagaattttttttcttgaaaaatttctaagtttaaatttttcttttttttgaaatttctgcggcgagattttgtccccgaaggcataatgccaaagaaattctcaagctttgtgccataaaatttttcgcttatacctaatttattacaatcttaattttaggtggttccattagccgttgcacaagcgggttccggaaacatg

SEQ ID NO: 105800 - DNA, 376 bp, Heterodera glycines
  Promoter: Source sequence=SeqID_34041; Location=470..845; Strand=-; Gene=SeqID_63938
aaatgttttgtgccccatttcgatcagtcctcccccctcatttgattcgatcgaaagtccgtgtcggcctttgtggtccatcaatcacttctcgcccaatttggcgagtcttctcgacgagttcttccccgcctctttccgtaattgtgttcaaaaaattcactcatccttttttttattattattttctgaatgaaatactaattaacttcctcccaatttctttggttttttccctctttttaaaccctttggtcaatttttttaacacccccgcggggcatggcattgccattgattttcaccgtttccccgggcaatatttgccgattcgttaaattttaaagaatttaccgaaacatttttagcctaaatg

SEQ ID NO: 105801 - DNA, 61 bp, Heterodera glycines
  Promoter: Source sequence=SeqID_21238; Location=1..61; Strand=+; Gene= SeqID_51831
tctcctcagctggttcctggttgctgctgatccgcgctcatttcatcgtccggtgaaaatg

SEQ ID NO: 105802 - DNA, 298 bp, Heterodera glycines
  Promoter: Source sequence=SeqID_44570; Location=1..298; Strand=+; Gene=SeqID_72043
tttagtgcgctaggttcgatgaaactttttaaaatataagcctaaactttttcgcctgttaaaaaaggaattaaaaatttttaaaaattttattcatctcccttttgatagaaaaagcatcagagagccttatttaacttttaattaacatttggtgcgtttcagagcacgttctaaaaaatatttatgaattaattttgcaaaataataaataattaatgaaaaagtcagaatttcgaaaaattttaaaaacaacaagcgttggcattttttcaggttaagttagtcctttacaatg

SEQ ID NO: 105803 - DNA, 641 bp, Heterodera glycines
  Promoter: Source sequence=SeqID_6956; Location=891..1531; Strand=-; Gene=SeqID_63397
atcctccccccccccccccctccattcatattttgtctatttatttcaattgtgaactatggcacttttatggtatctctttttttcatgatgtgaactctgaatttagatgtatatgaagtaatttgtgcctgatcaaaaataacaatacaaaaaggcagcgaccagtaatatttattgaaaattatgtaaattggcgttatgagtcattttgtctaacacagggcttgacacatagtacggttgaagaaaggtgttcatttttagaaatgttgtaaaaacaaattcttgataaatattgaaattatttgatgcatcttgttatttagtagggcactcatttcttgaattttactatctaaaaatcatttggtgagatgagtcattcattttgttttgtaatatgtgtttatttttaggtaaaggcttgctgataatttccaattttaacgcttaactaatcattttgactttcgttccaatggaatttctttttggtaagttagcaatcttctttttttgtaaattaataaaatacattaggaaagcgcaaaactccgacggaaatgttacggcaaaaccaacgtgcactgaataaagcaattcgggaattggacagggaacgccaacggttggaaatg

SEQ ID NO: 105804 - DNA, 433 bp, Heterodera glycines
  Promoter: Source sequence=SeqID_4219; Location=1155..1587; Strand=-; Gene=SeqID_53645
gtttaggcctttttccagaaaagagttaaaatccaagttttctaattttcctttgtttaaacttaattaggaattgatttgaacattgtcagaattggaaatgttcgggagctataaactggaaaagggtcataattttttaagcgaatgattttgataagctttaatttccgtttttccatcaattagcaatttatccgtgccaccacttccgccaactacgaaattcatttttttgttgatgagtcatatgagtcaacgccattggtgccatttgaatttgtgaacgaacggacaaacgaaaagcttacactgctaacagaaaaaatagatgtacagtgtatcatagggctaatgaagcgatatccaattggggataatacggtggcggatcagtgggaaaaagaaggaaattggaacaatttaaactatg

SEQ ID NO: 105805 - DNA, 143 bp, Heterodera glycines
  Promoter: Source sequence=SeqID_10643; Location=1607..1749; Strand=-; Gene=SeqID_73883
ggttatcctgtcaaactttgttgttatttttttcttttgtaattttcctaccgtatttttttgtaccgttttactattttccctcttctctctttttacagtttctttggtcgccaaatgtttgtttggtgaacacaaaaatg

SEQ ID NO: 105806 - DNA, 534 bp, Heterodera glycines
  Promoter: Source sequence=SeqID_477; Location=1141..1674; Strand=-; Gene=SeqID_45760
taattgaagaattaaaatgtgaacggacgcaatgaatgagagaaaattttgcaatgctcgcctttatatagacaagcaaaaaaattccgaaattaaggggaaaaaagttgtataaaagggcgacatttcctcacttttcctcacaattcactccatcgccctcatattatattattattattattattatcgtccatcgtctacaacacttcatcacacacgaagcggacgtgcccggcccaacaacttcaatggaggattactgtttcgacgcaacggcagcagcagcggctgagcagtctcggcgtcaatcgggagcggcatcggaccttgtgcaaggagacggcctgtcaaccggcttcctggacgcgatcatcacgaaggtcaaccgctcgcctcctcagcgcttcacggatgaggtagaaaaattttttgagtttttcaaaaattaattttccccccctttttccccaacagatcagtgacgatgaaatccgccagctctgcaaagcggccacggacgtcttccgaatg

SEQ ID NO: 105807 - DNA, 505 bp, Heterodera glycines
  Promoter: Source sequence=SeqID_14498; Location=1607..2111; Strand=+; Gene=SeqID_78543
gtttttattgttgagaaaaatttaccgctttttattctggtttttattactctaatgcttaaattaaaaaaggaccattaaagctttaggtagcagtaaattgtcattccatctgttttaagcgatgtttttaagaatttcagactatagccaattgtaaatttaaaagtaaaaaatgaaaattataatgagaaaggacatttaaaaaggatttatgggaagagagaggattcaatatgatgaatggcaagaggcagggctggttcccaggttttgaaaaaatattcttctattttcaaaattttagaagtcaagatttcgtgtttatttgctggggtttttccaaattttttgaactgtgggaggtccggcggagccgctaaaacactgctgaaattatgaatttagggtattttggaattttgaaaaataggcattttcaacttttaagcctaattatgaaaatgtaaaaagttccggaattttgtgctaaatggtcgaaatg

SEQ ID NO: 105808 - DNA, 602 bp, Heterodera glycines
  Promoter: Source sequence=SeqID_3227; Location=2043..2644; Strand=+; Gene=SeqID_83781
tccgtttttactgaaaacaaaattttataaaaatttaaagttagaaaaatatttttccaaatttcaaaatggactaaaacacagtaaaggggtgggtaaactgtaacccaacttaaaaacattcgtaagctgcaatttttcttaaatatttaaaatttcatcgattcaacctcgaatttttgaatttctacctcaaaaaacgaatcggggtaaaaaaacgatcggggtaataaaaacgaattggggtaataaaaacgaattgggtcaaaaacgaatcggggtaaaaatgaattggccaaaaaacgattcttccctttaccagggcaaatatatatgacaaattcaaatttatttttaatgttttcttcagcaatatctatcgaaaattgtaaattttaataattcaaaatgatttcagaaattgctattgaactattcattaatcccaaaaaatgctcttgtaaattttgattaagtataattttagtgcttatatgtggaaaattttgtttaaaaaataaaaatcaataaagttaaattttatgggagattttatgaggaggcgcacgcggccaaattgtatatgcgtaggaagaggaatg

SEQ ID NO: 105809 - DNA, 369 bp, Heterodera glycines
  misc_feature (71)..(71): n is a, c, g, or t
  Promoter: Source sequence=SeqID_5265; Location=1..369; Strand=+; Gene= SeqID_57512
atatatatatatatatatatatatgtaaaatttatataatctttcatttattataataaaaaaatataaanatatttttttcaatcaattttaattcaataaatggcccatatgcttacgcaaaacgttaacacgtaatcttacttttatgtttctaccagtatttcattcatttattgctcaaatatataaaaataataaatttatttataataaatattgtaaaatgtataagcaataaaattattttcaataaaaatataaaattatttaagataatttaattcgtaaataataaaaaaaataaatatattaaatatttgttaaaaaagtccatttttaaattatttgtctcacaaaaacagaatg

SEQ ID NO: 105810 - DNA, 167 bp, Heterodera glycines
  Promoter: Source sequence=SeqID_21917; Location=140..306; Strand=+; Gene=SeqID_52551
ttttcactgctcctcccaatgcttatccaccacagagcatttgtctgtcactgaccaaatttatccaatgccataagcttcccgtcatttccatgcataaaacaaatgccaatttcgtattattttaggaacatttgcatttttatgctgctgtaattctgcaaatg

SEQ ID NO: 105811 - DNA, 197 bp, Heterodera glycines
  misc_feature (74)..(74): n is a, c, g, or t
  misc_feature (89)..(89): n is a, c, g, or t
  Promoter: Source sequence=SeqID_41598; Location=1..197; Strand=+; Gene=SeqID_69680
agatagatcagatcagcggtgtaatcgcagagaagccaaagcgaaaggttggacgaagtctgaacaatgagggnaagggggagggatgnggagaggaagtcggacaaaaaagggacacgaaaagcgatggaaatggacccaattaagcgatgaaaagcgacattgcctgataagggtaggaacagcggagcggaatg

SEQ ID NO: 105812 - DNA, 68 bp, Heterodera glycines
  Promoter: Source sequence=SeqID_12619; Location=1..68; Strand=+; Gene= SeqID_76288
ctgcttggaatcatctaaaaagaaagtttgaaaatgagaacacgcgctcaattgctcggcaagcgatg

SEQ ID NO: 105813 - DNA, 122 bp, Heterodera glycines
  Promoter: Source sequence=SeqID_17338; Location=197..318; Strand=+; Gene=SeqID_81818
ttgtggatatgtttgtcacaagtacggaaggaaaaaattgggcggctgcgttaccattaatttgcttcgcttacaattcttcaattaactaccaaatcggcaattctcctttttatgtaatg

SEQ ID NO: 105814 - DNA, 624 bp, Heterodera glycines
  Promoter: Source sequence=SeqID_13735; Location=601..1224; Strand=+; Gene=SeqID_77656
agtaaaggaaaatccgagcattaaatgaaggttgggcaaatggtagaccttgaaagggatcgaaccctcgtctccggtgcggcgatcggcttctcacccaaatcactgttcttaccgtctctttatgtctccgttttaaagcgatttaactgcccgctggctcaatccatacatttgtcaattaaaaatcattttgaattcgtattcgagatttgggagcaatcgaaattatgtaatattttgggttaataatcttaatacataaagaataatgtcttccaaaattagcatttaaatttttgttatttttaggtgtaccgtaaactttaaaagtacccaccttcaatcagctgatccatcccttcattcattaatcaaataataatttgaattaaacttggcattatgttttttcgggaaaattatttcgcttactcggaaacttttttcattttctgtccacacttaggtaactcttttcggaaggttctcctttcttgcatttcatattttcgagattttattcttgggcattattgttcagtcactcaaattaaataaatttaaaacaaatttttgtaaccgtttttagatttttattctcgccttttcattttcataatg

SEQ ID NO: 105815 - DNA, 233 bp, Heterodera glycines
  Promoter: Source sequence=SeqID_1625; Location=4788..5020; Strand=+; Gene=SeqID_46961
tgcgatgccgataagcgccggccttatccaagaaaaatcccagcctgggtccaggtcgaactctagttattataggtatatgaactgtctaatgttatctgcctcccacataaaaaaatacgaatcgggacagtaaaatcggccaatacgtattgggtttttggtaaaccgggtttttaccataaaaacacattaagaaaacccattcatcattcataagttgtaaatatatg

SEQ ID NO: 105816 - DNA, 536 bp, Heterodera glycines
  Promoter: Source sequence=SeqID_36870; Location=1..536; Strand=+; Gene=SeqID_66083
cccttgcccaacttgtttcgtttccatggcgcaattcgatgcgtcctccgcttgaaccctcccacacaatttcccattcaccgaaacgactgccgactttggtcattcactgatcggaaaaggcatccgatggcacttttggagcttataaattgtggacccaatgtgataaggaaaagtttaattggttttgcttgggagaatcaaagtgacgaagaaggaaagacggacaaatggccaaagggacggaaattaacaaaaaaaagtgaaacgaattggccaacggggaaatgcccgcggggataatcagcggaagaaatgccaatgccatggcaacgaaaaagggcattatttgaaaggagaaacagctgaaaaagacgagctcacaatcaaagaaagtttaattgttatgcatttattattagcaaatttaaagtttgaatggaacaaaatttggaaatcttttgggttggttaaggcatttaaaggggggaggggaattaaggagaaaatgaggggaaaaaggaaaagaaatg

SEQ ID NO: 105817 - DNA, 120 bp, Heterodera glycines
  Promoter: Source sequence=SeqID_43431; Location=975..1094; Strand=-; Gene=SeqID_71101
ggtggccaagaaatgttccaatcagcgaaagaagtgcgtcccattcagaattacgaattcgtacgcattgctccgacggcaatttccgccgttgaggcggtcggaccgcgcgcttttatg

SEQ ID NO: 105818 - DNA, 821 bp, Heterodera glycines
  Promoter: Source sequence=SeqID_38976; Location=1..821; Strand=+; Gene=SeqID_67654
ttaagatttttgactcaaaaaactgttatttgagccctaagttctaattttgtcgaattatttttcgatggcacgactttttcacagtttatgcaaaaaataaattaatttaaatcggctggaaaactattggttatagaaagtgatttcaatcacttattactcaaattcatagctaaattttggtacattaaaataaaatatgttttttaaatcattaaaaaatgaatgagcgtcaagcatattgaccatatttatttataatttatttattttaacttaaaaattttagtatgaatattaagtattttgaccaattttagtaatcaatttttaaaagaatttgttttttaatctttaacaattttgccataccgtactttagctggctgcccatttgcctgtgtctttttgctattaattaattaattaattaaaggtaaacatatccaagggatcttgtaattagctaattaattaaggaacagaacattgcgacccaatgtttacaattttttgtttattttcactcccaaacatttttctgagcatccgaatgcaataaacacaatatttcgttgcataaattgtgctgaaacttctctatgatattcacaaatgcatttagcatcaattagctaattcatttatttttgtttaaaattttatttatttatttttaattaaatttaatttattgcaaaaaaatagttgtaatattttaaaatatacggccttttcttggcgaattttagctatttgttgtttaaataacaattttaaaaagtttgccctattttttaattgccaaattcgacatg

SEQ ID NO: 105819 - DNA, 153 bp, Heterodera glycines
  misc_feature (18)..(18): n is a, c, g, or t
  Promoter: Source sequence=SeqID_45537; Location=1268..1420; Strand=-; Gene=SeqID_72815
tttaaatgagtgtgaaanattgtgagtcaaaaaatatttaaactcagaatgaactgaaaaagaaacgacctggccccgtacaggtctattgaaaaagtctataattgggcgaaacgcaaaatagttttttttcaaaatgcaaaagcaaaaatg

SEQ ID NO: 105820 - DNA, 62 bp, Heterodera glycines
  Promoter: Source sequence=SeqID_16396; Location=83..144; Strand=+; Gene=SeqID_80795
aattttttgcaaaattttaataaaataccaaaattttaaatgataggatatgaaaagggatg

SEQ ID NO: 105821 - DNA, 717 bp, Heterodera glycines
  Promoter: Source sequence=SeqID_12931; Location=1514..2230; Strand=-; Gene=SeqID_76678
ttgtcagagagaaagtcgaagagagagacgaaataatggggaatgaataatttttcatgtataacttttttggtaattttctaatcgcgaaacaataggctaagaaaatttctaaacataataagctttcaaatgataccaagatattggatttggttaacaacgaaaaatagaaaaacttgggcgctactgtaaaagttaccgattttgaaacaaaaggggggaggaccttttgttttgcaaaatttttttaatataaaaaaccatgctaatttgttatccggggttttaaaggtcgctaatcacgaatctgaaatgtattttgactaatttctaatccttaacccgaactcgaataaaaatcgaaatttttaatttttcaaattatgattttttgttcaaatttagattaggaaatcggaattgatcaaaataattgaaagattcgtgattggggacaccaaaaacccttcttatttacaccgctgaaaattatgtcaccattcgtcactattttggcattttcctcactaatttcgttaaatattttgagattttaactaaaagttgcggccatactatgtaatcatcattctttcatgacttaggtatacgcaaatatttatttttatataaatttttgaagcttacaaaatcgttgccaactgattgcaaaagtgccgaaattctgtcttaataatttacctcaacaaaatg

SEQ ID NO: 105822 - DNA, 630 bp, Heterodera glycines
  Promoter: Source sequence=SeqID_12266; Location=805..1434; Strand=-; Gene=SeqID_75854
ttcaaggcttcgttttcatccgctgcgataagggcaaaacccaaaagccctttcctcctttcctttgcttcttttcctgctttcttttcctttttcccttcaatgcttttcctttttttctttgtttgttctgtgccccccttttttattgtcctcctccgaaaggattaaatgtgctgacgcgggcgcgaaacccttcacggttttacgtttcctttgggtaaaagaattttttatcagtccatggcaaaatttatgggccatttgaacgaacggagggcaaaaattaatgagaaaaattaaaataaaataaaagaaacaaataaaataaatcaaaatttgtctaattaaaaagaaatatttcgaaaatattacttattaaatcaaaatatttccgtttaattttttcttctttttcctctttttttttgtttattgtaattcatctgacttttgctttctatgttaagcacttaaaaatgctaacgcccgggggaattttccgcttgaaaaatcgatggaataaatttgcccccgggagtttatcgccatttgcggcactttgaacatggaatggaacaaaataatttttataaaggaaattattttagtttaaataaatatttgatg

SEQ ID NO: 105823 - DNA, 716 bp, Heterodera glycines
  Promoter: Source sequence=SeqID_17948; Location=1293..2008; Strand=+; Gene=SeqID_82504
ttgtgctgtttgattgtgcgtgtgtgtgtgtgtgtgcttgttgttttgtgtctttttccgagatcagtctggccttggtcctggaccttctgtgactaaacacctgcctcggaggacaaggtgtttgccttttgccttatggctaaactaaagcctcggaggactgttagtttgccttttgccttatggctaaactaaagcctcggaggactgttagtttgccttttttccttatttgtcaatggcctagtgcgcgaaaacaccctttttgcacgaagtacttcctcgaagggcaagtacttcgtccactacacaacaccttccaaccctctgttcggacgaagtgcttcctcagagggtaaacacttagtccgctacgtccctcgtgaagttatgcctcggaggacaataactacacgaaactatgaacactagacaagcctcagagggtccttgtctaggctctctaatttgcttttcccttcccctgtgtcaccgggattcgttgagtcaatccgtggttcacagatccacccaggagcgccaatttgtcccgattgcgttcggggccaaaggtcgggcactggggtcggggtaggcagggacgagacacagaattaataaaaaatttattccgggaaatgacctcaaacttgggtaattaaaccaaaattttgaaatggtgaacgaattatcacaaattgatcacagaaatg

SEQ ID NO: 105824 - DNA, 150 bp, Heterodera glycines
  Promoter: Source sequence=SeqID_32036; Location=1..150; Strand=+; Gene=SeqID_62351
tggcatcgaggtgatttttctttacaaaatttttgatacggtaaccatacccccccccccccccacctcgctggtaaatttttatgaaattattttttttatatgcattttaaaaattatcattttttgtattaataaaataaaataatg

SEQ ID NO: 105825 - DNA, 1003 bp, Heterodera glycines
  Promoter: Source sequence=SeqID_4546; Location=2621..3623; Strand=+; Gene=SeqID_54843
gggtttgtcacacgctcctcccataggcacgggtttgtgcggggcggcaacatcaaagggatgcacccctcccataggcatgggtccacgggcggcaacatcaaaggactgcacccctcccataggcatgggttcgtgcggcaacatcaaagggctgcacccctcccataggcacgggctcgtgcggcaacatcaaagggctgcacccctcccataggcacgggattgtgcggtaaacacccatgcgaaagtgcgcttttggggttctatactactaacctttccctaaatttctacttgacaaatggttgattgatgactgttggatatattttagaccactactctcatcatatttgaatggcaagtacgtacttgaaaatcggcccttgtgcgggaaagtttaaaaatttgcttatttccaaaattatactttaaaattagcatttcaagattgtacttgaaaatagcattactacttgaaaatgggcaaaaaaaacatttgaatttttacattttttgagattttataccagtatcataaaatccaaaaatttagccattttttgggcagaatctgttaacaaattgtttcaaattttcagatttttccccgccgaactcccccccccccgctccaaaaaataggaaaaacccattttggtgaaaaatataaaaattatatttttcttatcttttcgcgtttgaattttataacgttttcgttatgttcttgaaaatcagtctaactgaaccaatgagagccctgacttagatggtttgaaggttgatctcgaggtcgttacttcggaccatcgagactctcgaggatgaataattaccctccccttttcgcccattaattaccgatttgcatattcatttatcgcattcatccgattcgttgttaatcctcttattgtgcttttattcagttatttgttttgcatttttatttctcataatgaattatcatttctctcacagaaaaaattcacaaatg

SEQ ID NO: 105826 - DNA, 195 bp, Heterodera glycines
  misc_feature (49)..(49): n is a, c, g, or t
  Promoter: Source sequence=SeqID_15125; Location=1186..1380; Strand=-; Gene=SeqID_79308
gccgaagcatcacaaaccaatgagcagcagcaggcggtaattgaattgnaaacttgggaatagctactcgagagaaaagttgatcaagtttcaaagttatcaaattggtaacaaacaaatgattttgccataaaaaagatttgtcgcccgtgcgcatgcgtttcggtgccaacaccgccgctggcggcaccaatg

SEQ ID NO: 105827 - DNA, 322 bp, Heterodera glycines
  Promoter: Source sequence=SeqID_45471; Location=388..709; Strand=+; Gene=SeqID_72763
tatttcctttttgcataaaatttgtatgccattatttttattaaagtgccagcaagttcgtcgggcactgtaaattctgtgggcaataaaacggtataatactaacttttattgattaaaaatgggtaaattcgacaaattgttcaaggattccaatttcattgtcgatgagtaaaaaaaaaatttattattgtatagcattgattactgtaatcccgtaattaacgttttcggaaatatttattatgcaaggctagtgataatatgctcataatgtaaattatccatggttttattgaatgaattcaacaactagtcaatg

SEQ ID NO: 105828 - DNA, 791 bp, Heterodera glycines
  Promoter: Source sequence=SeqID_26007; Location=926..1716; Strand=-; Gene=SeqID_56759
atcactgggactcaattctcctgcatttcaatcactgggactcaacccacctgtagtgatattttgactttgaccattcgatattattttaatttattatttttggcattttgtttagttatttttgttgagctttttcatttgcgttttttttagtcgttaattgtagtaatttgttttaataatgattcgtggtaattgcggatatttgtgtgctgtggaataattttgtttgtgttttaattgtgcagtcaattgcatttattgcgaattgactgagtcggcataattggaaagaagccgaacgaattggtcaaagtccctaataataatattgtccccaatctctcctgtcctaattaaagactgttcccgtgcccctgccctaattaatctaaggcaaataagcagcgaacagcaccgaacggcgagaagttttactatttggcgctcctggacagaacacaaggtaacaacgacatcggttcaaatttttgaaggatttcggcattttatcgatctctgggggagacgataaacttttcgacttttgatattgttctctgggggagacaatcaacatcaacaatcgttctctgggggagacgaaacaaaaacgcttaaaacgaacaaacaaaaaccaattgtttgttaagttctctgggggagacaaattcggaaatttttcgacactcaagtcacctggggggtgcaaatagtcgattttgaaatggaaaacttggaacggacactcaatcatactcgtttgactagacagcgagctcaaaatg

SEQ ID NO: 105829 - DNA, 133 bp, Heterodera glycines
  Promoter: Source sequence=SeqID_5660; Location=864..996; Strand=+; Gene=SeqID_58820
attatttgtttaaaattgtcaggacaaaattctcgaattggtcgagagttgctcccgactgctcaattacgtgccctacaaggagctctcctcgctgaattcacatctcaaaacggcgatggttgtcacaatg

SEQ ID NO: 105830 - DNA, 52 bp, Heterodera glycines
  Promoter: Source sequence=SeqID_7251; Location=1385..1436; Strand=-; Gene=SeqID_64257
ccttttagtgctttatcaacaatttcaatggccgtgccaactgcttcaaatg

SEQ ID NO: 105831 - DNA, 175 bp, Heterodera glycines
  Promoter: Source sequence=SeqID_13126; Location=1341..1515; Strand=+; Gene=SeqID_76922
atttgtataagtggtgttgtcgcgttttcttaggtcgacattgcgcgcttgctcctttcacgcggtgcaatcgttgaacagactgatttctcgggtgcattttgtctctaattgcccaaaattagtggattaatattccttttttcgacttttaggaacgagatttgcgcttatg

SEQ ID NO: 105832 - DNA, 414 bp, Heterodera glycines
  Promoter: Source sequence=SeqID_16621; Location=1182..1595; Strand=-; Gene=SeqID_81033
aaaagcaaaagtaataaaaaaaatagagcccataaaattttctcaaaaatgccgacccctcctttgtaagacatttaataatttcatttacaattgaaatgtaaccaaaattattatatattttttttgactaattttttgtgttttctaactacataaaaagtgttaataaaaatgtttatttgtccatttttctgcctattcgagatttttgtgcctaaaaatggagtccctattggtcacagttaagacattttgttttctttttgaaaacattggcatttatatattacgccaatgatttaaaataatgtgattttttttttcaaaaaatcttcggacaaataacaaatacttaaataccccataatttaagctatttgccttttttaacattattgggccaaaataatg

SEQ ID NO: 105833 - DNA, 561 bp, Heterodera glycines
  Promoter: Source sequence=SeqID_8051; Location=1164..1724; Strand=+; Gene=SeqID_66828
tattacacattatttagttttcaacgagaatagaacgggaccggaatcggtccgggaattcccggttttcccatggcccggtttttattaaaaaaaattctaaaaattcccggcttcaacttttttcgtgccaaaaatggttttttttttttggaaaattcttcaacatatgagattgccttttatggttattggacagttttttttcttaaatttagacacaaaaaaacggtgctaaattttatggaagcaaaactttttggctacttataattttgggcttttacgcgtccttttttcaagaacactatttgacggacttgctcagttgggccggcacgggttgggctccagcatttccactataactttttttctctgtcttccaaatccaacatttttggtatcattcgaaagctcttcgcatgctctattagccaaacaaaaagcgaaaagatttttcaagcctggaaaaaattattaagaaaaaacttcaaaaatttcgacttttcgtaattgtctaagctcgaaaaaatggcttaggaaaagcatctaaacatg

SEQ ID NO: 105834 - DNA, 53 bp, Heterodera glycines
  misc_feature (30)..(30): n is a, c, g, or t
  Promoter: Source sequence=SeqID_31893; Location=1..53; Strand=+; Gene= SeqID_62204
cttttgcatttgcgaatgctgctcaacaantttgcaccgtttttctccaaatg

SEQ ID NO: 105835 - DNA, 338 bp, Heterodera glycines
  Promoter: Source sequence=SeqID_169; Location=1..338; Strand=+; Gene =SeqID_75827
taatcatttgttgtttgtttactacttaatctatccgttcatctgactgcattgcttgttttcgacaacattgttgatcaaatttcccattattaccccgtgaatgcgtgatcaaatgatcgcttatatgcagcaaaccacatttatttaggcatattatatgcacaataaaaacaaaaatttttttttgaaaatatgttcgaatccgggttaggggttcagaatttgtcaaaaataatgccggattcgtgctcagcaccataaaatagcgctagaaaaatttttccaggcttttcaaataaaaaaaacgggaccagtaaactagtttgccgcaaatg

SEQ ID NO: 105836 - DNA, 116 bp, Heterodera glycines
  Promoter: Source sequence=SeqID_41845; Location=493..608; Strand=-; Gene=SeqID_69899
ttttcccttcttcggttttttgcgtccctctgtatttgcacacacacatatatagatataaatatgtagataaaaaatttcttcctccattctactaaacccccacccccaaaatg

SEQ ID NO: 105837 - DNA, 527 bp, Heterodera glycines
  Promoter: Source sequence=SeqID_30621; Location=625..1151; Strand=-; Gene=SeqID_61017
ggtccctccccccttttgttgttgataaaattcaaaaccgcccttctttagagtagcgccgatttttttgtgctctattgcttatgagagtccaatcataattgtttttccttacttgatcaatcaatacctacattcttggtatcaaaagaaagcttatttgtcccgggaattcataaatccaagaaaagagcaaacactgacaacaagaaaaaaaatacaacgagaaacacttaaatttaacttatttttttgagtatattcaaaaattatttttggtctgttgcttcgagcccagaattttggtatactcaaaaattctataggcttagatagctttaatttaatattaaaaaagtaggtattgattgaccaagttagaattatggccaaagaaactgaagattgggctcataaaagtcgattggactcctaaattgaaaatggagtcttggttttatgaattcaaactactttttcctgtatttaaagcatttttttttgttgttaaaggtccaactggaatg

SEQ ID NO: 105838 - DNA, 224 bp, Heterodera glycines
  Promoter: Source sequence=SeqID_32351; Location=1..224; Strand=+; Gene=SeqID_62666
gtgttaaagcgcgtgttgaactgtcaacgagccgttctcgtcgcgatcgggatgagcggggccggggaattagtcgcgagaatgaggaaaaatcacgcaaaagggaacataagtcacccaaaaagaagaaaaaggagaaaaaacacaaacggaaaagcgaaaagtatgaacttttttaaagattaaaactcacaaagttttgacggaaattatttttaggaatg

SEQ ID NO: 105839 - DNA, 57 bp, Heterodera glycines
  Promoter: Source sequence=SeqID_11225; Location=2586..2642; Strand=-; Gene=SeqID_74583
ttggtcaacgaaaaaggatcactggagcaaaaaaaggcaaacattaactaacgcatg

SEQ ID NO: 105840 - DNA, 1003 bp, Heterodera glycines
  Promoter: Source sequence=SeqID_4098; Location=760..1762; Strand=+; Gene=SeqID_53173
tcatttgccactaaaatgcctcaaaaaaatactcatttggaatgaaaaatcctcatttttttaaacatcataaaattgcgaacaaatcagttaactgtcatatttttcgtttgaaacaatcaaattcatcaatttcttgtcatttataagcattttgtggattccaaattgcacttgatctcttaaatttttttgcttttaaattgctctttttgtggcgcggttttccaaaaaactttttgggaatattgggggagggggtccggcagtgccgataggcgctgccggaaaagatttgtttgttaacaaattttgtcaaaaaaatgattttgactgaggatttttcgaaaaaatgtttaagatttgaagaaaaagttcgaatattttgccaaatatacctaatttttaaaaaatcatgcgttttgtcacttttttatcaaaagaccacaaaaatcctcaaatttctcaaaagaccacaaaaatacgcaaatcctcattttccaaaaaattctctttgaccctctaaaagacaacaaaatgagtaaaaaatactcagatatagaaaccctgtattatggtgattgtgtccatctaaaaatgaattggtttgcttaaaattaaatggaaaaataattttccaattgtattttgtgcccaatttatcggtgccattctttgctcattgatattgcgctatttaaagaatacaattataaaaacgtttttggttttcattaagtatttattaaaatgtgcatttttgctaaaataaaaaattcaattattttcattgctaatgatatccaataactaataatattataacaccttattcgaagcaaacttacgctaccaaaaaagtaatctatttaattctgtgttgaatgtataaatttaatttacgcctttttgccacttttcattgttacgtcgttgtaactttggcactcgtgccattcattttctgtccaaaatcattctatcgttcccatttttttcgatg

SEQ ID NO: 105841 - DNA, 787 bp, Heterodera glycines
  Promoter: Source sequence=SeqID_3368; Location=1..787; Strand=+; Gene= SeqID_84398
ccccccccccctccctctctctctctcggttggaccgcttaactctttggccattatccggcaatggagaagagacttttggcgctgtccgccctcaaaaaaagagccgaaatttgttgctacactttgtttttggctttttgttggcttggccaattcaaactgcttgtgctttctcacggccgccgtttgaagtgctgcgcgttcttcaatcagcagtaccaccgttttcccccatcgtcgccaaatgatgcaaaatgttttggacagacgcataaaaaacgcgattggggcgggcacttcgctttgtccgctgtttcggtgggcccattgatcgcccaaagctcaaaaaaacagcaaaatgtagcataaaatggagcggatgttcgttctcggcatcagtgttctctcagcttctcctccgctgtcttttcttctcccattgcttttggctgaaaattgagccaaaatacaaagaattaaaatttcttatacatattttgtttattttaaactgctctttcaatgttggcacattatttagagcacacaattaaaaagtggcatttgattagcaatggcttaatttaatattttcgataatcaaaagcactatggcaaaggagagatttcaatgagctctttcgattttcggatcaaaatcttagcattaatgagtttttaatgaggttcccctggtttaaaaaaatctgatcggaatttcaaagcatttaatgccgatgccatcatacaaattccaagaaatttcagcctgattctccaaatg

SEQ ID NO: 105842 - DNA, 186 bp, Heterodera glycines
  Promoter: Source sequence=SeqID_43850; Location=420..605; Strand=-; Gene=SeqID_71428
ttttcagggctagttgattcggcaggtgagttgttacacactccttagcggattccgacttccatggccaccgtcctgctgtctatatcaaccaacaccttttatggggtctaatgagcgggcactttggcaccttaactccacgtttggttcatcccacatcgccagttctgcttaccaaaaatg

SEQ ID NO: 105843 - DNA, 637 bp, Heterodera glycines
  Promoter: Source sequence=SeqID_7804; Location=1259..1895; Strand=+; Gene=SeqID_66020
ttgatttctgccaattaaatatatttttaaatgaagttaaatacattttaaaataatatattgtttttactatttagatacaaattcgagaatgtgcacgtggacatcatgcacagctgtgccggaggagagccaaaaaaagtgcaattgtttatttggaaaattaaattttataaaaatgtttgttatatactgagctaatttttacggaatgatccatcgagattattcccaaagtcacccgaaaatggatgatttttgaccgtgaccggaaaatcggtcagtggaaaatgcgtcagtggaaaatgcgtcagtagaaaatgcgtcagtgatgcaaatttttaaaataaaattctatggcattagtattgtaatatagaagtaaacttctataagaaaatcattctcaattgcgaaccccggacccaaactcgaacaaaaaatcgaaagtcaaaattttcgaaattagtgtttttcttcaaatcggtttaaatacacagaaacaaactgaaatacatcaatcctgcaataggagatcatttatgccgtttttgaacaaaaaatgcttaattcgaaaatttagacttgcaacttttttgttcgaattcgcgtccggggttcagaattggccgaaatg

SEQ ID NO: 105844 - DNA, 298 bp, Heterodera glycines
  misc_feature (21)..(21): n is a, c, g, or t
  Promoter: Source sequence=SeqID_10583; Location=1417..1714; Strand=-; Gene=SeqID_73819
aaaaaagaaaaaattaaattntcgtacaaactcacgtttaaaaacccccgaaatttacagaagctcaggccgaccttgctcaactggtggccaacgagggcataaaatgtccccaaaccatcaaaacaattgacggattactgtacccatatttttgtatttcaaaaaatcattcattttatacactgtgattccatttttacgcaacagctatgtagactgcagttctacaaattgccaaaaattggccattaatgaccagacaacagaaaatggcgccatttttggccaccaaatg

SEQ ID NO: 105845 - DNA, 214 bp, Heterodera glycines
  Promoter: Source sequence=SeqID_13661; Location=1..214; Strand=+; Gene=SeqID_77568
ttgtacgctttgctatttttaatgctaaataacttttcttattataacttaattataaaaatttcttaattaaaggattaatatctaaccaaaaatctggaaattcaaaaaaaagagaaaataaatatttttctaattaataaaaattcttaacaatatatatatattaaagaaatatagaattttgttttattttttaatactttttagaatg

SEQ ID NO: 105846 - DNA, 406 bp, Heterodera glycines
  Promoter: Source sequence=SeqID_19126; Location=1678..2083; Strand=-; Gene=SeqID_83869
ttttgttcgaatcgttcgctttatataaatggacgaaggacgatttgtttatggccaattcgttttattagtagccaaatttttgggccaaaacgcgaaattcaagatccaaccgacgaatttcgaatattttttgtaacgtcaaaatgtgccacaataatttagtttttctctattaacagagagacaaagaaagagtacatcaaaatgagaggtatttttttctctggcactctctatttattggttcatctctcgttttttgaaacgctgtctaagtgtataaatatgcaaaaatttgcagtaatccatcattattttcttcacttacaaattctgccttctgtgactgttgttcgcctcccctttgctcatctgtgacgacgacacttcgtgaacgaacatg

SEQ ID NO: 105847 - DNA, 180 bp, Heterodera glycines
  Promoter: Source sequence=SeqID_24601; Location=1..180; Strand=+; Gene=SeqID_55336
aacaaatcagcgagaaaattctgtgtgaaaagtcaagagcactgacagttagagaaggacaagaaaaaagtgatcagagtcttactctgtgaaaaattcggcgatacattgaaaggaaagttggcgatctaagaaataaagtgataggaaatgttttaagaatgttcagagtcataaatg

SEQ ID NO: 105848 - DNA, 242 bp, Heterodera glycines
  Promoter: Source sequence=SeqID_1597; Location=2024..2265; Strand=-; Gene=SeqID_74722
aagaggagcgggaaccaatcccgcctcagctgggccaagccgcatttggccaaagcccgcccgaaaaaaagattggcgacaaactggtgccgttagcagggggcaactgcagccaccaacaatcggtctacgagcgaccaatcggtctacgagcgaccaacgagcacgaattcgagaagctaacggcaaactggtgccgttagcagggggctccagctcaacatttcgagagacgacaaatg

SEQ ID NO: 105849 - DNA, 142 bp, Heterodera glycines
  Promoter: Source sequence=SeqID_34314; Location=860..1001; Strand=-; Gene=SeqID_64141
ttattgatttatgctaatttttttaagaaaaaatacgctttttgggggccggtggtgccgataggcgccgccgggggaatttttttttatgaattttgttagaaattagcaaaatttttcagaaatttcattcttttggatg

SEQ ID NO: 105850 - DNA, 66 bp, Heterodera glycines
  Promoter: Source sequence=SeqID_103; Location=299..364; Strand=+; Gene=SeqID_69064
tttttaattacatttagatttaaaactctatatataacttttaattctgttaatttaaaaaaaatg

SEQ ID NO: 105851 - DNA, 722 bp, Heterodera glycines
  misc_feature (93)..(93): n is a, c, g, or t
  Promoter: Source sequence=SeqID_19600; Location=1..722; Strand=+; Gene=SeqID_84341
gattgtttaaattggataaaatgatgcgtaattttgaaataactttgacattacaaaatcattaaactaataaggaattgttttgaaaagtcncaattaatattcattacatccatataatggaacgtacgttttaaactctatttaataaacgtaatccggcggaaccatttagttgaactcacgccattttcgtgggtagtgctaatttgaaaaagtgaagaacggcatgagattttaatgagcgggtgggcgccatgaaaagccttttggcatttttcttcgctttgtttcccctgaatttacctagcctttatctgtgtccattttgcgttaaccttttggctttcattggccttaatctgttttttcagcttccacttaattcattttttaattaaaaattgaatggaatgttaaattgtcagttttgcttaataatacaaataatctttgtgttaatttttaataagcaatcaaagatttatttaatgttatcctcaaatgccagcagacgaataaaataaaagacaaaatgtaaaaaacatctgccaccaattgcttcttttcttctatttactaaatttatagcctttttaaaactaattttttataaaatttagaattgttcaattctttttgccaattccttccaatccaatttttgaatgaacattaatagttttagaaaaggcattaaaaactgaactaacaccaaaatg

SEQ ID NO: 105852 - DNA, 818 bp, Heterodera glycines
  misc_feature (19)..(19): n is a, c, g, or t
  misc_feature (22)..(23): n is a, c, g, or t
  misc_feature (35)..(35): n is a, c, g, or t
  misc_feature (40)..(40): n is a, c, g, or t
  misc_feature (51)..(51): n is a, c, g, or t
  misc_feature (59)..(59): n is a, c, g, or t
  misc_feature (75)..(76): n is a, c, g, or t
  misc_feature (87)..(87): n is a, c, g, or t
  misc_feature (94)..(95): n is a, c, g, or t
  misc_feature (111)..(111): n is a, c, g, or t
  misc_feature (116)..(116): n is a, c, g, or t
  misc_feature (120)..(121): n is a, c, g, or t
  misc_feature (126)..(126): n is a, c, g, or t
  misc_feature (134)..(134): n is a, c, g, or t
  misc_feature (161)..(161): n is a, c, g, or t
  misc_feature (163)..(163): n is a, c, g, or t
  misc_feature (183)..(183): n is a, c, g, or t
  misc_feature (192)..(192): n is a, c, g, or t
  misc_feature (203)..(203): n is a, c, g, or t
  misc_feature (206)..(206): n is a, c, g, or t
  misc_feature (224)..(224): n is a, c, g, or t
  misc_feature (230)..(230): n is a, c, g, or t
  misc_feature (244)..(244): n is a, c, g, or t
  misc_feature (246)..(246): n is a, c, g, or t
  misc_feature (262)..(262): n is a, c, g, or t
  misc_feature (274)..(274): n is a, c, g, or t
  misc_feature (283)..(283): n is a, c, g, or t
  misc_feature (286)..(286): n is a, c, g, or t
  misc_feature (294)..(294): n is a, c, g, or t
  misc_feature (315)..(316): n is a, c, g, or t
  misc_feature (318)..(318): n is a, c, g, or t
  misc_feature (336)..(337): n is a, c, g, or t
  misc_feature (342)..(342): n is a, c, g, or t
  misc_feature (344)..(344): n is a, c, g, or t
  misc_feature (352)..(352): n is a, c, g, or t
  misc_feature (356)..(356): n is a, c, g, or t
  misc_feature (368)..(368): n is a, c, g, or t
  misc_feature (373)..(373): n is a, c, g, or t
  misc_feature (384)..(384): n is a, c, g, or t
  misc_feature (395)..(395): n is a, c, g, or t
  misc_feature (401)..(401): n is a, c, g, or t
  misc_feature (412)..(412): n is a, c, g, or t
  misc_feature (417)..(417): n is a, c, g, or t
  misc_feature (419)..(419): n is a, c, g, or t
  misc_feature (421)..(421): n is a, c, g, or t
  misc_feature (429)..(429): n is a, c, g, or t
  misc_feature (450)..(450): n is a, c, g, or t
  misc_feature (468)..(468): n is a, c, g, or t
  misc_feature (472)..(473): n is a, c, g, or t
  misc_feature (476)..(476): n is a, c, g, or t
  misc_feature (478)..(478): n is a, c, g, or t
  misc_feature (480)..(480): n is a, c, g, or t
  misc_feature (484)..(484): n is a, c, g, or t
  misc_feature (493)..(494): n is a, c, g, or t
  misc_feature (502)..(502): n is a, c, g, or t
  misc_feature (514)..(516): n is a, c, g, or t
  misc_feature (520)..(520): n is a, c, g, or t
  misc_feature (530)..(530): n is a, c, g, or t
  misc_feature (539)..(539): n is a, c, g, or t
  misc_feature (562)..(562): n is a, c, g, or t
  misc_feature (569)..(569): n is a, c, g, or t
  misc_feature (572)..(572): n is a, c, g, or t
  misc_feature (576)..(576): n is a, c, g, or t
  misc_feature (581)..(581): n is a, c, g, or t
  misc_feature (590)..(590): n is a, c, g, or t
  misc_feature (597)..(597): n is a, c, g, or t
  misc_feature (606)..(606): n is a, c, g, or t
  misc_feature (616)..(616): n is a, c, g, or t
  misc_feature (623)..(623): n is a, c, g, or t
  Promoter: Source sequence=SeqID_4435; Location=3393..4210; Strand=-; Gene=SeqID_54438
atttaactaattaatgttnagnngtggaaatgttnaaatnagtaaatgagntggtgganaatgtattaaaattgnnaatggagaaanaaaatgnnaagaaaatgtttgaanaggtnaaanngaatntgtttggnattgtgtgtaatgtaaaaattgaaagngnaaaaattggagaaaatttanaaaaaatanatgaaaatttntgnagaaaattaaaagaaggnaaaagnattgaagaaatagnanaaaatatgaagaaaantgttgtaaatanagaaattgntanaattaatnttgaaatttttgaaaaaatgnngnaaaaaattaaaaaattgnnatttntngatggaanaagnaaagaaatggtnagagnatttgttgganatttattggtnggaaanaattttttgangaaantngnaagtaaanttttatagaaaaaaaataaanaaaaataattagggttanttannganantngggnagagaatanntggggatngggtaggaaatnnngganaaaatttgtnagggatggntggaaaaatttgaaaataatatngggaaanaanattntcatnagtaagganatttttngaaattttnataaagaatngaaaatntttgaaatagaaatttttttacacaaattcttagaaactaactcatctaaagacactctcatccgatttggagtgcaacagtggacattcggcaaatcccccgagtcggatcggggagtaaccctaaaaataattcattaaatccataatttatgctaaaatatgtgtccaataattaagcacacattaaaaatg

SEQ ID NO: 105853 - DNA, 117 bp, Heterodera glycines
  Promoter: Source sequence=SeqID_33490; Location=716..832; Strand=-; Gene=SeqID_63540
gaggagggaaataatattcaaatggaaatgcaaaagactaataaattaattaattttaaggaacattcgaaattcgttgctgagtcattgcttgcgccgaacattcacaacaaaatg

SEQ ID NO: 105854 - DNA, 255 bp, Heterodera glycines
  Promoter: Source sequence=SeqID_13313; Location=87..341; Strand=-; Gene=SeqID_77161
agtaataaaatcaactttttcaaattttgtgagttttaaatcccttccctaataattactaataatggaattattaatttgaagccattttctcggcaagcctatcatatattgcttatgtaataaatgtttgttcatctgaataagtgagacgacaagaaaaactgcatgaatatccaattgaattgctcattcatttttcattccgatcaataaaaatataatattttttttatattcctttatttaaaaatg

SEQ ID NO: 105855 - DNA, 262 bp, Heterodera glycines
  Promoter: Source sequence=SeqID_11592; Location=1..262; Strand=+; Gene=SeqID_75040
aaagggcgggggatggcaaaacgccggcccattgatcggcttgaagggtgctaaaaaaagacccaaaaggcagtgacgggaggacgaatggcgcaaagtgttgtcgccgggaggcgtttgaagtgacgcggcattccggcacggaggtgggccaacaaaagggggggggtggggagaaatgcccatgccagaacttaaaagcaaagccgagtgcaccgtgaaaaatcatcgcatttaattaaatattaaattagccgaaatg

SEQ ID NO: 105856 - DNA, 1003 bp, Heterodera glycines
  Promoter: Source sequence=SeqID_18479; Location=328..1330; Strand=+; Gene=SeqID_83090
ccgtatcgtttcccttccccacgaaaattttattttaaaagaaattaataaacaattttcaaaatttttgttatttattgtttcccccacacctccatttttcgaaattaaaaaaaaatgtaaaattcaaaggaaataaaatgtttgatcattgatcatcatttgccggggttggtgagcgccgccgagaacattttgaaatttgagtgcgggagttcaaagattcgttccttaaaaattcaaaaaatgcaattttgcattctaaaacaaaataggcagtcaattagtatagttgtgttaggtaaattctcaccgctacagtgtctcatttcgtccgtttatttgttatttaaaataatgcttgattggcattttgtttgttttttattttttgtcaaaacatttttctaagtgaaacaagtgcaggtgcgtgccatttgcgaacacaatttcttcatgttttgtaaacaataacatttcttagtctttaaaaacaacaacacaatcaacattaaatacggttaaatgttaaatggactagcttttttgggtccaatgaatggccattctcaatttcttaggccatagttttttttttcattttcgatcgattcctgcgttcttggtatcagtcaaaggcttaaaatttgtagaaggattcttttgtaataaattctgggctaaaacagcagacaaaaaatatcatgaatatattcggaaaaaccccagaatttcgtatttttttttgtaatttttttcttaatgtcaatttttgctattttcttgcatttatatgtaaattaaccagattttaagcttccatttaatacaaagaaatagtcactgtgaccaaggaaaaaaatggtctaagaaaatgaggatggtcattgattggacccataaactgaacttgagccgttaaatgcggattatttttaaatcgtttttaataaaatataaaactgtcaataattttgttgcccattttttaagattgctaatg

SEQ ID NO: 105857 - DNA, 253 bp, Heterodera glycines
  Promoter: Source sequence=SeqID_37429; Location=362..614; Strand=-; Gene=SeqID_66509
aaacataaattaatttatttaattaaataaaataatttaaaaattttgtttagtatttactgaactgcgcaacaatcaccaggggctgaccaccaaaatagaaaacggtagaaaatattatttattttcttgaaatgcgctttaggaatgcgcgacagccaaaatttgttgtccaacaaattggaaaatggtgcaaaataatatttattttaatttaatatttttattttgggaatgcgcgagaatcaaaatg

SEQ ID NO: 105858 - DNA, 798 bp, Heterodera glycines
  Promoter: Source sequence=SeqID_13917; Location=2066..2863; Strand=-; Gene=SeqID_77869
aaaatgccaatggccaaattatggccctatttttccagcagcgactgacggcacaaccgaaaatggcaaacggaaaacgcttttcatgcactctttgcacaaagagctttgaccggccttcatgcttgaaaagacatatgctcatccacacgggcgaaaagcctttgggctaaacaaagatatagcccaaagtgtaagcgatggattaaaattttgggatttttttcacatcacttttttgtggcgcactttttcaaaaaaatttgtgaaagtggacggggtccgcgccggaaaatttcacaaattttgaatgaaatctgcatgaaaaaataagtttaactttaataaaaatgcgggattgcagactgggatccagcaaaatccgttttttcccgtgtgctaatcccgacaaaagttgtctttcagatgcagaattaaaaatttaaacaaattttttcgttgtattcgataaaaaagtacacattgcacttttttgcggcgcttttccaaaaacttgtgggatagactttcattaaaaatcctaattttgtggattttcggaaaaaattgataattttctggttttatgaaaaatttttcgaaaaatttgtgtttatctttagtttttatgctctaataaaacacaaattaaatgattttcaaacattatgccagtttattaatcatgaaatttaacagattgacgattttcccaaaaagcctcaaaattctaaaaaagctcaaaatcctcatttctaaaaaacgctcattgcgaaggggaaaagtgaaggaacaatg

SEQ ID NO: 105859 - DNA, 1003 bp, Heterodera glycines
  Promoter: Source sequence=SeqID_38; Location=17242..18244; Strand=+; Gene=SeqID_53324
aatatagcttgattagcttaacaaataaaaataaaaatgctaattaaaatattttttatactgatcaaaatgaaatatcggtgaaataaatgctatatatataacagtttgaagtgcctcatatccttaattaaaaattattaattttcattacggaaattcattacctaaatatcggcggctaaaaccatgagcagaaaatcttcaaaatcttaaaataagctatattataaaatgcacttactgataaaattttacggatattaatgcggcctgtggcacaaacatcgacagtacgaaatgaaggcataagccgctgaagcataatgcacatatgcataaagtcgtcaaacaataaacaacatgaaaaggtgacgaagtcaaaaatactcaagaaaaatctaccggtacgcgtccgatcgaatcggcgcagaagaatttgaaaaaatggcgtagtaaaattgaagcctgaaaagtacaataattttttttaaataaaaaataccgtattgggctaatgcattttgaagctgccgcatagacaaaaagccaaggttctcgctcaatttgacgaaatcatatttccaatcgtttacatgctgtaaattcagtaaacaacaataaattcatcatttcctacattccaaagcgccttaaaatcttcatagccgacatatccatttcttaaagtgtcaaattggactactaaaagacggcatgtgtcgagattaaacggccgcgatgtcccatttgttagagcgcgctgcaatttaacggctgttaactgtccagaaccgtcgttgtctattttgttgaatttttgctctataaggagcgaggctgtggattttctatccattttagacaatataatctaaagtttccaaattattccgaggttttatttctcgaaattagaaggttataagcaaattaaaggctggcatttagatttagaaaaatatgagataactacacatataatcaggtttgattttaaatg

SEQ ID NO: 105860 - DNA, 457 bp, Heterodera glycines
  Promoter: Source sequence=SeqID_900; Location=421..877; Strand=+; Gene=SeqID_46341
ttttcgcatgagctaacgtagtataagtccgcgtttctcctcacaatatattgaactcgaatggagaaaatatgcaaatcataccccacccacaatgtatgtgatcgtgagtttataactttcctttcaagtccagaccaacaccccccccccccccccttctcccacttgtcgcgaccgctctcaactctctcttgccccactttacatagtttcaatcagagtagacgatgaaaagtaacgaatgacacaacaaataaaaataaaatttaaaaacgaacgagtggatagaaagaagagagcttcggatggagcttgaaaaatgatcagaaaagaaaaccgtccattactcacacacataaaaatcgatgctcaaaattcaacgctcacatttaaaaaaaataaatcatagatattatagaataataaaccaatctacggtatataattcaacatg

SEQ ID NO: 105861 - DNA, 862 bp, Heterodera glycines
  Promoter: Source sequence=SeqID_13357; Location=1755..2616; Strand=-; Gene=SeqID_77231
aatactttattttctttttagatgatatctgggcccaaccaaaatcaccatgtgacagagcttttgaatgatttatagaatttagtaaacaaaaaataaattatggcaactaaaattttgctcagacgcagtgacccccatcgatttgtacaatattataatatttttattcttatatatttcattgatataatttaaagaaagttttaattaaataaaataattttaatatttttgttttatcaaattcttacaaaattgtagtcaaataaaactaaataataaataaataatgtaaataaatttcgatctgctgattgtgtattttggacattcgtccgtcgcaactaattttgtctttgctgtgagcaaatcttttgcgcgtatttcttttttgttttgtgttatttcttttctttcttttcggcgtcccctcgggcgccgatgctcccgcaaattggtcccggaacattgggcgatgtccgcgcagtccgtccgtccatcggtccatcggcgtttcatctgtctgcgcggcggtgttcgctgtgttctcttcgctcacaaaggccaccttgggggacgagttcattagtcaaatccgcttcttccctgctcacccccccttttgacgggttcttctttcgccggccgatgtgttccatcgcaacgcacaaaattcaaagcacaaattcggcgacgactgcggcggcgattttcatttggcgtaatcgcgtttttgcgttgctaatgaggcttaatcgctttttattaatggagattggattggtcaaagccggtaatttttgattatgaggtgaggctgattgagaaatgatcatcacatagcagcagacaaacgatg

SEQ ID NO: 105862 - DNA, 628 bp, Heterodera glycines
  Promoter: Source sequence=SeqID_2028; Location=1486..2113; Strand=-; Gene=SeqID_77391
ttttccaatctataacgttgaaaagagaatccattgaatttataattcatattaagcatcaaacagttgaaacctatctatttattgaattttacctgaaaattttcgaaaaatttttggtatggaaatggcctaaataccttagtatggaaatggcggtatggaaacggtggcatggaacggccggtatggaaatggctggtacggaaacggcggtatgtaaatggcggtatggaaacggcagtatggaaatgggtcgatcccatcttatagtattcgctgacccacaaaatgtccagcccacgaaatgtccaagtctcgaatttgagttttttattattcagatgggcctaaggttaggcaaggggtaatataaagggtatattcgtattcagcgaccccgaaaaccttaaaaatcctaaattagactcattttgtttttataaattttgaaaaattttggacatttcgtgggtttttactcttttggacatttcgtggcttggacactttgtgggggtgccatagtattaccgagttttgtcctgcttcgctcaacagcacccggagtcctgttaaaaaaacaaaaaaaattaatttaggctttttggttattaatgtaagaatg

SEQ ID NO: 105863 - DNA, 82 bp, Heterodera glycines
  Promoter: Source sequence=SeqID_31485; Location=230..311; Strand=+; Gene=SeqID_61817
tttggcaatgcgaaagtgttggaggtgaacagctgagaacaaatggaaaaaaataaaatgaatattttacgtttttagaatg

SEQ ID NO: 105864 - DNA, 266 bp, Heterodera glycines
  Promoter: Source sequence=SeqID_28863; Location=275..540; Strand=-; Gene=SeqID_59441
cccccccctcccccgccactgcgcagtgcgcactctccccccccccatcgccggagggttcatcagcagctttttgcagtgccgccattgttgttatcccgcgagaatgtttttcttcatcccttcccatttatcttcctcttccaaatgattcccacccaatttctctcctcccccccaccaatcgcttctctcttttctttttttgttatgttcaaaatgttttccgattaagcaaaaagctgccaaaatgacgacgacaaatg

SEQ ID NO: 105865 - DNA, 96 bp, Heterodera glycines
  Promoter: Source sequence=SeqID_7507; Location=607..702; Strand=+; Gene=SeqID_46432
ggttttcaataaaaattttgggtaaatatgtaaaaaaatgcaattttttagacaccttccgatgaagcgagacgttttttcatttcattggtcatg

SEQ ID NO: 105866 - DNA, 400 bp, Heterodera glycines
  Promoter: Source sequence=SeqID_10161; Location=1730..2129; Strand=-; Gene=SeqID_73265
tccttcatgcttgctccttccactaaagatcaaggggatagagccgtctagatatgtataacctaatgggctgaatctttattgcattaatttgatctttttcgaatcttatttttgaaccaaaattaaatcagaggtttctcgttgccataagaattttgtgagggctggtggtagagatcgccacaggagaatggggtaatataatgaaaggtagaatttttttttgaatttttaaaagtcaaacaagggcttgcgagagcaaaggtttgatcgcaaaaatcaaaaaatccttcaaaaaaccacttaggtcaatttaaaagaaccgagaaaaggcctgctttaccattaataaaaacaaaatgaaaaatccactcttcccagtaatactgaattcatg

SEQ ID NO: 105867 - DNA, 1003 bp, Heterodera glycines
  Promoter: Source sequence=SeqID_1021; Location=3046..4048; Strand=+; Gene=SeqID_66274
tttccaatttttttgcccattcacatctgcctccgattttgattcctttgttcacactttctccgatcgccatttccattgggccgtttttgcattcatctcattttttccctttgtttggcatttttctccccgccgatttttgtacccttcggcgtcgctcttttgcatcttaatctttgcccccccccaggggaaattgtttttggtacttaagtattcgattatcgtctatttggcacacacacattcacctcttgctcttcacttttttcactcctcaccatctttttctttttgctgaatcattcccaatttttgaccccctcaataatccttatcgcccttcccttcctccaattttcaccatataatccatcaacatctcgcatataatcatccaccaatttttgaccattttatcatcatcatcaccaataaacattttgtcggaaaagtgttgaaagggtcagagggcaaaaaaggggggaaaattcgctcgggaacgaagtgaccaaggggagccaaagccccgagaatcgaagcgggggacaatcccccgcagagcagcagcaaacaaggacgggagccagttcccggcggttgacgcagttcgcggccggaagtccaactcttctcccgaacctcaaccgggagcgccggcagctcttcaaaaagtcggtggtgccgttacagcaacaaccgcaaaccccatcttgtttgtcctccccaccccctccccagttcactcccttgggcacggacccaacggcagcagtagcagtttcaggaaattgagtgaattgggcccgagggacgggagagaaactcccgcgcacagaccccctagccgtcagcgccggccgagtttctttgccacaaacaatttggtgccgttagcagggggaccagcaacaacaccccggtcgcaaaggaccagcacaaccaccagcaacagcacttcggtcgccgaggaccaacacaacgcatttgaacaaaaatg

SEQ ID NO: 105868 - DNA, 1003 bp, Heterodera glycines
  Promoter: Source sequence=SeqID_19995; Location=14..1016; Strand=+; Gene=SeqID_84766
ttaaatggtccattttagtgaattacctaaaataaaataaaattaatctttatttaattcagaaatagaaataaaatattcgttttatgaaatagaaagttatgctcttggatattattaaattaaataatttgatggattaaaggcctagagctaatttcaggggagcttattaatagaatttagaaaatggccaaattggaagaataatttgctttttctacgcccaaaaattattcctttgtattcaaacaatgacgcattcgaattgatttattgaattttctatggtatctattaaatgcaatttaaggacggactctgtgagtcgagtgagagggcttctttttatttttagaaaaaaaacctatgattttttcgttttttttttaatttgccgaataggattttctccagatatttttacatcaaatctttgattccattttttcaaaaaaaaatttttataattttttaagaattttttttttattgaatttgtccgcaaaatgtccgtccttaaatttcatttacacatcatagaaaattcaataaatcaattcgaatgcgtctttgtttgaatacaattaaataatttttcgtgcagaaaaagcaaataattcttacaatttggtcatttttctaaattctattaataatctcccctctaaaattgaaaaatgagcatttaatgcctttaatctccaccattttctttatttaataatatccaaaataaaattttgcatttcatataccgtacttcttcgaataaagccccagtggctctattgttcagtcccttcaaaaatggggctatattcgagggtgggaaagttttgttcagtcccttcaaaaattggactatattcgagggtgggactgttttgttcagtcccttcaaaaatggggctatattcgagggtggcgttctattcgaggggggggggctctaatcgaagaagtacggtattaataatatttttaaagaattcacaaaatg

SEQ ID NO: 105869 - DNA, 483 bp, Heterodera glycines
  misc_feature (35)..(35): n is a, c, g, or t
  misc_feature (131)..(131): n is a, c, g, or t
  Promoter: Source sequence=SeqID_28039; Location=865..1347; Strand=-; Gene=SeqID_58697
aagagaaatgggaccaacaaagcagggggaccacnagcagcaacaggaggggacagggtgggaaaattgaaaaatacaaaaaaaaaaaagtagaagatgcaggccctgaatttctaaaaattttgaaaatntaaatggataagaggcgataatacggtagcaatgtatacacggtaagatggtattcaaagtcatagaaatgagagaaacagggggtgagaaatttataggaaggacctgctagaatagcaggaaggctgttggtttaagaatattacgattaattcggtaagaaggaaatcatttttatcaagaagtatagtaggcaaaggcgtactgtatatattggtacaatacaacattagattaatacatggtgtgaatgacattgggcgataaaatgaatgatgaatattggttgcatagtgtacaagagcattttgtacagtatcccctgtttttgtaaatatattttttgagatg

SEQ ID NO: 105870 - DNA, 485 bp, Heterodera glycines
  Promoter: Source sequence=SeqID_6734; Location=1307..1791; Strand=-; Gene=SeqID_62676
tcacgacatttctttaatttttttctttttccggggcggaggactcttcttttcacataaatatccaagagattaacccattggaaagtcttaattgttttgttcaattttttgccgtacaaaagtaatgccccaaacattttacgcacaaataactcaattttatatagaaaaaattctgtaatagggtttggaaattttttttaaattatgataaataagcctgccagaaagagaaaatttttataccaaattcatttgggatggttagtttacactaataccagcagagcattagaccgtgaaaaaattattagactgtataataatttgtcagtattaatttagtttataaaattcacttaaatatagattgaattaagcacccgaagtaaaacgggagtgaaaaattttttcaaaatataaaaaataaaaataaaaaattcgcttatatgcaaccacgcgaaaacggccacgcgaaaatg

SEQ ID NO: 105871 - DNA, 338 bp, Heterodera glycines
  Promoter: Source sequence=SeqID_5571; Location=3243..3580; Strand=-; Gene=SeqID_46071
gcaaaatgttgtataaaaaagtggatgcgtcaagtgctgaggtggcaaatgcggggctggacttcttcaccatacccccaacgagctgcgctgtgtccaactccagctacagggagtacctgacgctgaacccaataagctctaggccctttcattttaaggcaggtggttttcacatacaatagcagacaaatccgttggttcagatccacccaatcaccagctatgtagaccttagcaaggtgtttgtgtgcacagagttcaagctcaaaaaagtggcagatgatggggttgtggttgatgtgccggcaaacgcagcggtcggccttatccaaatg

SEQ ID NO: 105872 - DNA, 368 bp, Heterodera glycines
  Promoter: Source sequence=SeqID_31628; Location=1..368; Strand=+; Gene=SeqID_61949
ggccagggatggacgaaatttcgtttcgttttcgtttcgtcctacattttcggcactttttgagtttcgttttcgtgtttcgttttcgtctaccaaagttttttcgtttcgttttcggtttcggttttcaaaattttgtttttcgtttcgtgtttcgttttcgtcagagcaaaattagacgaaaaaagtacgaaaaagcactggtaagaataggccccgttggtagatttttcattggcattccgtttttttccaaataaagggggggggggggcaaactacagaattaccatttttcttagtccgttttttccgtgttataatttccgttttactacacatcaaagtcttttttaggcctattaatg

SEQ ID NO: 105873 - DNA, 580 bp, Heterodera glycines
  Promoter: Source sequence=SeqID_25027; Location=1..580; Strand=+; Gene=SeqID_55758
aggctgtgcaggaatttgctgtggcacaaaaggagttgcggctgactgcgcaaagatcgggtgggcgaaaccggcaaccaccgggggcaagagcttgccacgtaaattgcggattcattgcgttagttataaaagctttaaattcataaagaaaaattgcactaaatcaaaattattattggggtgagaataactttcgtcatagatgagaattctgtaattttttgctaatttttaaaatataatatctcgggaaattctttgtttttttacgattttaaactctacactcgaaataattttaaaaaagaatcctgaaatataagtaaaccatttatatttgttagggctacatatttgtttttatctcatggcacattcagatttgatcaaaaaaaaagttccgcggaaggcggatttggtatttcctatcagttgtcttccatgctccaacttttcaatttaaaaaaaacgcaagtgaacattatgccaaatcgaaattggagatcacatctttcgcttaatcactttaaagccgttctctttgaattttcactttcctgctcattttttgataatg

SEQ ID NO: 105874 - DNA, 143 bp, Heterodera glycines
  Promoter: Source sequence=SeqID_9736; Location=2775..2917; Strand=-; Gene=SeqID_72530
atcaaagcccactcctacagaccgctgaaatacatcttggtgtttgtcaatggccaatggatctttggcatgttgtattcaggtgtttatcatcttgtgcatatttttttttcatttttttgtttacatttacaggttccatg

SEQ ID NO: 105875 - DNA, 80 bp, Heterodera glycines
  Promoter: Source sequence=SeqID_2227; Location=2883..2962; Strand=-; Gene=SeqID_78610
tgtgaggagaagcgggtacaaaggggtggcacaagttcagctagttcagcagaagaaaaccaacacactgaagaccaatg

SEQ ID NO: 105876 - DNA, 95 bp, Heterodera glycines
  Promoter: Source sequence=SeqID_41294; Location=897..991; Strand=-; Gene=SeqID_69457
attttgacttttggtatttgagcaaattttactaatttattttgactaatattttttttattttcttttttttacagtcaatttccaataaaatg

SEQ ID NO: 105877 - DNA, 82 bp, Heterodera glycines
  misc_feature (8)..(9): n is a, c, g, or t
  Promoter: Source sequence=SeqID_2205; Location=3894..3975; Strand=-; Gene=SeqID_78479
gcctgcannggtcgttttcttaaataaaagattatttaaaaagaatttcttaaattttgaataaacaaactttgtttagatg

SEQ ID NO: 105878 - DNA, 1003 bp, Heterodera glycines
  Promoter: Source sequence=SeqID_3900; Location=3952..4954; Strand=-; Gene=SeqID_52349
gcatgtttaaatgggtcggggtcagttcggcgcggactgtttcggcgccgccaattttgaaatgttataactttttttttagtcagttaaagttagcaaatctggcatcatttgaaagctctatgtgtgctctatatttacatgtcaaaatagaaatgaatgattcaaaattaaaaaagttatggcacgcggcgccgaaaaagccaagaaaaagtcaatttttgagtttttttttttggacataacttttttataaactgacgaaatttttttaaattttgcatgcttatagagaacttaagagctatcgaatgataccaaaatatttaatttggtcgataatgagaaaagttgttagcaacggcgccgaaaaaattttcagaaaattcctttctttattttttactcgactttccttcataaaactatcgatttttcaagaattttccgctccgaaatgagactcagttttggaaagatctcttctgtttaagcctcaatatttggacaaatttaatgtccatgataaaggtcacttttgaatgttgtaaaaaaaatttgaaattttataagggtatttaatttttcttcaaaaaaatttgcattctgttgaattaaattttctggagaaaaatgattatttattaaatgaaacggaattattttctaaattttgttttttcattatattaccaccatctcattacactcttgtaattaacaaatgttacctaataattattattgaaattttttttacaaaattttgattttaatttatttaagaagttcgcataaaaaaataacacataattaattaggtgtaattcgagataattggttatgttattatttccgatttaaatatatttttttatcataaatatattgtattcatgcgcaattattcacgttgaaaatcaatttttgtgttataaatgcgaaaacatacaaaaaatattcattattatataataatttgttttattgaatcaaaaaaatg

SEQ ID NO: 105879 - DNA, 182 bp, Heterodera glycines
  Promoter: Source sequence=SeqID_33909; Location=753..934; Strand=-; Gene=SeqID_63832
aaatgatcagcaaaagagagaataattaaaaaattgaaagcaattaaagaaaagtgaaggaaaaaggaaaatacaaatggaaagaccaatgcaaaattgagagaaaaattggaaatttattaggaattggtcgtcataaaatatacaaatggaaaaaagaattaaatataattaaaaagatg

SEQ ID NO: 105880 - DNA, 122 bp, Heterodera glycines
  Promoter: Source sequence=SeqID_8695; Location=792..913; Strand=+; Gene=SeqID_68876
ttttcccttattcggttttttgcgtccctctgtatttgcacacacacacacacacatatatatataaatatgtagataaaaaatttcttcctccattctactaaacccccacccccaaaatg

SEQ ID NO: 105881 - DNA, 57 bp, Heterodera glycines
  Promoter: Source sequence=SeqID_6230; Location=1..57; Strand=+; Gene =SeqID_60808
gaaaaaggagttaaaattgagggggggggggggggttacgacgaagaagaagaaatg

SEQ ID NO: 105882 - DNA, 148 bp, Heterodera glycines
  Promoter: Source sequence=SeqID_26018; Location=845..992; Strand=-; Gene=SeqID_56770
cagcatgcggatttggatgtgccgccaccgtcccaaggcattcggaaacaaaatatttagttaattgacaataattatccactgcatttatacagaacaacagccgtttaattcgcaacatttcgcggagcaaggccaggccgggatg

SEQ ID NO: 105883 - DNA, 535 bp, Heterodera glycines
  Promoter: Source sequence=SeqID_30002; Location=1596..2130; Strand=-; Gene=SeqID_60461
taaggtcgggttccgccgctgagggtgaagaccctcaaaaaagcactaaaaaaagcaaaaacgcaccgaaccaaaaactcgtcgcaatattagagcatattaaaaagaatgcggaagccctaggtgttactgcggatgggaagattttgagaagggtttcaaccagtgaggtagggtcacaaacaccgtcaacatacaaaacaagtaatattgaacaaattgtgtcctatctattgaaccagaacatcagcacgggtatcgctcgctttaaaaattttccagttggattaaaagattttttggatagggcataccaggatgattatcttaaaacaaatttggtttccgacagaccttatcagtttgggagtggagttgggagtttaattggtttcaaagagaataaaaagtgtgaaaaggggataaagagttttgtcaattttaagccatcattatggtattagaaaaaaagaagcgaaccattttggaccacctttacaaagatataaattcgccggtcagctatacaagcatg

SEQ ID NO: 105884 - DNA, 105 bp, Heterodera glycines
  Promoter: Source sequence=SeqID_37848; Location=1..105; Strand=+; Gene=SeqID_66833
agtcatcgcccgaaaatgacaaaaaaaaattgggaggaaaagcaaacaaaaagcacaaaatgttatcaccaattggttaattatcatcaatcagcacaaacaatg

SEQ ID NO: 105885 - DNA, 297 bp, Heterodera glycines
  Promoter: Source sequence=SeqID_738; Location=1024..1320; Strand=-; Gene=SeqID_60190
aagtatcccgccaattccgccgttcatcaatgacagagcaccattttgccgccgtgtccgggtgaagaaagaggcgaattgctaggattttttaatcagcaattttacttttcgaatttcaacgaagcgtatgaattcgtcatccacggaagaacctaccgatgtgtggagcagtattactgtgcccaaaaagcgttgtatctgaaacgtttcgacgcggcggatgcgattatgctggggacaaatagatatggcaaaagaataagcgcatttgagatgaagaaattcgcaaacatg

SEQ ID NO: 105886 - DNA, 240 bp, Heterodera glycines
  Promoter: Source sequence=SeqID_2609; Location=3340..3579; Strand=+; Gene=SeqID_80694
ttcctgaaaacccaaaaaatgatgaaaaatggttttaaaacattgatcagcactagagaatggcaaatcaacctttttattagtttttgcggggtatcaatttaaatgttgatatttaattaaatcaactaacattatgccatcaacgcaaatatcaacgtaatttttaaaatttgcgaaaatttgttaaaatttatatgagcggtttataattttagtgcgagagataacgcaaaaatg

SEQ ID NO: 105887 - DNA, 214 bp, Heterodera glycines
  Promoter: Source sequence=SeqID_22920; Location=1393..1606; Strand=-; Gene=SeqID_53621
tacagccatcaccaaaccaattcaattttcggcacaaatttttgttgagattttgtccgtttttttgagtccattttgaaggcggaaaatttaaatgataatttatgaaaaaagcgcggacccaaattcaattaaaatagcgaattttcattttttaattgatatatgcaattaattcccacccctttttttacaggaagaattttcacaaatg

SEQ ID NO: 105888 - DNA, 89 bp, Heterodera glycines
  Promoter: Source sequence=SeqID_12857; Location=1851..1939; Strand=-; Gene=SeqID_76585
tgatggttgcaaagcttgaatgggtatcctatttctcatattcaattgttgaaaagcttgattagctgttgattctcccaaattcgatg

SEQ ID NO: 105889 - DNA, 294 bp, Heterodera glycines
  Promoter: Source sequence=SeqID_4817; Location=5094..5387; Strand=-; Gene=SeqID_55828
agtccattcaatcccagaatcagcgccaattcatcttacagtctgtggaagaaatttatgacgctaattttatcttattttattagacgaaagtcgtcatcaattcacaaatcaaatacgaatgcatcagtgatttactctaataagaaaggtgtgtttttaattttaagattttttttgatttttccctttttatggtccaattccgtctgtgctgaaccgtctgtgtcgagtggtggtactgctggagggtttccgcttaatggggagccgtccgactttggcgcggcaatg

SEQ ID NO: 105890 - DNA, 1003 bp, Heterodera glycines
  Promoter: Source sequence=SeqID_20; Location=3204..4206; Strand=-; Gene=SeqID_76510
tcaagaattaggggggatacgcagggattctgaggggttgatgagtaattataaaaaaaaatttacactggaaatacttaaaatataatattattacgccctacgtgcatttgggcattacatgtcaaatactcaccaagatacttcatgggaaattgtgtccagaatccgaaaaatttttttttaaaaaagaataaaagtattacatcagaaactcataaaacgatgtaaaaagatgtttgacgtttaaattttggatataacttcaactctcaccaagatactgcatgtgcatcttggatatgtaaaatagacaacttttgaacaactcccgaacaactaatgaaccactgatgcacaactcctgcactactcttgcactactcttgctctaataaaaaatttaataattctgggggtgaaaaattttttggaattgtaaagaattttttacactggaaatatttaaaatatagtgaaacacgccatatatacatttgggcattacatgtccaatactcaccaagatacttgatgtggaatcgtgtccagaatccgaaaaaacttttttttataaagaacaaaataatacatcagaaactcttaaaacaatgtttaaagatgtttgatatttaaatttctgatttaacttcaattctcaccaagatactgtgctcctttgtatataaaatagtcaacgttaaagttagaggtccctgcgtgcctgcacacagatcccagcatattgaggcctagaggtccctgcgtgcttgcacttttcactggcttcacttttcagcgtgttctctcctacgcagagaaacacgtaaagagtataaaaggactcttatttagtgcgtttgtcagttcactttgaccaaacaaatatatgttgctccaattttttcattgttacagtttacgacctttttattttttttagtttttattactatttcttttagctttaatatttaattattttgcgattatttaaattatg

SEQ ID NO: 105891 - DNA, 139 bp, Heterodera glycines
  Promoter: Source sequence=SeqID_37601; Location=1..139; Strand=+; Gene=SeqID_66627
aatctattaagttctatttcaaaatttgaaccaaaaacatttcgccagaatataactagtgttgtataattttcttatttttgttgcttttaattttctttcttttttggtgcttttcttttaataggtaaatacaatg

SEQ ID NO: 105892 - DNA, 1003 bp, Heterodera glycines
  Promoter: Source sequence=SeqID_10802; Location=724..1726; Strand=-; Gene=SeqID_74064
aaaaaacgttgaatttataatatcatattcacaaatgaacaataagcacaatggtgtgttaaagaaaaaaataataaaactcacacgttacctaattggtattggaaaatgattacgaacaattattaatttttgaggaaattatgaaattacttggtggtttgtgtgaagtataattgtctccacggcaactttggcacggcaatgcacattgcattgaaaataaggccaaataggcaggcattaaagcagttaaacaaatcaactctttttttgaggcgagaggataaatgaaagaatttaatttttcatttggtcagttggatataatttggcatgctgaattttttcgatataatttagttttttcaattttatactttcatttctgttggacaatgaaatataaggagtttaaaagaatacccaaagtaccccaaaacagttggagaataatatattagaggatgtaacccaaaatatcaaaataatgacaatttgtgaatcaaggaagaacaaacccaatagtaaaattaattagggtagtataaaagattccccaaagaaattatcctgtccaaaatctggtgaataacattttaggcgatggtgcccaaacgaaaagtatttccaattcgacaatttaaaaaaaatatataaatgcgtaagggttggcagataattcagggccggctttatttatcaacccccctcaaaagggtggctttatttctaattcagggacgcactatattagaggaaatacgataattggaccgtaatttgtttaatttcttttcgtctgtttcaatccaccaactttttgtcataaaaactagtaaattctagaaaaaataaaacttaattttcaacaattgcctactcgtttagtacggacagatgaatggcagaaattgatgaatgatttcgaccgactcaggcaaaagtatccctttaactctgatgctaatagcggattttttgtgaattgatttagatgatg

SEQ ID NO: 105893 - DNA, 127 bp, Heterodera glycines
  Promoter: Source sequence=SeqID_494; Location=2347..2473; Strand=+; Gene=SeqID_54339
aaaagtgaatgacttggaagataaattgacaaataaacccgcaacaaatttgccagcggggataaaaacgccgaaatatgatgctacagtcgactttttcaaattcatacgagaatttaatttgatg

SEQ ID NO: 105894 - DNA, 292 bp, Heterodera glycines
  Promoter: Source sequence=SeqID_18930; Location=2317..2608; Strand=-; Gene=SeqID_83654
agaaaatcccatatgaaacatttgaaaaatttaaatccgagtctattccttatttctcttaaattaaaagcaaataatttttaagaaattgaaaacagtctcataataaaaatgatttgaaatttcgaaaattttcggcaaatcacgcgatgccgaaaactcagaaaaacgatattataattgtaatatttaaataatttccctaaaaattaaggctttaccgcaagtttttgggcaaccaaaaccggtgatcgtgttcagcatgagttctttactagaaccatccaaaatg

SEQ ID NO: 105895 - DNA, 291 bp, Heterodera glycines
  Promoter: Source sequence=SeqID_30145; Location=1..291; Strand=+; Gene=SeqID_60579
aaagtaacgcacaagacaaaaaaaaaactttttttgatcatttttgagtaaaaaaaatccaggtttttttttcgtgttttgcctgaacctggggacctgggtttttcacatttgacctagacttggatttccggacaaaaatccaggtccaggaaaaatccaggcctggatccaggtccaggccgatctatacaagtgatgaagcaagatcccccacattcatttattcattcatttagactaattacctcactcccattactgaagttggcactaaatttgcccaaaatg

SEQ ID NO: 105896 - DNA, 57 bp, Heterodera glycines
  Promoter: Source sequence=SeqID_31080; Location=513..569; Strand=+; Gene=SeqID_61451
ttggccaacgccggcggcctaatcgtgggaggagaagcggcagaaaacaacgcaatg

SEQ ID NO: 105897 - DNA, 72 bp, Heterodera glycines
  Promoter: Source sequence=SeqID_40674; Location=1..72; Strand=+; Gene= SeqID_68928
tcttttcactattcaaaaaattaatatacgttagcagaattgtaaaaaaaaattctttcttttagctaaatg

SEQ ID NO: 105898 - DNA, 497 bp, Heterodera glycines
  Promoter: Source sequence=SeqID_12637; Location=2615..3111; Strand=-; Gene=SeqID_76310
tttgcgttcatctgtattttcatcattgttttctatttgcccattgcgtcaaagcatcgttctgtttcttcctctttcatagcaaacggaagaagtagtcacacgcgacggcatcatggagaaggtcgtctacttaaagtttatgcaaattgtgctcagttggcattcatttggcaactccgttcacttcaccaattctgcggcacttttgctgacccaaaagtcaatgcttttcatcttttggcactgcctttgtgacgctccaattttggcataaaaatgcgcaacggaaaagcccatagaataaaaaaggaagttaaattccaacattttattgtataatcacaatcataattaaacaaaacaataacaacaatgatatgcatttgtattcgaatcacagaatctgttgattttgttggcactttcatgccgacctttccgccggttataacaatcgttttggctcgtaaccataaaggaaagtggacaaaatg

SEQ ID NO: 105899 - DNA, 270 bp, Heterodera glycines
  Promoter: Source sequence=SeqID_8288; Location=1..270; Strand=+; Gene= SeqID_67579
atatgaaattaatttcactatttcaaattattttcatgtatgggcaggcgaattctgtgaacaccgttctctcagctgttttcttcccccaaatccctgcttaaacggtgggacttgtgcttgggaggtcaaaaagtaaaaccatgctagtcattagcttgattaattgcccttcattgcctttgtcccttttctgttcgtccgctttgtccaccgtttgtctgtgtcccattggttttgatggcccccgttgtgagaaagccgcccatg

SEQ ID NO: 105900 - DNA, 116 bp, Heterodera glycines
  Promoter: Source sequence=SeqID_22193; Location=1..116; Strand=+; Gene=SeqID_52853
gaatcagttccaccgcatcattttcccggcaaaaaaaaatcgaattcatttttcttccccctctatctcttattacctattgctttttccgtttcagttcactttcttcgattatg

SEQ ID NO: 105901 - DNA, 218 bp, Heterodera glycines
  Promoter: Source sequence=SeqID_8762; Location=2820..3037; Strand=-; Gene=SeqID_46639
ttaataacaagcaatttgcattttaatctagtattgggattgattcccagtattcctatcccgtcctgatgccaatcccaatccagatttttccaaaattccaggctctaattttgtatggcaataactgcttcagcttgccaataaggccacgtagccagaattcgtggatttaccattattctcattcgaatgaatatgtacatagcatagtaatg

SEQ ID NO: 105902 - DNA, 366 bp, Heterodera glycines
  Promoter: Source sequence=SeqID_13978; Location=1642..2007; Strand=+; Gene=SeqID_77940
tttttccagaaattgaattaagaatgatttcgatttcttgctgggaataattttggtgcgcaagtgggcgtggccaaagtgcgcgtatcgtacaccctgtcattttccagattcattttaaaaattttgcactttttttttgcacatctgctgtttttctgcgctttatgggcaccgtattatttaattgggaatttagggaaccgtataattaaattttattaaaattatatgagcatgcctaaatgtttattcatcttccgtctttcacctcctttattcttcacactatttccatgctttgcgcatataaataccgaaattttgttcactcctcctcaatccctgcacagatttaaaaatatg

SEQ ID NO: 105903 - DNA, 257 bp, Heterodera glycines
  Promoter: Source sequence=SeqID_11493; Location=1074..1330; Strand=-; Gene=SeqID_74909
aggtttattttaatttttgggctgatattactgattcttcgacttattcacacaaaaattctcagaaatagggtcaacaattaaagtgtctaacgctatgtaccatgcatgttacaaattaacaagtggttaagaaaaaaccattcttctcaagttttcgttaattatacacatttttttcgtgtgcatttggcgacggttttatgtttgaccaatttgaaataattattatttaggcactgaacatcgccgaaatg

SEQ ID NO: 105904 - DNA, 72 bp, Heterodera glycines
  Promoter: Source sequence=SeqID_6187; Location=1..72; Strand=+; Gene =SeqID_60654
taattagcatctgctaattgttctgctgttgtggaggtccccgatgttgatccatcagcattcaaagtgatg

SEQ ID NO: 105905 - DNA, 817 bp, Heterodera glycines
  Promoter: Source sequence=SeqID_9202; Location=2656..3472; Strand=+; Gene=SeqID_70580
tactgtaaagaataattcaaatttacaatattatttatttcaatccaccatcaaattgtcatggaatctcacttaaaccctccataatgctattgattggcttaaaggcaaagcaataagaatatttctaataaattataatatctattaaggaaataaatgttttaagtgacaaaaaaaaaccctcaaaacattgcctaaaaattggaaaacgggtctttaaaagtttataatttacaaaatgtacataaaatatgtataataattagggatgatatttttagttttttacctattttttcaaatttaatttcaactattttggttgatcaattttttgaataaattttaacattttacacccctaaatttgaaagtttttaataactattttcccatttttagcaactattttgggttttttagaacctaaaaattaattattttggccgtttttagcaactataaatatcattcctaaaaataattatatattaatgttaacaccagttttttatcaatatataaagaaatcctttctataattatatattaattttaaacaacattttttataaatttatgacagaaattctttttattttttggctaaatatttatgtaattttttttaattaatttaattttgccttaagccctcacatcattggatcaatttgtccgcatgttttatattataatattatctaatttactttgtctgaatttcaatttaattttctgcacaaaagaaaatggaaacgatttgtttagcgaattatggaaaaatgattttgccgatgctcaacaaaaaatg

SEQ ID NO: 105906 - DNA, 436 bp, Heterodera glycines
  misc_feature (47)..(47): n is a, c, g, or t
  Promoter: Source sequence=SeqID_6776; Location=2789..3224; Strand=-; Gene=SeqID_62862
taaatatggagtgaccatttaaacctatattttcttttaaatataanttaagagaagcattcttaaactgaaaaggtcctgaatttccagatgtttgcattttacggccatttttcatgaagtcaattaaatcagcaacacgttttaaattaaattaattattataaataatatttggacattcgcataatgttgaaaaatgaaaaacaaatgccaattggttttatatttaaggagaaatagccgcgtctattataaataaacgcatttttgatgttttgttttcacttttgctctgagttttcttatgattcgtaacgtatcgctcttcttctgaagcggtacgtttttcttttttttttttttaatttaataacaattaaataatgaatgttctcatttatccattttcaaattaagactcattgtgagaatg

SEQ ID NO: 105907 - DNA, 296 bp, Heterodera glycines
  Promoter: Source sequence=SeqID_16414; Location=1..296; Strand=+; Gene=SeqID_80817
tggaagctgggacagaagtgatatacggtatcagtatttttattcttctattcattctttcctgcatactctcctttttaaggtcaattgcaaaaactttacattgcatttttaattgtttctatttaccatttaaagtcatcaaaggatttataaaaagagacataaaatacgatgacgagttagaaatgaatctattaaataataaacgaaaaagaaatgatttaaatgaatcaataaagaaaaagagaaacagaagattaaaaaacttaagcctaaaagcaaccactagcatg

SEQ ID NO: 105908 - DNA, 215 bp, Heterodera glycines
  Promoter: Source sequence=SeqID_2985; Location=7578..7792; Strand=-; Gene=SeqID_82644
taaaaattatttcagccatcagcagaagtgcaggaaggatgaaaaaaacaaacgggcggctcagccccgtccactcagtcccgccaaatttagggcgcgaagactttttttagttggcacttggatctttgaaattttgaaaagcctgcgattttgaatttctcagttttcctacggtttttttctttgtcccctttttcaaatttgttaatatg

SEQ ID NO: 105909 - DNA, 73 bp, Heterodera glycines
  Promoter: Source sequence=SeqID_27107; Location=442..514; Strand=+; Gene=SeqID_57814
attattagatcgcttttgctatatttgacgaatgagaattttggtggctagggatttatcctgctgcaacatg

SEQ ID NO: 105910 - DNA, 135 bp, Heterodera glycines
  Promoter: Source sequence=SeqID_43861; Location=965..1099; Strand=-; Gene=SeqID_71440
aaaaaattcttctttaaaattttttttgaaccccaattcaaaaaaaggaaaaaaaatttgcagtcaaaaaaattatttggaatttctccaattttgtttccataattttccgaaaggtattcgggtatcataatg

SEQ ID NO: 105911 - DNA, 127 bp, Heterodera glycines
  Promoter: Source sequence=SeqID_23271; Location=222..348; Strand=+; Gene=SeqID_53978
ggtagcaacggtatttctagtgcattttcaaattgattttatcggtaaatcaaccttttctgtttttcaatattcgggcttcgtccaaatcttatttgaaatgttgttgggttttcctcggcagatg

SEQ ID NO: 105912 - DNA, 85 bp, Heterodera glycines
  misc_feature (35)..(35): n is a, c, g, or t
  misc_feature (39)..(39): n is a, c, g, or t
  Promoter: Source sequence=SeqID_5688; Location=1..85; Strand=+; Gene =SeqID_58910
gcaatgcgcaaaatgattacggtgccatcactgcngccngcacaaatggagggaaaatgacaagcagctgaagaagaagcaaatg

SEQ ID NO: 105913 - DNA, 162 bp, Heterodera glycines
  Promoter: Source sequence=SeqID_7279; Location=1..162; Strand=+; Gene= SeqID_64335
aataatttattatttcgagtaatgaatcaactaaattattttccgacgatttataagcataaaaagcggggggggggatgtctgagtccgttccgtgtcatgcaaacacagaaatgaattttgccgaagaaaagcggctggggcggaacgtgcgcaaaaatg

SEQ ID NO: 105914 - DNA, 1003 bp, Heterodera glycines
  Promoter: Source sequence=SeqID_3558; Location=297..1299; Strand=+; Gene=SeqID_50860
tgatgattcagaacggggattgcaccagtaaggaattagctatttaaattattgtaaagaagttgaaatgggcggtaaaatttcgaaatccataaaaggaatggagggagggcgtgccacccggtagctcaatggtagagctgcccacaaactcggtggaggcgtgggttctattcccatccgagcctgagagctagagattaggttaatctcaagaatggattaaaacatggcacagacgccgagaaaaagaagcgaaattgtgaaaaaaaataatttaatggcacaaattcagagacaacatctctttaaattgcggggtcatcattgtttaaatagttaatttatacatgtgagaaaaagaattttttgtcaattagatgtcatattatgacttcgttttatgaatagaacagaaaagtgccaaaaaaagaatttttattaaaatttttagttaaaattaaaattttcttaaaaattttcgttctgagattttttattttgttagtgcaacgccaacgcgtcaccggctcgctggagggcatgatgctttcattgaccattgtggtgtcatttcatggcacttttgtcacacgttcggaccgtgcctatcgctgcatgtgcttcttccgtaacatcaaaacattgacaaatgcaattgacgtgaacctggcggccaccacggaattgttaggtaggcaattttaaaaaaaaattttaaatttttaaaatggcgcgctctggcattttgcagaccctgccaagaccccgtcaccctttctttccttccaccatcagtggtggcctggccctcctccctagtaaccatttgaatgttatcccaaagggttgtccaggggaagaatgaaaggcgggggaaggaatgggctgcaaactctcaaccgcctcgccattgccccacggcttctccccccccccccgcaacccattttatcttcgccttctccgattcacaaaaattgctgtcccttggcatggaatg

SEQ ID NO: 105915 - DNA, 1003 bp, Heterodera glycines
  Promoter: Source sequence=SeqID_4817; Location=1898..2900; Strand=-; Gene=SeqID_45909
atccctctgaagaaagcggcgctgaccatcgatcaaagagtgcggcgttcagaacgaacgttggggtaagcgaaaaactgacgatgtgattttcaattggataatttattaattttgctgtaaattaaatccacttctgtgtaggcttgcaaaatcgcaaaactcgaagtaaacggctccgatgtgatgaaattttacaaaaaacagcctccgttggtctgcaacgacagaaaagacaaggagccttgggttttcattgatgaggaccggcggataatggcgacagaaaaggcgcaaaagtatttaaattaaaatttgcataatttattgccaaataatttgctattccttagcatcggcgtggacaaaatcaaatgtttgtggagcttttatgagaggataagtgacacggaattgaaatggacaccgcgggaggcgttcaaatttggcgatttggtggagaagggcgactttgtcaaagtggactgttccggaccagggagaaggaaatggttagtttcaaaggagccccgacatttgcgcctatgtccaaaatcggactcaaagttgaattttttcaacccctgatagcctaataagcattaaaattaagaaaacacggttttatggttcattatgatcaataattttttgtttgaaaattttattattttttcaacatttttttgtgatcaaatgatcatgcacaatcacttttaatcgcttatttaaagctaattatgcgattagtgattgaaaaaacttagttttgaaccagattttggacaaaggcgcaaatgtcgggccgcaaaagtcggggccgcaaatgtctggaccggccaatgtcgggacacgtttaatttcgtcaaaggacttggataaatttatttacatttcaaaacagagcataacaaacatatgtttctaagtttcgtcattttaatttcacttgttttttagaagtaaatgatttgggtacaccaattaaaagcatccagaaatg

SEQ ID NO: 105916 - DNA, 585 bp, Heterodera glycines
  Promoter: Source sequence=SeqID_663; Location=3613..4197; Strand=+; Gene=SeqID_58496
ttggtttttacagtatccttaaaatttttgacatttttattttaaatttttttaacaaattaaaaataatagaaatataactagatttaatttttcgatttatttttatttttaaatttattatgttctattttttgaatgcattaatttttattaatattattaacattcattgaatcatttattacatgcttatttttaatgtagtattttgttgtagttaatcgtaccttgatttttcggcatttaggtaatacgaaaatgataaaaatatgcgtataaatattatacaaatatgcacaaaaaacaaggcaaattaatttaaaaaaatatgcatttgcatatttttgaccgccctgattattatgattccaaataaaaaagtccgcatttgcgtcttgttgcacattaccaaatcgaattttgccagacattagtgattatgaggtaaattaaagaagagtgaattctaagttatatataattttattaaattgtctaaagatggtaaatttagtattatttaagttctgtgtttttgctctattatctttttctgatttacagatatttaagtaaattatg

SEQ ID NO: 105917 - DNA, 256 bp, Heterodera glycines
  Promoter: Source sequence=SeqID_43543; Location=327..582; Strand=-; Gene=SeqID_71188
aaaaggtgtacaatttgttcatttgacaggtttatcacggtatgttcagccgataattggtgtattgatcccctgatccaaataaacttcttatataattagtcaattaatcaactaattagcttgttgtgaacctagaaactattttctggtagcggacaaaaagcgtctgataagtgccaaagaagcgacgcaagtgcaaaatgcggtggcaaaggccacggaaattctgttgagcagcgattgggaagaaatg

SEQ ID NO: 105918 - DNA, 82 bp, Heterodera glycines
  Promoter: Source sequence=SeqID_10802; Location=2934..3015; Strand=+; Gene=SeqID_74065
ggtcagaaaaaacaaaactaaaaatttgcatgatttctttttaccgtagtttgattgtcgttattatttagttttggctatg

SEQ ID NO: 105919 - DNA, 114 bp, Heterodera glycines
  Promoter: Source sequence=SeqID_4202; Location=1160..1273; Strand=-; Gene=SeqID_53584
ttttgacatggtgcatgtgaaaaacaacccttaaacaataaaagtaccgaaaaagagaagctaaaattcgaaaaaattcattcctggagtgtgatagacaatttgtttcagatg

SEQ ID NO: 105920 - DNA, 130 bp, Heterodera glycines
  Promoter: Source sequence=SeqID_8079; Location=1..130; Strand=+; Gene= SeqID_66916
tatcggcaaacacccgtcgtgatcgcttgatgagagtccttatgagattatcaaatcgggtaattactagtgcaagtgtccaaattaaattaaattgacattagacactcggccgattacggcgcaaatg

SEQ ID NO: 105921 - DNA, 53 bp, Heterodera glycines
  Promoter: Source sequence=SeqID_30460; Location=1..53; Strand=+; Gene= SeqID_60866
ggtccgatggccacactggtaacggagaattccatcgccgcataagcagcatg

SEQ ID NO: 105922 - DNA, 766 bp, Heterodera glycines
  Promoter: Source sequence=SeqID_4924; Location=1899..2664; Strand=+; Gene=SeqID_56214
aagtctattgacaacgcaacaattaattttgaatgggtcaacaatttcagagaggtcagtaaacgtcatattttcataaacatttcaatattttcatttggtttccgttttccattgtttagaatttatccgcgccaccacttctgtcagctacaaaatacaattcaaactctttgaattggtggagccttttacattagtgaacaagcggacccagaaaagctgacactgactaaagcagaagaataagacaaaagatggatggtaaaacgatgtccaattggggagacggcagcgattcgatgggatgtcgaaaagagggacgattttaacacaataatgttttggctgtcacctgattaaatcattatgaatggaaatttacctgataattgctcctcacatttatttgttgcttttttcgtttgaagacatttaatttgtttggattttgggacttttacatcaacagaagtgatgagttagaataggtatgtgctttaccacggaaacgcttgaaattgtatttaatttgaaactgcaacagtgtaattttttggcatttttttcgggatttccaaactcccgaactgtccgacccacgaaatttattttgtttgatttcagattttgtttacttattgtcagtgttgtgttgtagaaattcaaaatgatgcttgtctttcagcgatttgcatatcttttgtatttttttgaaaatttgtttcattttgtgacacatttttggtccataaattgcaaaatg

SEQ ID NO: 105923 - DNA, 111 bp, Heterodera glycines
  Promoter: Source sequence=SeqID_29356; Location=2144..2254; Strand=-; Gene=SeqID_59865
aaaatccggaccaggactcgaatttcctgaatagaccttaacagaattccggaattaaaattttttgtaattttttttttaccaatttccattcattgtgccacagaaatg

SEQ ID NO: 105924 - DNA, 288 bp, Heterodera glycines
  Promoter: Source sequence=SeqID_513; Location=1..288; Strand=+; Gene =SeqID_54984
tgcttctgctgctggtctttaaacgccattttcaccaacactcaaaaggcggaacaattggcccaattatttgtttccctccgccgatcactgatcatgtgaattgggtggcaaaactattggggaaatggcttctgatatttgacacggtccgatcatttttctttctttgataaaaagttaccgaatttttcatgccttcgcagaatttttttttattgtttttgtccaaatcgtttttattttggcgggccatcgtcggaatgctttaaaaacgatgaaaaaatg

SEQ ID NO: 105925 - DNA, 57 bp, Heterodera glycines
  Promoter: Source sequence=SeqID_31080; Location=511..567; Strand=-; Gene=SeqID_61452
ttgcgttgttttctgccgcttctcctcccacgattaggccgccggcgttggccaatg

SEQ ID NO: 105926 - DNA, 324 bp, Heterodera glycines
  Promoter: Source sequence=SeqID_3624; Location=936..1259; Strand=-; Gene=SeqID_51163
tgtccaaaagcgggtttaaacttacattttttcaatcccagatgtaaacagctttaaataagcgattgaaagtgattgtgtgcaataatttgatcattagcaaattttgaaaaaataataatatcttttaagcaaaataatttttgaccctaataaaccaaataagttttcttaaatttaacgctgtttaaagacatataagattgaaaaaaggtaagttttaacccgattttggacataggcgcaaatgtctggacttgttttttaattgcatgttgataaaattttatatgtacttggatttcacacatttcccccgttatg

SEQ ID NO: 105927 - DNA, 528 bp, Heterodera glycines
  Promoter: Source sequence=SeqID_12637; Location=627..1154; Strand=-; Gene=SeqID_76311
taactcaaaaggtgccgaataaacactgaaaatagtccacaaaattacttttgattttgtaaatttagcaagagatatcatatttgtgatcagcgaaccttaaaacccccggaaatatgttttcaggccgtaataaaaaaaaatttttttttcaaaaaaaaaactaagttcgaaagaaagttagaaaattcggattttcaaatttcctaaattttggtctttgacataaaaagtattcccgaattaaattaggtcaaaacattttgaaatttaagcgatttggcatcgattttcgggtttcgacccaaaaaacgagttggggtaataaaaacgagttgggtcaaaaacgagttggggtaaaaacgagttggctgaaaacgagttgggtttttaccctttttggatcctctggcaggtgcccctttttgcgtccggtttatccctagaattcaaaatgtccttgaaaatgatcactcgaaaaaaacacattcaaaatgcctatttaaagtgaacgcattgaacaaaatg

SEQ ID NO: 105928 - DNA, 1003 bp, Heterodera glycines
  Promoter: Source sequence=SeqID_4700; Location=445..1447; Strand=+; Gene=SeqID_55442
tggtacattattcgaatttatgaaatgtgcccgtaatgatttttcaatgttttgttttttttattggaaatacattgataaatatgttttagtattaaattaaacatttttcgaaaaaaaaatcagattagaatccatatggcacaaaatcagcttgccagactaaaacgaccccctgactaaaacgtcacctcagactaaaccgacccctcccgacctttggcggtttttagaaacgacccagcacgagcaaaatatacaacgcaaatcgccaaaaaattaatcgcgtaaaaaaaacattttttattgcatttttgttaaatgccaaaatatttacaaaaataaaacttttatttttcctaaaaccccaaaaatatttttttttattgactaaaatgacttttaaatgaaaacatttaagcgcaggaatgcttttttgagctccttactttaatgcaattaggcaaaaaaatatttaaataaattacttctcagcactaatgattaattaagacagcaagtcgttaagtgacttaggtgttaattgacttagccgcagcagatgtctcagcggagaaaggtccaaattcaacccattcagaagacaaagtgacaacaaaaaaatgattctaattacctaatgttttttctgcctaaaaatccctacaacaagcaatatttgttagttgtctaaaatttacattcaaaatgtaaaatataatttacaatttttgcattttatttttgtgtataataaatgtgcaaatttattggaccttatgattgattattctctgcttctctctttattagcaataaatgtttgataattctttctctaaaaagatttttcttgaagaaatgctttatgaataaaaatgcaaaacatttaacgattaaccatgttttagcgtacataataattgttttatttaaaaaaaattattcacattttattattagcttttattattattattatattcacttttttttagaaatg

SEQ ID NO: 105929 - DNA, 176 bp, Heterodera glycines
  Promoter: Source sequence=SeqID_1128; Location=3008..3183; Strand=-; Gene=SeqID_68303
attatgtctcggctgagttttggggtgcaccgccctaatttagccaaaattatttttaaaaatattttttcttttccgagcgacgcgacatttgaaattagttattagttattttgccgtcaccattgaaaaccactccgtctaccaaattttttttttaatttcagggcataatg

SEQ ID NO: 105930 - DNA, 137 bp, Heterodera glycines
  Promoter: Source sequence=SeqID_1220; Location=2408..2544; Strand=+; Gene=SeqID_70091
aactgtgatcaaacccaatttaattttgtgataattgtttacctcaataaaatattaactgattacaatcgcagaagggaataaattggccaaccaaaattaagaaacaacacaaatcatttttaaaggaaaaaatg

SEQ ID NO: 105931 - DNA, 54 bp, Heterodera glycines
  Promoter: Source sequence=SeqID_13376; Location=1..54; Strand=+; Gene= SeqID_77257
agaaaaaagcgattaaatacaatatttaatttaaatttttattctcacataatg

SEQ ID NO: 105932 - DNA, 250 bp, Heterodera glycines
  misc_feature (99)..(99): n is a, c, g, or t
  Promoter: Source sequence=SeqID_28455; Location=1..250; Strand=+; Gene=SeqID_59070
taagtaattttctgaaagagctcaaaagcagctttcgaatggtgtattcaattaattgtttacttgaaaattcacagagatatgtccaaccgaatctgnaaatgaataatggcgtagtattctataaaaaaattttttcttaggaattttacagtgcgcagggatttgaattatccataaacacatcatagggtaaatatctagcaaaaagaaatttttttacacaaaatcctagtccagcagacagatg

SEQ ID NO: 105933 - DNA, 447 bp, Heterodera glycines
  Promoter: Source sequence=SeqID_4130; Location=2907..3353; Strand=-; Gene=SeqID_45726
cgccgacgctcgcgttgatgcgcgcgcccatccaaccaaagccggtgacgcgcattttgccaaggccaacggccaaaaaggtacttcaaatggtagtcatatttccttgttttgttttactaggcagttcccccccccccccggaaaattttttctaaaaatttctcaaacctaaaagattttcaagaaaaaaaatcttaggaaattttttatatgaaagactcaaggaaaaaatatttttttcagcgaattttaggaaaatttttgagaaaaacttagtaactcatcataaaatttcgaaaatacgctggaaaaagtttcaaaaatttttttcttgtaatttcttacaaaaacatttcctaagatttctaggtttgagaagaaaaaaaataatgaagagtcgagaaatttcgtgcaatgactaaaaactaaaaacaaaataaaatg

SEQ ID NO: 105934 - DNA, 64 bp, Heterodera glycines
  Promoter: Source sequence=SeqID_17782; Location=1552..1615; Strand=-; Gene=SeqID_82320
attaattaatcacagtaaaatcaattaaacagcgcattttaaccgggactttcctccaaaaatg

SEQ ID NO: 105935 - DNA, 550 bp, Heterodera glycines
  Promoter: Source sequence=SeqID_11884; Location=619..1168; Strand=-; Gene=SeqID_75394
attgtgagcaatggtggcacacgacgcttttgaatttaatgcagtcaatcatggaaaaacctttattattttttaatttcgatttatggaattaaatgcttgcaatggttggtattctcgatattttttcgatctttttacttttacaatatcaattatattgtttcatttttaatttcttaattaaatgttgtgctgattgtggttagtgtgacttcggtgtaaaatgctcttaattttgtcgataaacagattaaaaatgctggtgtacttttctagttggagttgaaatactatttgattttatttgaatcaattaaagaacaaaacgccaatttgtctctgttgtgacacgacacgtcaatcgcctcgtttttaaaacttttctttcgctcctcattttttggtttaccagcccaattaattcactaatcaacgacaatcaacttgtttcccataattacataatgacaattgaattctaataatttacaatttctgttggaatattaaatactgaaaagtttttagaatttattccgatacaatg

SEQ ID NO: 105936 - DNA, 1003 bp, Heterodera glycines
  Promoter: Source sequence=SeqID_18309; Location=540..1542; Strand=+; Gene=SeqID_82901
tggagggcatgaagatttctgaagcgagaagatcagaaaaactccaaaacccgaaattcatactcaagtcaattttaaaaaattaatattcagaaattttcattaaaaaacgaattccaaacctacaaaaatctccggagtccaaccaaccccgccctggttcaaatgtggtatatctaaatgtaagttaaataaatatccacaaatgtaaattttgataaaatctgtttcaaaaagtttcgttttaactaatgtatttctcataaaaaattataactattcaattttcagaagaattaaaattccagcgataaatgattgattataaaataggaatatacaccataaaaaaagaaatatataaatcgacaaaaaaaaagaaaatctactctactgtccaaatgcctttttcaaatttcacttccttcaatttcgcccattttttaaatttctttcgcaactttttcgaaatttctatttgaattgttaaatgatacttcaaattctgtcttccattccttgtataagttttcaatttctttccattttttgccttctccaattttcaccagttgtcgccaaagcgactgagaaaatggaagaaaattgaggaagagaaatttaattgatttaaattggataattttaaatattgtgattaattttattatttaatttgtgatctttgaaattgtgattttgtccctccattgaacattttgtacatttttagcattagtcactctttttgttgttgatcgctctgtccaaattgctccacctacgctttttctttctatttaaacacgcacatttctcactcctcacatcttatacagacatcttattcatctttattttatatttatcaaataaacttctttcttatttgggaattattttcccccttattccaccccgccctctctccctcgcgccttcccatttttgcccccattttgccgtccgagccaacaagtggtgccgctagcaaacaaagatg

SEQ ID NO: 105937 - DNA, 190 bp, Heterodera glycines
  Promoter: Source sequence=SeqID_33329; Location=108..297; Strand=+; Gene=SeqID_63423
cgtacgcagctatcaaatttacaacgaatacaaaatatattctacagagaatataaaacgttaagtatatattaattttttattcgacaaaaatcaagcattcatcgcttttttatattttgcaggtaaatgtatgcagctataaatttacaatcgaatacaaaatatattctacagagaatataaaatg

SEQ ID NO: 105938 - DNA, 551 bp, Heterodera glycines
  misc_feature (43)..(43): n is a, c, g, or t
  Promoter: Source sequence=SeqID_42995; Location=1..551; Strand=+; Gene=SeqID_70774
aattaattatttattttctgtctgtcaaatgttttcttcgccngacttttctttttgctaattttctttctctccaccacaaatggcacaacagaaacaacaaaaaacgcacaatcggcgccggaaaagaaaaagctcaaaattctcgtctattcggtaatccccgcgcacagtcacatgcaatttatgggagcaattgccgactcattggccgaggcggggcacgaagtggtgaggaaggacggacagaattttagaagaatttaaaaagcaattaagcatttcatcaaaacaattgacgacgatttgcaatggacaagcaaagccgagagcaacgagaccaaactgtcctccaaagtttaccgggttgtgctcaagtcgcgcgaagcgcccgttgcgacttcggatgtgctttatccgttcagtggggacaatgcgtggcaaatgcgcaacgcatgggacaacagattcgccaggcttttcgatttgtggccatatttttgcaaaggcaattaattattcctaattaattgcattacattttcaaaatg

SEQ ID NO: 105939 - DNA, 852 bp, Heterodera glycines
  misc_feature (44)..(44): n is a, c, g, or t
  Promoter: Source sequence=SeqID_1634; Location=1..852; Strand=+; Gene= SeqID_74989
gaatttttttttatcaaaagtttctaggtatgaaaaaaaaattnagaaatttctgcggcgatattttgtctcggcgatatttcaggcaccgatatttgtcccgtctcctaaatattgtgcttttcccccacccattcgagtcaattttttcaataaaatattttttattttcaaaagatatggttttccgggtcactcattgatcagtgatcacgaatccccggcatccatttcgaccaattccggatcacagacctggagtcgaacaaaaatgcgaaaatgcaaatttttgtttttaccagtttctgtctgtgttcacgaattgcttatcattgcgtcacttttcttcatttgttttttgtttttaagttcgtcgcctgtttccttgccctcccttctgtcttatgctggtgtttctctgctgcgatctcatccaatttgctgatcaattggacggacttttggacttgcgtcaactttcgcgcggattacactgaagtgccgttggtcactttggtgagttttgaaatttggagggattttcaaggtcaggaaatcgattctgacagtcattttgaccaattccgaacctcggctcttgattcaaatggtcaaataaatttgagttttagtgaaaattaatttttgattgggtaatttgtttaaatccgattttagggttcaaattagtccaaaatggatgccaggatgagttttccgaccctgaaacctctaaaacatctttttactatttttttttttttgttttttttgcattctgaacacagttaagtgtaccccatttttaagatgctcagcatcgtcatggtgtgttcgtccgtcgtcgagatg

SEQ ID NO: 105940 - DNA, 482 bp, Heterodera glycines
  Promoter: Source sequence=SeqID_36982; Location=1122..1603; Strand=-; Gene=SeqID_66170
aggaagagaaaattcatttttgagaaatattttatatttattattcctttttttcatatcgaataaattataaatttaatttttaagaaaaagaaaaattgtcaacaatgaaattatgcctattttcaattttaattgcctttttaattgctcaacttgaaattgtagcggaaaagaaaaaattggaacaaaaaacatttgacgaaatatttggagaaaaatgggaagaaaaagaaaatgaacagaaaaagagagaaattattcaaaaatactatcaaattaaagaaaggatcaaacaaaaaggaagaaaatattcaacaaaagaatggaataaaattgaattgaaaatagcgaaaacattgggcacaaatctaaaatacatttacaaatggatcaaagaattaaatcttcaaaaatataaatgccacaaatcaaaaacggatgtacaaaaaattgaaattgtgcaaaaatttaatgcaatg

SEQ ID NO: 105941 - DNA, 1003 bp, Heterodera glycines
  Promoter: Source sequence=SeqID_142; Location=3765..4767; Strand=-; Gene=SeqID_74439
tctgtcactccgcccattttgtcgaatgtctatttaagcggccctgcccaaggggtcgctctcttcgcttccttcacccccaaccattcttttattcgttttgctggacttttcgatcaattttttcaccattttacgcatttttaattcgtcgatcgcttctttaataaattttgtgtcggaatcgaagtctcgaattcgttttcgggggacacggtaaggagggaaaaagaccctcctcactccatcacattcgcctacgtcttttccctcaaccctcccggatcccaaatccccctcccatcagccactgggaaaaaattcgggagtgacccgaagtagcgccaaattcgagcagttcagtctcccaccagtaggagcagcggaagagacggggagaactcccgtcgtcgtcaagtccaagcagggcagtgaaggaaggaagagccgagcggtgccaaatcgtccgacgaaaggacagggccgttcgtcagcgtaactcccaccagccggagaagcgcgcgtcgatcgaagcggactcccaccagccggagtgtccgccgcagggaacgggagtcgaaacccgtggtcgtcgagtcaaaggggtccgacaagcccttcctccaaccttgtcggtggtgccgttaagcaagcagcgatttgctgcacagttctctcaagcaccaatccaaatttgtcacccctcccccctcccattctcgtccccctttggcgctgatcggatcggtcagcagcatcagacccatcaaaaagaacggcaaaaaagggtgcgcttccctttacaacaagcgaacggagtgagcagaaagcgaaagggacgagagcggtgaagaggagcgggaaccaatcccgcctcagcttggcccaccccaacccccaagcgcgcggcgcaaataaaagattggcgacaaactggtgccgttagcagggggtccagcgaaacatttcggtcgacgaacagaacagacggaaacgaaaaatg

SEQ ID NO: 105942 - DNA, 161 bp, Heterodera glycines
  Promoter: Source sequence=SeqID_16639; Location=702..862; Strand=-; Gene=SeqID_81049
attatgtatttacattttctgtctccattttttatggataaatattattaattttccattgttactttaaatttcacattaaaatttgctgtttttcatttattttgctttacattttttacattgctttgcttccatttatgtgtatatatttagaaatg

SEQ ID NO: 105943 - DNA, 1003 bp, Heterodera glycines
  misc_feature (812)..(812): n is a, c, g, or t
  misc_feature (910)..(910): n is a, c, g, or t
  Promoter: Source sequence=SeqID_933; Location=732..1734; Strand=+; Gene=SeqID_64443
aaattttattcacttttttttaaatttttcaaaaaaaaaacccgggggggggaaattttaaaaaaaaaaatttttaaatatattttttcaaaaaataaaaactttttttaaaaagaaaaaaattttttggcgccccctttttttctcttttttttttttggcccaaaggtttggagagggggaaaattttttttttttttagggaaaaaaaaaaaaaaaccccctttttttttttttttttttcttttttttttttttaaaaaaaaaaaaaaaaatttaaaaaaaaacacaccaaaaaaggtgtgattcaaaaaaaaaaaaaaaagggtttgcttgtgtgcccccccccgggggttggtgggggaagaggggaaaacgggggggggaatatttttttttgggttcaaatatttttttcaaaaatttttaaaaaaaaattttattaaaaattttgggctcaaaaatcaaaataaaaaaaaaaaatttgtttttttttcttttttaaaacccaattttttcaaaattaaaaaaattttggaaaaatttttccctccccgtcactcgtttcccccccaaatgggtcaccttttcccctggaaaaatggctttttccctattcatatattctcttttaattattatatttttagggtaggaaatgggctttgtttttattctcggaaatttgtgttaaaagattaatgtgacaatttttatatttaaattaattatttattttggtagtcattcttttttgttgtgccattttaatttttgggtcctcaaatgtcgaccctaaaaagtttccgganccggaattagaatttttaaaattttcctttcaatttggaagcgtaatttttataattttttgcattactcgacctttacctcctaatcattttgtctnttagagaatatgcgagcaaaaataattttatttattttaatattttttaatttggccaaaattttcgtttgtttgccatacgaatgggaaatg

SEQ ID NO: 105944 - DNA, 534 bp, Heterodera glycines
  misc_feature (6)..(6): n is a, c, g, or t
  Promoter: Source sequence=SeqID_22090; Location=1..534; Strand=+; Gene=SeqID_52731
attttnttatgcatattttgatttttgaaaatttttagaaattttttttgaaaaaacaaaaactttttttttaaatgtatttctaaaaatagcaaaaattaatttttaaaatgttaaaatgtgattctaaatctatttaggtcatttttatgccattttatgcttatttaacattttacgaagatttttttccaaaaaataaccataatttttttttaatattttcgtgcatattttgggtttttatacatatttcttacatatttcgagatttttttttttacatatttatgtacatattttgaccaatttttgtacatatttttgacatccctagtcatacatattgcattcattattcaatcgaatgtttttttaaaacaagggactaccatttttggcatcctgtttgtttagtttagttaacttaaaaacaattcgaattttttgtcaaaaaatgcaaatttttcaaaattttcgtgtttttattttaaaaatttaacttaaattcatttttggctccctattttaatg

SEQ ID NO: 105945 - DNA, 426 bp, Heterodera glycines
  misc_feature (244)..(244): n is a, c, g, or t
  Promoter: Source sequence=SeqID_14718; Location=1..426; Strand=+; Gene=SeqID_47226
ccccccccacaacaaatatccttcgcctacggctcaaatccgccgcctccccctgccccctgctgtggtgggatgtgttgtaaagagcagagggagggcattgcaatgcttcattagtggtttctctccacaatccatgcgccatttgtgccgatcagtcgcgggagggagggcaaaagcaaagggaatgaatcaaatcaaaggcgggggagggggagggggagggggaggtccttcctgttcncttccatccaatggctttgacccctctcgccctttgcggatgattaacacaatacataagtgcaccgctctcccgccttctctcgcatttgctgcgcttgttcattcgcttgtccttaattattttttcaaaaattcggctgatttatttccaaaaaaatgaaaatgtttcttttgcagatg

SEQ ID NO: 105946 - DNA, 74 bp, Heterodera glycines
  Promoter: Source sequence=SeqID_7582; Location=1253..1326; Strand=-; Gene=SeqID_65306
ttcgaagtgaatggccaaaagataaaaaatattaattaaattaattttattttatttaagtggccaataaaatg

SEQ ID NO: 105947 - DNA, 129 bp, Heterodera glycines
  Promoter: Source sequence=SeqID_43962; Location=1..129; Strand=+; Gene=SeqID_71524
aaaaacaaatttattttaaatatctatcctttattataaaaagattggtattagttaatttcaataaaaaatattaataataattaaagggtttttaatttttatttcatttgaaaggaaaacataatg

SEQ ID NO: 105948 - DNA, 683 bp, Heterodera glycines
  misc_feature (65)..(65): n is a, c, g, or t
  misc_feature (158)..(158): n is a, c, g, or t
  Promoter: Source sequence=SeqID_9530; Location=1..683; Strand=+; Gene= SeqID_71760
tctccatttatctcccgggggaataaatggaacttttggaaaaaaataatttctttttaaaattntaataaaattaattattcaaaatcgaaattcatttgcaaaaaattacagatttttctttctattttaatttatgaaaactccttttaagaatnggagtgctgaattttttgaagatatgcaccttatcgttctgaatcaaataatttgaaaaaattattaagaaaaagcaccgacattattttaaatgtattttattttattctttttttttgctgaataattgttttttcatttttattaaattttttgttttattggcaaggattttaaaaaaatttgctatttctttctgaggattaaaatttttcactctctctgtcaaaagttctgtttaatatttgtacttttggcggtaaataattgtttaatacgatgccctaaacaatactgaagaggatgaagtgggtggaatcccttcaaaagaacgaattcattttttttttgaattttgaaatgtcctttaaagggattaagcgactgccgcaaaacgacagtaactaatcagagcttggaacattctgtaaggcttccccgctgggatttaagtgccgtaaatttgcctttttaattaattcattttaaaattttcattgcccaaaatttccaaaatgaaaatg

SEQ ID NO: 105949 - DNA, 87 bp, Heterodera glycines
  misc_feature (26)..(26): n is a, c, g, or t
  Promoter: Source sequence=SeqID_25598; Location=1..87; Strand=+; Gene= SeqID_56344
ttaattttgtattttttattataaanatatttattttgtttaaagaattgttgatataaaaaaaaccttttttaggtaatacttatg

SEQ ID NO: 105950 - DNA, 216 bp, Heterodera glycines
  Promoter: Source sequence=SeqID_29594; Location=276..491; Strand=-; Gene=SeqID_60071
atagttagtccttttgttgaatttttagaaattttatccgtcaaatcggcttttggaattttaatgagtaaatcagtaaccgtaaatgacattctatgcttctcttgttggatacacgggaagaaataatagttagtccttttgttgaatttttagaaattctatccgtcaaatcggcttttggaattttaatgagtaaatcagtaaccgtaaatg

SEQ ID NO: 105951 - DNA, 377 bp, Heterodera glycines
  Promoter: Source sequence=SeqID_9051; Location=1735..2111; Strand=-; Gene=SeqID_70107
tttaaccttttgtaaataaaaatcaaataattttttaatttattatccacttatttttattttggctgaaaatttgagaattgtacgaggcattttttcgtaatttcattttgtctcttttttaattgacaattataaaactgcaatcaaaatagaattttaattttgatgtttaactatttttgttttttatgtgtgtacgaagcacaaagaatcttattgttagtcccttcgctttttcttgttttctagtccttttattattttaatatggtcattgtgattttaatttatgtattttatgttgtatattatataatttttagttatttgtctgcatcttaaactccgtttttatggtccatcagccaccgatg

SEQ ID NO: 105952 - DNA, 110 bp, Heterodera glycines
  Promoter: Source sequence=SeqID_17565; Location=1..110; Strand=+; Gene=SeqID_82078
caagtgctgacgtgatttggaaattcagtctttgactgaagctgggtttgaggtgccaaaaaagaatatcatggttttcattccctttgtagcaagtgccaacgaaaatg

SEQ ID NO: 105953 - DNA, 468 bp, Heterodera glycines
  Promoter: Source sequence=SeqID_37440; Location=891..1358; Strand=-; Gene=SeqID_66517
tttcttaaattctcagttctaaatatcaatattttaatttgattatttatagaaaagaaataagaaagttttttgataaaaaaaaataaaatttttggcttgctttttcggccgaaatacatttttgcaataaaaatggcgaatttttaaaattgttgagaaattacatatgaaatatttcatgttcaaaaatattatgaaaaatataataatttaaaaaaaatattaatatttataattctctgcatacatttcctaagtctttgaaaattcatgtgaaagcgtagattataagaaaaccagcagcaatttccgcaaaaatgattttttgatgtttttgtctactaaaggccacgtcaattaattaagtcagaaaaagggggtatttaagtgcacagaaaaaacacaaaaaaaatatcatcaattcaaattttattcattaattaaataaaaatattttttgccatg

SEQ ID NO: 105954 - DNA, 855 bp, Heterodera glycines
  Promoter: Source sequence=SeqID_43138; Location=1..855; Strand=+; Gene=SeqID_70885
atcattgggaaagctctaagtgtcctttattagcctgccctcctaagaaaatttagtttaggttcaaaaaagttatggccccaagaattcaaaaaaccaaattttccaacttttttggccataaattggttcaaaattaacaaaaatttttggaattttgcaggctagtagagcatctgaagagctttcgattacgccaaaaagagaaatattcccttccttggccgcttccttttatcgtttttccctttcctctacttattttttcttggttgaaattcataattacggtttataacggaattctgtcgcgtccaatttctccgagttggacgcggtcatccatttcttggaggagttgcggccagacacggcaagtgaaccgaacagtgatttaatggcatttacccgtgacgagagtgatcagactgtgttacggtgctgatcagcccttaaataatcctaaaaaaaccggtagaaacccgagagaaattccgaaatctcgagacttgagcagcacttttttgttcaaaaggcaatttccctattggcccttctcattccgattattttgctggccacaactttgaacccgctttaccaacacatccatccctacctcaaatagtcagtctcgaaattttaatagtgaataagtattttaaattaaaaaagcaaaaatttaaatcgaaaatttgctgctgccttttgttgtcagctattgtatccacgccaactaacgttaattgtttcaaaatatgtttttaaatttaaatttgttcattcagtccgctgctgcacaccggcaactcgtcgcccagtcacgacgcgttcgccaccgacatttacgcgatg

SEQ ID NO: 105955 - DNA, 277 bp, Heterodera glycines
  Promoter: Source sequence=SeqID_7628; Location=674..950; Strand=-; Gene=SeqID_65454
tttttgataattgctttttgttgtgtttgcgcagcatttgccttcctttgccccccccccgccctttggcacaattgcccatttgtcatgtgaacaattttaagtgagtattctcgagattttcgatctcgacccttgaatctctgagcctatttaaagattcgctctcagcattttccacatttaaaattggcacaaaacacagattttttaaatccgccaccgataagtgatttaggtatttacataattatttttccgtttttaagtcaaaatg

SEQ ID NO: 105956 - DNA, 140 bp, Heterodera glycines
  Promoter: Source sequence=SeqID_7095; Location=1201..1340; Strand=-; Gene=SeqID_63824
aaacaatccttttcaactttgcatatctatagcgataaaattctgcaccgtttaatgctgattttattattaaccctgctaacatttaaaaagatattacattaaaattagattattttttctttttaataggatttatg

SEQ ID NO: 105957 - DNA, 1003 bp, Heterodera glycines
  Promoter: Source sequence=SeqID_12775; Location=77..1079; Strand=+; Gene=SeqID_76487
cattaattttactcaacttttattgttccaaactcatttttgagataaaaaatcaaaatcgaggtcaaatcgatgaagtgttagaggtttttggtctatttcaattcaggaattttattattttatggacatgaattacgaacttagaacaattcttaattttaattttttctaactcattttttacaaattttttctcgccgtatcgtcttttatttatcactttttgtaggtctttaaattttgccatcctacagcaaattccattccttctcgtcttttggtcatttgcatagaaaatgtcttataatttcgctgggcttaaggaggcattttcggctgtcgtgaaaagcactgcaacaataaacgaaaacgaaaaaacttcatcgtcgaaaaacgaaggagcagaagcggaggaaggggaggaggaggacagttttttggtgtgctatttttgccggtagagtccagccgattgattggagtccattcgatcgatccaaaattcacaaatgctttagtcttcttttgtttgtttaattaactgtgggatttctaatcttgtgggagtatgtatctcatcattttttcatcagcgtcgtcttcatttccattcggcccttctcagtgaaaatgtcgccgattctccgcctaacaatgatcatttttcggtgttttcatcctccactaattgtgtcagcgaatttgggactgtcacggccgaaaatggacagaaaatgcaaaagttctgcgattttgtcgtttttctttttactttttcaatttagcggttacgacaatcgaataacaattgaactttcgtctgcgtctgtcgccaaattgagtggacttttcggtgaaatctgttagctttttgagattataaattctccttttgctttaaggtgatggctcttcgtcgtccatcgaattcccttcatcggttgaagtgaatttgccgatttggctttgcgaatttctcttcaaagcaacgcaaaaaatg

SEQ ID NO: 105958 - DNA, 80 bp, Heterodera glycines
  Promoter: Source sequence=SeqID_5788; Location=2619..2698; Strand=-; Gene=SeqID_59229
actgcaaatttgacattaaaaaaatcaaaatccaaaaatttaccgcaaaaggaatgccaatcaacagaataaccaaaatg

SEQ ID NO: 105959 - DNA, 358 bp, Heterodera glycines
  Promoter: Source sequence=SeqID_38557; Location=291..648; Strand=-; Gene=SeqID_67336
cgaattgctttttagcgttgataatcaggatattgctcatcttttgcggctcccgtcagagttaagatagatgccgttttccgctgcggtgcgcaaaaacagcttgctgaacgagagtgtaatcgttggccaggcaagtaaaaacgtgacggcaggcacaacagtgttgattcttaatcaacaatcacggtggaattttgcctaaacgctccggcgacagcgccttcggccggcgatccttgcgccaactgtgacagccaccccgcagatgggttactatcgcgggcagaatcgacaagcgatgccttattgtcgtccagggattgccaagccacggtctgaggataattgagtaatg

SEQ ID NO: 105960 - DNA, 655 bp, Heterodera glycines
  Promoter: Source sequence=SeqID_387; Location=398..1052; Strand=+; Gene=SeqID_51069
aataaataaattttaattaaattttgaaaaaactgcaaaatagatgttaattttttgattaaatcgtatttaaattttttatctcaaaatcttattttagggctgccttattttgaaaccatcagatacattctaaatatcttttaattactggccaaattatccccgaaacgccggggatttaatctcagagaacggggaaaaatccccgaccaaattatcgaggattgtggcttgtagaaattaaaaatgtcaggagaaacaatttaacgctaaattaattatttttttttttttttgggatgtgtgccaatggcgaattaattgcttttcattcttttaatgaaagggcaaattcagccgtttttgctaaatttgggcggcattggcattttcgtaagatgttaaattagtttttttactttaaaatgttttaaggggactggaaaatctgtttaaaattatttattttaaattttattttaaaattcaattaaatctattccacattaaaatgataattaaattataactattttcctcttaattagcatttttccgcaccgttaattccaatttttgtgccattttcagcccattgaatttgtttaatttaaatcctataaattattttagaaataaattgtaaaaaatg

SEQ ID NO: 105961 - DNA, 179 bp, Heterodera glycines
  misc_feature (75)..(75): n is a, c, g, or t
  Promoter: Source sequence=SeqID_31496; Location=1..179; Strand=+; Gene=SeqID_61827
gggggcagcattgcgaggcgtcactccgttgacgaacggagtgacctgatgggggggggggggagaggaaggtantaatgacaatggaacattccatcccttttttcatcttttttttctgtttctaaattttttccccttccccaatttttgttttttatatcatcaattttagaatg

SEQ ID NO: 105962 - DNA, 153 bp, Heterodera glycines
  Promoter: Source sequence=SeqID_43310; Location=665..817; Strand=-; Gene=SeqID_71008
ggtgagactcaatctctggggaatatcttccctatatcctgtagtttagttgtgcgttgggtttttgctccccataaatgtttgagtaccccaaccggacacttgaaaaaatcgatttttttgtttcataaatatttttttcagaaagtcatg

SEQ ID NO: 105963 - DNA, 1003 bp, Heterodera glycines
  Promoter: Source sequence=SeqID_10186; Location=251..1253; Strand=+; Gene=SeqID_73299
aatgacaaatgaatataaagaaaaaagaaaatattcaagaaaaggaatggcaccaaaattatgatgaaatttgtaagaaaattggagtaagccaaggaacaattaacaattagaaaatggaaggaaaaactcggattaagtggtaaaagaatcactgagaatgaaaaaaatcgaaaaaatgaaaaatgttggcaaaataaaaaaataaaaattcaaaaatgagtgacaaagaaattgatcaaattatgaaaattgatagaagagtatttctattcgtacgaaataatttggagaagaaattttggaagaatcattaatttctgttattaagtattacacattaataaaatgagaacaattaaaaaaaagttttgcaaaataaaacctaaaaaataaatttttgttatttttaaaaatttggcatattatgatcactcattttgtatttttttttttaatttttttttcattaccaaattatttcttcaatttcctaattatataataaattaggcaaattttcttgctaatttcggcgagatcagaaatggcacacttattaattaggctcattagatcctttaccttgacactaaaaatgagttggacagcatttacgcacctttgacaccgactcttcagacagatttgaagttgatgacgaaatacgattaattttttcaaaaaaaaatgtttatcttgagaaaatgaataaaatatttgaaatatttaaacataaattgtcctatttttgcacatttttgtcatggttttggtcaatgcaaagcttttcattttttaatgggtaatgcttagcgtttgaaataatttcctaaattcattaaaaaatattaattttatatagagttgagcgggaccgggaccggggcgggtaatcccggttttttcaggtcccggtcccggtttttggaaaaacagaaatcccggtcccggttttgccagtcccggtcccggcgggactaaataagcactggtaagaatg

SEQ ID NO: 105964 - DNA, 94 bp, Heterodera glycines; identical to SEQ ID NO: 97954
  Promoter: Source sequence=SeqID_32225; Location=625..718; Strand=+; Gene=SeqID_62552

SEQ ID NO: 105965 - DNA, 1003 bp, Heterodera glycines
  Promoter: Source sequence=SeqID_1066; Location=6424..7426; Strand=-; Gene=SeqID_67107
atcctgcatacaaaaaagtagagtgccacgggaccgggaatttttgccaaaaccgggaccgggacttgccgggacctgagaagccgggaccgggacctcgattttttttcgggaccgggaccgggaccgcaagaaaaaccgggaaccgggaccaaccgggaaattttaaaaattcaaaaaaattttaaaaattaaaaaaaaaattcaaattttaatttatatcaagtgaaaataatacaaaattatttggttttttatttaataaattaaattaatgaaaattttcaaacaaattttcttcaattatttcaaacaattaatcatttttggactaaatcatcgaatattaatagaaattcagatttgattttcacatcactttttttcggagcgcttttccaaaaaacttttgggaaagaaggggtccggcggtgccgataggcgccgccgaggggaaaattttaaaaatttgggtgcaatttgttaacagattttcaacaaaaaaaggttggtttttgcgattattaagctcaatcttacatttggcataagaagaattgtgaattttgtcaaaataaaaccaaataaagtctttttcgttggtcatttggtctaaattacaaagaggaaaattgtctataaaatgaacgatgaatgtataaatattttctgattgcatattccatttaaatgcgcgagaaaattggaattttggtcgttttcaaaattttataccttcaaatctaaatattcaaaaaagaaaatcgcttcaataaattttctttataaaaattttgccctaaaaaatgcgcggcgcgccgcgcacagaaaaatcccgcggtcgcggatcgcggattcaaattgccgcggtcgcggatcgcggatcgcgcaaaaaaaacgccgcgaatcgcggatcgcgcatcgcggatcgcggtcgcgtcccagccctgcggacgactttgtcacgtactctcatgcaaatttggaggggaggaaggccatg

SEQ ID NO: 105966 - DNA, 56 bp, Heterodera glycines
  Promoter: Source sequence=SeqID_11444; Location=483..538; Strand=-; Gene=SeqID_74843
ttttttcaaaatttatatcgaaaataaattatttaaaattattcaattaaaaaatg

SEQ ID NO: 105967 - DNA, 1003 bp, Heterodera glycines
  Promoter: Source sequence=SeqID_15221; Location=940..1942; Strand=-; Gene=SeqID_79423
tagtacataatcaattttttgttttaatttaatttttatttttgcttacttttcaagtttttaaatttttatgaaaaatctagtttttttggaattataaaaaaaatttgtttacaaattgcccaagatatatgtatatgcgttgccatgacatttttgaattcgggacttacaagggaacctcgcgaactgtaactcggaaaatgggtataaatttggtaccattcgatagagcagggtcgacttctattgtgaaacaaataattaattgagtaagaaattttttctaaattgaatctagaagattgattggctcgacaatttgtctcatttaatttgatcaatttgccacaaattcgccgattttattttttgttgatcactaattattccatcagccccctcttgccaacccccgcaggagaaaccgaacaaatgcaatttaatttaattgaaaatttaattgcaattttaacatttcaaggaaaattttttttaaattattgaggtttaaaaatttaactttttgaatgaaaattggctgaatgattggcaatattgtgataatttaatttttaaaccacaaattttctcagcacttagatttgtttgttcacccaatcaatttcatcgatttatttgtcattttttacattaattgattattggggggctgtcggggggggggggaggggtaattgattattaattttaattattccttcccaaaaggcatattaatcattttttaaaaatatcattaccctgacaattaaattgttcgactcaaatatatgtcaagagtctcgacctggtcaaaaacccaaccatcaaccttttactttaaattgattattaataattgattttaattaaccctcggcggttttttttaaattcaattaattttgacttaaaatttagctaaaaatagtttcaaactgcgaaaaaaccatctatgaatcttttcacctcagcctaattacccttaattacccaaatg

SEQ ID NO: 105968 - DNA, 1003 bp, Heterodera glycines
  Promoter: Source sequence=SeqID_8313; Location=383..1385; Strand=-; Gene=SeqID_67663
ttattagaaagtaaatttacttcatttgcaactgcaatcagtgaataaaaaaattttttgcttaatttttggctgaaaattatgtcactattcgtcactattttggatttttttcactattttggcactttgtcgtcactattttagctaaatattttgcgatttttcgtcactaaaagtcggggccctagatataagcatcaacaaagtagataactttttaagtcattttaaggctatttaaaatcagaaaaaagtcatttgactaaaattcacagcgacattaattaaaaaattttattagatgccagtaatttatgaagaaacgcttcaaaacttggaaaatagcgcaacaaaaattattaaatctaatagcaaatttcttctctgtcttatttgatactttgtctcagttacactttaaatcgaattgaatattatttgacttaatcataatttattaataataacaattatgtatttttgcgcataaaaatgccatttcattggcactttttccccatgttcgtcaaatgcacaaattaaatcgcaatagtattgtcgaaaactaacagcaccaaacaaaatacattaatctaatttctcttctgaattcttggttttttatctcagttgtttcaaccgtaaattgctttatgtattagataaacatttatttgctttaatggcactcatcagaaacgcactgtcgagaatttaattataataattaaattgcgcgtcaaatgaacacattaaatcacaatagcattatttcaacttttgaaagccctgaatttacaattgtcggctgaaattttaaaagaatgaatttttctgcggtggaccctattggatattcggtacacatttttgaatttatttaaaaaaatagttagcatgtcatagatgagcaactaaaattagcgggagtagaacggatttgttttatacatccgagatcgcccttgttttcgatccgtgagatgcctgtaccgtaatg

SEQ ID NO: 105969 - DNA, 56 bp, Heterodera glycines
  Promoter: Source sequence=SeqID_15791; Location=1..56; Strand=+; Gene= SeqID_80114
tgatagttggaatcatcaccaggcggttattgatactttttgtagaacaaacaatg

SEQ ID NO: 105970 - DNA, 843 bp, Heterodera glycines
  Promoter: Source sequence=SeqID_15299; Location=2506..3348; Strand=-; Gene=SeqID_47284
tttagcttttcgcatttcgcttttttttcatttcgcatttttcagtttcgcttttcgcatttcgctttttatttttcaatttggcccatccctggctgacacacatttgtaatttccaatttattaataaattttgaaaaaaccttggcctgggttttcagtaaaaatccatggttagccaaattgtgcgagctctatgaaatgaaaacgcgaaattggattttattagccacaaaatccctcttccatttaaattttttccataaaatttgggaaaattccctggactcgctgcttctgtttactggttaccctctccccctctgtgctgtgttctctctccatcaatattatattccatcgtttgtcacacattttgtttgcttccccctgtttttttttgttttgttttgcttttgtcgtcttcggcacaattgccgccttctctctctctgcccctctctgtttctctgttgtgtctcctcccccaccccagtccctctccctccgtttgttccgttgtactttttctctttttatgatttttttcgcccacagaaaccacccatttttttcagttacacattatttgcaacaacaacaccaaatattatagttttatttgcgcgttgaaagtttaaaagtcaatgagaaaaataaaatgtaaggaaaaaacaccacacgcattttccaccattttttgtgccatttcggtttccgtttctcatacatatttgaaatttatgccaccattttttgtttcaatttgaattgtttgttttgccagcgcggttttaattaaatttggatatctgaaagccgacggacggctctcttctcatg

SEQ ID NO: 105971 - DNA, 487 bp, Heterodera glycines
  Promoter: Source sequence=SeqID_27732; Location=574..1060; Strand=-; Gene=SeqID_58403
gagattgggtaaattccccctccccgaaatgaaaaatttttccaagaaaaattggcaattttttaaaattttgaattattttttcttagcaaaatgcgttaaattaaaaaaaaaaatcggtggcgcccaatcggcatcgccggacccccaaaaggtaaaatcatagttggattcataccaaggcccagaggccatttttcggcaacccgagtttttcataattctgattttgtccataaacctaggtccaaattggatccaggtccacgattaaaacattagttgaaataaatgtaaatttcagaaagaattattcgtgagacgataaatgttcaagtaaattgggctcaaagacgtaaaaaaatgtatttttattttgttccaatttcactcataatttttaatacaaatgtttatggcagatattaaagcccaaaatataaattttgggtagcaaaatggaaaggaaacacatcaaaacggaatg

SEQ ID NO: 105972 - DNA, 1003 bp, Heterodera glycines
  Promoter: Source sequence=SeqID_12970; Location=2518..3520; Strand=-; Gene=SeqID_76726
aaattcaactaattgaaaaattatttttaaaattaaaaatgttttaaatttatataatgaaaaaattaaaataaattcatataataatgcatttttgtgtttaaattactgcaattaacaaatcatcattttacgtttccgtcttaatattcataaaattatttttcatcaatcactaattatcatcattttccatttttgaacgatgaaaaattattaattaaaatgctgcattagagaaggcctgcgcaagttaaaaaacgaaacaatcaaatgggggaaagggcaaaaaaaataaggacacagcgccgaagcgaaagtgacacccccaaaaattggtggcggggagacgacggacggacgaccgaactgtgatcagcagcagaacagccaacgaaatgaaatgtcgggccagtcccatttgccgttgggcacgtcttccctgcccgtccccacgcccgaggccatttgttatgtgccggaaaaaagggtacccccgccccatcccatcgcgacacccctataaattgggcctcctccaccccatcatcaccactcattggaatgaacagtcatattccatcatattccaattagcaattggagtctcgtcaattcaaacaaaagtttcactttatgtctcaatattcccccaataattatcattaattaattgtccagtcttttaatcaggttttgatgccgtctcactcattgaaaatggttccaattacacccaaaaaggcacccggccccattcctttcataacggaccccgaaaattgagctttcttgaattcgaacagaaaaatcagccggcccctcaagaagcaattattagcatacccaaattatatttcctaaaacatcccaaaagtcctcaagaaaatctcattaattttccctaccttttttttgccgcaccgctcactattaagcattgtcccaaccaattaacaatttcctaccccccttcaggtagaaaactttgcaaaaaaaaatg

SEQ ID NO: 105973 - DNA, 92 bp, Heterodera glycines
  Promoter: Source sequence=SeqID_12541; Location=2603..2694; Strand=+; Gene=SeqID_76187
ataagttggggcagagcgggaacggagatgaaaataagaaaatgcttttattatctgagccagttacgatgaaaattacttgcgtgaccatg

SEQ ID NO: 105974 - DNA, 153 bp, Heterodera glycines
  Promoter: Source sequence=SeqID_39546; Location=813..965; Strand=-; Gene=SeqID_68098
aaaattctttatttttatggtgagatgaatgatagtattttagggattattcggggagggtgtcgagacttttaatgggattccggacatgaataagataaagaacaggaaaaacccctcttactgatacttgacgatttaatgcttaacatg

SEQ ID NO: 105975 - DNA, 153 bp, Heterodera glycines
  Promoter: Source sequence=SeqID_33920; Location=779..931; Strand=-; Gene=SeqID_63840
gggctgggcattttatttaattaaatattttttgcttatatgtagagaccggattttatgtatatatatatatatatttttgcggcttacttatggcgaaagaagcccaaaaaatcgcattttatccgaatttcgggctctaatttagacatg

SEQ ID NO: 105976 - DNA, 571 bp, Heterodera glycines
  Promoter: Source sequence=SeqID_3097; Location=175..745; Strand=+; Gene=SeqID_83179
atcaaagaagaaaaaaaaagttatttgtttttatttgcatgccttttttgttgttgtttttatattatttgtgttttttccaccatttaccgctgcccatagtcttccccccccctcggcaacaaaattccgtgatctgcaaaactggaacaaaaaaaccaaaaaaggaatactgaatggcaatgataaaatgaaaaataaataaaatggcggccaagaattagtagtcttatcttgtagcgtacgctgacccctcctattcctcctgccttccacttacggtggttgagttgactgctgctgttagaggcagagatgacaaaacatggaaagactatttgtatatgcccgcggggcagtgtctaaccaaaaattttgcataaatctaaggcaggaatgagataaatagtaaacagattttcacttcatcagcaccgcaggcaaattcattctcctcattgcaacgatgtcgctccacccctcactcttggctcctcctccctttagattcaactgattcgcctatttttgatttagatattaaagaattactacaatattttcagcaatg

SEQ ID NO: 105977 - DNA, 144 bp, Heterodera glycines
  Promoter: Source sequence=SeqID_18680; Location=2640..2783; Strand=-; Gene=SeqID_83348
ataaatccagaaaacgttaaaattttcatatagcaggaaatagccatgccacttgatttttgggtttattgcagggcgcgtatctgtccttatttataagatttgtccttatttggagggtccaaatcttacaaaataaaaatg

SEQ ID NO: 105978 - DNA, 607 bp, Heterodera glycines
  Promoter: Source sequence=SeqID_16018; Location=1..607; Strand=+; Gene=SeqID_80368
atatatattgtagacaattttatttacaacaatgtcgtggactttatgcgcggactgtcactgtatgtgatggcggcgaaaatttgcatactgtacccaagcggaacggtaccctttttggtgcaacagttcttcctcacctattcactgtggtgaacacattatcggacaaaaatgaactaaattgccgaaaaaggggacgaaagaaaataaaacgatggtcataaggactcccggacaatccgtcagcaaatttatattgtgaaaatgaattgaaaaaaatttaaataatatttttttatattataaagtaatgaaaaagcattttaaaaaatttaaacgatactttcttaagaaaataaattaaattgaattattaaacaaagaaatgccgttaataaatctaataatcgcattcgcaagatttgatttttaattattgctcaacaaataaaatttgctgacgaattttgcactgacggagattccgtagagacattttctaagacgaatatcaccttttttgactcaaaattttcctcagcatttttttcggctttcaaattaaaaaaaattattaaaattcatttcataattccttaaaatg

SEQ ID NO: 105979 - DNA, 1003 bp, Heterodera glycines
  Promoter: Source sequence=SeqID_1307; Location=678..1680; Strand=-; Gene=SeqID_72238
ggttaaattctacgatcttgaatagggctccgatttttagactaaaaattgctaaaacggttagtccttagaccttaagaacaaaaaacaagccttaaaaagtcataaattaggactgtgtatatcggcttatctgtatcttaattaattcgtcattccttatccaattgaccaaaataaaaactagagtaaaatacactaattgtaaatttttaaagcattaactgaaaaaccttttgggtaacttttcaaaaacatacaggtcgataacgaaggttgttcatacatataaggccaatttgtactgttttcgtcctaaaaaatgtcaaaattttaccaattttccggatctaatgttctctattttaacaagaaaatgtttcgtttcaaggaagttgcaaaaattcaatttttgacaatgcctataggtttttttaaattaatcaacaaattttgagattttgcaggatagagaacatttagattgtcaagatatcattaattgaaaggttccaaattttggtctggaaaacagtatggtccaatacgactcgggttttaccgattctttggaaatataccttaatacattttttctttgtttgcaggtccctaggagctcaataggaaaaatagccttgtctaaaattaagcttcctgtcaactaacattgttaagcttcctgttattacaggaatcccaaatccaaatgtgagaatttaaagaacgcgcttactcatgaattttatgcatttttgtcggattctttgcccccccccccccctcccaagaagttagtcgcgatagcacgtaaaaatactgcgatgtaaaacctgcttaatatcagtgtgtgtgtggcgttagatctgcgcgtcattatatacgacattaattgcgtttttaaaataagaaaaaaaatatcgcacgtctttaagataaaataagtcaactgatagccctttcttgaattaagtcagcgaagtgtgaagaatttttaataatg

SEQ ID NO: 105980 - DNA, 139 bp, Heterodera glycines
  Promoter: Source sequence=SeqID_34887; Location=1..139; Strand=+; Gene=SeqID_64579
tttacggcgatttgacctacgcggaaggggccaacttctcacattggccacgctgtccccgcgagtacctatcattatctgcgacggcattggcaagcgctatttggtgcccggctggcgactcggctggctcatcatg

SEQ ID NO: 105981 - DNA, 671 bp, Heterodera glycines
  Promoter: Source sequence=SeqID_31915; Location=387..1057; Strand=-; Gene=SeqID_62226
gatttttcttttcaaaagctttttttagataccaaatttgttctgtttagttgggaatgaagcgagttttatacacttttaaaaagattcattttttatttaaattttccttctgtttaattgacctttatttgtctcattcgactgcctcatttcatttcccacttaatttgctcaaaagcattaattcttcactcttttttcaaataaatgtttttttccgactctctatgaaattatgtgcctcggcatttatgaaatttttaaaacccgcaaatttgattgggaatttttgcactgatacgaaaattttttcttccataaatggtgtcaggttttccaaaaattttcaactttcttgattcggctatgcatttatatacaaaatatggaacaaaccatgcaaataaacacattggcattgggagtcacttttaaagttttaaattcatgaatttaaaccattttttaaacttgaaatgtatggctctctctgatcacatcatcattagccaaatgatctctgatcacttcttcattaaccaaatacaattttttaataagctatctctgatcacttctccattagccaaatacaatttttataaacttatttctaatagattttgttttttttctttaaaatccaatctgcttttctcgacttaatg

SEQ ID NO: 105982 - DNA, 57 bp, Heterodera glycines
  Promoter: Source sequence=SeqID_7006; Location=1838..1894; Strand=-; Gene=SeqID_63552
caaaagtgagtaactcgaactttaaaacattttgaacattaataacagattccgatg

SEQ ID NO: 105983 - DNA, 1003 bp, Heterodera glycines
  Promoter: Source sequence=SeqID_3292; Location=2499..3501; Strand=-; Gene=SeqID_84091
aaaatctcactagacatagaaatttgggatgaacgggatcagggtttctggaaagtcgggtatggagtccaatttatttgacttatctaaatcgccgccaaagaaaaacaataagagagaaaaatatatacctaggattgaatcgaaccctcgacctcaggtatagcaatcggctcaccacccaaaccagtgctcttagaaaggaaagggaaaacatgtttgaaaaaaacattgaactaataatggctaatgggaataagtaaatgagggaaatacgtcgagaagcccttacactttgtctgatgttctttgatgcattcctacatgaatactttgcatacattagttgattggttatatttggtttaacttttttaacttttctagattaatctaggcgctgatcaagaactagcttcaaaatataaaatcacgattttatctatgatttcatcatatgattctgtcgatgagttttcttagtaacattagctgaggctaaaacttttaggagagtattgttcaatatttggcttttgtttggctggtaataattcgttcacttccttttcttttatattactttgttcctttcatttaattattatccttttattccacgtttgatgaaatttgaatgagcttcgccgatagccataagaaaagctttgttccaagaggtagaaaaaagaaagaaattggtaattaaactaaaacatattttaaccattcagccggctatcagtctccgtccacttcgttttcgggaggtttgaggaaggattattattggaacagaagcggatgttccacccccggctcaatcacttcaggcaccagcagattgtgcgttcgttttggcatatttttcggttgcgtcgctttagtttatgttaattacaataagcttattgctttcaatgtgttatttatttcatgttaaatcattctctcctttcgcagttcgtcctcaaacgtcggttgtttttccgccgttaaaatg

SEQ ID NO: 105984 - DNA, 220 bp, Heterodera glycines
  Promoter: Source sequence=SeqID_14536; Location=3736..3955; Strand=-; Gene=SeqID_78590
atgatttgaatcacttagagcaaatttgtcataaaattggttcgcaaacaatcgaactgaaaaaggcaaaagaacaatttactttaaatattagaaatcgtcaaaagtacaaaggagaaagcgatcaatgggagaaaaagcagaaattgacgccaaaatcaagaaagttggataggaaaaacacgttttggacaatgagataaaaaatttgaacgaaatg

SEQ ID NO: 105985 - DNA, 283 bp, Heterodera glycines
  Promoter: Source sequence=SeqID_30156; Location=473..755; Strand=-; Gene=SeqID_60590
ttaatctaaaagcatttctgataataaaaaagaaaaaaaaattttgaaaaaatttgacccaaaaggggggtacaaactgcattagtaccattgtgtggtcattgaaaccaatttaatatcaaatatcaacgggtcccacccactaaactgttaaaataagcgagtcattaatttcgataatcatttttggtacccaatttccactccctctccccttccgaatggtcataatgtctttttgctttaggacgagtctcccattctgatcgattttcctcaaatg

SEQ ID NO: 105986 - DNA, 544 bp, Heterodera glycines
  Promoter: Source sequence=SeqID_12659; Location=820..1363; Strand=-; Gene=SeqID_76334
aggatacgcaggaaaattgaaggactatgaaaatacggaagattcgatgaatgccccttagaatttgtttgatttatgttttttcaattatgttatgttatttgctcaattaataaagtattttattaattcattaactggggatcggatttttaggctctaaaaaatgccaaaataagcactaaccttttaaaaaagaatttaatttggggacgaaacgactcattttggcttaggggacgagacgacgcgggacgaaacgacgcgggacgaaacgacgcaggacgaaacgacgcgggacgaaacaacgcaggacgaaacgacgcgggacgaaacaacgcaggacgaaacgacgcgggacgaaacaacgcaggacgaaacgacgcgggacgaaatgacgggcagcgtttaaactagcgccgacaaaatgaattgaaacgccaaaaattatataatttagcgctaattcaatttatctgactagcggggtcagcgccttcggcgcatcccccgctaggcagtacgattgtgttatagaattatg

SEQ ID NO: 105987 - DNA, 653 bp, Heterodera glycines
  Promoter: Source sequence=SeqID_6861; Location=3543..4195; Strand=-; Gene=SeqID_63136
aaaacgtaaaatatggacataaaatatggactaaaaactgctaaaatatatgttttaaaccaccaaaaattccaaaaaatgtgtgtttattcaatatttgcttaaataaacttaaaaagtacaataaacaaccaaaaaatggatttaaaacttaaaaatgcaaaattttattttctccattgtataaaaaatacttccaagttttgccaaaatttcgaaaaaaaaagttttcattttaaaaaaaaagaaaagttcgcaaaaaaatggcgaaaatatttataattttcgtgaaaattttctaaaaatagccaccgaaaacaccgaaaacacccaaaatatggatttatatggactttaaaatctggtaaaaatatttgtgccaaattgattaattttaattgtttttaggaaatcattcggactcatttatggaaaatttacgctcattgttattatcgtccattgaaatctgagcaaaaagggaaaaaattctagtgtctgaaattcaatcaaaagaaaaatttggaattaaatcatttgccaaattaatcaaattattattggcggaaaaaaggcaaaatcgacaacagaaaaaggacaaaaaagatgaaaaatcaaaaaattctgcggagaagcagaagttgaagcttatg

SEQ ID NO: 105988 - DNA, 121 bp, Heterodera glycines
  Promoter: Source sequence=SeqID_10716; Location=571..691; Strand=+; Gene=SeqID_73966
aggagcttttccttttgtttcccttgccaaattagcaaatgctaattgcccacgccttttcgacaaatttcaattaatttaaattaattaaatatttatttttctaaaaatcagtctgatg

SEQ ID NO: 105989 - DNA, 190 bp, Heterodera glycines
  Promoter: Source sequence=SeqID_7956; Location=4461..4650; Strand=-; Gene=SeqID_66483
atcagcaaaacgtaccgcggcacacttgacaacatcccctctctcaacaattccaacgaaacgacaacaatttttggacggcgcagcgcaattggacatcgcagcactgctaaccagcactgaagtgtctgaacccgttcgtgcagtcatttgccaactggatgcacttctcaagctcgcggtggacatg

SEQ ID NO: 105990 - DNA, 286 bp, Heterodera glycines
  Promoter: Source sequence=SeqID_16776; Location=758..1043; Strand=+; Gene=SeqID_81193
aattagagatctaaatatttagaacggacggataagggtacatacttatgggctaaataacgtgtagtccgtaaaacccgtcatcggctgagaaagacgtgctacgggttcataaaaacccgtataaggtttcattgcggccccagttattcggtctctatccagaacagagtcgtgcgaaatttcaaaatttaacatagatttaattttatagtttaattaagttttggataatgagttcatgaaataattttttgaaatgaattacggttactattaagaaatg

SEQ ID NO: 105991 - DNA, 539 bp, Heterodera glycines
  Promoter: Source sequence=SeqID_13775; Location=1046..1584; Strand=-; Gene=SeqID_77698
aaaatcaggtattgttatttgattggactcataaaatacttttggactcataaaagtcgcttgggctcctaaagtgcaatagagctaaatgtactgtaacaaattttacaaaaaaagcctaagcctagtaccaagcaggcctaaagctaattttgtggccggagtcagcaaaaaacagcggcaaacttttcggaaaatggtaacaaatgaattgaatctataatttttttttattcatggtaattaatttgaattacttttgctatatatgcaaaattttaaatctaaaattcacaaattaactttcaaatccttcaaattttaatcgtttggaatttgttgcgctttaattcagtttttttaagattaataaataaatttatacaaaaaataaaaagaattaaaataaaacaatttgataatattaaccataaaagataataaataattaattaattttaattgaaatttgagcaaatattaataaatatataatagaaatttgagaaatttcgatttttttttcaattttagctatg

SEQ ID NO: 105992 - DNA, 352 bp, Heterodera glycines
  Promoter: Source sequence=SeqID_20222; Location=552..903; Strand=+; Gene=SeqID_85022
aaaactgccaaaattgttagtttttaggttctgaaaaactccaaaataggtgctaaaaatgaaaaaaataaatgccaaaaaatgtcaaatttagtgggtgtaaaatgacaaaattttattcaaaaagcaaaaaattatgccaaatcagtattgagacacactatttttaaaattaaaaattcttatcaagaaaaaaatttaaaaaatttgtagatgaatttttgagaaaatttttcaattaatagggttgcctttttggaaataagccccaatttctaactttgtcaattttccataaaagttgcaaacgcgtcaaattcaaacacaacgccagaaacaagtatcgcaaatg

SEQ ID NO: 105993 - DNA, 330 bp, Heterodera glycines
  Promoter: Source sequence=SeqID_6214; Location=1414..1743; Strand=+; Gene=SeqID_60751
aatgctcacttttttttgaattttccataccacttgcataaatttactgtcattttatgacagccaaaaataattctattgtgcatttgctgctaactatttcatgcaaagagcgataaaatattttcaagaatcttttgcattcgacaccgttgaacagttgtatgcgcattttaaagaagagattttgagctcccccggtgaatattacccaaaccctctttgtgtgcttgattgtgtacacattgtcaacgacgaacacgctgatttgccggtgttcattgaaggaacgcttgatttgatcgccggactagaactgtattccacatg

SEQ ID NO: 105994 - DNA, 152 bp, Heterodera glycines
  Promoter: Source sequence=SeqID_27732; Location=1..152; Strand=+; Gene=SeqID_58404
cagcatttctcaatttgcagaatttgtcatatttatatatttagttttttgaaagtttatcccgcataaaacagacagtctttgattttcgccttttttagattatttgtgcagaattctattgacaagcaattaatgtgataaaggaaatg

SEQ ID NO: 105995 - DNA, 311 bp, Heterodera glycines
  Promoter: Source sequence=SeqID_26352; Location=1075..1385; Strand=-; Gene=SeqID_57091
cctttaaggaatagtaatgcaataaaaattgacgatgttggtcgacacataagttaatagtggtaaaaaagggggaggggtagaagcctaaatttacgggggaaagacgccttttcctttttaggccacttttttgcgggtgtttatttaaaactatggggaaggggagggatccagcggtgccggtggcgccacaatctttccttgactaacttttgcgccatggcttggttcgtacaaataatcgccagtacgtggattttgtatgcctgccggatcgcgtccgacaatgtaagcgttcacgccacatg

SEQ ID NO: 105996 - DNA, 595 bp, Heterodera glycines
  Promoter: Source sequence=SeqID_32058; Location=1..595; Strand=+; Gene=SeqID_62367
attcgtgatcagcgaccccgaaaaccccaggaagacgtttttgacgaattaaaaaaaaaattatttttttttgaaaaaagggggggggggcaaagcacactattacccaaatgtctggggcgcaattctggggtaaaatgcattcttaagtcattcggatcaacgaagtatattcgatggtttacccagcagtaatcattgtaaaaaacaaagtgaaacttataattttaactggtgtaaaataattatagccgggatttctagtgaaaaaccttttttttttgctcaattgttttgctcaaaaaacgcatttctgcgttgaaattttcttgtattcgctaatttaaatctttcgaaaccattagccaagatataagcaaaaagatcgacccttcatgaaatcggtcccagtcccggattatactgctttactttgtgtatttgcaattttaggctgacagtttgaaaaataaaaattgggctcaaaactattaaaaatgattggactcataaagtgcattagagcccagtttttttggactttatgagcatttaatttttttcttagaatttcattcgaattatttttaggatg

SEQ ID NO: 105997 - DNA, 562 bp, Heterodera glycines
  Promoter: Source sequence=SeqID_807; Location=725..1286; Strand=+; Gene=SeqID_61772
aacgatgagccgatacaacaatgagctttaattcctcataaatttttataaaatttgggaattttcatttcacatttaacaaaatttggctaataaatgtaactcaaaatgattaattggcaatttataggagaccactaaataggagaaatttcaaatgttttgatgtatgggtaatcagatcattaggcgagattaaaaaattttgaattttaaacatgtgatataatctttttgaatgattaatgtgtgatatagtggagtaaatctgtcggtacatcaaatgagcaatttgtttaaaaatgggtcacatccattatcgggaattcgggatgcgttggtgcataataaagctgcctcccatttggagaataataataaagccgttgtgcaaggtcaacagcgcaccatttaaatgcatccctcccgtctcgctctcattatttcttcacatcacttgctcaatattttcacatttatttatccgctttacattttgctatatcccaaatcatatcatttaagcacacaaaatttacttcatatttttttttaaaaaatg

SEQ ID NO: 105998 - DNA, 778 bp, Heterodera glycines
  Promoter: Source sequence=SeqID_2429; Location=1..778; Strand=+; Gene= SeqID_79680
atttcaatgcattttttgtgatgggctatagggccaaatgttcacatttttcactttgtgccccatttggccgatttttgcccccctcaatgtccctcccccatttgctcacccatttcggtttaattaccccaagtttgagataaaatttggtggtaatttttctgtgctttctttctgtgcggccccaaatccgaccgttagtcccgtctcgatcgcccccggcccctttgtgctctccctccaacttgtcaaagtcctgcacccaagtgcaggcaattgtcggactccaccgcgcccacacccgcacacaaactcggagtacgataagtggcgaccctggcagggacaaccaagcaacgacaaacagcaacaagtgcgcgacaagccgcggcggtgcactcaacggaaaaggtgtggtgaatttggaaaaattcactcggtgttccaagtgttcgctctccgtggcaaaacttggacacaacaaggaggggggaagcaaaagtgggagttcggggaaatactgatcggtctccgtgccatcagtatttcctaggtcaaattactgctcggtctccgtgccagcagtattttgtcaattactggtcggtctccgtgccgccagtaatcagtaatattactgatcggtctccgtgccatcagtaataggggcaattactggttggtctccgtgccgccagtaatcaagcaaagtactgctcgctctccgtggcaacagtaccggtccttgccaagcaaaggaaggaccgttggcatg

SEQ ID NO: 105999 - DNA, 438 bp, Heterodera glycines
  misc_feature (2)..(2): n is a, c, g, or t
  Promoter: Source sequence=SeqID_37859; Location=490..927; Strand=-; Gene=SeqID_66840
tnccacaatttgaaataataataattttcttattatatataatcattcttttgctttatttatttgtttttgccttaagtccctctgtttctgtccatcctaaagatcccccaatgatgacctattttccacaactcaacaatttatgtaatgttttgttgtccatctgttcgtctcctcccctttactcatgtcagtatttaagcgatgcctttgccctcacattcaggactttcctttaccatttcttaaacctcaggttccctgcctgaagctttcttatttttgcttaataaacttttggtctttaacaaataagagttttgcttttcttgctttaaaaccgggaaaaactaatctggtgttggacacaacacttatcgtaggtcattatgggatcgctcggcttcaccttattccaggggtaggaagccaatg

SEQ ID NO: 106000 - DNA, 141 bp, Heterodera glycines
  Promoter: Source sequence=SeqID_27327; Location=1805..1945; Strand=-; Gene=SeqID_58017
caacgcatttataatataagaaaaaatggattaatttccaaacattaatcacgtgaacttgcaatttcgtcatccattcacaatgattgtgtctggaagtcggagtgtgtaatgcgtatgctacagaatttgcagaaaatg

SEQ ID NO: 106001 - DNA, 266 bp, Heterodera glycines
  Promoter: Source sequence=SeqID_4232; Location=1..266; Strand=+; Gene= SeqID_53704
tcattgcattgtcttcatttcactcataatcatgccccaccccgcggacatggcactagctgttccaacagctaacagacactctcaaaaacattgcaaatcaaaatgcaaatcccaataaacaaaactccgatttattcgctacaattaattcccaattgtccgaattcatctacaacccggaggcggatttggtttttgaaatttggcacgaacgttatgggccatttcttgagacagatggacaatcattgccagatgaaatg

SEQ ID NO: 106002 - DNA, 221 bp, Heterodera glycines
  Promoter: Source sequence=SeqID_24303; Location=870..1090; Strand=-; Gene=SeqID_55026
tggcaagtttttccaattcggccacggcatggagttcgagttttttcagacgtccagcaaaaaaacaaaatgcctgcttgaccgaggcatcctttgcaacgttgacctaggtcgggaaaactttttaaaggcaaatccaattgtgagcgtattgtttttctcaacacctatattttcgtcattgaaaattgtttattttaaaagtttcagaatagaaaatg

SEQ ID NO: 106003 - DNA, 1003 bp, Heterodera glycines
  Promoter: Source sequence=SeqID_8108; Location=351..1353; Strand=+; Gene=SeqID_66992
ttacaggctaaaaatattataccagtcataaacgcagaaattaatgtccaatggaactaaaaaaatgaaattcttggcgaattccgattgaaaccccgacaaattcaaagaaagatcagaaaattcaggaacatgaaaatgaaaacaggaccagggatgccatggaatttggttgactttttgaattcactttttttaaattattttttggcgccgtgaaaacattttgccaagtttggtagtggagagagatttggatgaattctggcgatgaaaaaaaaattgaataaaaatgtatcgataattgaaaggctttcaaatggttggagagagaacccaatgagcaatcggttttagaacccctaaaacttgaaaaatttcgaaattgggccctcttaacctttttaaacatattttttacgtttttaattgatttaaaattaaaatggtgcaaaaaatggaaaaattgcatttgcccgacgtttgccctaatttattttgaatgtgcccctattccgggcactcgaaatcgcatctgtatcatgtccagtagagcattttttgtatcagtcacagattaaacataagccatgaaatcatcgaacacatgagaaagatcatttttaaattttcaatttggatcttctaacttttcacgtttaactaacataaagctcatgaaaccttctgtcagattaagaagttgatcagaagcgactaaattgctttttggatcgacttaatcttgaagaatgaagaaaattggacgctcctaatctttttgagtggtcaaacctagacaaattaaccataattcgaaagttcaagaagatttgggtcaaaaattgttggggaatccgaacggaatttgagtcttctgggacctcatactaattccaaccagcattttaatcagctattattatattagcagaactccagaacttttctcatttctccggcggccattgcttaattttttctgccacaattagtgaaaatg

SEQ ID NO: 106004 - DNA, 259 bp, Heterodera glycines
  Promoter: Source sequence=SeqID_30471; Location=376..634; Strand=-; Gene=SeqID_60874
tgttagcatgaattttatacataaaaaacactggcaattttacattaaaaatctggcataatttaatattttagcaaaaagagccggcgaaaacagaaaattacggctttccctatgattttcattcaattttgcattatgctgctgtgaaaacaagcgggtcagttattttaaaggtataaatgaaaagaaaataatttggcaatgaatcagctattacaacttgattacgctgaaccgtttttaccaacgcacaatg

SEQ ID NO: 106005 - DNA, 867 bp, Heterodera glycines
  Promoter: Source sequence=SeqID_11641; Location=786..1652; Strand=-; Gene=SeqID_75091
cgctataaataaaggaatttttacgggacggcagttttacgggattctcgctcccgtaagacttcggactcccgcaaattatttttaccgggctctaaaaatggcacaaatagtatatattttaaatttttatttgacttttttcaaaaaaatctctttgtatttttttatgctaatctgtagcttagctgttcaaattgacaaaaacaaaaattattaattttttgtgctcttttaaaagtaaaaaactaaatagaaatcaaaatatttttatttagtcaaatttctgcgcgaatgacagaattcagagaggaattttaaaaatcttttatatttagacattttgtttttgtgcattttaagacaaacattcaacttctaccaattacaaacagtgacagaaagaaacattgtctccttcagccaaaaacaaaatgttattaaacactcccaaagcatttgaatcagagcgtttttgaggggggggggggggggcaatagccaaacaaacctttgtcataacaaaatgctcaaacttctcaagaatggcaatttaatttgtcgtggcttagcgtctgacattttaaaacgaatgtttgcgacgcccaagggacaatcgttaatcatcaaagtggtgccatttggacatatgtattatcacttgaatttttcgtgaatttgccaactctttttcaattccatttatttcaatgattaatcagtggtaaatgggagaagggagacggatttaaaaggataaaattttgtatataaaaacaggacggagagaagaaaaaatcataatttgaattaaaaattatttaataaaaataaaattaattattttttttagttccatcgaagatg

SEQ ID NO: 106006 - DNA, 444 bp, Heterodera glycines
  misc_feature (44)..(45): n is a, c, g, or t
  misc_feature (53)..(53): n is a, c, g, or t
  misc_feature (57)..(59): n is a, c, g, or t
  misc_feature (62)..(62): n is a, c, g, or t
  misc_feature (68)..(72): n is a, c, g, or t
  misc_feature (85)..(87): n is a, c, g, or t
  misc_feature (89)..(89): n is a, c, g, or t
  misc_feature (92)..(92): n is a, c, g, or t
  misc_feature (95)..(95): n is a, c, g, or t
  misc_feature (100)..(100): n is a, c, g, or t
  misc_feature (104)..(104): n is a, c, g, or t
  misc_feature (107)..(109): n is a, c, g, or t
  misc_feature (113)..(113): n is a, c, g, or t
  misc_feature (123)..(124): n is a, c, g, or t
  misc_feature (126)..(126): n is a, c, g, or t
  misc_feature (129)..(130): n is a, c, g, or t
  misc_feature (133)..(133): n is a, c, g, or t
  misc_feature (138)..(138): n is a, c, g, or t
  misc_feature (148)..(148): n is a, c, g, or t
  misc_feature (154)..(156): n is a, c, g, or t
  misc_feature (158)..(158): n is a, c, g, or t
  misc_feature (163)..(163): n is a, c, g, or t
  misc_feature (165)..(165): n is a, c, g, or t
  misc_feature (171)..(171): n is a, c, g, or t
  misc_feature (176)..(176): n is a, c, g, or t
  misc_feature (178)..(179): n is a, c, g, or t
  misc_feature (183)..(183): n is a, c, g, or t
  misc_feature (186)..(186): n is a, c, g, or t
  misc_feature (188)..(188): n is a, c, g, or t
  misc_feature (190)..(190): n is a, c, g, or t
  misc_feature (194)..(195): n is a, c, g, or t
  misc_feature (197)..(197): n is a, c, g, or t
  misc_feature (200)..(202): n is a, c, g, or t
  misc_feature (208)..(210): n is a, c, g, or t
  misc_feature (213)..(214): n is a, c, g, or t
  misc_feature (219)..(221): n is a, c, g, or t
  misc_feature (224)..(226): n is a, c, g, or t
  misc_feature (230)..(230): n is a, c, g, or t
  misc_feature (236)..(236): n is a, c, g, or t
  misc_feature (240)..(242): n is a, c, g, or t
  misc_feature (245)..(245): n is a, c, g, or t
  misc_feature (251)..(251): n is a, c, g, or t
  misc_feature (257)..(257): n is a, c, g, or t
  misc_feature (264)..(265): n is a, c, g, or t
  misc_feature (268)..(268): n is a, c, g, or t
  misc_feature (275)..(278): n is a, c, g, or t
  misc_feature (281)..(282): n is a, c, g, or t
  misc_feature (284)..(285): n is a, c, g, or t
  misc_feature (291)..(292): n is a, c, g, or t
  misc_feature (294)..(296): n is a, c, g, or t
  misc_feature (298)..(300): n is a, c, g, or t
  misc_feature (302)..(303): n is a, c, g, or t
  misc_feature (306)..(306): n is a, c, g, or t
  misc_feature (309)..(309): n is a, c, g, or t
  Promoter: Source sequence=SeqID_554; Location=1..444; Strand=+; Gene =SeqID_56131
ttttaaacaaatcgcaatgcaattgcctctgcctcataaaggcnngcccggancccnnnccnccgggnnnnncacatttaacgannncnccncgncccgnccanggnnncgcnggagcagggnngnganncgnaaggncaaaaacccnctactnnncnaaaangnaaaaanaaaanannaaanganangnagcnnangcnnngccccnnngcnnaaaannnaannnaaanagccanaaannnagnaaggangaaaanagcgggnnaancaccacnnnnaannanngaaggnngnnnannnanncanaancaaggacaaaaatcggagatatcgtataacaaaaaatccaattttggaaataggcgccagtctgctcatgaaataaattacaaatatttacagttattttgacctgagcgtcagtagtgaatgagtcaaggcatg

SEQ ID NO: 106007 - DNA, 383 bp, Heterodera glycines
  Promoter: Source sequence=SeqID_14310; Location=1..383; Strand=+; Gene=SeqID_78335
caaaaactcagtcagtatacaaggcagttgggaaaaaggtggaacaattggtagctacgacaactaaagctccttttacaacgactaaaaaatcgaaaattgaaaacacactgaaaaaggcaacaccaaaaccaaaaattgtgggtttgaagagcagaacgcagaaggttcttagcacagttagaccaagcactaagaaagtggtcagtgagctttttccaaagtcagctacaactccgagtacaattttggtagtaaaaagcacaaataattccaaaaatttttctaagcatgtgctggttaaaaaacctgaggttgaattggaaaaggccacaacagcaagtctatttccaaagacaattaaacacacagaaccaacaatg

SEQ ID NO: 106008 - DNA, 573 bp, Heterodera glycines
  Promoter: Source sequence=SeqID_1706; Location=5448..6020; Strand=+; Gene=SeqID_75422
tttcctaatgaggtcttaaatttttaccgaccttttctctttattttgcgctgctaattatcattaaatagttcagtgataatcgtttttcagtcaatgcgccctttggcggatctaaaaataaggaaccaaaagaggcgagtttttgacccccttcgcccgcacaaccgaataaaagttggttttttagggatccgcgcaccaggcggcttgagtggagggtccccccccccccacgggtgagtgattaatttgtagaataaaatttcttttctcattttcagatgattcggaccaggaggagaagcacggacaaaaggaggagaaggccacaaaaagagaggcaaattttcgaaaaaaataagacgactcgatttaaaattttacgcgatgaattttattgaatttttaaaccgcacattcgtcaactttggccgcatatttcactcaccgcaacagactcagcgaaatcaaaggctgcttgctcatgggcgactgagtcgtgatcccagccaaactacgacagcgcatcctcaccacactacatttcacccatcctggaattgtcgaatg

SEQ ID NO: 106009 - DNA, 1003 bp, Heterodera glycines
  Promoter: Source sequence=SeqID_9302; Location=273..1275; Strand=+; Gene=SeqID_70913
ccttagtccgtttgggcatgttctgctggtgtgtttagacggaccttggagtgatcgaattcgtgtctttttttgttgctaattcacttacaacaccaccacccggtgggcgcccgaccgtggcaaataattgcactttttgtttgttgggcagtgcttcttcgttttgtcgcatgcttaaatggccatttttgttgtgactttaattaaattcaattttccaattaatacaaaatattttttaaattttaattcccaatttaattttccgcttttacttatgtgactgagcgatcggtcagcacatctcgccgtatttcttcgtctgttttggatgattccttcagttgataaaataaaagtaattaaaaattggacggtgaaaagcacagaaaaaaacggaattcgcttcatttggataattaactaattaatggatttaaatttcactttcaaacttaagtatgcacacaattaatccttttgtttgtctaattgcctgaagcgattgacgaaaccaatgaaatggacggacggacggacggacggagagaggggagagacacctgagtaaattgcaacattgaagaaaatgaatggtaaatattcacaaaatgtgttaaatgaaataattagtgagcaacaggaaaagaaaaacaataaatgaccagaaaaagtcgaaaaaggaattcattaaaatatattcaattaaaaaattaaattaaattaatatttatttctttgattatttaatttaaaatgccatttcggtcccaaattatgtgccattcattgcccttattcttcttccacattttgttaacgatttgctctgtttgctctgtccctctcccattaatttttcggcaatttccccatttgcctttgggatggatttgtttagcttttcactaatttcgtcaattttaccaaattcattccaataaatcccaaaattcttaaactaatccctcccaaattttattcttttttttcaacgatg

SEQ ID NO: 106010 - DNA, 375 bp, Heterodera glycines
  Promoter: Source sequence=SeqID_28466; Location=298..672; Strand=+; Gene=SeqID_59081
agtaaaataaattatttataatttcaatacttacctaaattattggtttttgcttataaacaaatccaaaaaatttttatttttgaaatattattttgtttccatttaccgaggtgttttcggttgacacacgtttggccaatcccgaattctgaacccataatatttttaatcacttatactatgaagcaggactgtatccagtaaaaagtttcgggggagtgcaccaccgaagagcttttctttttttttttgttctccagaccaaaaaaaaaagattttccggtgtcatttttcaagtttttagcaaaaatacccataattaaaggtaccgtgacataagagggattgacaaacgcttgggcacattaaatg

SEQ ID NO: 106011 - DNA, 285 bp, Heterodera glycines
  Promoter: Source sequence=SeqID_42587; Location=1..285; Strand=+; Gene=SeqID_70442
ttgcggggtccgtcgggggtgtggcattcttacagtatgctctttttaggctctctccgtggaatgagtgatttggtccgttttctgccaaatgccttttctctgcttaaccacagggaatgcctttagacttgtgagtctgcaaatgtttttggctctgtggtcaattcgacttgcgattcggtcgacgcgtccattcgatcgatgtatacggtaggaagggatggggagggtacggtaaggttgagacgcaaaggaatcccatccaatcataaatggaagatg

SEQ ID NO: 106012 - DNA, 346 bp, Heterodera glycines
  Promoter: Source sequence=SeqID_6355; Location=1..346; Strand=+; Gene= SeqID_61252
ttttagtgtatataaagcatattttggggtttcgagaataaatgcatattttgcattttagagcatatttaatgtctaaaacgctgcttagtcatgttttaatttttatacaattttggcattttttgagaaattaaaagcaatttttgcaatttttacggcatattttattgcatatttgggcatttttcgggtttttagggcgtattggagggatctttagtgcatattttatgcattgccattttttagtgcataaacttcgaaccctaataacaatggccatattttatgaataataaaaaaaatttaaataattttttaatttttcttacagaaaaaaatg

SEQ ID NO: 106013 - DNA, 616 bp, Heterodera glycines
  Promoter: Source sequence=SeqID_18596; Location=1..616; Strand=+; Gene=SeqID_83230
cgaaagaaaattatgctgtttgatgacccgggaaaggggggggggggtgaactgaatttaaatggccaactgtgcaggaaattgagcatttagtttccgttaatcaaaatctatggagaatgatagcaagagatggttaaaagccaaagccgcttagagaaaggagggataaagaacaaagagaaacgggatttgggaaaggagaagaaaatatttttattcaaactggaacaaagaacgccataaaaaattaaaatacaactgcaaaaataaaatttacaatgtctacctaatttttcgagagcccgaatccgggaaatgggaaaacgaaaggaaagaacggcatggattgcgaacgggaattccgcttttcccaatccctgtaaaaatctcatccgggcaaaaaggacgggaaacgagagaatgggatttccgggttttccgcgggaatcgcattcccaccgggctctaatttttttcacttttctcttgtgacaatgagaaggagttttaaaattttacaatttttagtaaaaaaatttttatgtttgagatgttggaaaaacctattttgtaccgaaattatctttcttcaatctcttccgctctgctaatg

SEQ ID NO: 106014 - DNA, 119 bp, Heterodera glycines
  misc_feature (82)..(82): n is a, c, g, or t
  Promoter: Source sequence=SeqID_7262; Location=2456..2574; Strand=-; Gene=SeqID_64292
catgatttctgactgatctttcacgggacagcagggctggacgtaattgcggattacggaaattacagcattttttggagtntagggttacgagtttccgtaattgaaaacaagttatg

SEQ ID NO: 106015 - DNA, 263 bp, Heterodera glycines
  misc_feature (5)..(5): n is a, c, g, or t
  Promoter: Source sequence=SeqID_11904; Location=761..1023; Strand=-; Gene=SeqID_75414
tcccntttttctccaaaaaataaatacctggccaagcctttaaaagtgcaaccgaattatggaattccttttttctacaggtgtccaaagttgctgcttcttgggtcgtttcgccaattctttccggctcaatttcctcaattatttacatgtgcatcgattttgctgtgcttagaagggttaatttggacaatgtgattaattaaggcatttaattaatttcattaaagaaaaacccgttcaaatgtggccttcgaacgatg

SEQ ID NO: 106016 - DNA, 1003 bp, Heterodera glycines
  Promoter: Source sequence=SeqID_2338; Location=2322..3324; Strand=-; Gene=SeqID_79205
actaaaaatttatgctattaaaacagcaataatttagttggaaatatttattgaataaaagtaggagcagtaaaaaactgatgtaaatggaaacaattgataatgaactggggaaagaaaaggaggagacattttttgctgattgaaaaggcgaggttaaagaccactggcgagtgtgcattacatataaaaaaaggaaagaaaagaaagtaatcaatttttatccaaaagtactttgctccatattttttattatgcctttctttctcttttaactcactcataaaattcttataaaaaacattaaaaaaaaattttaaaacgaataatttaaatataatatttgacgggaaaatctcataaattattgggactcgcacccacaacaccccatgaccaaaggcaagcacactaaccacttgaccaccgggtcgcttgcgaccatcccttttaattcccttttcattttccttcttttttgggaaaaattccgaccaaaagtgcttgtaatccctttttagggcacttcccggacccggacccaaacaaccctggtatcattcgaaagcccaggctttgtagattggaagaaattgtttcattttttggtttgaccaattttaaggcatgcaaaaagcgttcaaaaatgggacattcaaaaaagtttgattttttgagtcatttttcgaacacagttcgaacagttctaaaccgatcgaaaccgcactatttttcccttatagcccttgaaaaactgcgtcgattgaccccacgctcgacctgtaaaactcgctagaaagtcttaaattagtttttaagcttggatcatgggtatattattcttatatagggaataattttgattccatatacaattgattatttctttgttgttgtattttacaaattatatattgcatatttgctacggaattttttatttatatgtatttatttaatatgattttgcagagacttttaagcatttaaagaagccgacatg

SEQ ID NO: 106017 - DNA, 58 bp, Heterodera glycines
  misc_feature (17)..(17): n is a, c, g, or t
  Promoter: Source sequence=SeqID_21177; Location=1..58; Strand=+; Gene= SeqID_51764
aaaacttttaaaaattntggcaaaaccgacaatgacatagaatttgtttaacattatg

SEQ ID NO: 106018 - DNA, 438 bp, Heterodera glycines
  Promoter: Source sequence=SeqID_10897; Location=323..760; Strand=+; Gene=SeqID_74179
ttttttgaggtgaaatctagaaaaacaaacaaaaaaaacatttttaattggaaaatagttttttagtatttaatatttctcttcctttgcaaagcccggtggcgcaatggaaaacgcgtcagccaacgaagctgaagattccaggttcaactcctggtcgggttgattcttttttaattttaattaaaacgaattaatttgcaattttaaattgttttttaaataaattttctaaataaataaacaaatcccatccaattggattaccccagcatttttctcgcgcgcaatacaaattgttatttttaccccttaaattcagtagacactaaacgctatcttaggcctgagtattttcactaatttaaaaatgccaaaattttttccaaaaattagttcactccgctcaacccaaatgatgatggcaccacgccaatg

SEQ ID NO: 106019 - DNA, 59 bp, Heterodera glycines
  Promoter: Source sequence=SeqID_25463; Location=850..908; Strand=-; Gene=SeqID_56196
ggtcagtgttttcctttgacttttggcaattacatttttcgggcctttgttttcagatg

SEQ ID NO: 106020 - DNA, 1003 bp, Heterodera glycines
  Promoter: Source sequence=SeqID_13059; Location=298..1300; Strand=-; Gene=SeqID_76838
gaatttactgatatgggaacaaattttacaataatccttaaaaacccgaatttacgaatccgtacaattttctatactgacttgcgtttcccgggaaaattggacaacaaaaaaattattatttgatattagaatttttatttcactgaatttttgttgtgtttgatattattgtgaatttgttgtgaaattaaataattgttaattgtggcgttctgtttactattttatatttgattgtattctcattttctaatagggcttccatttttaggcacaaaaaatcgcgaaataggcacctaaaaaggcaaaaaaaatattgcaaaaataggcattaaataggcacaaaaatccccgaataggcactaaaataggcaaataaaaaattttttggtagcaaaacacataaaaattaattttaaaaaaacttatttttttcatttttgttgaatttttattaagaatttttccaaaaatcctgaaaaaggcgccaaaaatggcgaaataggcaaatcggcaaaaagtcctaaataggcaaagtaattgttttcttctctgtcctctaacaaatctgagtttgtttaattttgtgttccatttgaaattatagggattttcccaaattccatacaatttgaccggcaccctttccaattaattaagctcgggaaaatatttttaaaatattggtactcaatttgccataaacttgaccaaaatctttgttgaaaaattagtgaattttttaaattattttatcatttaatgacaattttcgagcaagcaaacaaacaaacaaacatacgtcaatccgttcttccgtaaatcaggtctctctatcagatttgaattacccatagaaagagaaagaatttttaaaaatatttcaaaagatataatgccatgaaaaatatataaattatgaaatgaaaagcatataatatatgtagataaagaaaattaaatttttaataattatgatccaattttaaagaggaaaatg

SEQ ID NO: 106021 - DNA, 1003 bp, Heterodera glycines
  Promoter: Source sequence=SeqID_5128; Location=1626..2628; Strand=-; Gene=SeqID_57015
attttcttcattaataatgtttagcaataaaagaaatattttaatctttgcatcaatacaatttttgtgatttaaattgttcaattttctttttaaatcaatttgaaatatacttttttttaattgaaattaataaaaattatagaattctgtaaataattttcactaaaaaacttgtcatctcattaagtcccacatttgtgttgtggtcagttcattttgataacccaattaatctaatcaatctccgcggctttctcatttttctgaaaaaaatgaaatcggcaatgaagaaacaggctttatcaaatgttatgcaattaataatagcggtgctaataaagatacaaacaaaaagcggccattccaacagcatagaatatcacagggtcacactttttgcgatgtcctggatttgggatgaatgggttcttttttttactggttttatgtgatttgtgatataaatatgttaagctaaaaaaagaatataaaataaatatatttatttacattacataaggctataaacaaaattcaaaaaataaatctattatttttatagataaaaatcaaatcatagaaaaattaattttaaagataaatttgttttttaaattaaaattaatttcgttttattacataaaaaaatatttatttaataattaatttaataatttttttgaaatccagttttttaatattaaaaaatctttttctaattattttaaataattaatatgtcaaatataacgaaacaattatgatcacaataaaatttggtgcgcgctgactttaatggattgcttcaccgttgcacaaatccaactaattagtgcgctaactggttttaatggggctgaaaattttggctataattaacacattaagccacacttttcagtgacaatatttaattgtcattttagcttcacaaattaatatagtgtcttaaaaattattaatttaataatctaaaattactcagtttttttacagtatg

SEQ ID NO: 106022 - DNA, 359 bp, Heterodera glycines
  misc_feature (24)..(24): n is a, c, g, or t
  Promoter: Source sequence=SeqID_24624; Location=1102..1460; Strand=-; Gene=SeqID_55363
ttttgaaaatataaatgatacttnttcaaaaattttttacgagttgccataatgtcgaaaatgccatatttatttattttttaattttctttcatttgggcctttcaaacgccttaccacgcttgaaaagcaaagtcttcaaggcaaagttaaaacaaattaattaggtcataataattgctcttaagatcgtaagtgctgttcgcaatttgtcgatgagcgctgacttgttagaaaaaacgattgtgatttggaattgggataagcttgagaagcagcagcagggccaactgccttcttttacggacattgagcaaataataaaaaaagctcaattacccacttgtaaacttgaaatg

SEQ ID NO: 106023 - DNA, 326 bp, Heterodera glycines
  Promoter: Source sequence=SeqID_6781; Location=52..377; Strand=+; Gene=SeqID_62887
ttggaccagccgaagctaaaaaaatgcagttcagcacgccaaatccatcaccgaagaacaaataaaatcaggcaaatttcagtcaatcacacaaattttcgagcatgtcaaaaagcaaaaagcttccgttgcggagagcttcactgggcccaaaattgcccaaagaagaataatgtgtgcagaaaatgccagaggagcgggcacatcgagcgacagtgtgacaaaattcaggcatatcacaaaaataagaggagccaaaatccaaaagtgaatattgtgatgttgcccgacactttcatcaattccgtcaatcgtcgggtctaatg

SEQ ID NO: 106024 - DNA, 205 bp, Heterodera glycines
  Promoter: Source sequence=SeqID_43554; Location=1..205; Strand=+; Gene=SeqID_71201
ttttgccagtgtagcgcgcgtgcagccccggacatctaagggcatcacagacctgttattgctcaatttcgtgcggctgaacaccgaaaatccctctaagaagttgtgcccacagaagcaatgagccaactatttagtaggctagagtctcgctcgttatcggaataaaccagacaaatcgctccacgaactaagaacggccatg

SEQ ID NO: 106025 - DNA, 1003 bp, Heterodera glycines
  Promoter: Source sequence=SeqID_3266; Location=609..1611; Strand=+; Gene=SeqID_83964
ccgccgaaataacgccagccgaaatcacgcctggacaaaaccacaccattatgaatatttttttaaattttcaaacagaattttttcatgaaaaagctcagaaaattttaagaaaagatttgttgaaaaatttcagaaaaatttagtaatttatcataaaaatccaaaaaaaaatcgcagaaatttttaaaaaattttcttgaaattttcttataaaaaatttcaaagattttttcattaaaaaatttaagttagaaatttaaaaaatttcaagcggcgtgattttgtcccgttccctttcctccattatttgccttaagaggtgttaatctgtgagtgcatggataccattcctattctcatagtacagtacttttttccgctttttacataaaggcatcatcagcaggtgtcgttattgagttttcaatttttctttaaaaattgatcggattttccagaaaaatccatcaaaatttcttgcatatttcaacaaaatttaaatttccctgtggtgatttcggcaccgcctcattcccccatacaaaaaataaataaattatttatggaatccaatcagtgatgggagactggattaattattttataaaaataatttttgataagttttggaaaatttttttatgtcaataatgcgataacatttaaaaccaatttgaattattatatttgtgcaaaataaatatatttttttaaataatcataaaattttgcaaatttcaaaaaataatctgtgactgttaggtctgaagacgtttcttaacaaataatcaggcaatttgtccaccctcttttgccgatttcattttattcaattttggcttcaaaaagaaagaaattaattttgtaattaacaaattaagaacggaaaatgcgttttttataaataacaaaaatattccaaaatattatttttttatttaaatatttttagctttttgtttttattttgttaatttttgctttattcagcgagaaaatg

SEQ ID NO: 106026 - DNA, 486 bp, Heterodera glycines
  Promoter: Source sequence=SeqID_6177; Location=1478..1963; Strand=-; Gene=SeqID_60606
aaacgccaccaagaaaaataaaatgttgagaaaataaaactggtccaggttataattttttttttacaattttaacagtcagttataacaagatggaattccgtgtatcaaatgctcgatgtttttcgtcgccagaaaaaccgttactttcaatggaagcagaacgcactgaatttcatttccttggttcataagcaaagcgttcactgctcgattttgtctctgatcatttaccgccgctaattcagattgattttatatttctgcgccaactttgtcctttgttggagctgtttaacagagaaacggaaagagtaataacaatttatttatatttctcattttaagttttcacgtcaaaagtcaacttgttcttgcattttgccaactctaaaaaggctttttgattttttaaccaaagaagaacatccacaacaaattaggttaattgcgcagagtctcgctgaatctattggctcacgaatg

SEQ ID NO: 106027 - DNA, 458 bp, Heterodera glycines
  Promoter: Source sequence=SeqID_12490; Location=1..458; Strand=+; Gene=SeqID_76126
ccgacatttgataccccccgtttttttaaatgttcggggatatccttagaattaaaacaattagactcacgccgccatatccgccccctgtatcaatcccccccgtatcgtccccccccctcccccaaaattttttaaaacaacgaaatttttaaaaagaatttttaaattttaataaaaatttttgaaaattaaaaaaaaatttagtggggggggagaacagcggtggaatggtaaacgaactgttcgcttcggcacacacaaatcaatttgtcatagaaagattaattttgatggaattgcattcgaataaaaaatttttttgtttggaacttttacgttttaattttggatcatcgacgtggctatccgcgacgcgcaccgccttcacttggctcaatggacagctgatccggattggcttcaaatacacacggcacccattctgcactgccatg

SEQ ID NO: 106028 - DNA, 1003 bp, Heterodera glycines
  Promoter: Source sequence=SeqID_10069; Location=1978..2980; Strand=+; Gene=SeqID_73137
ttgttttacgccaattattttttggcaatttttttcgttttttaccgtccatgttgggggcaagcacaacattgttttaaaattgggaaaaatatattttaaagggttttcgtcaaaaatttcattgttttgttgcccgcttcctctcacttgctctacaacagattagaattgacaaaaattgagtgtgatgaaaaatgctggtcccacaaaagaggcagaaagggggggggggtgggttgagtgatttgtgctgttttcggagggcgttgtgattattttccaacactccgagcaaaagtcgatgtttttgtttgtcaatcaaaatcacatccaaaggcaatcaacaaagcaacgtccattcatatttacctattttgcaatatttgtttacattaccttatgcatattttgttattaaaaaaaagtttttacgtgcattaaacagtattgagttaaatttatataagtaaaaaaaaaaaaaaggtaaaattgttcgaattcgggatttggaattggtctaaatttaggtactttcccattatgtgaccgcaagtcaaaacttttctgcaacaaaagggatacataatccatcaatcgagagtgtgtaattgtggcagtgatatgcgtggtgcgagataagaacagctcaggacaaaagaatcccggtttgacgttgcaacaaatttgcgcgcccctttgttgattttttaaaaattttgccttgcggtcacataatgggaaagtaccgaaatttatgttgtattcataatcagcgcacccgcaaaatttgaaatttccattctctactatccatatttttgttcgaaaaaaaatttgcgcaatttttcagtttttaatattagtaatttgctgtgctctctctctctctttctgttgccaaccataaattcacacacatcatcatatcacaatgagcagccgggacagcgagtttgagctgttgaacgcatttttatgttttgaggatggcacacgaatg

SEQ ID NO: 106029 - DNA, 463 bp, Heterodera glycines
  Promoter: Source sequence=SeqID_7609; Location=385..847; Strand=-; Gene=SeqID_65401
taacttttttctaaaacaatcaattttaattttgtttatataattagatagcccaaagattactctattgttctgctaaatttcaaaaaattttattgaatttcaagaaagctagggtcaaaattgttgagtcaaaatttttcgcacttttttagtcacaactttttgtaaatttttactaattttttgaaaatttcataaatagtagaggatgcttcgagctgtcgctaaatacttaattttattaatttgactaagcttaagctaagttatgattaattacttggaaaataaaattaaaataataattaaatttaattattacaaacacccatatttttgtcgcttcggctcagcacgtttgtcaacaaccaaaattctggaggtcggccaaaacaaaaagcaggaaaaagaatttaaatgccgggcagaaaaagaactgaaaattttaaattttgaaatg

SEQ ID NO: 106030 - DNA, 315 bp, Heterodera glycines
  Promoter: Source sequence=SeqID_12814; Location=600..914; Strand=+; Gene=SeqID_76540
aattatcatattttacattcaaaaatatttttatttccctaaaataaacattgtatattttgagctcaatttatgggttattattattttaaggtgaatgatggactacttactgtttattgactttatcaaagataggattaactcttttaattccaaaacagtgaaagacgtcaattttaatgtgtacttagccttttgtatatgatgaaaagcaattggcattgtgccaatgccaaagcaacaaaaagtgccaatgaatgcgctaaacttggccattacttggaaattttgtatgaatatttgttcagaatg

SEQ ID NO: 106031 - DNA, 236 bp, Heterodera glycines
  Promoter: Source sequence=SeqID_31335; Location=1182..1417; Strand=-; Gene=SeqID_61708
tctcgccgggacaaaatctcgccgcaaaaatataaaaaaaattcaaaaattgaattttttcaaggaaaaaacaacaatttttgtaaattttgaaagtttttatttttaatagaaaacttttggttttgtgtagcattctctgagagattttggtcaaaaactttttgtcaaaaacttattgctcccttttccgctaaattattaattttcataatttcagttggtttgcagcgatg

SEQ ID NO: 106032 - DNA, 208 bp, Heterodera glycines
  Promoter: Source sequence=SeqID_19358; Location=1..208; Strand=+; Gene=SeqID_84090
cagaggggggctctaaatcagggggggcttaccctcaaaaggggggctttatatcagagagtggctctaattcagggggggcttaccctcaaaaggggggctttatttcagaggggggctctaattcagggggggaaaatcccagcctaaagagcataatcagtcaaaatcattttttaaactgaatactcaattaagtcaatttatg

SEQ ID NO: 106033 - DNA, 1003 bp, Heterodera glycines
  misc_feature (22)..(22): n is a, c, g, or t
  Promoter: Source sequence=SeqID_22474; Location=185..1187; Strand=+; Gene=SeqID_53146
aagcagccacagccattcgttntagcgaaaataaattgaatttgcttgggttccattccttttatatgtagttattcttcgagacatttttttttctgttaggtacttcacaaccagggttgtcagatctgaggatttatcctcattttgtggctttttgagaaattttgaggcttttggggaaaatcctcagaatcttttaaattttgataaattgacaaaatgttttacaaatatttaataagtgggtttttaatagagcatcaaaacgaaaatctcacccaaattttccaaaaaatttgctaaattttttataaaaaccaaaaaagaaccaatttttttttccaaaaaatcacaaaattaataattttttaatgaaagtctgctaaaaatatgggcaaaattctcaatttttcccctggcggcgcctatcggcaccgccagcccctaaaagtcctttatttttgttggagatggatgttgatgttggattttaattaatttgaattagcgccatacagtaacagtgatgttcctgtttgtttctccgcgccacatttccagtcattattttccctccgttgttttctccccattcattaattattttattcttaatttttcggttctaaattaaatctgttttgctccttccattttcgtcattcctctgactccgtcgtcatcttttatttatttattgatttcatttgtctttccacaataaatttaattctgttgttccttgtggacacaacattggcgacgcccgagtgcatattttgtgcattaccgtgaacttaccaaaaagctactctgacggccacctcacataacccataacactaaagttattccccatctgaccgcaagcctgaagagtttctcagtatattgactgagtaaagctaagtgtgtgttcggtatttgccaaatattgcaagtggcataaatttaattttatatttgttattgtcactttgaattcattctctctataatg

SEQ ID NO: 106034 - DNA, 1003 bp, Heterodera glycines
  Promoter: Source sequence=SeqID_13958; Location=301..1303; Strand=+; Gene=SeqID_77917
tgaaagtttgcaatgtgtatgctgttgttacggtatgcgtgacgtttgtgaatatactatatgccaaaattaggttactgaaatggagtccaaaaggggacttctagtgaggtttaaatctcttgaccaaattagtttagacgggaaaaaatttctcttccatactgttttttgtttcctctacatacctatcggcaatcgtaaggaatgggggtccctaatttaacttttttattttgggttcaaaaccagtttccgggggttttcgagggcgctgattacgaatctgaactcgaatttgcccaattccgaatcccagacccgaattcgaacaaaaaaatagaaaatttggcgctactgtaaaagtggtcccttttgaaaatttttttcacttttttttcatatatttttattattattttttattacaattatccatccttcctttgacttcgatttatccgagtcatatagtctcaacaattttggcacaacaatttgttttggataagtccgttgtgtgccaaaaattgtaaaatctcttcagtttttggaaaaaagccatctcaaatttatatcgtccaatgttggaaaagcgatgagcggcagattgttgtaatcattagggttgtaaattatatggattaacatattttttctgcgcatatgctataaagaaaggggctcaaaaatagcatttctgcgttaaaattttttggtttgctgaaggtttttagtccatataaatcagggctgcacgcaattacggattacggattgcggattacggaaattacggggtttttagagttacggattacggattacgggttacggatttttgagaattttccgtaattttgatccgtaatttgacttttggattagttttcgagacgatttcttgtaagattattttttataaaaactattttttctattttttatttaaagaaaatatgttcatttctttaaattcttatttctttagcaattaaaaatg

SEQ ID NO: 106035 - DNA, 1003 bp, Heterodera glycines
  Promoter: Source sequence=SeqID_7455; Location=352..1354; Strand=+; Gene=SeqID_64875
cagacccgaatttgaacaaaggttcgaaaattattatcagatttttggttcaaagtgatttaaataatcgtttattaatgagtttcagttgattccgcgtatttagcctaattctgaactaaaaagcaaagtttgaaaaacttgaattttcgaacctttgttcgaatccggttcgggttcgtatttggtcgaaatcgatgtcagaatcggaaattccaaatcaaaaattattcagttaatttgatcaggaagtttttgggatcacctgaaatactgagacaaggttgtttaccttaacacataaaccctttttgcggcacggttttttcaaaaactttgtgggtcaggagctgtctggccgacagacgcgccggagaaatttttgaaaatagattttcaatttgttaacagttttctccaaaaaatgaccatcattgattttttaccgagacaaaattctctgatctggtgtcacatcagcgatacatatgacgtcagatgagtgatttgacggaaattgaaataggcccctggttttttacaataaaattatgtttaaaagttaatttatccaaaaagcctattcattaaaaaaataaaattaattaatattgaagaattgatttattcaatagtgaacaattgattcacccaaaaacaaaaattgattaaaaaatcccgataaaataaataaacataataaataagtattaaatgtctggtcaacatttgtttatgccatttaaaaagcctaagaattgaaaaaattttcataaaaattattctctaaaatattaattttttttcttatatttaatttaagattttccttattcgaaaaaaacgtttatatatttaaattaatatgatggattattttattccaatatttttattattaatcattgccttttctttgcatttacaagtgataatggatccgtaagtttctctgctaattaggtgacaataattaagcatttttttatcaatttgtcagatg

SEQ ID NO: 106036 - DNA, 146 bp, Heterodera glycines
  Promoter: Source sequence=SeqID_8492; Location=2443..2588; Strand=-; Gene=SeqID_68272
tttcgcaccccaaaatggacgtttggtcttttggtgtgtccgatcactgatcactttttcaaatcattcactttccccgcaggaatgttcttttgggagcttctgacacgtcaaagtaattatcaattgcaaaatcaattataatg

SEQ ID NO: 106037 - DNA, 504 bp, Heterodera glycines
  Promoter: Source sequence=SeqID_23884; Location=1006..1509; Strand=-; Gene=SeqID_54573
attgcggactccgagcttttgagattaaaatttttgagcttcggaattcgagcagaagtgccaccaaaatgatgatgacatttgtagaagggaaatcattttaataaaagatgtaaaatattattaaccctaaccaatacaagtttatgctggtatggtatttatatggacaatccgaataaatgtcctggaatggtcccggaattttccggatcatgcaaaccgagcatcacaatatggctaacctattttcgatagtaatattcagcttaaggacacatttttcgtaaaaaaatcaatttagcatcagataatgctgttgataattttaggaaagacgaaaaaatgaattcactttcttttattttttttattaatttccattttatatatctctatgttaatagtgcagattgaatgagaaattatcagaacctagataaataatatatgcttagataaattgaaatttatttaaatcacgaaaaatcctatttcgaaatg

SEQ ID NO: 106038 - DNA, 97 bp, Heterodera glycines
  Promoter: Source sequence=SeqID_27918; Location=1..97; Strand=+; Gene= SeqID_58578
gaatctatatttggatgttcacgctaaaaatccctattttgagtgtttgcccctaaaataatttttttccccttattttggcatttctcttaaaatg

SEQ ID NO: 106039 - DNA, 347 bp, Heterodera glycines
  misc_feature (84)..(84): n is a, c, g, or t
  Promoter: Source sequence=SeqID_7128; Location=1..347; Strand=+; Gene= SeqID_63911
gctttatgttaattgaaaaaggtcaaaaatatttttttattctataggagtggaagagcgaggtttaggggtttaataatggangtggcataagaggtgggaccgcatttcgcattccggcatttttttaatgaaaattccggaaaatgcgtgaatttttattttttcatcaaagcttaaaaatatccttttttacactaaatctgtcaaaaactcaatctaagttcaaagaatttccacggtgaaatttggaaaacctactcagcacatgggtagatggatgcttgttttttaataatttaatatgttatttctttaattttttcatttagttatctcaaccaatg

SEQ ID NO: 106040 - DNA, 928 bp, Heterodera glycines
  misc_feature (25)..(25): n is a, c, g, or t
  Promoter: Source sequence=SeqID_42834; Location=1..928; Strand=+; Gene=SeqID_70644
aggcaacttggttggtaccaagttntgcggtaaaaaaatgagaaaaaagagatagccattttttggtcaagaattttttttgtttgcgtttcaaatatcgtaagattgtttgatagggccagacaagagaaggcaactgttggtaccaagtttgcggtaaaaaaatgagaaaaaagagatagctattttttggtcaagaattttttttgtttgcgtttcaaatatcgtaagattgtttgatagggccagacaagagaaggcaactgttggtaccaagtttgcggtaaaaaaatgagaaaaaagagatagccattttttggtcaagaattttttttgtttgcgtttcaaatatcgtaagattgtttgatagggccagacaagagaaggcaactgttggtaccaagtttgcggtaaaaaaatgagaaaaaagagatagctattttttggtcaagaattttttttgtttgcgtttcaaatatcgtaagattgtttgatagggccagacaagagaaggcaactgttggtaccaagtttgcggtaaaaaaatgacaaaaaagagatagctattttttggtcaagaattttttttgtttgcgtttcaaatatcgtaagattgtttgatagggccagacaagagaaggcaactgttgttaccaagtttgcggtaaaaaaatgagaaaaaagagatagctattttttggtcaagaattttttttgtttgcgtttcaaatatcgtaagattgtttgatagggccagacaagagaaggcaactgttggtaccaagtttgcggtaaaaaaatgagaaaaaagagatagctattttttggtcaagaattttttttgtttgcgtttcaaatatcgtaagattgtttgatagggccagacaagagaaggcaactgttggtaccaagtttgcggtaaaaaatg

SEQ ID NO: 106041 - DNA, 391 bp, Heterodera glycines
  Promoter: Source sequence=SeqID_25783; Location=414..804; Strand=-; Gene=SeqID_56522
atgaatattattatgatggtaaattgtaacaaaagtcaattaataaattattttatattttttcttaaaagttcgcattccgtccaattttgttgaacaatgactccgccgccattttttgttttactttaaaatttctgtcaatcaaatgcaaaagtgagaaacattttgttttaacgaatatgcacaatttgtaaccaaatcataaagtcaagaaaaaaaattaaggaaaattgtcataattggggagggggttgtcaatcttaactgtggaaggacggaaacgcacgaaaaaaaccttttacctgcttggtttgttattttagaatgaaattccatatgattttgtatattttggaacatttttcgcgatttatatgcataattaatg

SEQ ID NO: 106042 - DNA, 516 bp, Heterodera glycines
  Promoter: Source sequence=SeqID_13396; Location=1..516; Strand=+; Gene=SeqID_47124
ttattttggtggttttttgggaaaatttaacaaaaaaccacaaaaagcctcaaaatttctagaaaaaaccacaaaaagcctcattttgaaaatttagcctcattggcctatcaaaaaaccacaaaatgaggctaaagcctcagatctgcgaaccctgtatttacctaactttaattgtaagatacggtttaacataacttcttaactcattgtcagccagaattaaactcctttcacgaacatttgattttcagaaattgttgcactaattgctaattattatggccacaaaagcttttcagcatccaaaggatcaactccttgatgagcaatgcaaatatcttttcaggttacttttttgttaatttctcaacaaattgttagccaatttcgtttagaatgtccaacgaaatgaaagatgatgagcagcgattcaattttgtccacgggtagggtgttgcattggagggacatttaaagaaatttaaaacaggcacatttccgccgtcgaggatg

SEQ ID NO: 106043 - DNA, 155 bp, Heterodera glycines
  Promoter: Source sequence=SeqID_2099; Location=1..155; Strand=+; Gene= SeqID_77839
gcataaagttatcgaacagcaccaagaatgcttaatttgtttgataatgaacaaagtgatggtccaaaaagtcttccgttgacgttttggtcggcagcgttttggggtgcaaccagcggcggggggggggggggggggtctaagtgatacagatg

SEQ ID NO: 106044 - DNA, 571 bp, Heterodera glycines
  Promoter: Source sequence=SeqID_20483; Location=1..571; Strand=+; Gene=SeqID_51022
aaatcggtagagatttttgttctctttctgataggccttctcattttttactgaaaaattttggcaaccccctaggaatctttgttctaaaatttcccagatttcaatccatatgggggggggaggttgattggtgcatgacacattttctcgaggacaaaagagttatcggtgtagtttttgggtatttgttagtgcattaattaatgtttcttttagcgtaaataactcttttttgccggcattcatttttgagaaaaccggggttttttttttaaatttttgttccattacttttgcacctgactgtaaatctcaattgaaatttaaatattttcgtctgtcatgtcgggggtcgggtcggggaataggtcccaaaaatgtcgggggtcggggggctcggggttcggggcttaacccctttttttaaggaccaacgctcctcggccccgtataatttgtttggataaaataaatttataaaaatcataaaaagggtattgagtttcactcaccgaagggaattgaattcgccggtcaaaaacttgcactaattcaggccaataaaatg

SEQ ID NO: 106045 - DNA, 110 bp, Heterodera glycines; identical to SEQ ID NO: 99093
  Promoter: Source sequence=SeqID_32520; Location=938..1047; Strand=+; Gene=SeqID_62826

SEQ ID NO: 106046 - DNA, 68 bp, Heterodera glycines
  Promoter: Source sequence=SeqID_2761; Location=1..68; Strand=+; Gene =SeqID_81460
cgctttttcaaaagaattccggaccagtgatccttttccccgagggctactgcaccaacaattccatg

SEQ ID NO: 106047 - DNA, 70 bp, Heterodera glycines
  Promoter: Source sequence=SeqID_15535; Location=1403..1472; Strand=-; Gene=SeqID_79814
atttttttagattttggtaaaaaaaatttaaattttttcgtggtgcgacaaaataaaatgacctgctatg

SEQ ID NO: 106048 - DNA, 1003 bp, Heterodera glycines
  Promoter: Source sequence=SeqID_23552; Location=393..1395; Strand=+; Gene=SeqID_54243
aaaattggataaacaataatttttgtttataatcgcattttatttgaaattttaattattttctttctttttcttcgcctttctctttgggcattcattaatttgctccaagtgaaaaagtaataattctataagaataaaaattctatcctttacctattcttttgctcttcttccatttttgggtcatcgttttgccgtgattaatttttgctttgcccccataaatgggcgaacaaagtccgtaggagataaattcaaacatacataattatttaggaaatctccaaaacttttttacttttcaaaccctaagcactctgggtcatacaataatttccaattgaataaatttaattaaagagtaatcaaataaaattgttgttgacttcaaccaattcgatggacagcagcgatttgaaaccagcagaaaaaagtggtgaaataaacggttaacagataaaaccatttaatttataaataaattaataaaaaaatgaaattatgatcattagggcggggaatatatggaaatccatctttttttcctggactgtcggggttcatatttgtccatattttggcatttttccaaaaaacctctattagaaaggccccatcaggtaaattggcctttttgactcctaaagaccgaaaatttccgaaaaagatatttttagcaaaattttggcgaaaatattgattaaatttaattttattaaaaattggttaatttatgtcaaaaataagcaaaaaagcttaaatttcgcttttcaggttgatttttcgctataatgagtaaacttaagctgtatcgtgttttttcttctaaaatgatttttaataccatattttgccatttttaaaagggttattttgcgtttagcgaatttgaagaaatttgagaaattataccctcaaattggaaaaatttatgttcaatttttgccattttatgtccatatttcgctatttttggtccatataagtcaccgccctaatg

SEQ ID NO: 106049 - DNA, 147 bp, Heterodera glycines
  Promoter: Source sequence=SeqID_13710; Location=3725..3871; Strand=-; Gene=SeqID_77633
aataataataattattaataataatgataattatgtgtatataaatgccgtggtcatcccacggaaggcattcattcttccgacttccttccctctccttggccattattcattcatattctttcttcctccaattgtcataaaatg

SEQ ID NO: 106050 - DNA, 241 bp, Heterodera glycines
  Promoter: Source sequence=SeqID_28885; Location=278..518; Strand=+; Gene=SeqID_59457
accaaattttggcaatcgttgaaatttgtgcaaatatattgagttttagttttaaactaacgaacaaacaaaaaagaaggttggcacaatacgccgatttttatagagaaattgccaaatctcgttcagagaaaacggcaagaaaaaggatacaacaggggagtggtatagccctgggagctgtcttggtcccggtactgagtgttttagcccaacatttattagaaaaaataacatcatg

SEQ ID NO: 106051 - DNA, 88 bp, Heterodera glycines
  Promoter: Source sequence=SeqID_45112; Location=585..672; Strand=-; Gene=SeqID_72479
taattagttgttgattacttacgaaagcaattaaattatcccttttcccgtccgacaaattgtgaaattaaaaaaacaaaaataaatg

SEQ ID NO: 106052 - DNA, 88 bp, Heterodera glycines
  Promoter: Source sequence=SeqID_26776; Location=1..88; Strand=+; Gene= SeqID_57536
ccccttttcggccgatccctgtggaaattacgaagccctaacccaccaattcttcgaccacatttacgaacataaccatgacaaaatg

SEQ ID NO: 106053 - DNA, 861 bp, Heterodera glycines
  Promoter: Source sequence=SeqID_21677; Location=1278..2138; Strand=-; Gene=SeqID_52287
taaaaaatgtttcaaaaataatgttgacgatataaaatctcttaattttaaaatggtcgtagattttcaaaaatactctgattattttgtagaattttcaagtttctaaaaccgatacaaaaatgatttttcctattccttgaatgactagcggtgtccttaaattatttcgtgcttgaaaatcttagaaaagtatatttaaaacttgaaagaattaaccgcactaaccctattaatttataaggtaaactgatttcaaggactgtacttgagattcgaggctgaatatttgtagtattaaaatttttatcattatcaaaacgccaaaaaaatatactaaaaaaacattctaagcttaaaaatgtgtaaatatttttaatggatctaaattaaatattccaatgttcgctgtgaccagggttgccgttcaaagcttttatgccatattatttctgcttttgctatcattttgtgtgctctgcgctttatataatattaataattattattatttattattataattgttaaatatttaaataattcataaacgatgggaggttaatgatttaaacgaaactgaaatgcccttaatggcactctgaaacttttttgtaaaaaaaatacaattttatttttcataattttctctcttttcaaaaaattttaaatacatacatagtttcgcttcaaatcgacactcgaaagcattgaaaattttaatgattatgaaattggtacaacaaaatgaatcaattaaaaaaaattttctgaaactttctttaaatccttccctggctatatacaattatattattattattattacttatttatatgttagcattgatgtgacttatg

SEQ ID NO: 106054 - DNA, 989 bp, Heterodera glycines
  misc_feature (80)..(80): n is a, c, g, or t
  misc_feature (89)..(89): n is a, c, g, or t
  misc_feature (157)..(157): n is a, c, g, or t
  Promoter: Source sequence=SeqID_25890; Location=954..1942; Strand=-; Gene=SeqID_56664
tttttaggtagcaaaacacataaaactttccttattttttttgataatatttcatttgtaaatgaaattattaaatgttntaaattatntagaataaggacaaattttcaaaacaaaaattcttgtaagaaaaaaaaaaaataaatttataaatttntaagcaaaaataggcattagaaaagtcatcgtagacacctccaaaccaagctgaaaaagcgtttttcgtgcttctcagtgcgtattaattgcgcagaaaatttaggcatttgcccaaaaaaaggaacccctaatataataattatatgacaaaactgtaatgtttattaaacattaattggtgaaatttttgaaatacttatagttccataaaaataatttaatttatttatttaatcttcggtcatttttggcaaaattgttccaattttcttagtttctcatccatttaatttcgcattacatattctttcccaaattgtttcttccaattgaaaatgctattttgatgaattttcaatatttttccaatttccttttcactcattttcggcttttctccttttatttgccaatacattttcattttctccattttttctttttccgttataaattttcggctaattccaaattgcttcttccatttactaattgttttaaggctaactccgattttcttacaaatttcttcataattttgttgccattcttttctggaatattttattcctttttgtttaaattcatttgacatttcaatgaattttcgaataatttcaaatttttgttcgtcagtttttaattttgaatgatttattttttgatttactcccaattctttgatccattcataaatataattgcgatttgtgcccaatttttttgctatttttccttcaattttactccgttcttttgctgaatattagcggggtcagcgccttcggcgcatcccccgctaggtagtacgattgtattgtaagattatg

SEQ ID NO: 106055 - DNA, 214 bp, Heterodera glycines
  Promoter: Source sequence=SeqID_8344; Location=494..707; Strand=+; Gene=SeqID_67745
ttccgattttccactccccgtgctccccgagattgtcagcgtgaacgggtgtctgaattgcaaatgtttttcatcaaatttttgaaaattgtcagccatttgtttaatttcataaattgtttcaaaatacctacattttctattttatatatacatataataaaaaataagtgtgtgtgtttagatcattcttaaattgttcaaacaccaaatg

SEQ ID NO: 106056 - DNA, 737 bp, Heterodera glycines
  Promoter: Source sequence=SeqID_26957; Location=685..1421; Strand=-; Gene=SeqID_57697
taaaaacgtccatctcatttttcgtcgatgaactttctaagccccaattggagtattagctttattttttcaattttcctggcctcacctcgccctatgggcaccaccggacgccaatcctttaaaaaattcaaagtcaaaaaaatgcaattccggcggtgcctatcgccactgccggactcttttattttaaaacacttagaaaaattaacatcctaaagccacatccgcttttccagctactaggatctcccttctcagtttgaggatacaatttaaaaaataagtttcttagtttttgttgagttgggaattttgtaattaaatttaaaacagttttacttttacttactttaatgaatatttaaaaaaataatgaaaataattttattctgtgtgggggtcagtcgaaccaagtcaaaaatcaaaaaacgattggagcttcagctacaaggctaatgtttcttgttgtttactattttaaaagaaatgattaaattattatttattttcaaataaattttctttttctgccaatttaaaaaaatattttctctcaacaattcacccaattgaaaaaccaattggatattttcattgctttggaaaaacctgcataggatacgtattgatttttacgtgtaaaatcgcgaaaataaattatgttattgcatttttgcctaggggtattcacaattcattcaaaaatatatatttaaaaaattaaaataaaaatg

SEQ ID NO: 106057 - DNA, 91 bp, Heterodera glycines
  Promoter: Source sequence=SeqID_5634; Location=779..869; Strand=+; Gene=SeqID_58719
gaagataatccagatttgtttgtcgtgaattttgttaagaaactgataaaaagtatttaaggaatttttcattaactcatttataaaaatg

SEQ ID NO: 106058 - DNA, 116 bp, Heterodera glycines
  misc_feature (3)..(3): n is a, c, g, or t
  Promoter: Source sequence=SeqID_31650; Location=184..299; Strand=+; Gene=SeqID_61966
ttntaatgaatgtcaattttgaagacaaaaagcaattatattattttatctaattcaatcaaaacataaataagttatttaataatatatttagataattttcagttaaaaaaatg

SEQ ID NO: 106059 - DNA, 60 bp, Heterodera glycines
  misc_feature (48)..(48): n is a, c, g, or t
  Promoter: Source sequence=SeqID_25050; Location=2050..2109; Strand=-; Gene=SeqID_55783
cagttagtcagcgtccagtcggtggtgcccagtggtaccggaccgccncaagtgcccatg

SEQ ID NO: 106060 - DNA, 477 bp, Heterodera glycines
  Promoter: Source sequence=SeqID_7733; Location=124..600; Strand=+; Gene=SeqID_65773
tatttttgctaaatggccataaattgataattcagtgaatgaatgatggctgagtgaatgttcttcgcctgtttcctgaattggctatcgattttgtcctttttctgccatttgcttcttttgcggccacaaatcgcttttggtccgatcactctgtcccatcgattcgttttctcccccgagggaatatgcgtgggttttgagcttcgccccccgggcatttcatgcgatggaatccccgacaaatgttcgctccctcccattcggcctttgtccttctctttcccatttcctttgccatcccttcgattgttttggctttcccttttttgccaaattcgttcaaaaaatgcctttggtctttcccccccggcgtcgtttaataacattcattctttaaaatacgcataaaaatatatcattagtaggtcattccgaagaaggttaatccaccgtcggcagctgaagtgaaaaatg

SEQ ID NO: 106061 - DNA, 54 bp, Heterodera glycines
  Promoter: Source sequence=SeqID_17941; Location=1394..1447; Strand=-; Gene=SeqID_82497
aatttccaagaaaaaattaattaaaaattcatttaattgttttagtgcaacatg

SEQ ID NO: 106062 - DNA, 196 bp, Heterodera glycines
  Promoter: Source sequence=SeqID_1226; Location=3077..3272; Strand=-; Gene=SeqID_46701
attctattttatttttcatagaagtatataattatctttaatttatgagttgtttgatacaattttttcttaaaaaaattgaattaaatttttttttttactaaaagaatttaatattttgatttgttatgttatttttgagttcttctaatgtcaaatagttccaaaatttcagtttttttttgaattttaaatg

SEQ ID NO: 106063 - DNA, 156 bp, Heterodera glycines
  Promoter: Source sequence=SeqID_29028; Location=292..447; Strand=-; Gene=SeqID_59598
agtgaatttgttagaccagagaatttcaataattattggcacttattctttccctgttaaataaaattttttcattttttccctttcattattttttgttcattccattattatttattcgagttttttttctttattaatttttcagttaaaatg

SEQ ID NO: 106064 - DNA, 127 bp, Heterodera glycines
  Promoter: Source sequence=SeqID_17583; Location=1009..1135; Strand=-; Gene=SeqID_82092
taatgagggtgttttttttagataaaattatataaatgtggaacgaaaaaataaaaatgaatgaaaattaaaaaaaatcccaaacattttataggcatttttccgactgtccgctcacctcgcgatg

SEQ ID NO: 106065 - DNA, 623 bp, Heterodera glycines
  Promoter: Source sequence=SeqID_17277; Location=1..623; Strand=+; Gene=SeqID_81747
aggcattcatttcagcaaatcagattaaaccttaattctttttctcataataaaataaaattaattaaaaatatttttaatacaatttatattacggtagtcttaattaaaataataatttaataaattcagcaaaataataataagctaaagcaattctgatttcccgaacgaggtgaacgactgaaaatcagcacaacaaattggtggagtcaaaaacggagctcgggaaattgtccgaaagtttgtggaccaacggaagtggaacgaacggactgaaaacaaagccaaattgggttgtcatctgtgcattggaaaagtgccgagactgtgaagtcggttggtcttgacttttcgaaatttttgaatgtaaataaaataaattaaacatcggaaaatcttaaaatcaaataagattaaagaacaaggcaaaactaaataaaattaaaattaaattagacaacaaatataaataatacaaaattaaacagtcaaatatcccggattatttaactaaaagatttgttgaaaaaagtgaaggtgatagggaaagggaaagaagggcacaagaaagagaaagaagaaaaaagggtcaagaaatagaagaattaaatcgaaaaatg

SEQ ID NO: 106066 - DNA, 426 bp, Heterodera glycines
  Promoter: Source sequence=SeqID_1618; Location=881..1306; Strand=+; Gene=SeqID_74865
aaatataaataaataaaaatgaaaaatattattatataatgttaaaatgaataacaccaatacaacaaaacccaacatacaaattttgaattccccagaagagcctaatgaaactcttttacatgtactactttttcgcattatcttcttgcatttccggtgtttttgcttatttggttcgttttaattcggtggcttaaaagtcacggtcacttaacgcccagcgaggcagagacagtaatgcatgagatgaaaaatatcccccgacacccaccaatatttttcgcaacaaaatgatgcaagattagagaaaactgacagtgaactctctctctctcttcagtatgaccaaatcgataatgagtcatgctggcggaggattctcaaagcgactcattttttttcatctttcattttacaaaaatg

SEQ ID NO: 106067 - DNA, 1003 bp, Heterodera glycines
  Promoter: Source sequence=SeqID_6080; Location=1384..2386; Strand=+; Gene=SeqID_60242
tctttaatgctattttgttaactaaattgcttaaatttcaaaaaatttacggaataatatatatttttaaatttttaattaaatctccctgatcaaacgagctgaatagcctcacaattattaaatcgccggtttcaaattgttacatatgtatatcgatataaatataaaattagcagtaaacagaacctcattccaaaaatactttaaataaatttattataaaataatttttttaaatatttattctacttaaaaaatattcttttctttgctttgtttgattgtagtggcttgaaacacattttaaagttcctgctgcggaccggaaaaacggtgcaaaaaattgtttttatttttttaaaccaaaattcattcttttgtacaattatagcctaccgaattcagatgattataaaaagaaaattttcgcgaaatgttcgggttttcgacctcaaaatctgattttttgagcccggtgttcttttgaataatttttgatggccgtcatagctttaatttcaaaatggacgtattcacatgccatgtgaatgtagattagcaaaaaaacattcgtcttgatatgtgaaattaattcagccaaagctcctaattagaatatgaaaatggtgatgaatttattaagcctttttacattaaatattttgccaaattgtttaataattgctcattttgattttgctcactatcacagaagtgccttactgaattaatttcgtattttatgatttcattttctttagcttcacttttctcctctatgtatgaagagattgcgatcatatttatagtcaaaaatttaatcaatttattttgtattaaattcggttaaaattacacaaattcttttatttttcttatttcttttaaaaaagactccatccaaacaatcttaaacatttttcgtaagccgaatcaaatttaagaaactcatgtaaacttttcactcatattaattctcttattaatcttgcaaaaaatg

SEQ ID NO: 106068 - DNA, 1003 bp, Heterodera glycines
  Promoter: Source sequence=SeqID_18190; Location=999..2001; Strand=+; Gene=SeqID_82778
aatcaaataccaatttttcttttttaatttaataatttaatttaaattcaaattgtaatttagttttaaaaccaatacctgaactaacagttcaatttcgcattttttgcgtgctcccgccgcctccaataaagtatcgtcaagtttatcgtcatacgcatttttttcaacattctttttccgtttactcaagaatattttgttcaacccctttttcctgttttcatttttgtattgcgaagaaacacttatttgctgaattatacaatttcgaaaatatttttcacaaaatgacccataacttaatttttctcaatttagaaaattgttatgaggcgaacttatgaaaatccagaattaaaagcccttttattttgttaacattaaaaacccaatataaattttatttaagtgaagtattttttaaatttttatttctattttatttaattatttttattttattttttaatttatgaccagcatacttaaacaatggacatttggacgaaataaattaaaaataaattaactaataaataatttaaataaaaatactaaaaaaaattccattaatttgctgatattattttgaaaattttaatcaaaaataatgaaaattccattaatttgctgatattgttttgaaaatatttgtcataccattgttgatttgaattattttggcgttttgttttagtttttgtgaccctttattttattttgttttgtttggggtatgtgtgatatatgtgctcttcctaaatttgtaattgattgctgtgtgctgttttattaattggaagtaaaagaaagcagtgaaaagagacggcgatttggttttggatttgggatacaattcccctttcccattggactattctttttcctacgacgaaacaaaaacttttattttgctaatttttatgctcctttccggaagcctctctaattacataatttacatgagtaaaacaggaaaatcaagaaaagttttatcatg

SEQ ID NO: 106069 - DNA, 61 bp, Heterodera glycines
  Promoter: Source sequence=SeqID_44431; Location=1..61; Strand=+; Gene= SeqID_71920
tgccatttttcgtcaatattttccgatttgaatatctccttagtgaaaaaatttgattatg

SEQ ID NO: 106070 - DNA, 77 bp, Heterodera glycines
  Promoter: Source sequence=SeqID_6614; Location=1..77; Strand=+; Gene =SeqID_62209
atttggatgattgtattatcggttcgatgacagaggactaacacttaaaagacatcgaaacatttctgaaaacgatg

SEQ ID NO: 106071 - DNA, 985 bp, Heterodera glycines
  Promoter: Source sequence=SeqID_14666; Location=1..985; Strand=+; Gene=SeqID_78767
tgttcattcccaaaagtcaaaattattagctgcgaggcgatactgtattgatctaagatggcttataatctgttcgttaaattgctgctttgtttgaatcgcctgcggcttcttttgaccaaatttgttttatggttaataaattaaataattattaacttttttaaatttttttttgttaggtgttgatgggttgccaaaacgaattcagaaagaagaaaagcaacttgcactgttgcttttgtatgcatcacacaactttggcaaattgaaattgtttaaatgcgattactactgacttatagcgtagaatattttgatattaatcacttatatataagtatttggatatattttattttttaaacttatttggatatttttattttttaaagtcatttatttgtttcacttaaattgtagttcatattgttaaatttatttttttaattcactaaattatccgcaaatgtcggctaaccccgaaaacatgtctagccaacaaaatagtctgcataagagtgtcgaataaacaccagcagagacgggaaaattcaaaaatgagttagtttcctttgagaaatttctacttatttatgaaaataaaaaaataataaattgtttttcgataatttttaatgtccgtttttgttaatgctgtttttaaaaacaggcgagacggatgccccagtcacgtgtaaccaaaattgaaaaaaaaacaatttctgcagcatggagcaaaatgtgcagttgtttttttaaaagaaaattgaataaaaatattttcttatttgaattttgttatttaaaaaatattatatataagccaatttaaattggctatttcatcatttcccttaaactattatataaaccataaaaaattccattttcatcaaacattattaaaaaattaaaaaatttaatgcattttttcttctttgcccttgtttatttttatttgttgggaatcgaacaaataatg

SEQ ID NO: 106072 - DNA, 531 bp, Heterodera glycines
  Promoter: Source sequence=SeqID_29200; Location=1..531; Strand=+; Gene=SeqID_59734
actcactgatctggttcatttttcgtcttgatcaaaattcttttccttcattatacactttttcgttccatgacgcctgatcaggttcactctcctcactgatcaatttgtccatttcctccctaaacacagcatccatttcccctgatcagaatgtccttatactcaatgatcagattcattatttcgccctgatcaatatgtcctttgtcttcatgataaacaaacgtcccgccgttccctgatcaggtttactttcctcactgatccctaatcactttgtgcatttacttttgatcagaatgtcattatactcattcatttacctcactgatcactccttttccttttctgttgttttcctctgatcagtgcatacttttgtattttctttattattttgtttcatttttttcttgattatttcgcccgttttcctgtgattaattatcattttctttgttcagaagttctttttttcagaacatttgacgatttattttcttacaaccaatacatatttcgaagatg

SEQ ID NO: 106073 - DNA, 283 bp, Heterodera glycines
  Promoter: Source sequence=SeqID_17187; Location=428..710; Strand=+; Gene=SeqID_81636
gaatgcacaagggggaaacgaacttcttgttgaatcatttccgccttcgcgttttgagcaaattcgtaaagacgaatttagcaaggagcaaaaagcagtctttgcgaagctacaaaaacaagataagcatcacaaaaagcacatttgagaatgaatgacggttttatcaaaatcattgtaattatatttaactaaatgattcaatgttctgaaaataccttctcccatttcacttccgtcgctaatgcgcgcgcttcaaaaacatttgacgatcaaaaacatg

SEQ ID NO: 106074 - DNA, 179 bp, Heterodera glycines
  Promoter: Source sequence=SeqID_35761; Location=1..179; Strand=+; Gene=SeqID_65240
ttggcagaattgaatgtcaaattcgtgttcagcaacccagaaaatccccaaaaaaatgggctttatgaactttaaaaaaattcgaaaaaggggagggcgtaccatcaaatcaataccaagaaatattcgaaaatttgccgcattcagatggctacgagtatgtgatctcccgtgacatg

SEQ ID NO: 106075 - DNA, 67 bp, Heterodera glycines
  Promoter: Source sequence=SeqID_40524; Location=966..1032; Strand=-; Gene=SeqID_68830
tttccaaaaaattattcctttaatttgaaggggaaccattgttgcggcgggcggtggccaatcaatg

SEQ ID NO: 106076 - DNA, 263 bp, Heterodera glycines
  Promoter: Source sequence=SeqID_24065; Location=1989..2251; Strand=-; Gene=SeqID_54763
ttgtcagattaaacaatgatttgaattaatttctcatctttattttacatttcacgtaatttttttttatcatggtcgtccttaacgcgtttttgtcaacatttagatgccaaaaaactttaattagcattattgttttaattcataatacaaaataaattctgagaataataaatacactgattaataagacaattaaaatttaattgctctgtcaggcaccttcaaattaatggcatttaaaatttctcggtgcccaaatg

SEQ ID NO: 106077 - DNA, 581 bp, Heterodera glycines
  Promoter: Source sequence=SeqID_10844; Location=1016..1596; Strand=-; Gene=SeqID_74115
tttacttcgttctcatcatcattttccatcgccgctaaatcaaaaattcctttggtctcctcaatttttattattatttttttaatgaaaaaggttcccaaattataaatttgtctgatcttcgttctcttaatcagaataacaaaaatttctgccgttcgcttttctccccacaaactgcttaattagccaattagtgatgcttttcctccgtttcccttttgctcgtccgccgttgttctgctaataatgcgtcatttctcgtaggaaaaaggaacaaagatacataaaaatatgctatgctttggattttctgtgctttttgcttcaaatccggcaattcgttcgatgcaaatcgttcatttccactgaatgccccgggggagcaaaaggataaaaggatggagtttggcgggcgatgtgcattgattgtggggattttgtggggaactcgttcagaagcggacaatttttaaccttcccattgactaaccgcaggcttcggtttcgtttgtcacaattttgtatttcagcagccttttaaacccccaattttctttcgtttttcctttggcacaatg

SEQ ID NO: 106078 - DNA, 95 bp, Heterodera glycines
  Promoter: Source sequence=SeqID_18636; Location=726..820; Strand=+; Gene=SeqID_83291
ggttttgccgcctccctcccaaatttagcattaattttacaaaatatttccaaggctatggccacattgtgccaagaacgccggaaggcaaaatg

SEQ ID NO: 106079 - DNA, 59 bp, Heterodera glycines
  Promoter: Source sequence=SeqID_8424; Location=1714..1772; Strand=-; Gene=SeqID_68014
atataataaatttaattttaaacaattattcataaaaattctagctaaaaccaattatg

SEQ ID NO: 106080 - DNA, 496 bp, Heterodera glycines
  Promoter: Source sequence=SeqID_2961; Location=1..496; Strand=+; Gene= SeqID_82513
ttttatgttgctgatttaaataaaagtgaatgtccgcgtcttggaaatattgtgagggacagcagtgaataggctccgaccccaaaccagcataagttttgcacgacaactataaattaaaaaataagaatgccgtcaatttttaacgggtatttggccggatgaattttaaaaattttaattaatttatttaaagtaaatttatcataagccttttattcgctttcatttaagcaaaagtcaaaaattaaaaaaaataaataaatcaaaaactaatatagtttaataataaaaaaaaaatctaaattaaatttaacttcattattttcaattaattcaacaattctctttaattcaaatgaccgaattttatggtacaccaaaattaataattcttaatttgaagccagaagaatttaataattaaactttaattcaaaataattgtaagaaaatatgaaaaaatgtctatttttgagaaaaattcagggaaatg

SEQ ID NO: 106081 - DNA, 1003 bp, Heterodera glycines
  Promoter: Source sequence=SeqID_5949; Location=340..1342; Strand=+; Gene=SeqID_59766
gggaaaaactgttgctgaacggggggaattcgacgagaaatgagaagaatgaattaatgcccgaggaaggtatgatttttgggtgggatttctcgggagttccttaattgctaattagtgtaagggtgggcgccttttttgtttggttaatggaaaggcggtaagcggaaactgcccataactttcgtctaagtaaccaaattaaacattcttgatatcattcgatagccctaagggttctctctattacttcacctaattttcaaaaatttgatcatgtttggacaaagtttggccaacagtactcaggaaaccaggttatcagaatatattgatcataattttttgaaacttagccaaatttttgaaattttgcaggccagaagaaaacacttagagctatcaaatgatatcaagaaaataaaaatttaaacaataaattttttcattagacataaaataatttttttcttcaaaaaataatttgttagaaccacaaaaattttttgaaattgaagtaagctaatagagaatccttaggatttcgagtgatatcaggaatgtttaattttattgcgtcatttttaagaaattgcttaaaatgaccatttttcttgtattttttttcttgatttcggggcggggggggggggggggaggggttagcccccacctccgccgccttggctacgcccttggtacccttttcaagcaaaatcctgggaccatccctgcaccctcccttccgttcctcactcggtacaacccgaaacatttagggaattctatacctttgctaaagaagaggtcgacattgaatctacaactgcaagcgaccaaaatcaaaatcatcctaatccaatattttttataatatttattagtaccatcattttattatgctggttatgctgctggtacattcaatacaaaaaagggggccaaatttggggccagataatgtgcctaacactactcatcgggttccatcaatttcaaaatg

SEQ ID NO: 106082 - DNA, 520 bp, Heterodera glycines
  misc_feature (32)..(32): n is a, c, g, or t
  Promoter: Source sequence=SeqID_27023; Location=1..520; Strand=+; Gene=SeqID_57754
tctgacataaaattgacaaaaaaggacataantcgtttcaaaattaacggctgaatatgaaagcgcttaaaaaaataaagaaataaatttaaccgtaataatttttcgcgaaaaaaggaactaaaaagcaaaaatttcccacttttttttttgcttatttttcgtaaaatttgttagtttttaagaaaatttcaatttaaatttcgaaaaactgtttttttttgaagattttcggatttttttgggtaaacaggccaattgataatgggaatttagatatatgtagaactacatccttgaataagctaaacatgcttttcgtgcgtctcatggctcccagagcccgcaaaaaatagtgaattctataaaattattttacgcccaactcataaaataaataaataatttctgagacatttttgaaattttattttcctaaattgttgaggacagcagctttttgacggatagtgccgatgaaaaaagcagttttataagcagcgcagaaagtttgctgatg

SEQ ID NO: 106083 - DNA, 799 bp, Heterodera glycines
  Promoter: Source sequence=SeqID_19503; Location=259..1057; Strand=-; Gene=SeqID_84227
attaattttttatttgtttctcggcccaattcccttgcagtcttttgatgaatgaaatatttccgttggatatgcgcggcttcggaaagggcgtcgcgattttggccgtctatggcaccgcttgcgttctcgaccaaatgtttcccgtaaaatttcccattcattggcaattcaaaaaaatttattttcatattttcctcaatctgatcggccaatcgcaaaccttcgtcattttcgctctgatcggactttgtgcgttgtttttctcgtggcgttatttgcccgaaacgcacggcaaatcgttggaggaattggagcagcagttcaaagcgggcgattggaaggaattgaaaaagcgcagaaatttacataaaacattcgacgcaacggaacagccgaaaagagaggtggcggagagcaattaattaattaattgatgatgttcggttaggaaagttataaatgatgattcattttccgaatcggcaaataattatgaagaaaataaaaatgaaaaattttaataaaaataaaagaatggcaaaacaaataaatcttttaactttatgaaatgatcaggaaaaaaataattactttttttttgttacaaatacataactaatgagtgagtgtttcgtgagtttaaaagttttttttttgcattttgctatttgatgcggatttgttactcaaaaattgactaaataaaaaataaatgtgtttattttttaaacattcaaaaaacctacacaattcgtatatcatgttagtgaattgttttatcatttcagtaaaaatg

SEQ ID NO: 106084 - DNA, 113 bp, Heterodera glycines
  Promoter: Source sequence=SeqID_32474; Location=1166..1278; Strand=-; Gene=SeqID_62780
agtattttcctggatttttgtccacttatcctggaaaagcatggaatccattccaaatgctataaacatttttacagaaattggtggacggcaaacgctgtgtgccggccatg

SEQ ID NO: 106085 - DNA, 65 bp, Heterodera glycines
  Promoter: Source sequence=SeqID_599; Location=1..65; Strand=+; Gene =SeqID_57255
cggcacaattaatgagcaatgccgttaaaagcagtgacacccgagctctgctgatgacaacaatg

SEQ ID NO: 106086 - DNA, 393 bp, Heterodera glycines
  Promoter: Source sequence=SeqID_36728; Location=1..393; Strand=+; Gene=SeqID_65981
agtaatggccataccttttggttagaaaaaattttttcaaaaaaaacgccagaaaaaaatgcgggaaaatttcccgcgccagccccggacaaacaccgggtttgggacaaacaccgggggcgacccttgttttcacacaccctcccaaaggtgtgaaaacacatgttttcacacctgggacggttgggacgctccccgtgggataactactgtcatttatctacgttaatcttactggttttgatcacgatttttgaaaaatcttgatcattgcaagaaacatgaatttttttttctaatatcgatcaaaatttcgtttctgaaccaaagtgatttaaattcaatgttttcaaaaagtttctgcataatttttttttattttatagccaaatg

SEQ ID NO: 106087 - DNA, 1003 bp, Heterodera glycines
  Promoter: Source sequence=SeqID_24244; Location=896..1898; Strand=-; Gene=SeqID_54960
tatttttaaaaattgtctcaacatataatatatatatacataaaaatttggtgcagaaatctttttttttttaccaatttctttttttgaaaaaattttggtgttattttgcaaaaaatgcccatagaaaagttaatgctattaaaaccgtgattccttaattatattatttctgtgaaaattttgacttttttttttggaaaaatgccgttttgcctcaataggtttccaaaaggcgcacttcggcacattttacaaaaaaaaatacaaaatatttatgaattctttaatttttttaaacaattattgtcatacaaaatctttttagagttcatttgttcgcatcatatacataatgtatgacaattcgtaaaatcaaaaaaaaaaaaattgccatgtaattatcggcgaaaaacgtgtaaaatatcttaaaattaccatatattattagaaaaaaaagctcatttttgccatgtaaatgtaattatcggtgaacaacgtgtaatttcattaattaataggcatgtgaattgttgaaattacccgaattgttttcattgccatcatttggcattaaaattaattaactgttgaaataataaattgtttgctgaaatgaaaggcagacaaaaaactgataaatatttgacaatctgaaacaaattaaattaaactagtaaatgaactttttattacattctttcaattccaatatttaataaatggcaaattaactcttaattgaataaagtagctattcatttttttcacaattattgtaataaaatacaataaaaagaaagctctcttcattagattgagagaatcgcatatcacatttttactaactaattagaaaatagatatttaaaaataataatttgctccactgatgcaaaagcaattaaaaaataaagaattaatttaaaatgcttttttctaaaatattatacttaaagataaaaactttaaaaattacttacattttttaaccttatttatg

SEQ ID NO: 106088 - DNA, 869 bp, Heterodera glycines
  Promoter: Source sequence=SeqID_44288; Location=1..869; Strand=+; Gene=SeqID_71791
caccccaccaaaagcaaaacgatataaccaaaatataaggaaaaattttttaaaaaattttttctccatcttcctttttgatactaaagcatcggaaggctaaaattaagttgtaaataaaatctgggcgctttaggccttcggggaaaaataccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggctcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggctcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatg

SEQ ID NO: 106089 - DNA, 59 bp, Heterodera glycines
  Promoter: Source sequence=SeqID_12679; Location=1148..1206; Strand=-; Gene=SeqID_76359
tgagttacagttttcgaattccaccaaaattgcatggtaaatcgtcaccacgaaaaatg

SEQ ID NO: 106090 - DNA, 70 bp, Heterodera glycines
  Promoter: Source sequence=SeqID_14910; Location=2855..2924; Strand=-; Gene=SeqID_79072
aaaggacgaggcgaaagaggagtcacccgaagtaatattcccctagagttggcctaagaaactggggatg

SEQ ID NO: 106091 - DNA, 297 bp, Heterodera glycines
  misc_feature (184)..(184): n is a, c, g, or t
  misc_feature (207)..(207): n is a, c, g, or t
  Promoter: Source sequence=SeqID_27195; Location=1..297; Strand=+; Gene=SeqID_57882
aaataaaataaacaaacattaagtctcaaatgagttttccctcactagtgaagattaattttaataaataaaatttattaaatggattatatattagtcagaatattatattaaaatttttaaaatgtgaaagaatttttcgaaaattgctttttttatgcacaatgcttcaccttttctcacngatacaatttgcggatgcaagcncagcaaatgagacagacaaaaatagtagtaaattaatataaaatgtgaaaaaaataaattaaaactaattaattatgaaatttaaaaatg

SEQ ID NO: 106092 - DNA, 156 bp, Heterodera glycines
  Promoter: Source sequence=SeqID_21872; Location=1372..1527; Strand=+; Gene=SeqID_52513
aatgaattgaaaatgggacatcaattataaaagctttaaataaaatttttgaaatcattcaattttttgtgcatttcatttagtgatttttccttcatttctgttcccaaatcccactctcaaagcaattcgttttactctcaaccgtctaacatg

SEQ ID NO: 106093 - DNA, 163 bp, Heterodera glycines
  Promoter: Source sequence=SeqID_6240; Location=1..163; Strand=+; Gene= SeqID_46210
tatttgtattttccgttatttctttattccttaaatgctttaggcaattccattttatttaaatttggcattatggcattctgaaatctttaaaaaaaagtcacccaaatgattggagattttatgttctcatgtgatttgtaagcaaatttttgtgaaaatg

SEQ ID NO: 106094 - DNA, 285 bp, Heterodera glycines
  Promoter: Source sequence=SeqID_9323; Location=637..921; Strand=-; Gene=SeqID_70995
aataaacgtaataaagttttttttaattaaattaatattcatttaatttttattttatttgtttaaggcaaattgaaaattcttacatatggtgaggaaattgaaatatgtgaaaagaagtgaggaaatgaaactaagaaaaatctaacgatgagtgataagaaaattgccgaaaatttgggtgtcaaccgaaccagcttaatcggatggaagaagaagttcggcaccaaaacgtgaaataaaagaatttttcataaaaataatttattagagcacggtagaatg

SEQ ID NO: 106095 - DNA, 124 bp, Heterodera glycines
  Promoter: Source sequence=SeqID_3072; Location=674..797; Strand=-; Gene=SeqID_83078
taccagcgtggaattgaggggaagtcagcatgcaaaaatgttcaacatcttttgtatcaaaatattttttactgaatgagctgtaaattctttcccttgatcagtcaaaattttccatggaatg

SEQ ID NO: 106096 - DNA, 131 bp, Heterodera glycines
  Promoter: Source sequence=SeqID_26364; Location=1604..1734; Strand=-; Gene=SeqID_57099
aaaattcgttgtaaaaatttcctacgatattaaatgtttccaagtcattgggcatttggtatagcattttacagcgggcataatagtgacactgtactgtatataatcaaaaacccaaggaccatcaaatg

SEQ ID NO: 106097 - DNA, 527 bp, Heterodera glycines
  Promoter: Source sequence=SeqID_266; Location=4344..4870; Strand=+; Gene=SeqID_80659
tccctgatacatacggaggaatgattgaaaaaggcgaagccgaccggtttaaatggtgctaggtcattgcgcgaaaatagcaaaaatggcgtttcgcgaaaagtgcaattttaacaaaagagagcgggccttatcagtacgattcttgtgataaaatgatttttaataatttcaaatgtttgttttggtccttaccataaacacaccactgcaaaaaaacaaaccaaattataaaggtttataaaattaagttctttttaatagcaatttataaagaagcagagaaaatttaaaataatttaatttcgcccagccgttaacccgccaccgtacaaaagaaaaactaaataaattggaaacattgaaattttttattattatttattaacattgattatttaaagaattcatttattattatctgaaaatctccgcgttcatagtaaataaagtgaacatttaaataaattaaaaagaatttattgttttaaaaaacaacaaagaatgttaaaattccagtaaaaatg

SEQ ID NO: 106098 - DNA, 273 bp, Heterodera glycines
  Promoter: Source sequence=SeqID_394; Location=699..971; Strand=-; Gene=SeqID_45596
aattctcatgagtagtgacccgtgtacttttgttacaatttttggcgctaaattcaaatttgaattttcgcgtcaatactctgtgggtggagggacgcttgctggggttgggccgtagggtgtaaggcttatttaatgctattttaaatatatttatctattttaaatatgtgtttttatctaatttagaattatttatataatttaaattgtttatttttaggaatgtaatatatattatttaaatgttttatttttagatatcccaaaatg

SEQ ID NO: 106099 - DNA, 243 bp, Heterodera glycines
  misc_feature (124)..(124): n is a, c, g, or t
  misc_feature (136)..(137): n is a, c, g, or t
  Promoter: Source sequence=SeqID_5207; Location=1238..1480; Strand=-; Gene=SeqID_57270
ttcctctctctttttttttgccaccacacattttcttcaattctttattttgggtggggtgcgcaaatccgcccaacgaggcggaagaaggcgcatttggatgaatgtgcatccaaaatatgcnaatttgaagaannatggagtcatattataacattttgtttttgttataacttttaacaactaaatattaataataattaataatttttcttatgaaaaaagcgaatcaattaattaatg

SEQ ID NO: 106100 - DNA, 87 bp, Heterodera glycines
  misc_feature (42)..(42): n is a, c, g, or t
  misc_feature (63)..(63): n is a, c, g, or t
  Promoter: Source sequence=SeqID_36832; Location=1162..1248; Strand=-; Gene=SeqID_66061
gcatttttattttaaaatatttttaaaagcatttttctaatntaggctaaaagaaccttattnaaaatttcagtgaatttcctaatg

SEQ ID NO: 106101 - DNA, 286 bp, Heterodera glycines
  misc_feature (11)..(11): n is a, c, g, or t
  Promoter: Source sequence=SeqID_20373; Location=454..739; Strand=-; Gene=SeqID_50895
aatgggggatnaaaatattatcaaaatgagaagttggagtagtagaatgataataattgataataaaaaggaggaggaaataagggtggaattaaggaataaaatgaagagtgaagaaaaatagtagaagaaggaagaaagatcatatgaggaggaaggagcagagagggaagaggagggagaaagttatgagacggaggaaagtgaagaagggaaggaagagggggaggaacggaatggagcagtacagcaggagaagcagaagaaagaagacaacacgaccatg

SEQ ID NO: 106102 - DNA, 1003 bp, Heterodera glycines
  Promoter: Source sequence=SeqID_2880; Location=4626..5628; Strand=+; Gene=SeqID_82145
aaactaatgaatgaataataaataaaataatttacgacaaaaaatgactactgaattttattaaaagaattctttgattctaattcaataattttttgtttttatttgaatccaaattctaagcaattcatatttataatttcaacattttttcagccaataattcgaattatgtttattaaatcatgaagtataatttactaagatatttacaatgtcattaaaattaaaatattatatgtatccatttttgattaaattatctaactaaatttattgaaggtaaattgatttttccaaatccataatcttgttaaatcttcgattgtcatatcaacaaaaataatctggcgatcattttatgccttttgattggcttaacgacaatgctttttgaatgactttgaacagctgccactctctctccctctccctcttctctctctcttaactctctctctctctctctctttctctcctctctctctctctctctgtgtctctccctctccctcttctctctctcgttctttctctctctctctctctctcgttttctcttctatctctgtttttctctctgcttatatcttttgctctctccatttcactaggacattgttcatttctcttttttctacactattttcatagattacttttctttttttcttttccattaactatctctgtctttcactttttctttcattcatggtctctcttcattgcatagatttgaaaagagtaaaatgtgaattggcgattgactgtgtctatccatatgggataaaccaactgcattcatccgacggggattagtgagccacaaatcgcttccctctcttccctcttatactgttggcccatcaagaaacggggcaagggctgctgatgggacaatgaaattttttgatagattgattgacatggtgtggagaagcattgccatcatcatcatcatatatcctccaccttccattcgtctcgagacaaaaaaatg

SEQ ID NO: 106103 - DNA, 391 bp, Heterodera glycines
  Promoter: Source sequence=SeqID_7853; Location=1259..1649; Strand=-; Gene=SeqID_66163
caaataattagacagccatattaatcaccatttagtgtacattcaatatattttttgttataatactaaggtaagtttttggtctttttaataaattctttttttctataaataatccttttattgcgcacatcattaaattgagtaaatccaacactaatcaaatgcgagtgttgatattattattatttttatagaatcctactgagggttaaatttatttaaaaatgaaattttattctttatttttatttaaaattgtttcacaattttgtgtgttcgactatggtaaagaaggtacctcaataatcatttaaaaacacattaacattgttttattatttttctataaatatttataaatattcttttagtcttttgccaacaaatg

SEQ ID NO: 106104 - DNA, 352 bp, Heterodera glycines
  Promoter: Source sequence=SeqID_23296; Location=1432..1783; Strand=-; Gene=SeqID_54003
ttgagggtccgatttgattgtgttccaaaattagaagaaatgggggtattgaaaaacaaagaccccttttcctgccgtgaaaattcgtgcattgcccaccttttgatttttcgacaattcaggttgaaaaattcctttcctgtcacatatgcatgtgtccttttgtgagtggggagtgtgcccccctcactcccattgtttccatattttccatgccccatgtattgtaccatggcttaggattcagcgctcatgtcctgtttgtaaatttttattgccatgaataaattttttgttgttctctgttaaggcgattgaggacagtttcgtcattgagcgcaccacgcaaatg

SEQ ID NO: 106105 - DNA, 574 bp, Heterodera glycines
  Promoter: Source sequence=SeqID_5749; Location=358..931; Strand=-; Gene=SeqID_59115
tttttaattgttcgcaacaattttcggtttcatatgtttgaagttttcagtttttttttgggcccatcgtctcctcccctcctcatcgtttgccttcattcatttatctcttttttaaattctgccgtttataactgatctttttttgctcgagaattgtccaatatgtatatttattttgctgtttattccgtccattttttgtattgctattttgcaactttttcattttaattttattctctattttccattgttcacttttgctcatttcattttgtcgattttttttttttgctgtgtcgagcttggccaattgccgctttttcaaaaattataaaaaatgtaaatttcacttttaccatttttacacagccttttgcaattctgtatatataaaataataatgtaaaaagaaataaattttgacaatttcattcatttatttatttatctatcataataatgatttcctaaacaaatgcctatttttttccttttttgattttgagtggatttttcgcgcaaattttttttggcatttttggtgcataactacttttttttgacaatg

SEQ ID NO: 106106 - DNA, 253 bp, Heterodera glycines
  Promoter: Source sequence=SeqID_13293; Location=860..1112; Strand=-; Gene=SeqID_77135
aaaattctgttacaccgatcattcaacgttttgccaattagcggattagaatcgggcactttgtataacacaattttgacggatcacaacatgtccacatagccaacagtcattgaaaaggtgcggaaaaggaaagtcgcctttccgtccaattcctttagagggtattatatcatcgggtaatctctatgtatctttggccgaggaaagagaaaagctattgtcttgcaaggtgttggtccttgtccgaatg

SEQ ID NO: 106107 - DNA, 295 bp, Heterodera glycines
  Promoter: Source sequence=SeqID_2471; Location=1..295; Strand=+; Gene= SeqID_79882
atcccaatcaaagcttttcgtgcccctctttatttcaaacacttttttaattaaatgtttttgattttcccattttcggcttttgcctccgcttcttcgcccgtctgcttcatcatcgtcttccgctttttacgtccgttctttaataagacgacatctctgttttacgttacgttggaagatgtgtccgttttggcctttgatctgatcaatgatcggaccggggagcgattgacgatgaaacagatggacaatttgcacttgctgatcgtccgttctccgattgggcgcgatg

SEQ ID NO: 106108 - DNA, 1003 bp, Heterodera glycines
  Promoter: Source sequence=SeqID_124; Location=2146..3148; Strand=-; Gene=SeqID_73169
tcaagacttaaaattttatgagtttaaacaaaattagacgggttctaaaattttatgagtttaaacaaaattagacgggttctaaaattttatgagtttaaacaaaattagacgggttcttgttatttcggggccaactaatctgggtattcaggtctaagtccaaacagaaactaaatacatgtttaactatgcgtttaaacaaccgtaagaattgactaaataataagattgaacaggtttccatagataaattttttaattttcaataacatagaaatttttgagcacaagggttgttaaaatttactaaattttaatgatttatataacattttatatatttattttgttttatttttttaaatccctccctctggtgcccaaacttcatgttgccaccctgactccccaagcctaaaaaaagttttttgaaaaatgccgcaaaaaaagccgtttgaatcacgaatgcactgaaaattacgatttgcttattcatttgttccccaaatttcgatcagaatcctcgcctaccggcaccgtcggaccctcatgtttcccaagtttttttttgtaaaaagtgtgcaaaaagcgtttttaacagcaaaaaacgccgtcactttaatgttgagacttatgagacttctacgcaaaaattccctttgatctacctcatttttaatgtgtttttgatttatttggattcttttcatttaaatttctcgctttccgagtcgagaaatttatcggtttttggatctcttatcgtttccggggttatttctcggttcccagtaaaaatcacttctcgcacatccctactttttgtccttttcatgcattttagatgcctttttttcgtgtctcttttaggtggctatttaaaaaaggtcgttttaaatccaaaattacttgagaattgggttttcttttgctcattgcttttgtaaaaatttgcgtaaaaccattactctttttaagccaattattctgttcaaaaatg

SEQ ID NO: 106109 - DNA, 220 bp, Heterodera glycines
  Promoter: Source sequence=SeqID_27338; Location=495..714; Strand=-; Gene=SeqID_58028
gatggatgggatggacgggcaaaaagggggaaaagagagttatttggaggtggggagggggggaatcgaactgctgacgaagaaagggaagaagggggggggggtgatcatggcaagagggaaagggacggactgagtgattggagacgcaaaaagtgatcaaatgggggacactcttggaatgcaaaatgaaagaaattgttaaagggacggaccgatg

SEQ ID NO: 106110 - DNA, 1003 bp, Heterodera glycines
  Promoter: Source sequence=SeqID_14032; Location=553..1555; Strand=+; Gene=SeqID_78008
taagcaacaaaaattatagtactaattgatcagcaaaaggatttttttttaataaaatgatcgttagtcaattaaaaaatctttgtttaaacattgacccaaaattaaatatatttttttagatgactttttaaatgatgagcgctgctctggtcatgaaattaataaataaattgaattactaaataatttattatttaaaaaaaatatcaaacaatatttttcatagagtttaataagtttatatattatgttttgtaatttaattacagtcatcaatatagattttattaatagctatattttgtctctcgatacgcttataggaaatgattggaattattttttatttttacatttttaaatcttaaatttttattaatttatcagcattttcaaatttaaaaatttttgttgtgatttattttttttaaatttaaatattccgccaaaataaatttcttagtatatggaaatgctacattactttaactgcttcttaatctttattatttattattcttcagtatatttaaaaagtattctttaaatattaaaaatttatccgcatataaatttaaaatttaatcattttaattcatcttaacaaacaaaatttttttatcttatttaaaaagaaattatgtttttttaatattgacgaagccattggtctggtcgaatccgcttcggcactttttcttttctattgacgatctctaagcctaattcatcgtacttaagagcatgtcaggaatctgttcgctttcatcattgatttataacttaattttttttaattcaacattaaatcagaatcataactaatgattaaaccctttattgatttattcaattttttcgtaatcttactattaacttaaaatactttttatcataaatatctttcactatatcaaaaaatcatcaaaattttatttatttatcgcttatatattactacgtttcttatagtataattattataatcttcttgcagatg

SEQ ID NO: 106111 - DNA, 345 bp, Heterodera glycines
  Promoter: Source sequence=SeqID_4880; Location=2452..2796; Strand=-; Gene=SeqID_56066
tttttattatttattattattgtctcttcgtaaataaatatttgttggtcttattcactcggacaaagacacaacaaatttggcgcagtcagcagtcgtcttcaaccaacaagaagacacccggactgcacaccacaaaaccaatagtccctaggcgggtgaggtctgcaaatactgcagtttttcgccatcaacaaaaccaatagtccctaggcgggtgaggtctgcatatattgcagttaattcgccgaaaaaccaacagacctaagaaaggttgcggttccgcaataagcggtttttcaactgtggattctcaaattcggcgccggcaaacatttcggcatg

SEQ ID NO: 106112 - DNA, 790 bp, Heterodera glycines
  Promoter: Source sequence=SeqID_16674; Location=1280..2069; Strand=-; Gene=SeqID_81074
agagagagagagagagagagacggggatagacaacacacattttgttgtaagaattttgccgaaaatgttgatggcgttttatgcaccgtgggcattttggagtcccgcttcctcagcccacttcgatgggcgggggctaaacaccttatagctttctttttactcagcatcaaacataaatcaaattttcaaattgtcttacacacttccatgaatcataccacacactcacagtgccgactattattatatcattcgagttttccaccccccccccccccttaacccatcccttcccgggagggggcggggaatcaccaacttcgttccatcacggtgtcgtcgtcgttcgtcgtcgtccccccagcccctcccgtcatcgtcctccaaactttttctacctgtattttgctggtgcacagttgggcagggccggtcccgcccccctatggtgcccccggggcgcgggtggacccctctctaatcgagaggttcaatcaaaatgacacccgccctgggggcacaactggtggcgcgcttgggactgtaacacacgccaccactgcgcctccatctcctcttgcccaaacaaggccatcggggcgcctagcgcctatttaaggggttggccggagccgacatacgccacaaatcaacaaataaataaataatactaaaaaatactaataaataaaattcattttttaaataaatttaaagcgtaaaccacccaaaagggacaacaacacagcagcactaagcttaataatcagcaacaacaacaaaatg

SEQ ID NO: 106113 - DNA, 447 bp, Heterodera glycines
  Promoter: Source sequence=SeqID_8130; Location=1..447; Strand=+; Gene= SeqID_67070
cccccccccccccccgaaatcagaattttttgaaaaaaaatttattttttttttaaatattatattaatttttttgtaaaaataacaaacgagtttatgaaatgaaaaaaaacagatcatttacaattgaacgcgtctaatgcaatcaattcaatttttaaaaaaacacgaaaatacacccctaaatattgaggtttacaaaaacgaaaaaatacacccctaagaaccgactttttgagttgccccccccccccgaaacgaaggtcctggctacgcccttgcaacctggttccattaaaaaggtaaaactaaaacaccaatcattgataattgaattttttctgtagaggagtaagagtgattttttaattgaattatttttttattaaaaaaacaatatttcctagtgaattcaatttgtcgaattcaggtcaaacgggggcgatg

SEQ ID NO: 106114 - DNA, 299 bp, Heterodera glycines
  Promoter: Source sequence=SeqID_36180; Location=585..883; Strand=-; Gene=SeqID_65567
tgatatctaattaataatttggcattagattcagaaattttttaaatatccaaatttaatttaattttatgaatctaaaattcagaataaaattaattaaaatatattttaatatttttcaaatatcaaaactaattacgtagttacggaattctgaaacctataagagaaatttttttgaataattaagacttgaattaatttaataagcaataaattaaatatacttaaaattcatttattttttcttagtatttgaataaattttaagctcgatggtcattatgccttaattgatg

SEQ ID NO: 106115 - DNA, 715 bp, Heterodera glycines
  misc_feature (128)..(128): n is a, c, g, or t
  Promoter: Source sequence=SeqID_503; Location=5302..6016; Strand=-; Gene=SeqID_54653
caaagcatcaggaagatcgttaatataatcataaataaataaaggtccaaggacagagccctgggggacgccagagccaacttttttactggaggataaatcatccacaattgtaacacgaaaaggtnctattactcaaaaagtcctttatccacatcaaaagtttgccccttataccgatttttcccatttggataaaaattaattcaaattgaaattccgaaatttttttgttttttaatagaaaattgtaaatatttttgcttaaaattctttccataaccctgcagagtgagcaggttaatgaaattggcctatagttttcgggattatttttgtcaccctttttaaagaaatgctatcgtatagtgcttttttggatgggtcagttttagcttgtctgaataatttagccttttctttgatggatgctaataaatgttgtgggtatttaggagtcaaatcattcttggttaaacgctttattggaatacactcatttaaaatttctaacaacatactgttaaaggcggaatatttttgatttatgctaaagcattcatatgacaaggcatttagccttgatgctatgactatattaaaatgtaacacattcgatggacaaaaccaacgaaagtttacgatctttgttttcggttttgttttaggagtaattaatgtgaaaaattgtgttaaatgatccgatgaaaaaatg

SEQ ID NO: 106116 - DNA, 131 bp, Heterodera glycines
  Promoter: Source sequence=SeqID_5382; Location=1618..1748; Strand=-; Gene=SeqID_57837
cccggtacttaaaaattccggtctctactgtccatataaaaataaagaatgatatttattcctataaaattaattatgaagatattaaagagttaaaatactatgagaaaaattgcctaatgttgcagatg

SEQ ID NO: 106117 - DNA, 89 bp, Heterodera glycines
  Promoter: Source sequence=SeqID_17482; Location=297..385; Strand=-; Gene=SeqID_81986
ttgacaaagacgaccttttgggggagacgaaatcttcgaaaggggacggcgtttttgaactgaaagaaacaaaggacgagtgggaaatg

SEQ ID NO: 106118 - DNA, 1003 bp, Heterodera glycines
  Promoter: Source sequence=SeqID_9579; Location=210..1212; Strand=+; Gene=SeqID_71959
gtataaaaacggaaaaagacattggctgcattcaacaagcaatatttgtaaaaaaatgagaattttaaattttcaaaacttgttcgaatccgggttcgggttcgaaattgagcctgtgataaaggccagattcgtactaattgtaaactttattatcaatagggctgccaaaaatatgcacataaaatcgtaaaatatgcaccaaaaatcgtgaaatatgcatataaaaagtgaaaaatatgcacataaaattttccaaattgagggtgtaatttctcaaaatttcttcaaatttgttaaacataaaaatcttcaaaaatggctaaatgtggtattaaaaatcattttaggagaaaaaaaaacatgataaagcaaaaatttactcattttttgcgaaaaatcaaccaaaaagcgaaattttgctttttttgcttatttttgacataaattaaccatttttttgagaaaatttatttattcaacatttttcgtgaaaattttgctaaaaaaatttttttttttggaaaattttccggtttttgaggtcaaaaaggccaatttgtctgttgggggccgatctattagaggttttttggaaaaacgccaaaatatgcacataaatcgcgaaatatgcacaaatatgcacatggaaagtcatcctagaagcttcaaatcaagctaaaaacatgtttttcgtgcgcttcaggcttcccgcaatccaggaaaaaaatatgcatgtgcatatttttggcagccctaattatcaatatgtatgtgtgtttgtttttgttttttcctactgaccctttgcatttcaatttgttggagcgattgcattgggcgggggttgtaaacgaactgaacgaattggcgggcattggcggcaatgaaaagggtgaggaacagcaaaaaaaaaggtggcggagagaatggaagacgaagcatcggagggagggaaaggacggagaaaccgacctaaaggggaaaatgccaaggaaaaatg

SEQ ID NO: 106119 - DNA, 475 bp, Heterodera glycines
  Promoter: Source sequence=SeqID_2904; Location=1..475; Strand=+; Gene= SeqID_47478
gcgggggccggaaacgcaacagagaatggtagggaagggatggagcaggtcattggagtttctcacagagtaaataaaaaaatccaccaaaaaataacattaaaaattttcaggaaaaaatcctagtaattttttcctttttttatcagccaaagaaaaataatttttatttttttgatgaactaatgaaaatgataatgcttttttggcttcaaaagttttttttcttcaaaacattttgatttgttgactcttattgttagataaaaatttttatgcctttctgaaaattgcgtaaattatatctacggtcggtcgcatcttcattttaccatgaatcatgcataatcgctccactattagagggggggggggggggggggaatgtggactgaaccagttgggtttacaaaaaagcgatttatttgcatgttttattggtttatttgtaaagttttgaatacatactagtatg

SEQ ID NO: 106120 - DNA, 89 bp, Heterodera glycines
  Promoter: Source sequence=SeqID_29063; Location=293..381; Strand=+; Gene=SeqID_59626
agttttgctccatgaaatttttgtagaatttgcgcgacttggccaagtacgtcagtgcctttgacttgcccgatcagtttctcaccatg

SEQ ID NO: 106121 - DNA, 311 bp, Heterodera glycines
  Promoter: Source sequence=SeqID_20927; Location=399..709; Strand=+; Gene=SeqID_51512
tttgttcgctagaaagttgttccaaaaaagagatagccagttttctggcatacccgagaacttaggaaattctttgaaaaattatatgtcagtagcgacagactacgcggcgcctgctctcgagcatttgatcggggtaaatgggttgccaaagagagatagcaattaaataacaataaacgagtaatttgtaagttctctgaatgaggaattggcagatggagtcagctcggtgaatcttgctcacaggcattggtgggaaagtaccaggtgtcaccacccatttaaaaattccaccccatttaaaaatg

SEQ ID NO: 106122 - DNA, 280 bp, Heterodera glycines
  Promoter: Source sequence=SeqID_18088; Location=221..500; Strand=+; Gene=SeqID_82674
ggttattatttaaggctgtttagtttatttcacaaattaagacaattgattcctttttgcttaaaaaacatgacgagcaaaaggaagttgaggaaatgttgactaattttatggtccagcaaaactgcgccttttcagtttttgaaaattcaattcttctaaaattaacgcaacgtgcataccctaattttgaggtttgacagtcagccactatttagaatgagatattattcagactcgcagtgaatggcattttcgaaaaattgtgattccaagaatg

SEQ ID NO: 106123 - DNA, 264 bp, Heterodera glycines
  Promoter: Source sequence=SeqID_25297; Location=1270..1533; Strand=-; Gene=SeqID_56049
ccccccccccctcttcttccgctttgttcccattcattcatttgttcatccatcctttttttgccccttccgccaatttaatttattcgaattttattgtatttcaaaaaatttaatttgtccaaatttttagggacaataatttgaaattcaattgattttaaaattgtgcaaaggtgcgcttttgtgtccgtccgttcacatgcattgatgggaacgagaaaaggtaattagcgaaaagaatttgaaatttcaatatgaatg

SEQ ID NO: 106124 - DNA, 422 bp, Heterodera glycines
  Promoter: Source sequence=SeqID_10313; Location=72..493; Strand=+; Gene=SeqID_73493
tttatttctaaattagcgttttttctgttcattttctacgcataaatttgtgtgaataatattttttaaattttggctaattcaatgacttggcaatcgatgctttattagcatatgattttgtcatttagcataatcgaaaaaatatattttacttttacgattcataaaaatttatgatttataaaatggcttttaacttcgcacattttttcttcctaaactttgcctttttgctctgctcatccgtcactaatttggccacaaaaaatgccaacgaacaaacgccaaacggacgggcgatgttcccaaacgcgccgaatgctcgaaacattcacaatgattacggtatttaccgtcaaaacggaaagtaatcggccgaacaaagctcagaattgacagcgcaccaagtgaccaaaatg

SEQ ID NO: 106125 - DNA, 147 bp, Heterodera glycines
  Promoter: Source sequence=SeqID_1585; Location=24..170; Strand=+; Gene=SeqID_74629
agtttgggtgtgtcttctcacttttttcccccacttttcgcttccttttgctcaattagctcaactcgcccactcgcgtcgcaaatccctccaacggtcgcttcattttcaccgattttttgacgcaatccgtcgcttggatcaatg

SEQ ID NO: 106126 - DNA, 91 bp, Heterodera glycines
  Promoter: Source sequence=SeqID_2839; Location=3367..3457; Strand=-; Gene=SeqID_81866
ctcaggtcgatcaattcacacattttcatgcttttttcttatgaatttgacaattttctgattgcttgtacagctccaactcctcggcatg

SEQ ID NO: 106127 - DNA, 195 bp, Heterodera glycines
  Promoter: Source sequence=SeqID_13414; Location=1..195; Strand=+; Gene=SeqID_77303
tccgaatcgtccgccgaattagtcccagttgataaaacagctgctgaccctatcactgttcctttggaaagactcataaaagtgccaaaggcagtccccgacatcgcaacattaccacggggaaaaaacccgtataaaaatgtgctaaatgcaatgattttcatgatttcggcccaactgaattttgaaaatatg

SEQ ID NO: 106128 - DNA, 90 bp, Heterodera glycines
  Promoter: Source sequence=SeqID_42845; Location=351..440; Strand=-; Gene=SeqID_70652
aatacgacagaaggccaataaaagcactccaatttttcgagaggaaatgaattgtttaattaaaattcaacactattttagaaaaaaatg

SEQ ID NO: 106129 - DNA, 578 bp, Heterodera glycines
  Promoter: Source sequence=SeqID_6707; Location=2510..3087; Strand=+; Gene=SeqID_62572
tgattgactttttctgtgccgattagcatgccaattctttccctcgactgctccgtcgttggctctttccattgcatttgcttgtggcctgcttttccgttacgactgtctttagaatagaaatggcgtcacattgcttaattcgtcaatattattgtatcatttccaatcgtttatcaaattgcccagactgtcctattacaattagtccgatctcatcgcatttaataatttcgatttttgaggtccattaaaagcttttcattgtccatttgcggttatttttcctgttgctttaacttgccatataaattatatatatttttatataatttaacatcaattaatttttgaatgttttaaatgttcgctggtattgatgggcagcaaaatgttctcctttccgctcaattacagcgtttactttgccaccacggagaaacggcgaatgcattcgttttctgtcaccaaatgcaaccggagctgcaaaaggggccgacgtgagtgggcgagcggtcattcattatgtgcaagttaattgggcaatttggaattgcatttaaatgtaagataaaatg

SEQ ID NO: 106130 - DNA, 332 bp, Heterodera glycines
  Promoter: Source sequence=SeqID_6383; Location=622..953; Strand=-; Gene=SeqID_61331
ctggtcatgattttaaaaatatagtttttgcgacggacattaacctgaattgccaaatatggcgtaaagctagccttaatctttaccaaaatgactttgacaactctggctttaggcaaattgaaaaaaattggaatgatttatcggaatggctcaatgattcgtttatttattcatttctctgctatattagcacggtttcgacaaaaaatgttgttgttgttgactccttgtatactgatatccagcaaatgccaaaaatacttttatctaatctgaaaaaaaatgtctttaattctaatcagcagtcgcccccagagataatacttatg

SEQ ID NO: 106131 - DNA, 662 bp, Heterodera glycines
  Promoter: Source sequence=SeqID_7292; Location=1257..1918; Strand=-; Gene=SeqID_64372
aattttatatatgaattatcaaattaaaatagtaaactgcctataaatttcaaataattattaaaatttatttttttttaatttgggggctgattttattgataaatttatttaattaaatcaattgttaaattaattatctgggaccgaatttatttggattaaaaattcccagataatgaattcaattatcgcaaacagatggattggaatgtacaaaatttgcgaattataattttaaaaattgtaaatttctaaatgttgtccgtcccttagatgcttaaactaaattgcaattgctgatttcatgcgaaataatcttacaaaaaaaaccatcaaaatccatacagactcaaatccgaacttataatttttattcatacaaaaaagtgaccataatcgaataatgatgtcattttacaataaaatctttttaaatttatatttatatcttaaaaactttacaaaattttaaagctttcccatctgtcaaaaatggttaattggactcaaattgaagaagaagaagaagcaacaaaatggaggcgaaaaattagacgcagaaaaaataaatttaataaatgaattgttggacaaagaagtggccacgcacattcacaaggagtacacgctcaatgtgctcaaagggatgtacataaatg

SEQ ID NO: 106132 - DNA, 1003 bp, Heterodera glycines
  Promoter: Source sequence=SeqID_11925; Location=1198..2200; Strand=-; Gene=SeqID_75434
gggaagggatttatgaaagcttgcgagtgattcgatgagaatttagagatgaaaaaatcagatttataaattaaggaggggaggggggtgacgaaaccgaagttttatgattaatttaactgattgtatttcagtttctatgattattctcatgagaaaataaagcattgaataaatggggttaactttgttttcaatatgactattacacataatatcgttcttatagcataataatggcataaaaatagcgtagtgctacatttgcggaccgaaatatcaaactttgcgactgaaatgccaaaaaaagaaagaaaacaaattagaatctacatatattttcataaattttcaaatacttccaatattgaaattaatgacgtttaagctggtctgtaagtagtcgagattatctgtctcaagtagagaaaagtcaactttggcatacctttttttgtttttcattttcttgaagggaagaaatacccttcaactagattcaaattttatgacctatataggcgcccccacaaattgtccaagccacgaattgtccaagccacgaattgtccaagccacgttttgtccaagccacgaattgtccaaaagagtaaaaacccacgaagtgtccaaaagtctaaaaagctcataaaaagccggaaaacgggtctattttagggttttcagggtcgctgaataccaatacgacatttatatagccccttgcctaaccctagacccacccgaataagaaaaatctccaaatttgattaaaaatatgtgctttttttgtcttcagattttgctattcattaattgaacaaatgattcgtaataaacttgaaagtctacaaaaaagtcggaagaagctttgtttgtcagcatttcaaacccaactgaggaggccgtaaattttggagtggagattgacgaactgcatgccgtgataacttccgacaatgttgaacaacagactttgaacgaggctgaactttcaacaatg

SEQ ID NO: 106133 - DNA, 544 bp, Heterodera glycines
  Promoter: Source sequence=SeqID_14375; Location=1335..1878; Strand=-; Gene=SeqID_78411
aaaaaatttttttttgtactttcatgttttctacccccgcccttcgagaaattttaaaaattcatattttgttgtttttaagctcactgatatcgaatagcatttttaaagttatagcgaattacgaaattttcttagctaaaattgtctgtcaaataattgcagcacttattaattaggtaattattgtttttttctaccatcaaaaggtgctggctgtcaaggagaaggaacgtctggaggaggaaggcgaacccgagtcggaacagcaggccaaactgatgatggaccgaacatgaaaaagggcacccaaaatttaattgtttttttttgtttttgtttttgaaagccgtcattgcatatacgataatataataatacagtgggtttctgtgttccaatttgtatccatttgattgttggggttctttaatgcctcgtcatattgttttttcatattttttatttttgtttttttttaatttgcattttgtaatagcattgtatcgtacgttaccactgccacccgcactcaaacaaaatg

SEQ ID NO: 106134 - DNA, 70 bp, Heterodera glycines
  Promoter: Source sequence=SeqID_25474; Location=871..940; Strand=-; Gene=SeqID_56209
ggttggttacagctaaataaattaattttaaaatattaattaattcattttttatttttaggcgtcaatg

SEQ ID NO: 106135 - DNA, 385 bp, Heterodera glycines
  Promoter: Source sequence=SeqID_18333; Location=297..681; Strand=-; Gene=SeqID_82935
tttttttgggggggggggcgaagttcgaagccgggcggtgtacattatttttctttgtattttttgggttaattttcattacttttaataaatttaaatgtttggttttattaataataaatttttttagtttaattaaattttttgatgaataatgattttcattaaattatttattatatttaattaaagaatttcagctattattttaaaattaaattgtaaaatttttttcatttcaatttaaataactattcaattattatacatttcataatttgtttttcattaataaaaagtgtattatattttaaaaaatgaaaaatataacacattgattttttatctattttgagtaaaaacaattccttaattaccataaatg

SEQ ID NO: 106136 - DNA, 650 bp, Heterodera glycines
  Promoter: Source sequence=SeqID_9713; Location=1904..2553; Strand=-; Gene=SeqID_72457
attgttttatttagaaaaccggacttagaccaattttcaaagggaagggagtaagaaaaaacgaagtttgtgtgataagagagggcgaacattgggatggtttaaaatctgttactcaatttttcgccgtcaaaaatttttgtgtaagctgtgaggtgacattttggaccaaagaccgtcaccgaatggaatgtagggagcgttgcaaaaagtgttgccggatggggttcgggttcccctgtttggatgtttgtgaggcgatacactgtggagaatgcaatcggaatttctacaacaatgattgtttcgagtctcacaaaaagacagcttctagggagtacaagaaatgcaacaaatgtggggaaacatatcaaacacgatcaaaacacacgtgcggggagaaattctgtagaatttgcaaagtctatcatccgggtcggcaatgtttcattaaaaaaatcaaactccgacagcagaaagcataccgaattgtggcttatgacctcgagacgacggttgtagggggcgaacacaaaccaaatcttgttagtgccgcgcatacttgtagtgtttgtgtgggagaagagagggaatgcgaaattggtccgcggatgatcacttggtctgtagcagatgggtttgaaccgatg

SEQ ID NO: 106137 - DNA, 251 bp, Heterodera glycines
  Promoter: Source sequence=SeqID_37319; Location=1..251; Strand=+; Gene=SeqID_66416
cgccaataaattttaaaggcgaattgcacaactttccaattgtaagcaaccaaatccggcaccgagaaatttatgaggattttggcccctaccgggagcacgaaaattttcgctccagccaaattcaaattcgccaacaacctgcgttagcgtggcaacaacaaaatgcaaacttcggctttttgccatgcgaacggcaacacaacgaattcgtcggacgacatctttttgaggatggacgtcaaatgatg

SEQ ID NO: 106138 - DNA, 1003 bp, Heterodera glycines
  misc_feature (7)..(7): n is a, c, g, or t
  misc_feature (26)..(26): n is a, c, g, or t
  misc_feature (41)..(41): n is a, c, g, or t
  Promoter: Source sequence=SeqID_5162; Location=2272..3274; Strand=-; Gene=SeqID_57116
ttacatntaattatttattttcaatntaattacctctaatnttgtcattaaaattaatttaattttcttttcaatagctaaatgagcagattgttcgccttgcacttgaagtgttacattccgaaaatcctgaacaaataaaaaaacagaaggaggtgctaaaacttgccctttattatcaacacgtgctggttgagctcagagtaattgattaataattaaaaaacgagtcaaattaagtataaacttgtggctttttaaaaatatttctaaataaaatgaggaatagatatgagagatttaattaaaattcactaatatttttaataaatgcttaattaaaaagagaaatttcttactaaaataaatttttttttaaaaagataattttttttaaatagaaaaaactgcataaagcgagagaagaattaaaagaagcaaacaatgcaaagagcaaacttaaaaagcttaaccagaacactgaacatcagaatgcaattataataaaagcggagaaaaaagtgaacaaattaagggacacaaagcgggaaacaaaagcgtaataattatctaataaattttactttttaaattatcaaataaaaataacatcccatattttatcaaatattaatgtgccaaaattttgttgaaaaccccggataaaaccctagaaaaaaaaattcagggatttgcaatttttttttttaaattagctatttttccaattaaattagcatcattaaaaaaaccattataaatttgttaattaactgatatgtgcacaataattaaaaaaaggaaacttttaaaatcattgtgcccgctattttatttacaattttaaagaagcatcgatgagctggtcgatttggccaaaaagaacaaacagttttcatttgtcattcgtcttaataatttgagcaacaataagcatgggttgcacgaattgttgaaagattgggaaaaagaaataccgtatcagtatgaccgtaaccaaatg

SEQ ID NO: 106139 - DNA, 258 bp, Heterodera glycines
  Promoter: Source sequence=SeqID_1716; Location=2112..2369; Strand=-; Gene=SeqID_47001
gacaatagccacaataaacatcaaaacgaagtggcaaacaaacaaaaacaaacaacaacaccaataatgagttgtccaaaaaagatcagcgagcagagtgcgcttgcgttcaacagtgcgctgaacgtgttcaccgttccgcccacaaatgtgtcggtgtcgcgttccttcttccgagaactgttgccattgtccactatcagccaggaggggccctacctgttccgcttgttcaatgacaacctgtgggcggacatg

SEQ ID NO: 106140 - DNA, 471 bp, Heterodera glycines
  Promoter: Source sequence=SeqID_15063; Location=1..471; Strand=+; Gene=SeqID_79236
aaagtcgcatagacattaaacatgcacaaagatccgcgaataatgttttaaataagacaaaattttttaagtaaaaaatttttttaatgtacctatttagttgaaaacaaaatttatttctaaatttaaaaaatatggacacttaacaatttgtttttaagtgtatacaatttttaaatttactcatttattaaataatatttttaaaattatccctttttcaggggacaagtacactctgttggacaaccatgaccaaattcagtggcgcgtgcgcggcatggacgacgttgaggttgttcaaagaaaaattcagattttgttgtcctaataaaagttaattaaaaactttagttaaaaaatggattttttaaattactattttaatttcaatttaataaagtttttctgatttttttggttcttaataagtttaattaaaaaatggatttctagctttaattaaagatg

SEQ ID NO: 106141 - DNA, 171 bp, Heterodera glycines
  Promoter: Source sequence=SeqID_17347; Location=1..171; Strand=+; Gene=SeqID_81823
cggtgcaccccaaaacgtcgtcggccgaaacgtcgtcggaaaactttttgaaccataactttgttcgctgtcaatcaaattaagaattgttggtgttgttcgatagctctatgtgtttattattaattgtcaaaatctcaaaaattttcgttaagttttaaaaaagttatg

SEQ ID NO: 106142 - DNA, 827 bp, Heterodera glycines
  Promoter: Source sequence=SeqID_1401; Location=5866..6692; Strand=+; Gene=SeqID_73293
atttcaaaaattggaaaatgggccggtaaatcatcaaaatgccaaaataagtagagaaacggataaccttttttcgataaattgaaattgcatcaaaaatggtgaacataaattttacaaattaaaaattattatttgttaagtcatattttgatcacaactgacaaattaatctttctcatacatagaatagagtgaatgtgcaagagaaatggcattaatttaaaatgttgaaataacaaaattggcaatttgaaccataagctttatatatttttaataccaaataatttgtatttaaaaacttattaagaaatacttctcggcttatgttagacatgaggaaatgaactcactgccaaaagtgccaaggaaacgaaatgccaaattggaaaacaacgggaacaaatgaatgcaccactcatcaatcattgtcagaaaatacttctaaatttgccgttttaaggcattttaatgaatgagactctcaacagatgtttatctcttttctatttatttgttagtcatttttgattttaaatttatttatgtgttaacggaaatacgataaaaggaagcgcaaaaatgctttgctttagttcaatttgttatcgtttccttaaatgtccttgcgttaattaccatatttaaataatattctgtcataattagaagtattaattgtttttgcaaattaatttattgccaattattagtccatcaattcgcttcatcttccgccggttgggtttgtaagcagacattcgatgtcgcgcaccactaacggcggattgcccatcacccaattgccatttgcgttacaaatg

SEQ ID NO: 106143 - DNA, 69 bp, Heterodera glycines
  Promoter: Source sequence=SeqID_4266; Location=1754..1822; Strand=-; Gene=SeqID_53828
attcagaatcaaaaatcagatttttaacaatttttttgccgtatttttccaaaaaactatttgggaatg

SEQ ID NO: 106144 - DNA, 102 bp, Heterodera glycines
  Promoter: Source sequence=SeqID_3804; Location=3394..3495; Strand=-; Gene=SeqID_51944
cccacaggtgtttttttgaaatttttaaataattttactattttaaaatttaaataagttacattaaatttttggtatttccgaaatttaaagtttgtcatg

SEQ ID NO: 106145 - DNA, 154 bp, Heterodera glycines
  Promoter: Source sequence=SeqID_10092; Location=946..1099; Strand=-; Gene=SeqID_73158
ttcattcactcttttactcgcccatccatccattgattagcttttattattaatttatcccgctttttccctctcactcactcccctccaaaatattatttatatttcttttgccgcccatttaattaatctcccaatttttcattttttcatg

SEQ ID NO: 106146 - DNA, 827 bp, Heterodera glycines
  Promoter: Source sequence=SeqID_38286; Location=814..1640; Strand=-; Gene=SeqID_67147
aaaagcaaaccgcaaaaaacatttttcttgcttttttttgataaaaactttacaaaatggtaattttcatcctccaaatgttgattttaaaaattcaattgggagccctgttatttgtaaattattaattattattattattattatcactattattatttaaatccttaaaaaaacttatgagtatttatttttttttattattaagtcctgaaagaaacattattgattcttttcgctggcaaatataattatgcttaataattatgcttatccgattaataaaatggatattattttatgttgtagtattcacttataaatttctacatatttattaacgttacaaatttaataaaagaaataggcaaagtgttcagcatcgagtgggaatcgagcccactccaccacccaatctgtgggcagatttaccattgagctcccgaggcaaataatgttacatgagatttgcgctttggacatttatgcctatgtcaaaaatcggactcaaacttaagtttttttcaagccctgatagcctaaacagcattaaaattaagaaaacacagtcttctagtttgtttggacattaattctgctgtttgaacccaattttgggtatcatttccagattaaaaaaagccaacaaaaggccgggcaaattacaaaaaagcatgtgcagctattttggcgacataaatgcaacaatatgagccaatacttacaaagtccaaacacataaatttttgtgttatgtgtgatattttatgtcaatttttattatttcaattaaaatatttcttaatctccttaataagcttattatg

SEQ ID NO: 106147 - DNA, 769 bp, Heterodera glycines
  Promoter: Source sequence=SeqID_2280; Location=1078..1846; Strand=-; Gene=SeqID_78870
ttccaactctgtcctcctccccccataactaatcaaaatcaatccaataataaataacttttccccttccgatagaatcattttatgaatcgtcatattattgaatttaattataccattttaaaactgaaagacgacaactcatatcttctaaagtctcttttgcctttttgttcagcttctcacaccagacataatttatgaattaatattaaaagaaattttaaatacaaaattttgatattaaattattgtacataaatgccgttctttccaggtccgatggtcagctgataatcatcagttaatcattcttcttatcgcattttgcttttttatactaaagaaggaaagtgccttaactcacatggccatttcccttctcaaattcaaaattctctcccttctcttccctctctctcatttttgtttgttttgctaattatccatccattagttttgtctcgctgttctttcattcgctttgtgctttttctcccctccttttttccatgctcttccccaaaggaaaaaatctaaagttcaaaggtaaactttcagccaaaagacgtctgagagagagaagagagcaaacagccccaactttgtccttccccttcatctgctgatcttatcttctccaatcgctttcccattcctttgccgaaagtaattttaacaaataaaaaagaccggcaacagaaagagacgcctttcgtccatttgttcgcctctcactgagtctctcttcgactttactccccaaatg

SEQ ID NO: 106148 - DNA, 559 bp, Heterodera glycines
  Promoter: Source sequence=SeqID_7640; Location=1..559; Strand=+; Gene= SeqID_65496
attaaaaaatattatcatatcaaaaaacaaaatccaaaactcaaagaatacgaaattgccgcaaaattgggaatttcaatgagctcattatacaaatacagcgatgaattagtcaataaacacattaaaatatgctaattattccaatttatcgttttaattctttttttattagaaataaataaatttgcattttccatctgttctttggatccatccttgtccaaattagagtcaaatccttgtgatatttttcatgatacaattattcatttatatgtttggctttctgtgattttttatacaccaatttttctaactttatgcttaatgttgttctattctcgtctgatccaattcaatcaataattttgataacattgttttattaacacgcagtgggatttgaaccatacaataataatattatgggatgaaacatttttatcatatgtaaatatcaaacataaaataatttatgggttgaaaatttgtacaaaataatataaaagaaattgtggaaaaatttcataaaattaaagaaaaaataaagcaaatg

SEQ ID NO: 106149 - DNA, 417 bp, Heterodera glycines
  Promoter: Source sequence=SeqID_29616; Location=62..478; Strand=+; Gene=SeqID_60087
ggtaacccgttcatttttgtacaaaaggcaacgtgtacaattgcttggttattaggattatgtttaggcgtaagctttaagctatacctaggcttagcttgcttgggcctaggcttaggcttatgcgtaggctttttgtaaaatatgagttgacttttgtacgaggtgccattgaccccaaatatacgatggaatggaacttattttattagcctttgtcagggatgcgattggttaaattattaataatattatggatgggttttacaaattgaaatagggggaaaagattcacttaagcgctgatgtcgaaattttgaaaattttagcgtgattttaagagattttgcaatttcggcataaataaacttaaaaaatttggtagaatcgtaaaacccttacccaacgacatgtatg

SEQ ID NO: 106150 - DNA, 1003 bp, Heterodera glycines
  Promoter: Source sequence=SeqID_4786; Location=5352..6354; Strand=-; Gene=SeqID_55716
tatcaaaaacacctccaagtttgccaaatttcgaaaaaattctcattaaaaaaaaagaaatgttcgcaaaaaaatgacgaaaatatttattgaaaatgccaaaatgacgacgaaaactcaaatttttcgtgttttgtggggtgtaatttttaaaaatttccaaaaagttgatctttaggggtgtatttttcgtttttttttttcatttttcttgtgaaaatttccaaaaaatggccaaaatatggactaaaaacccaaaaatggcgaaatatggatttattcccgaaaacccccaaaatatggatttatatggactaaaaaccttcaccaaatcaaaaaattttaacgcagaaatgctatttttaagcccctttcttcatagcatatgcgcagaaaaaatatgttaatccatatattttacaaccctagtgatatatgtgctcttcctaaatttgtaattgattgctgtgtgctgttttattaattggaagtaaaagaaagcagtgaaaagagacggcgatttggttttggatttggggtacaattcccctttcccattggactattctttttcctacgacgtggcgctcctgtacaaaggtggctcagcagtggcaataaacgacaaatttggacgagcaacgattttaaaaggaaaagtaaatccttctgcaatttgtaacaggaaaagcaaatcctggtctctggaaaagggaaacaaatccctaatgaagtttcttcattggttgtggccacgaaatcagtaaaacgggaaaactaaatccctctgcatataaaaaaaaaacgcaacttcgaaaaggaaaagccgtaaagtgtgaaacaaatcacgatttgtcagttcggtaaattaacttcgtctaaaaactgacttcaaaaccgggaaacgaaaatcccatttcaacatgcaatttcttctcaacacaaaattcggccgaggaaaattggaaagacaatcgcaactttttggtttcattacaaaatg

SEQ ID NO: 106151 - DNA, 340 bp, Heterodera glycines
  Promoter: Source sequence=SeqID_30660; Location=1244..1583; Strand=-; Gene=SeqID_61067
ctcataattaatcaacgggaaaagcattattagtttcatgtattcctcgtcctgaggtgtgtgcatttcattcccccgtcgtttcacggccaaaattttttattttttattttcatttttagaaaattttcagaaaaaatcttcattttttttttgtaagaatatataccaagagaaactttttttaaagaaaatttcttataaaaaaatcattaggattttttaaaaaattctaagtttgatttttttttaattttcggagtgctccgctcccaaatgtatttgtgctcggttctccacccatgtgggtttgtttgccttttctatttttcaaaaaatg

SEQ ID NO: 106152 - DNA, 407 bp, Heterodera glycines
  Promoter: Source sequence=SeqID_23896; Location=1..407; Strand=+; Gene=SeqID_45819
gtttcagcgcggatggggcccaacacagacggggtgcggggataggtgatatttttcgtggtctctggcgctttttcctgccactaattcgcagagctggagattctgtcacagacgaaacaattcagactggaaaacgctttataaatagggtaatcgatgaaaaacccggtttgaagggaacgatagagacgttggcaactgagagtaaacgtggagcggataatgttttagagaagggcggatttcggcgtcaatttggcacaggagggcgaagaaagcatataaaagctaacaattcctccattctatcacatcaaacgataattggaaaaacaataacaaaaccgttaattcaaagcaaaaagaggcttcgatcagacgcgttcgggctttattaaaaaatg

SEQ ID NO: 106153 - DNA, 62 bp, Heterodera glycines
  Promoter: Source sequence=SeqID_2839; Location=1..62; Strand=+; Gene =SeqID_81867
aagccatgtttgacatgcccgcgccgacccaatatttcgtcatgcgctcatttttgggtatg

SEQ ID NO: 106154 - DNA, 445 bp, Heterodera glycines
  Promoter: Source sequence=SeqID_8035; Location=318..762; Strand=-; Gene=SeqID_66772
aattcgtaattttattaaattttatttttaaattaatattttccttatagcttccaaccatttccaagaaggaattgaaaattggaccgaaaatttcttcggtaaaaattactaaatttaatgtttaaaaaataaattgtaaaaacttttctttagtttggtaaatattttggcatttttaaattaatgattgtaattgtaattaatttaacatatttaaattaattaatattcttttttattcaaatttaaattcttttaaataaagcataattaatcaaccactgcctagggcaaattcctcgtcttgcataagtcaaaactgcatgactcatcagtgtgcctaaaatcgatgaaatgccaaaatgacaatttcgatattttcctcaatgaagcggcaattttgtggcacattcggttgtccgcccacctgttcaagacaatg

SEQ ID NO: 106155 - DNA, 660 bp, Heterodera glycines
  Promoter: Source sequence=SeqID_25794; Location=1..660; Strand=+; Gene=SeqID_56534
tcgcagaacttagccgaccatgaggaggactcactggttttggggacatagcaatattgggtatgacaatgagtcgtagggctttatgagcgaccccccccccaaaaaaaataataaattgggctcaaatggacattggtcagaaagcaaggcccattaaaaccagttcggtttgaaattctcttaattaaagcgcctgttttcacaaagcaacagatgtgaaagcaatgagagagagaatcaatggccaaaagcggcggacggatttattcagaaaacattaattgatcactaatgttttttatggtcaccatttccatttgatcagatttgtctgtaataggttcaaagatatctgtctgattgtacttacttagggtgtaacataagtttccgcacaattttttttttcaaattcaaaaattcataactccgtaatttctgcagttattttaataattctttttttattttgttcgtcagaaagtcttctttcatttcattttttatttgcttattcaattttttagtattttttcccgaccatgcaaaaattgaaaattggcccactaatttttctcgattttttatggtcaaaaaagtaacctgatataaaaaaaaggttttctatacaaattagaccagtagaatccgaatatg

SEQ ID NO: 106156 - DNA, 134 bp, Heterodera glycines
  Promoter: Source sequence=SeqID_332; Location=11970..12103; Strand=-; Gene=SeqID_82790
tttgaaggggaaagctcgcgcagcgcgtcggtcacactgagatacagtacacgcgcacgcctgccgaattccacaagctgctcgacgactcgacttacgacaaactggactttgtccacgtctccgaccacatg

SEQ ID NO: 106157 - DNA, 52 bp, Heterodera glycines
  misc_feature (48)..(48): n is a, c, g, or t
  Promoter: Source sequence=SeqID_30583; Location=1689..1740; Strand=-; Gene=SeqID_60990
tatcagattatttgaattttttaaatacatatttggaagctcaattanaatg

SEQ ID NO: 106158 - DNA, 506 bp, Heterodera glycines
  Promoter: Source sequence=SeqID_18924; Location=800..1305; Strand=-; Gene=SeqID_83649
ttcattaaaataatgcgttattaaaaattgtttcctattattttaatcatttagcatcattattattttccgttcgtaatccgacgacgataaatactcaaatccaaaaaaaccaataggaaatgttttgttcccaagggagaggagacaggacaaaaaagagatgagataaaatctgaaattgaaaaaaatccctcattttttcatagacaatttcccattaggtcgtcgtcgctcgttcatccaactccaatatgttcatgtactttctgattcttattaaaaacaaaaaaaaaataaataaatcccttcaatttttatgcgaatttatattcaaatggaactaataaattggaattttaatttttaaatttattgggctaaaacaaatatgctatattttaatttatttgtggaaaatttattttagataataattttatagcggctaacatttatttttgtatttaaattgaaaaacccacaaaaattgtttcgccaaaatg

SEQ ID NO: 106159 - DNA, 1003 bp, Heterodera glycines
  Promoter: Source sequence=SeqID_3246; Location=709..1711; Strand=+; Gene=SeqID_83887
ctttgaattattgaacagattacaattctgtcaaatgaacattgcaaggaaaagcttcggaccgtcaaaaagaatggacaaattccgcagatcccttttttgtgtgcaaattcgacaaaaaatgcctttttgaatgtgagcaaattaattaaaattcagttaaaaaggtttaaatatatatatgcatatactcatggaaatccaattcaattgcaaaaaaacggacgcttttatttgctgggactgtcgaccggcggcacaaaatgagatgagttgccaattctatataacatatatttaataaataaaattcgattgatttttttaattgaatgcgtggcaaatataattaaaatccattctcagttttcccttatcattttataaatttgcattttcatataaaatttatgcccattcgagaaaagaaaaattgaaatttatacaatgaatgggaaaaaaatcagtcgctttaattatttttatttctttgtacttttaaattttacaataatttttgcgaaattgccgaaggcattgtttggtattttattttaattcattttaaatgtttaaaaatgttttccgtaaggcataaagctgaaaagtcttgaggatggatatatccgtttgctttttgaccatcaattggatgacaatgcgcgacaaaaactcagtgcccaattgacggctgttcaaatttgcatggaaattgaaaggtacgaaaattacttattaaaaattgaaatattattaattataattccattattaatcccggggttttccaatgtttgttcatttttttaatttggcaattattttcctgctggcaattttcattggtacttttttttgtgatcattcagactttaaattttgcacgcaaatcaggtgtaaataggacttctgaattagtaaattgataaaataattaatttatttacatattgaattattttgggtttaatttttggaataaaaatgccgttaaaagaaaatg

SEQ ID NO: 106160 - DNA, 71 bp, Heterodera glycines
  Promoter: Source sequence=SeqID_14508; Location=874..944; Strand=-; Gene=SeqID_78559
ttaaacacatttccaataaaatttagcattaatttgcaacggtcgttcaaattgtctttatcgaagagatg

SEQ ID NO: 106161 - DNA, 200 bp, Heterodera glycines
  Promoter: Source sequence=SeqID_23753; Location=253..452; Strand=+; Gene=SeqID_54462
aagaataattaaatagtaaaatcagacaaatgaaaaaaggctagaaatagggggaaaagaagtgaagagaagaggagagaatggataacagagagagaataaaatgagaaaaatgtaacgcgaaaagataaaaagaaaaaaattacaattaagaattaaagaaagaaaatatataatatttaaagcagagaaaaataatg

SEQ ID NO: 106162 - DNA, 91 bp, Heterodera glycines
  Promoter: Source sequence=SeqID_16525; Location=1132..1222; Strand=-; Gene=SeqID_80930
atcgagtgcaaaattataagcatatcgaataatttttatatttcacatggatttgcatttaatggttttaaattgaatcaattgaataatg

SEQ ID NO: 106163 - DNA, 772 bp, Heterodera glycines
  Promoter: Source sequence=SeqID_10222; Location=558..1329; Strand=-; Gene=SeqID_73366
aaattctgtactatcatattactttaaattgttttaaatattaatatttaacacggcgagtcaattttgggctccaagtacaaataagtttattatttatttagtaatcagaacgccaaaactttgcaaaacttaaaatttattggggattttcccttgtaaaaatggaagagtcgatctcgagttagaaaagaaactttcaaaaaacaaaagagaattcgatagagagggccgaaaaactagcctaggcaaaatttcaagaaaatcgcaactttggaaaaatttttacgactgggcaaagttttttctttttctctcattttgacgcactatttccatgtctctaacatataagataacacatggttcatttttttgccaataaacaatttttttaaacttttgactatttaagaaatattcttcagaattttcccttcaaaatgagcataaaatggttttatttggtatattattgaaaaagttataagctaaaaaaattcataaaatcaagggtaaaataaaatgtttaccttttattgtttgtatttgttcttttggcgttctgtttttattatttttttatatatttgctttaaaaaaatgaaatttatacacaaacacaaagaggacttgaacctgagacccacatttggtgactaactcacagaccactaagacgaaaaaaccaacttaagtgtacttggagcccaaaattgactcgccgtgttaaatcatgacatatttatgttgctattaataaataaaaatg

SEQ ID NO: 106164 - DNA, 157 bp, Heterodera glycines
  Promoter: Source sequence=SeqID_26787; Location=1315..1471; Strand=-; Gene=SeqID_57544
ttagggggaacaaaaatttttgaaaattactggaatttatatgcaaatataaatgggtttttagtgaaaattaaattcaaagcgaaacgttacaaaaaatgcaaaataaacaagcttaaaatcaaattcgcatttaattaaattattttttaagatg

SEQ ID NO: 106165 - DNA, 118 bp, Heterodera glycines
  Promoter: Source sequence=SeqID_12265; Location=827..944; Strand=+; Gene=SeqID_75852
tcgcttggggccgcagacggacgccggcgggggcggtggacggctgagaggggccaactgagtacgggtggggcacactaaaaagggcacatttggcattttgtttatttatcttatg

SEQ ID NO: 106166 - DNA, 208 bp, Heterodera glycines
  Promoter: Source sequence=SeqID_44299; Location=403..610; Strand=+; Gene=SeqID_71798
acccaccaactttcaatggcattccaatctctgggactcaacccaccagcatttcaatctctgggactcaacccaccagcatttcaatctctgagactcaattctcaggctttccaatcgctgggactcaacccaccagcatttcaatctctgggactcaaatctcctgcattccagacactgggactcaacccaccaactttcaatg

SEQ ID NO: 106167 - DNA, 151 bp, Heterodera glycines
  Promoter: Source sequence=SeqID_29863; Location=950..1100; Strand=+; Gene=SeqID_60329
ccttgaaaaagttaaatgaaaattataggaaattgcaatttcaatcccagaaaaattttatattgtatgagaaatgccattgacccgaaaatccgccgtcggaaaacaacggaattatttaatttgttgacagaaaaaaagcaccaccatg

SEQ ID NO: 106168 - DNA, 193 bp, Heterodera glycines
  Promoter: Source sequence=SeqID_40392; Location=620..812; Strand=-; Gene=SeqID_68743
tggatggtaaataaacaaacaaaaatgccaaattaaatcattaattaatcactaattaattaatatgaaaaattgtatcaataaaatgttaattagaagccatgtgttgcttctttcacaatttgcacattaaacattgttgttgttttttttcatttcccatccatgggcggaaaacgctgaacaaacgatg

SEQ ID NO: 106169 - DNA, 299 bp, Heterodera glycines
  Promoter: Source sequence=SeqID_12113; Location=2510..2808; Strand=-; Gene=SeqID_75681
ttctgcgggctagaaaatgaagatcaaaaatgaataaaataaacctgaacattaacgaaaactatatttggctcttaattttggcaaaatgtttaataaaattcaaataaatgaattgaaaataggaaagccggaaaaaaacccaaaaacccggcaaaaacccggcaacttcaaaaacccggcaaaaacccggcaaggacccccaaaacccggcaaatgccgggttttccaggtaaaatggcacccctgtttgtgcaccgcttctgaaaaaggtgcaacaaattaactgttaattaatg

SEQ ID NO: 106170 - DNA, 375 bp, Heterodera glycines
  misc_feature (17)..(17): n is a, c, g, or t
  Promoter: Source sequence=SeqID_25620; Location=557..931; Strand=-; Gene=SeqID_56369
cacccgaaattttttanagggaaaaatagtatttttgctaaaatcttaaattttccttgctggtacctctctccccttagaaccagcctcacctaaattttaatttttcaaaaaaaccactatttttgaagaaaatctgctaaaaacgactcaaaatcgcaaaatttgtcactttttggacaaaattttttaacaaatctcattaaaaataaaaaaaattcccggcggagcctatcggcaccgccggggccgccctctggtcgccaaattttttttcgcaaaaaaatggtgtgaaacaaaggttgtcgccagaggtgaagggtacccccccccaagccgaatggaggaaaactgacacgaaattcgaaattaatg

SEQ ID NO: 106171 - DNA, 563 bp, Heterodera glycines
  Promoter: Source sequence=SeqID_22763; Location=1..563; Strand=+; Gene=SeqID_53463
tcggtgcgcgaacattcgcagaaattggcggtcgcttcgctgaccgaacttttcgttaatgtgttgcccgggtacgaaattcgaccgctgacggactcagaaaagacgcaaaaaatgaaaaaggaaaccaaaaggtaagggaaattttggtgagatatttcgttccctttttcttttgggctggccgaatacgaacacgccctgctcaattactatttgaaattccttcgtttgctcgagaaaaatgcgaacagtcagtctttataagccattcattcattttggttgactttttccagagattcttcagaagggcaaaaggcattcattggctgaggaagcgccgactttttccacccaattttcttttatttgcgtccgatgtttgtgccgactcattgacaaatgttcacattttaatttcgccaagaatgtcatcacttgcttggtccggcttagcacaacgccgtggaaaaaggcaattaaacaatgaatgaattggcggggaggggggggggatggaagaattcgtccaatcgctgtttttgccgccattttagatg

SEQ ID NO: 106172 - DNA, 124 bp, Heterodera glycines
  Promoter: Source sequence=SeqID_13248; Location=857..980; Strand=-; Gene=SeqID_77079
agtgtgatcagcccagcagaagtgcagcagggatatactgatcagactaattggagggggaaattggcacaaattaggggggaggggtgggggataaacgatcggacaaaatgacaaaaacatg

SEQ ID NO: 106173 - DNA, 104 bp, Heterodera glycines; identical to SEQ ID NO: 98209
  Promoter: Source sequence=SeqID_2117; Location=3809..3912; Strand=-; Gene=SeqID_77936

SEQ ID NO: 106174 - DNA, 252 bp, Heterodera glycines
  misc_feature (69)..(69): n is a, c, g, or t
  misc_feature (105)..(105): n is a, c, g, or t
  misc_feature (143)..(143): n is a, c, g, or t
  Promoter: Source sequence=SeqID_10512; Location=1..252; Strand=+; Gene=SeqID_73739
aagttgttagagtactaatagttcaaatacatatcattaaaattcacaaactgccgttgtggctttttntaatgttttgtttttctcatttttgtaatttcgctntacggatttcactttttgtttttagattttcttttttntagtttttaaaatatgttataaattatgtcttatatttatctaataattagtcttttcttaatttttttttgattaagataatgattttttgttgacattgcacaaatg

SEQ ID NO: 106175 - DNA, 451 bp, Heterodera glycines
  Promoter: Source sequence=SeqID_45266; Location=837..1287; Strand=-; Gene=SeqID_72596
atttctctactatttcatttataaataatatgcgctgaaatatgatataattaataataataattttgttcaaaggactaagacaaaatttaataagaaccctggataaactttgttattcgcaagttaaatgtaaatataaagtaatagtgttaaagtttaaaataaaatattctcatttattcatatatcaaaatttcttaaaacgagctgtaatttcaaacaaaaattcaaattttcttttcgcgttattaattttaaactatttataataaaataatggaaaacataatttatttagatttcataatggtaaaattcccggttggtccgggttcccggttccggaccaaaatcgaggtcccgatcccggcttctcagatcccggcaagacccggtcccggttttggcaaaaattcccggtcccgtgtatcaaatgataccaagaatg

SEQ ID NO: 106176 - DNA, 877 bp, Heterodera glycines
  Promoter: Source sequence=SeqID_7981; Location=3258..4134; Strand=+; Gene=SeqID_66582
atatattattaaaaggcctggaacaatactaccaatacggttagggatacggcgctgatccgatatacagtgtggacgaaccgtagggtcatgaaggtggattttaattttgatgaccagcagatgatggatgatgatgatatatgatggcaaaatgtattattatttgtatctacaaattaaaaaaatgataataaatttattttaaatgaattctacataatttgatacttaaaccctttttgttctgccatctctgttttgtttttaaatttttttctatgctaattttcggcgctgaaaatgaatttaacatttattttaatctaacattcatttgctgtgaaataggcacaaaaagaaattcaaaataggcactaaaaaacctcaaatttagggatgtataaatgacaaaaattattgaaaaatgaaacaaatttcgtaggggggtatttttttaatatttaaaaataggatttttaaaaaatttttgagcctcttaggctctaaaaataagaaccaacaaaataggcaataataactcaaaaagtaacttaaaaccaccaaaaagcacttgttaaatgttttattaaaaatcaaaattaataaatccatctttttaaaattttattgcccgaaatgcttaattataaacaaaattttatggttcgaatttggagatcagtttttattgtggtcttttattaccaaaaaataaataaatattttgttattaaaaagctataaatagttaagaaatgaatgataaagcatttggaaattctttcatttaaaaaatattcaaaactgataatttcccatgaaaaattttaaaatgaattctttcttttttttcatcacaattcttcccacaatg

SEQ ID NO: 106177 - DNA, 91 bp, Heterodera glycines
  Promoter: Source sequence=SeqID_3173; Location=157..247; Strand=-; Gene=SeqID_83524
tgttggtccaaacttggccaaatttgtccattttttgtagtattgtagcgaaaaaaattgagacaaagtacggcacatttttcccttcatg

SEQ ID NO: 106178 - DNA, 69 bp, Heterodera glycines
  Promoter: Source sequence=SeqID_32628; Location=37..105; Strand=+; Gene=SeqID_62928
ggtttggcaaattttttaaattaatatttttattttatttatgtaaatatcatttaagtctgtccaatg

SEQ ID NO: 106179 - DNA, 1003 bp, Heterodera glycines
  Promoter: Source sequence=SeqID_168; Location=3727..4729; Strand=+; Gene=SeqID_75826
aagacatttatcctttttctgccaacactatccttggcctgttggttgtgctctggatttggctcttgggttcgggtccccttatatgttgccgaattaattgaattaaatcctctcatgggtttggaccccggcccctgggactgagtgattttaaatcacacatatatgacatttatcctttttctgtcaacactatccttggcctattggttgtgctctggatttggctcttgggttcgggccctctgacttgtgggtgaattagttgaattaaatcctctcatgggtttggacccctgcccctgggatcactctgggtggtctcgacattcaaaaacattggtaaaaaaaagggtgattttttgggtggagggagggttttggacgcccgtaaacgtgtccttatactactgttaatttctcaaaaaagtctcattttttatcaatttcgctagcttaatgtaatgctttttggcgtaaattttttttcgctctcaaagatttactcatttttcggaatttcttcgctaaaaatcaaattttgccttaaaagtgaaaaagtcatgaaaagggtcaaaaaaatacaaaaaaaaaagaaaattttgaaaaattattgggcatttatttgaccacgaatttgagtgccaaaaaagacatttttgtaaaaaaaaactaatttttccaaaaaatcgccaaaatatgtgacaaaaactgccgaaaccccaaaatatgtttttattcccaaaaagcccaaaataaatatgtgctaaagactcgctctgattgaaaggaaaacaggtaaaaatgctatttttgagattttcatgcgatagatgcgcaaaaaaatatataaaaacatataaatccgttccctgataatatccgtcaagaaataggaaaaccctaaaaatccaagctttacccaactcaattaattcttctgctatttgtgtgacatcattcggagctcggccaaattgtgctaattgcctcaaaaatg

SEQ ID NO: 106180 - DNA, 512 bp, Heterodera glycines
  Promoter: Source sequence=SeqID_10466; Location=664..1175; Strand=-; Gene=SeqID_73675
aataaagattaattgaattctctcccccaggggcctatttcaattcccgtcgtatctccgatatgatgtcatatctcagatacgacatcatatcgtcacttagcaccgccgccagaaccaaagcaatgacaaacatcgaccggcggcgatttactatggcattttaaaagctaacagttggcatcactgcgcagaaatttactggccctaaatgtcggcttcttcgaggggacgcattcagttggcatgaaaagttgtaaagcaacattcggcttttacctcattattattattattattattattttaatataatatattttttaaagttaatcaatacgaaatgaaaaataattttatttgcgttgttttttgccacggcatttcaatggatggctttgccaacgtaaaaagtcacatgaaatagtcataactctaattgcgcgcgtcaattcattttctgcataaatggcaatgttgaaaaagaaataaccatttctaaattgaaaatg

SEQ ID NO: 106181 - DNA, 155 bp, Heterodera glycines
  Promoter: Source sequence=SeqID_14686; Location=1..155; Strand=+; Gene=SeqID_47223
ggtaaatataaattcccaattttgcgtgttgctaattagttccaagtttgcttaccctgaaattgtgtttgggtacaattatatatccaatttataaaatcataaaaaccttccttttttaaccaatttaactgattcattttcagatctacatg

SEQ ID NO: 106182 - DNA, 731 bp, Heterodera glycines
  Promoter: Source sequence=SeqID_10864; Location=1333..2063; Strand=-; Gene=SeqID_74144
ttcgtcgtatagtattcgggctaaggcctatttctaacaaaaacccaaagggtgtggaaccgaaacctattgcaatggtaaaggggctgccaaaagcgtactgtaatttaatatcatcttcttacaaatgtacagtcattcggactttatgcctttttcccatcacagttaaacattcattctcaatgctcattcttactgtaatttttcttctttctcacattacagtgtaccatagcatatttccgatatttctctaaattgtaattttttctcattcattacatcattattcaatcgtgaaaatggccataagccatatcattaaactgtatcgccgactctcatcaatcagcctgtcccatggcattcggtgtttgccaatcagctttcacatacattaggccttccgttttcataccattacaatgtcagtgcccatcctatctcttctgatcttgaattcacaccatgtatgagcaatacttaagccttatgtattcactaatcagtcattatccatcacaagccttcgctcttcagccatcagtgttcactcatcacagttccccatcaaagcactaactggtactaacccatactaagtccctcactcaatgctaactcgtttgcatcaatcactagtgtgtacttattgagactaacaccttagtttatagataattctagactcaattcactactccttcaaacctcccaacccatcaatg

SEQ ID NO: 106183 - DNA, 893 bp, Heterodera glycines
  Promoter: Source sequence=SeqID_18650; Location=707..1599; Strand=-; Gene=SeqID_83306
gaatgtcaaatggtcgcgctcgacgttatgccatcgttgggggcgttggggactttgttggttactgtagttaccctaacatttcaagaattgggtcctaaattgacgacttttgcgaccacgtggcctgcccgcgaaattctaggattatattgtatgggctctctatatgtctttctatccctctcttatactctatctctttatctgtctttctatctctctctctctctcttatatctctctatctccctaccactctttttatctctctctctctctctctctatctatctcgctacttatctccatgtctacctctttatctatctactctcgatacacatctctctattatctctctctattcgtatcaaaactttcggctactaaatcccgattatatccaaactttaaaattgcccacaaaaattcctgtccccggtcgtctccgatgggtcggggacttggcccccatttttatacaataaaattggcccattggatacacttggactaaaaatgatgatgcctttttcacaattttttttaggatggactgaagcgcatgacgaacacttgctcattgttgtcgacaaatttggccttgaggacattcatggaaaagtcaaactgttgcccaaactttttgaatcggtacagttttaaaagggtgtataatttaaatatctatattaaatttatcattaatttttcccgttctctaaattgtcgtaaatccggcgatagagtaaataaaatcatgtcaagtcataaaacataacttatcataggttggtccaattgatgagcacattctgttgcggcgagtggtcgagatttgtatcacgctggagaccgccaaatggagtgggcccgcgtccattgaaatg

SEQ ID NO: 106184 - DNA, 532 bp, Heterodera glycines
  Promoter: Source sequence=SeqID_24886; Location=430..961; Strand=+; Gene=SeqID_55633
atctgtgaattttataataggcccaaagaagacgcagaaaaataaagagtgattttaaattttaaataaataattgatcaccataatttaaaaaaaaaattgatcacccataaaatcgtctaaaattgatctaaaaattcacccaaattttatagggaaaataaaaggatacgataatcctaaaactcattaagaattttaaaagataagtaggccaaaacgtggcagataaaataattaaattttttttttgctatttttggaaataattattttttacaaaattttttttagcaagttttcctttctcatttcttctaagctgatcggaactgaaccatatttaaaaataatcaaagaaaaagtggcatatattttttatatttttaaaataaaatcgaataaaacagaattttttctaattttaatttcaaatggattttcatttaaatttaatttaatcatttatttttatttgcctttccacagaataagcgatgtgtggcgaaagcaggccccgtttctgaagatg

SEQ ID NO: 106185 - DNA, 52 bp, Heterodera glycines
  Promoter: Source sequence=SeqID_11224; Location=670..721; Strand=+; Gene=SeqID_46937
tttgtacctttaagtgcttttttaggcttatcaaaacattttaaacagaatg

SEQ ID NO: 106186 - DNA, 757 bp, Heterodera glycines
  Promoter: Source sequence=SeqID_4719; Location=503..1259; Strand=+; Gene=SeqID_55496
tcgccccttcccgttccaaaaccccccccccccttcccttaccaaaatcccctccccccccccttcccttaccaaaacccaccacccccctgaaaaattccggcccaaatttggtcccaagatccccccaccctccctttcatctgacccccctaccgcgattcgctccccgcatattttgatcagataagattattcaattgcgtttttttaattttcgtttgttgcgaaatttttgtgcggggcgcaccaaaaatggtgccatccgcgctccaaggtcaaaatagtttttatgttcacaatctgtcaatcaaagttcttgggcgagaaaatttaaagcgctgcggagatgcaaaaatatttgcggccactttaccgcagtttttatacacgggaactgtcaatcatataaagaagggaacgccgaagcgacttcatttcaattccatttcggttgaggcggggggtcggggccattctttgcctctcggggcgcttgcccacaaatattcaaatttttccatcaatcatctttatctgccaccgcggcactgcagcacggcatgccagtgggtggagtcagcagccgcaccatccgcaagtttacttcatttgccactttcgtccgctttcaattttgtcagcagcagaaccatccccaattcaattctcattgtttgtcagtttcgaccactttccattgccaacatgtcttttattgcccccggcactttcgcgttcctttcaaaagactatg

SEQ ID NO: 106187 - DNA, 161 bp, Heterodera glycines
  Promoter: Source sequence=SeqID_657; Location=1290..1450; Strand=-; Gene=SeqID_58304
agtgggacacaacgctgttcagctcctacgtgaacacctttgtggggctcaaagtgcaggcgagtggctggcctgaaggttgcgacagcgaggagcagcgccaggcatttgtgcaagacttccagcgcacagagggaatccggctggacccggacaaaatg

SEQ ID NO: 106188 - DNA, 414 bp, Heterodera glycines
  Promoter: Source sequence=SeqID_36739; Location=1..414; Strand=+; Gene=SeqID_65987
ctggcatatgatttgctcattctttttctttgtgtctccgcttttctcttcactctctccttttctcttcattttttttttgaatattgtttggcattttgtatacaaaaataagaaactacccaaaatgatttcttttttaactttcttacttgagcagactttgttcgggaccggcttttggaaatttcggaaccagtaatcccgcttctaggccgggaaaaatcgctcaaaaatgggaaaaagattgggaaatcttggtataaatacagagcccggaactagtcctggacccgaattcgatgccatagaatttttttttttgatttttttcatccttattaattttttagccatttatttgacttccagttcagcaattacattctttgttcttcttcaattttcgcaatg

SEQ ID NO: 106189 - DNA, 450 bp, Heterodera glycines
  misc_feature (50)..(50): n is a, c, g, or t
  Promoter: Source sequence=SeqID_31661; Location=403..852; Strand=-; Gene=SeqID_61975
caggtgcagcaaaagcgataatatgaaatttccaaacaacgagtttagcntattaatcatggaaaaatgtgaagggaagacaggcggccaaaatgaagcccaacggtggtgtcacgccaataaatctccgaggggcaacaaataatttttaggggggagagggggtgggaaatggcatggccaatgccattctggccaagaatagcaccacacagtgtacaaaaaggttcatgtgaaagtgggaggagaacaatcggcggcactatgacaacggatgaaaatggaaaattaattagcggaaaaaagttgcacggcataattagttgtgagaggggtggggggtaagcatattatagtagcgcggccgtgcgcggtggtcgtgctggcgttgggaattggaattcggaatggggagggaaagggaaaagtgccacatattcccgaaggatg

SEQ ID NO: 106190 - DNA, 671 bp, Heterodera glycines
  misc_feature (26)..(26): n is a, c, g, or t
  misc_feature (35)..(36): n is a, c, g, or t
  Promoter: Source sequence=SeqID_1782; Location=3663..4333; Strand=-; Gene=SeqID_75931
ttttagccctggggaatttttggaanaattatttnntattattttatcatgttaattcagcagaagtcattggcaggctgcatcataaaacaaaaattttttttatagctatatttaaagaaaattaggatataaaaaaaaactggaatttcttagggttgtaaaaaaaaagatataaaatttctaaaaattctaattttcttgaaaaattttgacctaccctgtcttaatctccccaaatttgttcaaggagcggctttgccgggctgttatgtgaattgcagtgcgaaatgaaatgcctaaatggtggaaagtgccaaaaaacgacggacaagggcgaattctgtgaatgccctaaaggcgagaaaattgaattattatactgtattaacttttatacataggtataatttatatgatcaagaaacgagaaagtcccggggtgcccttttattttaattttttcattttgaaatttctcattttttgtttgccctgaggcaaaaaaaaagcataggaccattttaagccggtaccaagattgtggcaaagaagaaatcttgggacgagtaccaattgtaactcatttgtggaataatgccatgaaaaacttattaagaaatgtttatatattttaaaaattttttgccaggttttcatggccctttatg

SEQ ID NO: 106191 - DNA, 404 bp, Heterodera glycines
  Promoter: Source sequence=SeqID_39020; Location=291..694; Strand=+; Gene=SeqID_67686
ttcgccatcaagcttcaggccggaggccacaagccgcgaccaggcactagcgcaccagccccaagcacggggttgggcactagcaccgtgtccaaccattcgccatcaagcttcaggccggaggccacaagccgcgaccaggcactagcgcaccaagccaatatcaaaacaaaaaacataaaaatgaatgaatgaatgaatgatgaaaaatatttagacaaaattcaattcagtaaatattaatgcatgagaaaggtcagagaattgctggacgggcaaaagaaagagggggaggagagaacggggggttaattatctcataattcagttctgtacgatttttatttaaatatttttttttataaataattttaaaaaaactttttagatttttaaaaaaaatg

SEQ ID NO: 106192 - DNA, 474 bp, Heterodera glycines
  Promoter: Source sequence=SeqID_3113; Location=1..474; Strand=+; Gene= SeqID_83264
aaatttaaaaaataaaacccctaagaaatgaaaaattttctcaacaattcatctccaaaattgattttcatattttttttgccaggaattttagattttaaaaaatgttgtaattccttaatactgatttggcataatttgttgcttccttgaataaaaaaaaatcattttacacttctaaattaatttgaagttttttagtgaatgtttaccatttttagttcctgttttggcgtttagagcctaaataaagcctacccattttggcagtttttaaagcctaaaaatattatctctaactatcattggaaataattttgaataattgaattcatcctttttgaaattattcagttcccggagttcctccggtccgtttattaaatgttgtttttgttcatgttcatttattaaaacaaatcaggtcatctaaatttttaaaatttagcaattcaattttatttatctaatatg

SEQ ID NO: 106193 - DNA, 651 bp, Heterodera glycines
  Promoter: Source sequence=SeqID_6116; Location=2655..3305; Strand=+; Gene=SeqID_60421
attaattgaccatttaccttgataatttaccaattgcggctttatcttctttaaatgattaatatatatttgatttaggttgaacatgggcatgaggtgatggtcttgcacggaccgggtcagtttagtctggccggtttagtctggtcgttttagtctggccgttttaggctggccagtttagtcagagggtcggttttagtctggcaagctgtttttgcccataactcttaaaatgtttttttttgtcaattataaacaaggaaaaacttaaaatatctatgtttagctacaatataaatgaatatcccaattagaaaataaaaacaaagcgaaaccttcagtttggcaccgcctttttatagcttcaggcaaagtaaaccctaatttttttcacgttttttctccatagaaggcttcaacgggcttttgcttgtttatatccaactgttttccgcttcatcaacacaattcgatatgagaaaagtcaattgatgcagacatcgcacgatgcatcgctggtgaagtccctcctcaaaaaacgcgaaaatatcgtgccgttgatacgaattcttcgactcttacagggttacaataccatcaactaaaacggccagactaaaccgacccccaccgggtcttgcaccaatg

SEQ ID NO: 106194 - DNA, 129 bp, Heterodera glycines
  Promoter: Source sequence=SeqID_5238; Location=1181..1309; Strand=+; Gene=SeqID_57392
tattcgcccattctgagggacacgtcgaaatattttgccaaatcaaaattcgatcgaagaaagtgcctgattctcgagagacaaactttccccctttttccaatcccactttttgttgtttcagcaatg

SEQ ID NO: 106195 - DNA, 388 bp, Heterodera glycines
  Promoter: Source sequence=SeqID_26054; Location=960..1347; Strand=-; Gene=SeqID_56801
ttcgtttgctattcacaaagtgattatttcaatccaacaaatccatcgtccattctcttctctctgatcatttgccattccctttcactcgtcactcactgatcaccggcactgatcggacgcattatcagctgaagctgaaaagaggcacagaaacgaccgacattccccgtttttgtgttgtgtgatggtcttgtttggtttttctcattgcgctttgctttcccccccccttttttttttttgcttttcctccgcttctttcctttccctcttacgcttaccccccccccctccccttccgtttttattttgcccctccctcagaaagtgctgccggtgtcgtcggcacttccgctgcgtctggtgcagcggtgacgcaccaatg

SEQ ID NO: 106196 - DNA, 775 bp, Heterodera glycines
  Promoter: Source sequence=SeqID_36596; Location=572..1346; Strand=-; Gene=SeqID_65869
attatttaaattagtgatgggtttgctgtagggtttattatgacttttaattatgtttggctttttatggtgtcctttttcggttttttgattgggtttggtgatccgtgtgtgtgtgtgtgtgtgtttttttaaattgggtttgtcaacccttgattttgtatgggcttggtgacccttatacttccggatgacgagcagttgcgcaacggtgaatttgacgttttgacggggcaatcaggtgcagaccggacaggcagcacagtaagacgaatgggcacagcaagacaaacgggcagagcggcaggcacggcaggacaaatgggcacagcggagtggacaggcacaacagggcgaacgagcacagcgggacgcacggcaggacaaatgggcacagcgggaaaggcacggtcccgggtcgtggcaccaatttttgtcgtggcgacaaaaaatttgcgtcgaactctgcggggtgaaggggacgggaaggggatgaaatgggcgaggcgcgcagagtagccggtcgggggaacgtagggggtcgggaccgatcggagagcgatgagtcgtgccggttttcgtccaggcaaatagaccaagttgggcacaattttaataagagtatgtttattgtgtcgacctcaaacttgggtaattaaaccgtcccaatcgggacggtgagggaaacgaaaaatgggggacaaacatgataatgtgaacggggaaaagggggcacaaaaacggtgacagtaaataaatcacaaatggaaaaatg

SEQ ID NO: 106197 - DNA, 205 bp, Heterodera glycines
  Promoter: Source sequence=SeqID_28173; Location=728..932; Strand=-; Gene=SeqID_58822
gcccccagccacagcccctgctttctcccagtcttaagtcttggatttgtcaaataaattcaagacttcaaaataataatcaaaaattctcttaaaatttttttgaacccaattcaaaaaaggaaaaaaatttgcagtcaaaaaattattcgaatttctccaattttgtttccataatttccgaaagttattcggtatcataatg

SEQ ID NO: 106198 - DNA, 173 bp, Heterodera glycines
  Promoter: Source sequence=SeqID_34120; Location=899..1071; Strand=+; Gene=SeqID_63995
ttgtagcagaacaaatgagacatagctgacaaattgccggggcttttatactccccggaaaattaggccacgcccacttttgaaagctatttaagccgagattttctcacacaatcaaatcagtcttgcaaaatcatcatcaacaacaatggcagatcaatttgtacaacatg

SEQ ID NO: 106199 - DNA, 656 bp, Heterodera glycines
  Promoter: Source sequence=SeqID_11348; Location=664..1319; Strand=+; Gene=SeqID_74732
tgttttgtttgcccacacaaaacgtcgtcaagtcgctcaaccaccgcccgactaaagtccaacgattaatgaatgaatgagtgaccaataccaaaataataatcaatgcacaacattttaacactgattttgcgttaattaaaaaataaatatttatgttgtaattattttgattaattaattaaatttaattcgtttcattttttgtacttatttattttagtgtaaaaaaatgaaaaattggaaagtttttagcaaaaaaattttgtgaaactctcttttattaattactgtgaattcagtaatattttttcaaaaaatttctcggcagcatcgcctggtgcccatgaaaatacctgaaattatttcttggttcacattaagttaaaaaaaaaaattgcttaaaattcgtcacaaaataattaatgcttcctacttcaatttgggttaaaaattattttgacactaatttgattaattctaattagcattttatttgttagacaccaactgtttttttttaatatataaaacaatgaaaaattaatttttttgtgaaacaaaatgtgtgtaaatgggagggagtttttattcttttggtgtctaaaattctaaaaaaaaatctattatcattatttcttaaaaactcaacaatg

SEQ ID NO: 106200 - DNA, 556 bp, Heterodera glycines
  Promoter: Source sequence=SeqID_20799; Location=809..1364; Strand=-; Gene=SeqID_51377
agctggaaatcatgcggaagcgccgtgaatttcaggcatttaatacgcaattgttaaggcatattcctttttttattagggcccggaatttgaaaaaaacccgaaccaggcacttggtattggacctggataggattgatccggactaattgtaagaaaattcctgttttataatcaactcatgtcaatgtcctattgcatttttcaaaaacatcaaaacctgaacccttgagattcctattccgatttctgtcctttccgacctcttctttttgtgtctctatgatttagtttttcctttctcttttctcacctttccttaattcctttaggaaggtcttcatcgctttcatttcctcactttcgttgcccatcttcgctttatggcccattcccttctccgcaattcttccactcttttgacgccattcactgttttgtttggtccaatttctgcgccgatttcacccgcccaaatgggacaatttcttctcaaggaattccgaagcaaattccggtctcaaaatgacacattgaggaatgagtcgaccaaatg

SEQ ID NO: 106201 - DNA, 86 bp, Heterodera glycines
  Promoter: Source sequence=SeqID_10036; Location=255..340; Strand=+; Gene=SeqID_73094
tgtgagaaaattggggggagggcattaaaaattaattaataattaaattgaaaaataataaaataataaaaattaaatacagtatg

SEQ ID NO: 106202 - DNA, 270 bp, Heterodera glycines
  Promoter: Source sequence=SeqID_43576; Location=1190..1459; Strand=-; Gene=SeqID_71217
aatttaaagcacattcaatggcaatctttgacgaatttattgttgttgacgaaaaaacgatcagtgaattcataggcaataactgtggcagctgtaactgtaaatttcgtgatgtgacccaatttgctgcactgtaaatttaattgtttaaattttaaaatgtaaaaataatacttaaaaagcaaccaaatttaatatgtagcataataagccaagatgattttttatttcaatttaaattcatcacttacatattttagtgaattcatg

SEQ ID NO: 106203 - DNA, 251 bp, Heterodera glycines
  Promoter: Source sequence=SeqID_19327; Location=1889..2139; Strand=-; Gene=SeqID_84066
gtccgcttctctgcaaattgcaacttttgccgtcaattaccgtggcagacctttcatggagagtttagttggtcagtttttgtggtcgtaacacacacaactcacgcggatcagtcccgatagaagggaaattatgctttctaaaacgattcgaaatttttgtcatctaaattcacagtgattttctattgtttgtacgtctagaaaacaagcccctcttctactcaatcatttgctcttttggtgcaatg

SEQ ID NO: 106204 - DNA, 185 bp, Heterodera glycines
  Promoter: Source sequence=SeqID_36191; Location=696..880; Strand=-; Gene=SeqID_65575
ggggggggggggggattttggcacgagattaatttcgaatgtgttggaaaaaatgtggagaatgaattgctgattgatagcaaattggctgtcaattaaattttttgtctttctattccatttcaatcattattatttcgataattaaaatgattaatttcagtagttactgtaagagagaaatg

SEQ ID NO: 106205 - DNA, 73 bp, Heterodera glycines
  Promoter: Source sequence=SeqID_41889; Location=1..73; Strand=+; Gene= SeqID_69925
tttgcagcaaaaattattcgaatttctccaattttgtttccataatttccgaaagttattcggtatcataatg

SEQ ID NO: 106206 - DNA, 528 bp, Heterodera glycines
  Promoter: Source sequence=SeqID_21017; Location=166..693; Strand=+; Gene=SeqID_51596
tcccaccacaattagcgggtgcttgttttttggccaaatcacttccttcactcaacacatagaagacattcagaaaaactggaagcaccgctgaaacgcatgcgacgcattttcatgtcaatggattttgggaaatgggcgcagcgaaagtgccgagaattgggtgggcgcggacgaggccgggctcggggctcagaaagtcactgaatccgaaatccggtccccaaacgattcgaaattggagtattcttgaaaatgctttactaaatatgaattatctcaaattaatcaaattctaaaattttatatttttttaatatttgcattacaaggaattttggcctaaaaaactccaaatccgagcccagccaaggcacggactctttgagcaccataacatttagggatggaggagacgttgttgcacaacgatctgtggataaacaacatcctttggcacaacggacagagggcggacgaagtggccgctttcattgactggcaactcgcctcccgtggttggcaatg

SEQ ID NO: 106207 - DNA, 306 bp, Heterodera glycines
  Promoter: Source sequence=SeqID_2027; Location=1842..2147; Strand=-; Gene=SeqID_77390
agccaatcgatattcgcctctctccgtcaccaatttattatttttatttgtttcttcaataaactttattgtctatatttgttgtcgttcctttgggtaaggacacaacgaatttggcgcagtcagcaacaaaagcctaagcggctttcatcggacattttaaaaaactgatcacctggggggtgtaagtttccgctgggtgcggttttcatcggacatttaaaaaaactgatcacctggggggtgtaagtttccgctgggtgcggttttgaaaattcaacaaattttcgacaaaaattcgacatg

SEQ ID NO: 106208 - DNA, 354 bp, Heterodera glycines
  Promoter: Source sequence=SeqID_11681; Location=1..354; Strand=+; Gene=SeqID_75151
ttaattttttcaataaaaatgttttacttaaaattattccttctttggttcttgttggtcggaacggaaagttgttgcctttcaaaagaagaaaaagagcaatttaccagtgcccgaagaacggtagaaggcgtatttagagacataattaggttagataacgaagcaaaagaattttctttttctgcacataataccatggttgaagcccaaaatattaaaaataaaaaccctgataaacctggtgtgaatttttggcatagcaaattattagatggagttttaaaaattcatgccctatatgacaaaataaaaaaagaagaaaagaatatgaaaaatataaaaaaaggtatg

SEQ ID NO: 106209 - DNA, 201 bp, Heterodera glycines
  Promoter: Source sequence=SeqID_27521; Location=262..462; Strand=+; Gene=SeqID_58214
ggtctgctgaccctttaaatcctaagccttttatcacttttcaaaaattatctaattattagacattattaaaactaccatttttacaaaaacaaaatttttggagagtatatttttcaaagaaaatttgctttttaagctgtttatttttcatttttattgaaaaaatcaatttttttattcattccagacgaagggatg

SEQ ID NO: 106210 - DNA, 138 bp, Heterodera glycines
  Promoter: Source sequence=SeqID_19220; Location=1..138; Strand=+; Gene=SeqID_83965
tagcatttttaattagactcccaggacttcaaaaagaaaaagagttagacatagtcaaagcccaagctgaagagcttgaattgcttcttaaaactcataaaggacaaattcccgacccaattctccaaacagttcatg

SEQ ID NO: 106211 - DNA, 174 bp, Heterodera glycines
  Promoter: Source sequence=SeqID_3719; Location=318..491; Strand=+; Gene=SeqID_51605
ttcattcatcgggaatgaacaaataaataattggaggtggccccaaaatgagtgatcacaagtgtcgatcgacacagaccggaatttataccggaacaattattgcgggatcgctataaaaagagcagttgatgaatgggtaatgcaacagaataaaacccaaacattcagatg

SEQ ID NO: 106212 - DNA, 134 bp, Heterodera glycines
  Promoter: Source sequence=SeqID_7017; Location=4219..4352; Strand=-; Gene=SeqID_63577
ttttgttaaatcatttgtacgactagcagcaaatcaggaggccatccttcaaatcacttttggaaatacagcgattttgtttggcttttaatttttattttaggataaccaataaattcccaattttggttatg

SEQ ID NO: 106213 - DNA, 184 bp, Heterodera glycines
  Promoter: Source sequence=SeqID_8893; Location=1..184; Strand=+; Gene= SeqID_69551
cttgaaaatgcctttcacttcatgtccttgaattttttcggaaaatcatcaaaaattttatatgtaatctaaaatattttttaattattattatatgacattagaaaaatttttaaccattctttttaaatttaaatttccgttttctgagcacccaccacttcagacacttctcgtcccgatg

SEQ ID NO: 106214 - DNA, 486 bp, Heterodera glycines
  Promoter: Source sequence=SeqID_1623; Location=267..752; Strand=+; Gene=SeqID_74890
ggtgcttttgcttttgtatttgttgaaaaaacaaaccattggattttcagcttttataaaattgcgtcaaattcaattcccaaatgaaaataattggtcccaattgttttcaccttcaaaattcactaaaaaggcaattaattaattgttcactaatggttcattatatttcattttttgattaagtacaaacattatgccgccatttgttgcgttgtcggcaatttaattcatttggcacaattttgtgactttgttgagcgcaacattcggtttcaattattgcatttcgacactgtgactgatggagtcaatttcacgcatattatgacggaaaatgacggggaatttaagtgcccaaattcaattttaatgcctgtcctaaaacaaaatcggtatttatatttttatttgaatatataaataaatttttttttgcaaaggaatttttcactgcacaaagcgtggctagtgggaatagaaatg

SEQ ID NO: 106215 - DNA, 531 bp, Heterodera glycines
  Promoter: Source sequence=SeqID_16478; Location=2674..3204; Strand=-; Gene=SeqID_80886
tattgtttaattcacattcgaatgccaatgttgacgtgaacacataataattatgttttcagctgatttaataagcaccccggggaattgtttgacaggaattttgtccaaatcaaagattaattgaacacaattcgaaaagacaatttgtcctttggcattttgtcaaattaaaattttcatcctcgtttggaataatcaagtctaaatcatcaaaaagttggtttgttaccttaaaaataaaagagtatttatgcctttattgaaatagctttttttacaaaagccgacgaaaatttaccttaacaaattcctcccttaatggatggtttattaatattaaattgtctgggtctattataattaaataaatacgttaaattgctttgtttaaattttgagcaaaatttccaatcgcgtcttttcttttttctaatgatatttaataaatttttctccaccaacaacaacggcaatgttcaatggggtcaaccgccgccttttgctggcactggcgccgtttcgcagatg

SEQ ID NO: 106216 - DNA, 53 bp, Heterodera glycines
  Promoter: Source sequence=SeqID_20776; Location=1..53; Strand=+; Gene= SeqID_51337
aattaaaaagaaataaatattctaagttttaataattacctaattttcaaatg

SEQ ID NO: 106217 - DNA, 1003 bp, Heterodera glycines
  Promoter: Source sequence=SeqID_2868; Location=707..1709; Strand=-; Gene=SeqID_82050
tctgctggaaaaaagtgacatttattgctgaatttgtggtggacaaaaagtaattttcccattttgaattgaattgttttgtacaaaagaaaacattgctaaagatttaacaaagaaaaacagaaaaagtgagtttttatattccaaaattataaataattttactttatagttttataatttaaaaaaatccctttttaaatggtataaaaaataattaaaaaatttattaaaaaatccgaaactaatttaaaaaacactccaaaacagaccaataaaattatggactaaaaaacggcaaatatggacataaaatatggactaaaaaagcccgaaatatggactaaaaaggtcaaaaatgaccaaatatggaccaaaatatggactaaaaactgccaaaatatatgctttaaaccctaaaaaattacgaaaaatgtatttaagctaaaaactgccaatttttattagattctagcttttccaaaaaagtcgatctttaagggtgtatttttcgcctttttttttgcattttttttgtgaaattttgccaaaaatggccaaaatatggactaaaaacgcaaaaatagcggaatatagatttattccctaaaaccccccaaaaaaaaatttatatttaattaaaagaaagtttttgaaaaagagaaaaggtaaaaaagtacgtaaaataatttttaaaatttaaaattaaaaatattttgtatttttcggccgaatgcttttttaacaagaaaaattcatatagaaaatatataattattttaaaaaatctttacaaaatagcgagtcttttttaaattcacgtgaaagcaaataagaaaatccaccaatttccgctaaaaagattttttgatgtttttgtctaataaaatccacgtctattaaggaaatcagaaaaaggggtatttaagtgcactgaaaaaataaaataaagacatcattaatatattttattcattattaaataaaaaatctttttgccatg

SEQ ID NO: 106218 - DNA, 260 bp, Heterodera glycines
  Promoter: Source sequence=SeqID_13431; Location=1434..1693; Strand=-; Gene=SeqID_77321
aaaaatgcctttttacgtcgcttttttctaaaaaattttggggaacctggggccggcggtgccgataggcgccgccgggaaaaattttgtaattataatacgatttgttaatagattttgtcaaaaaaataaacaactcattgcaagcgacaaatattgaaagggagaaggtatagccactagactacataaacgaaaaaatgctttaaaagaaataaattatttagggtcgggattcgggtttcggaacgagaaaaatg

SEQ ID NO: 106219 - DNA, 67 bp, Heterodera glycines
  Promoter: Source sequence=SeqID_34186; Location=637..703; Strand=+; Gene=SeqID_64038
ggtaacgaaagttttggtggtaattttttgaaattattaaaatgaataaatgaaaatattaaagatg

SEQ ID NO: 106220 - DNA, 936 bp, Heterodera glycines
  Promoter: Source sequence=SeqID_6412; Location=1..936; Strand=+; Gene= SeqID_61455
aattccattaaaatttccaaaaattttcctcggctgcgcctgtcgacatcgtcagaatccatattttgtcatattttcggaaatttgactacaaaataagcaaaaatggtcattttttcagtgaaaaatgaatgaatgagtcatttctgacgattttttaatcttctaaatcacatttcattttttcgaaattttggatttaattgccccaaaaaagccgagggatttcagcccaactacatatataaatattcagcaaaaattccatccttcagcccttaattacagtacataaaccatttgaatggggtggggaagggctacgaaacatacggtaggtgtttacgggaaagtatagtaatctatggttttgtgaaaaattaaaattcaaaaattaaaaatgctcttcaaggccagctatgtgtccttctgcgggccctccggcaaacagatgcaacgcttttttgtgctgcgccgaaatttctgtctctattcctatcagacggacaaagtgccaaaatttgcggaattttcccgctaaaaattttgtttaaatttctcaaggacaaatgcgctttggccatgttgcccgtgtccggctgtgacattggtgatttatcatttatttacaatattattttgtgaattacctgaaaaaaagtttaattttttaatttatttttaatcatttttacttaaaatactaaatgaaatatatttaattcggtaatttaatacatattttttgtaccttcaaattatctatcttttaacggacaaagaagtaaaaaatctctaatatttaaatataaaatactttttaatacataaaaatggcaaaatttatttttaaaaaattaaatgtttattaattttaaatcaaaagaattttgttttttaatctggacaattacatttcagcaatcaatcagaatg

SEQ ID NO: 106221 - DNA, 954 bp, Heterodera glycines
  Promoter: Source sequence=SeqID_5711; Location=3520..4473; Strand=+; Gene=SeqID_58993
tggtggtagtttagcaccgtcttaaaaacaggaaaaaaagaacggtaaatcgagaagaatcaaggaccaaaataaaaaccaaaagtccaaaaatccaagaatttctcaaaccgaaacactgttctcaaattgcgctcgctaatgccaatgccaactgatgagaaatgtttgtggcgaattgccttttaaactcacttcactatattttagtctttggctttatttgcgctcattcatttattcatatattatgtatttttctgaatcagctaagcaacattccaatgcaagcctcttaatttagcattgctttttttacccaattaatttatatattttattttattacttaattaactaattttattaacatttgccaatgcaacattccattacaagcctcttaatttagcattgcttattttgctcaattaattaattaattaaatttattttgttgacatttgccagtacaacattctcatgcaagcctcttaatttagaactgtttgttttgcttaattaattaattatatttttttaacatttcccaatgcagcattccaatgcaattctctcaaattagcattgcttattctgctcaatttattcattaattatttttatttggttaacatttgccaatgcgacatttttactgacttcctaatttagcattgcttaattgtctcaactattaattaattttgtttttcttttattattttattaatactcactgaaatttgtgacaaaaaagctttagtaatttattcaagtgaatttttcattatcatatatcgttatgttcattgcattttgtgggctcatttactacaaaactcagctgaatcattagtccattttcaatttgttctcactgatcggctgaataatttttttttaaatttaccacataatattagtaaattgctttagaagattaaaataatg

SEQ ID NO: 106222 - DNA, 818 bp, Heterodera glycines
  Promoter: Source sequence=SeqID_7320; Location=1..818; Strand=+; Gene= SeqID_64460
attgggaagaaaatgcaaaaatggtctttgatcagccaaatgaacacgttaagtgatcagataaattttgctaatgagcaaattattggacagtcgagcagcggcggaacgggttataattagaatgtgattatgacaaaatgattgaccatgaaataattttgagagggtggagcaatttgaaaaaattccaataaaatgaaaaatttaaatgataaattaacaaaattttttaattttaataaaaagaaaaagaaattgaattaatttaaatgataaattataaaggatttaatttaattaaaagtgaaaaaaatctcaaagccttgacaagataaaaatattagaaaaatttaaaaagtaaaattgaaaattataaaatttaatttcctttaaattgtttaaatatgtacaatactataaaataaacacattttaaactattaaaaatgctaataaaaactaagaacttccgttgtcgatttaaaaaatttacgcgaaattttacattaaaaaggagcgcaaaaacattggtctttgaccttgcgatcagaaatgatacaactgatcagaccaaaaaaattggtcattcaccggaaataaaaaggggcgggggcacaaaaaaggctctgatcgatcagtcagtcatgaatggcgtcaaaaaaatgtgatggatgctgttgtaaatgtcacagggtgtaaattaattatgcctttttatccagtttttaatggaggggggggggggggcggaaattcgaaaattggaatatgtgcgccccgcgtgacaatcgtgcaaaaaaaacgcgaaaaatatg

SEQ ID NO: 106223 - DNA, 443 bp, Heterodera glycines
  Promoter: Source sequence=SeqID_14392; Location=2883..3325; Strand=-; Gene=SeqID_47198
taatcaactgaggaatatggtaaatctaaaaagtaaaatcaagaaatatgtaaagcataaattgacagttagataaattaaaaagagcaataaaaaaatttgaattattcaatttgaatttttttttttttttggcaaaatgatctttctaaaattaatgcggcttaacaatatgtgcacaaacaggacgcacaaaatatgccccattgctccacatagctcaaagatagacacgcaataggcgcgattagttggggcggaacagaacggggaggaatggagagggagaaggagtagttttataatttataattgattttcatcgttcgtttccttttgaccattacatcctttcatttttacatctttttggagaagacacaagaatttatttacagtgattaaatagtattttagaataaatacaaattattttaaaaatg

SEQ ID NO: 106224 - DNA, 51 bp, Heterodera glycines
  Promoter: Source sequence=SeqID_20160; Location=1961..2011; Strand=-; Gene=SeqID_84948
aatttaaagctctgagaagagtctcgagtattaattagtattaagcatatg

SEQ ID NO: 106225 - DNA, 500 bp, Heterodera glycines
  Promoter: Source sequence=SeqID_5784; Location=1554..2053; Strand=-; Gene=SeqID_59211
taagtagaataatgatttatagagttttttaatcagaaaaaaaattttttatatgcttgtttataatgtatttcgattaatagaccataaatacaatatccccttcctccccaacccacacaattcgacgcccccgaccagcattgccccaggcggtttgtcccttacgcggtcgctcttctccagcggctgcttctcctctcccttcccatcatcgcccgaagcaaaagcccctgaggcgctttcctctctccacaccgtctcccgccaattactttattctcttttcatttactgcttgggaagctggtgatgggaatgtgtggggttgtggggggaattgcccctttccgccttcattttcttcgctttgtatttattttgagtattatgtccaaaatgaattgcttcgtacttttaggttttgaaaagaatcaaagccatttctttgaatagatttgattcatttcatttaaaaaaaacaaaaattgccgccgatg

SEQ ID NO: 106226 - DNA, 420 bp, Heterodera glycines
  Promoter: Source sequence=SeqID_10677; Location=1..420; Strand=+; Gene=SeqID_73923
aaaatgcatggtatacaatttttaaccattgtaaggcaaataaaaaatggtcatgcaattttcctaattttcaaacgttacgtcgaacgtcgaaatctaacagcaccggaatccggattttcgcagattttttgatggctaattgatcaacttgcaatttaaaataattatgaaaatctatgaaaaatttaaaagaatttttgattttttgagagcatctgtctgataagattttttaattgaaatattaattaaaaatggaaaaaatttctcgattcgatgttggcttagaattgcatcctaattaggcttcctaatggcaaatttaatttgtcataattcacggcacaggattggctggcccaggtgaaggaatatgccaaggacagtgtacagcttgtgcttgtcggcaacaaaatg

SEQ ID NO: 106227 - DNA, 125 bp, Heterodera glycines
  Promoter: Source sequence=SeqID_38125; Location=1..125; Strand=+; Gene=SeqID_67038
cttcggcttgagcgaaagaagtgatgccgaactctgatcttctgacaaaacaaatattggtttgtcattcaacttaaaaaattaataattgaatgatttttggcttcgctattcagaaggaaatg

SEQ ID NO: 106228 - DNA, 293 bp, Heterodera glycines
  Promoter: Source sequence=SeqID_5196; Location=1193..1485; Strand=+; Gene=SeqID_57229
tccataaaggaacagctaaaaatttagttggtcacgcgaagctaaaagaaaagcaacattattttttaagtgatttaaaatattttttgtcattttggttgcccgatttttaaattttgaatttgattttttaagatttgttttcttttgtgaaatttttattatcaaattaactaatctttcgttgtctccgcctcatttaccatctaaaatgatagggataacaaacagtttaataacaacaactttagataatcgttattaaataatcattactagagttttgaaaaatg

SEQ ID NO: 106229 - DNA, 233 bp, Heterodera glycines
  Promoter: Source sequence=SeqID_3336; Location=607..839; Strand=-; Gene=SeqID_84260
tttcgtggtcgacgcattactttttttgccttttgcgcaaatggacaaataaattatgggtttttgggcgaaattcctcaggaaactgcgactttgcctatttcaatttgtttttcgaatttactttttacgaacccttagaattttgtcagctttcccatgatttctctttcacccattttcttcaataagtgagtgaaggccgtttccaaattaattattgccgctaaatg

SEQ ID NO: 106230 - DNA, 389 bp, Heterodera glycines
  Promoter: Source sequence=SeqID_35153; Location=675..1063; Strand=-; Gene=SeqID_64779
ttttaaatccatcatttgctcagctttatttaattgaacatttcaaactatctcaccaacaatttaacagattaccaccaatttaaaatcctcatttgctcagctttatagaagtgaacatttcaaacaatctaaccaaaaatatagcagaataccggcaatttaagatcatcatttgttcagctttattgaagtgaacatttcatacaatctaaccaaaatttaacagcatcagctttcaatatttgttcatattttatttatgacaaaagaatacaaaatttgccctcgaagtttggttttttctgaaataaaaggcacgtcaaatgctcgaaaattcatatttcattaattattcaattttattttattcaaaatcaataaaaatg

SEQ ID NO: 106231 - DNA, 1003 bp, Heterodera glycines
  Promoter: Source sequence=SeqID_4300; Location=184..1186; Strand=+; Gene=SeqID_53953
tttttgtaaactgacgaaattttttgaaattttacaggctaatagagaatctgaagagctatcgaatgataacaaaaatttttaatttggttgatcaggaaaaaagttgttagcaacggcgcccgaaaaggccggcgccgaaagtgggcggttcccatttatagccctagttatttgatggaaagaaaataaactgttttatttattaaatatgaaaaaataactgattttttgtattgttcattttgatcagccataactcgcttcattccccactaaactgaacaattttgatatgcttcaaaagatattgaaaaggagaaactttataagcaaaagctaagcattttgaaaaaatatctgggtgaactgtagtgaaagccccttgaaaaaagggtcaaatgatataccaatcggttcgtctcaaggagctaagcatggaaaaatatgtctcagttgcggaaatacaaaaaaaactggtttttaaacctgttcaaaactcgaaaaattgtgagatttcgcacactaactttttttaaacgatcgaatccccacaaatttgggggaccagagcgtttgggcccccgtttttgggcccccgcgtttgggcccccgtttttgggccccggggtcgtttgggcccccgtttttgggccccggggtcgtttgggccccaacccaaaaatcgaaaaatgtgcttttttaaaaattaagattctaaaaacagcctgagggatccctcgccacttggcataagctaggtttaattaacattcgctcatttttcacaattttacttattccaaatcctattattttttaatagttaaccaatttgatgtacattctgatttggacatttttcagaatggctaacccaattgcaaccaaaaaacaaaaagtaaaattgtcttacaaaggccacctttaacccttcgctaaaatgagttctgatgggatgacaaaattttggagatgagttcaaaaacagcactgacaaatg

SEQ ID NO: 106232 - DNA, 159 bp, Heterodera glycines
  Promoter: Source sequence=SeqID_21426; Location=1..159; Strand=+; Gene=SeqID_52030
aaatttattcggggtctcacctccgtctcgcagacgggagacctaaatttggacgcggttcgccacgatctggactgggccaggggtggacggacaacaacaaatccttcagcgaaaaatgtcaattataaccagcagctccgacgttatttacagatg

SEQ ID NO: 106233 - DNA, 120 bp, Heterodera glycines
  Promoter: Source sequence=SeqID_3059; Location=3850..3969; Strand=-; Gene=SeqID_47513
tgtcagtgaattgcatgcactccccattttgttgttgtgtttaagtcactgaatcgcgtccctttctctttcagcactgatgatggcaccggcaacttcttcctgagcgcatatgccatg

SEQ ID NO: 106234 - DNA, 614 bp, Heterodera glycines
  Promoter: Source sequence=SeqID_19660; Location=571..1184; Strand=-; Gene=SeqID_84394
accagttgccttcgccggccaccctacagtatcctgcggcactcattgtgaaccgtgacccccatcacaaagggggctcccattggtgtgccatttatgcccgggacttggacgcgccagtgatttactttgatagccttgcccttcccataccaccaagtatttcatcatcctttttaaataaatttcccaaaggtttacacaaaaacattgaagcctaccagtccccattgacatcaacatgtgccccccattgtattgtctttgtttaccacatgtcccatggaaaatcattcgataaatttatacatattctcaaaacttgttcaaaccctgacatgtattcattattaatgctaaataaaatgttgaacagttaaattatattttcaatttcttaattttttcaaaattgtgtcttccacctactaattatgcattattctacctaaaagttacattttccaacgtttaattattttcgtactttattttccattcattaattatgcatgcaataaaataaaaaggggcggagcttatccatttgagttggaacaccggtataaaagccgctcgaatttcttcattcagacataaaaaaatctgaaatg

SEQ ID NO: 106235 - DNA, 91 bp, Heterodera glycines
  Promoter: Source sequence=SeqID_38297; Location=1..91; Strand=+; Gene= SeqID_67157
cgttgatggcgatggatttataacgcgtaaaaataagtaatgaataaattaattattttaaaaattaaattttagatccgagctgaggatg

SEQ ID NO: 106236 - DNA, 588 bp, Heterodera glycines
  Promoter: Source sequence=SeqID_7666; Location=639..1226; Strand=-; Gene=SeqID_65561
tctaaaagatttttatagaaagcgtcgccggaacgcggtcacaaaagaaaaatgcataattaagtaacataaattctaacattcccacgtaaatcacgtcaaatttacaactgaaacgctatctgcttactcaaccaaaagaaagctaaaagtcaaataggtttgtccaactttctgaaaacggtaaattaagcatgtcagatccccagaatattactcttgaccatctattattttttacgactttcgctaatgaaataatcaatttttactacattactattttatacattcacgacttttcaaagctacgttttcatgtgatttttaatgagttgtcactgaatttggattcagttaacccattggtaagtagctgtgaatgttagcattctaaaagatttttatagaaagcgtcgccggaacgcggtcacaaaagaaaatgcataattaagtaacataaattctaacattcccacgtaaatcacgtcaaatttacaactgaaacgctatctgcttactcaaccaaaagaaagctaaaagtcaaataggtttgtccaactttctgaaaacggtaaattaagcatg

SEQ ID NO: 106237 - DNA, 360 bp, Heterodera glycines
  Promoter: Source sequence=SeqID_19; Location=7579..7938; Strand=-; Gene=SeqID_76509
agttgaaataaatgtataaaattgattaattagttaatgttttgcggtatttaggtgggacttcaggtcgcggtcatggaagaagcgggtgcgtcccctggaagaagacccggacaaggccaaaatgtttgtgcgtgtgtacaccgtgtcaccgcgcaagcatgagctatttgccttgaggtaataaattaaaatgaaaagttaataaagctatcaaatagaacactgctcctccaccgtccgggacccaagagctttgccgaccttcgcaccattgatggcatccaatttgacacattcgtgggtacgtgccaacatttgggtcttcaagtgagcgatgaagtcttccgccgagccatg

SEQ ID NO: 106238 - DNA, 776 bp, Heterodera glycines
  Promoter: Source sequence=SeqID_9134; Location=2581..3356; Strand=-; Gene=SeqID_70355
ttcttttgctgatgttttatttaataaaaacattatttatttccgttttattacgcttataaaaaacataagtatgtgcagactaaaataaaatcttttagccaaaccaaattttttgttttatttatttttaattaatttattttttaaccaaatagtgtctaatattccggtgtccaattttccattggtgtccaatcttctagtgtccacttttcggcgtccaattttctggtgtccaatttaccgggagccgaatggcgagatggaaaacgtaaattttcttttataattaaggggtgttaaccagaggtcgcatttttacttatttgtaagtattttacttattttgagggtccaaaacttacatattttaaatgtacttatttgtaagtaatgtacttattttggcattctagagaaattcaatttttttatctttgttttaaagcgaatattaatttttttttttttttgcagtcttgtttttctctttctattactttttaattcgctttattgagattcataaaggttctatttagcctagcttataggttcatggctcctccaaaacataaataattggaagacaagttatttgacgaaataacagatatgaacagaatcctggcagagatcccccatttttttggcatttcaatcgaggagaaatggaagctggttttcaaggtgaatggcattttctagcttgcttatttacaaaaaaataggctcaactcccaaatttgtacgttctgatcagcaaagttatg

SEQ ID NO: 106239 - DNA, 424 bp, Heterodera glycines
  Promoter: Source sequence=SeqID_25308; Location=1439..1862; Strand=-; Gene=SeqID_56057
caaagaaaacgacgattaattgcttctgctggccatggccacggttttgtggcataaccttgacagaaaaagcaccgaaatgaatgagcaaaatggagacgaaggccaatttgaagtgcatggaaattgggagataaagggtctgtaaaggcggaaatataatttataaaatttaaaattagaaataaattaaagaaatttcaccaaaatgaatagtaaggttttttgtttcataaatgaagaaattttatttccatttattaattggattaaacaaaagttaaatcagtctgagaatgttgtcaattttaacggacaaaattccgatggattgtcgaattgtttcgtccatttcgccaagtacaaattccgtcgccatctctcccaaccattctctgcaatctcttagttcgtcagtgaaatg

SEQ ID NO: 106240 - DNA, 91 bp, Heterodera glycines
  Promoter: Source sequence=SeqID_29312; Location=552..642; Strand=-; Gene=SeqID_59821
atgaaagatgtgacaatcagcttatacaataataaaattcatttaagttaatgcatttgaaaaaatgacagcaaaagggaggagcattatg

SEQ ID NO: 106241 - DNA, 66 bp, Heterodera glycines
  Promoter: Source sequence=SeqID_34501; Location=1..66; Strand=+; Gene= SeqID_64272
atttcttaatttcaggtaattaattttttttatttccacaaaatctccccaccccaaaaaataatg

SEQ ID NO: 106242 - DNA, 758 bp, Heterodera glycines
  Promoter: Source sequence=SeqID_16279; Location=965..1722; Strand=-; Gene=SeqID_80672
ttgcacgtaacaatgcacactacctggtgctgatgcgcaacccgtcgggcgcacttcaggtacgctcgttgggcgtccagctgttcccgggtgcgctgcgccacttcctcgaggcgtacgatgacgcgacagcggacccgtttggttacctgttggtggacatgcacccgaccacccgaccacagatgcgcctcaaaactcatatatatccgggcgagctgaccgttgtgtacgcaccacgagaccgggcagcaatgttcaatgcagaagaagcataaaagcggaaacaacaacggtaacagcagcagcgacagaccagaaacaatacaacaagaaaagagacaacaacaacaacaacaaaagcaagcgaagaaaaggccgaaaccaagtcaatacattcaacggaacactagctttttcaagcaactgagcaactgtcgctcggcacgcgcacgtgcctaccgtcagctggtgaggggggcgagcagtgagcagctgttgtgtctggtggaaagtgcgttgaacattctccgtgcacgcgtcccgctccggagcactcatcttcagcacttgcgcgctcaggcccaacacgtgcgtgcgttgggccgtgcgagaagcggccacggggcacgtcgactgttgctgagacagcagaccgggcgcggcgtcccggccttggctggcttggtggccagcgttgtgcttccactgctggcggataagctcatgagccgcaaagacagcatcatccaaacatg

SEQ ID NO: 106243 - DNA, 128 bp, Heterodera glycines
  Promoter: Source sequence=SeqID_38440; Location=1228..1355; Strand=-; Gene=SeqID_67253
cggggatctctagagccatttgcaccttcgacaacgacaacaatgctgctagccctctacaaccacaatttgttggattaagcgattatgactgtcaatttgacaatgatcagcccacggaactgatg

SEQ ID NO: 106244 - DNA, 68 bp, Heterodera glycines
  Promoter: Source sequence=SeqID_11171; Location=1807..1874; Strand=-; Gene=SeqID_74524
atacacaaaattctatttatctttcaataattaaattttagatttatgaccctctctactactcaatg

SEQ ID NO: 106245 - DNA, 669 bp, Heterodera glycines
  Promoter: Source sequence=SeqID_28907; Location=1..669; Strand=+; Gene=SeqID_59474
ctcgatcagaaccccactctcgaataaagccccccttctgagaggggttgaacaataaagccaccgggggctctaatcgagtaaatacggtagttaaaaaataataatttttttttaaatttttgcaaaaaaggagaaaaccataatatttgcaaataatgaaaattcagtaggataaattattgcaaaagaggagaaatcataatgtttgccaataataaaaaatcagtaggataaattttttgcaaaaaaaaaatcaaaaaattaggcaatattattatgtaattttattttattttcagcaagataaatttttcattgtcataagggttggcataatcaacgtcaaaattaatgtcaaacaatgccagatggactgcataaatacggggtggcataagctgaagccatcctcatggcccgtatttcagcttttttccttttcatatagcatttttggagagatgaaagcaagaaaaataaaaaaatttctgacaaatatgaattagagcgagttattacatataaacatcctagaaatagtcaattttgtaggtttgacaataaaaaactatttagtttaagcatatatttccgcaatttaaaaaaataaaataattaatataaattttattttttaagacaaataacaaaaaaattgaactaatg

SEQ ID NO: 106246 - DNA, 190 bp, Heterodera glycines
  misc_feature (18)..(18): n is a, c, g, or t
  Promoter: Source sequence=SeqID_9451; Location=2137..2326; Strand=-; Gene=SeqID_71469
gtcatgcaattttgcgcnagagaggatagcgtcggggcaaaatttattttaccatttatgcaaatttgcgaaaagacttcaaaaatttccatttattagtcgcttaatggttctttgttattttattcattttggggggtgactcacataaattttcattcagatcccggagttaattgaagaggcgatg

SEQ ID NO: 106247 - DNA, 1003 bp, Heterodera glycines
  Promoter: Source sequence=SeqID_4027; Location=1277..2279; Strand=-; Gene=SeqID_52874
agcgtaataaaatacacccctaagaattgaaaaatttttctcaaaaattgatcgccaacatttcatttttttcaaaagttatggattcttaaacttgtctgggacggagttggcaggacggagttgacccctacccagatgggggtgctgttagttttcgacagtggtgatctcgacagtgttggtttcgacagtgattgatttcgacagtaaagcttatttttttaaaaattgttctatatggcataagtctcgttaaattttgacaattagaatgataagaacatggctcttatacattgcagaggtgttcgagttttcgaattcttgcttaagagcttgcaaatttgaattttggcacttgaacccggcattagttagcagttttttccacacgattcgagaatcttatctaagaaatttgttgtatttttgactacagtctagcaagagatattttttagaaaaaataaaagcgataaatttttgccaaaaaaatcatacaagtcttattttattacttacttcaattataaattttgtatatgcaaattgtatattcatataaattcatgtgtacaataaatcatgtagaaaattaatttaaaagtactgtcgaaatcaatcactgtcgaaaacacctggtacgaaagaggtggacaggtggcaattacccaataattacggccagatgaaattgcacattaattaagtggcgctgaatcttcataagtgcttattggttagattcattcctttaattatcagataaaggttttttaatgttttaaagtgagtttagccattaaatatccgatgaatttcagaaaatctcaaatttttacatcccttcacataatttgctgaaaagcattaaattttgtcgacatcctatcattcgatagctttaagtgttctttattaatttaaaaattccagaatttcgtaagttataaatattgtttttccctaaaaaattctttgtagcaaaaaaaaccaaatg

SEQ ID NO: 106248 - DNA, 287 bp, Heterodera glycines
  Promoter: Source sequence=SeqID_41166; Location=1..287; Strand=+; Gene=SeqID_69355
aagagacaaattccaaaaacgaattttaggagaagcatttgaagaagaaaaaacaaagcaatgcgtaaaagaaaaagaaagcataaaaggaaacaaaaaaagaaaagaatggactaattaatgggaaaaacggaaggacctcgtgggttttaatgataccctcaattaagaacaattaactgattaattaattattgatgaaggaaaatggaaagctacgccggaaagaaaaccaaatgatttagggattggggaaaatctcaccgaattcgcgcactttcggcatg

SEQ ID NO: 106249 - DNA, 65 bp, Heterodera glycines
  Promoter: Source sequence=SeqID_34364; Location=286..350; Strand=+; Gene=SeqID_64183
tgtcctccgcctccgatgttgtgccatcctcgacgaccacttcaatcgcaccaacgacagagatg

SEQ ID NO: 106250 - DNA, 175 bp, Heterodera glycines
  Promoter: Source sequence=SeqID_15080; Location=1326..1500; Strand=-; Gene=SeqID_79253
tgttttaaaagaaattttaaaatttaattctcgaaaaatgttcgagttcggattagggattcggaattggtcgaaatggaggccggattcgtgctcagcgcctcaaaacacccctagaaaagtgttaaaaaattttaagataaaaaaataaaattaaaaaatttcggggccaatg

SEQ ID NO: 106251 - DNA, 140 bp, Heterodera glycines
  Promoter: Source sequence=SeqID_21701; Location=1..140; Strand=+; Gene=SeqID_52312
agcaacaacaacatgaagatgagcagcagaaagaccgtaccacaattttgattgcgccccgaatttggtggaaccgtcagcgttatgaagtgtttcctcaaatttctttggttgtgtatgatcgtcgccgggaaccaatg

SEQ ID NO: 106252 - DNA, 209 bp, Heterodera glycines
  Promoter: Source sequence=SeqID_32496; Location=1..209; Strand=+; Gene=SeqID_62801
tgcgatttttgttatgtaaaaaacatattaattttaaacttattattatttttaaataaatacaattttttctgagaatttttaaataaaatgaaactccacctattaatcgttttatttatatttttgatcactcaaattaatcaaatcggaacagaaaagaaaaagttggaactaaaatcatttgatgaaacatttggagaaaaatg

SEQ ID NO: 106253 - DNA, 389 bp, Heterodera glycines; identical to SEQ ID NO: 106230
  Promoter: Source sequence=SeqID_35153; Location=675..1063; Strand=-; Gene=SeqID_64780

SEQ ID NO: 106254 - DNA, 359 bp, Heterodera glycines
  Promoter: Source sequence=SeqID_4075; Location=255..613; Strand=-; Gene=SeqID_53062
ttttttatgtgaccagtaaaagtcagtattaccaaattttgtggtgtaggcccaaaacccaagttttcgatgcgatctctggaaaaatctcatctctattcctcattatgttagacttcagatttgactgatttcaccacttttgaattgttttttatatttttatctggattgaatgtctattcaccagagcaactcaccaaataggagtccacaatttggcgtatttaatgtttattgtgtggcgtaatgaggaaaatatcccttttgcttttgcattcctaactacctataattgagcgtatgattcactttattttcatttgtaacatttctcagattcctgtgctaaacaaatg

SEQ ID NO: 106255 - DNA, 726 bp, Heterodera glycines
  Promoter: Source sequence=SeqID_6229; Location=925..1650; Strand=+; Gene=SeqID_60807
gtagtgattaagagaggacaactttgaccgattgataatgggatttgcttaatttgataaattttgttggaatttttaataactaagttaaaagttaagccgtctttttctatttgtcgtataaatttcttcttaacttattatttaatgaatttataagataaatggatgaacttgttcatttcgaccccagcagtgtgagttttactatttgatttcagtacacttatccatgatagcataactggaaaaagatattcacagggtgtacaaggcaccaacgtttttgtccatttttcaataatttttaaatgagcatccctttctctgtagatttctctcttttcggcaaatgcgttgtccgttgatgatcagagcagcagcactattgccgaagtctgttgcccttctctttctttcatttggtgtgttctttttcaggaaaggcctctttcgtccgagtcacaattagtcgcccaaaagtcaattggcacagatcagacggaacatggcgaaacggacggaaggcgagtgacagagacacctttagggggtgggcgaagatttcatgctttcatcttcctcccccccccccaattcgcctccctattttggcccctttttgttagtgcgcgggagaaggtcactctatttttaatatgtggggaagcccttggcaaaacgaattcgtttagattttccacttaccatcgaagaaaaaacatg

SEQ ID NO: 106256 - DNA, 64 bp, Heterodera glycines
  Promoter: Source sequence=SeqID_25072; Location=1038..1101; Strand=-; Gene=SeqID_55801
actgaaatttcgagcaaaaaaatgttcgccgctaaatcaatcggccaaaatttgttgcgaaatg

SEQ ID NO: 106257 - DNA, 67 bp, Heterodera glycines
  Promoter: Source sequence=SeqID_12531; Location=1684..1750; Strand=-; Gene=SeqID_47046
tcatatattttaggccatgagtctgctgtattttcgatttgcatccgatttcgagtttttaaaaatg

SEQ ID NO: 106258 - DNA, 135 bp, Heterodera glycines
  Promoter: Source sequence=SeqID_29874; Location=1044..1178; Strand=-; Gene=SeqID_60338
caatctctagttattatctgttatctgtgctcaaattcaaaagttaatcaaaagacaaattttaaaacgcctttatcttttttctaacacgtccaactgtttaacatttcttagaaaaagtttcagctctccatg

SEQ ID NO: 106259 - DNA, 561 bp, Heterodera glycines
  Promoter: Source sequence=SeqID_27765; Location=247..807; Strand=+; Gene=SeqID_58431
tggagaaacgaaaaaaacagaaaaatggcgagaaaagaatacatttaattgaatatattccaatgattgcttaatggaattgatcaaaaatgttttgacaaattttgcaaatgattcgacttattttttaagctttttctgtttgataatttcccaatgagggcgtaattggcaaaattgttggcatcaatataaaacatggaatgcattttaattaatgaagcaaatttatgaataaatggtccatcaaatgaaaaaacatttgatgagaagcgatgcccgggggaatgaaacaaaaaaagaataattacattttgagaagtacacaatcagacttgttatttattataaaaaggccaaaataaaataataaatatatcaaatgaaatgtaaaataattttaattcaaatttacaataaagtcttaaaatattagaaagtccttttctttttcgtttcgagtttcgtttcaatgtgccaattttttggggggtttctttcgttttctgggtttttctgtcgagaaatgccgacaagaaacattaattgtaagtcaaaatg

SEQ ID NO: 106260 - DNA, 62 bp, Heterodera glycines
  Promoter: Source sequence=SeqID_22776; Location=840..901; Strand=-; Gene=SeqID_53472
tgattatcaaattattttgttatttttttttcattttcagccgtcacgtttctctccacatg

SEQ ID NO: 106261 - DNA, 307 bp, Heterodera glycines
  Promoter: Source sequence=SeqID_4446; Location=3345..3651; Strand=-; Gene=SeqID_54482
gataattcaagaaaaaagtgaaaaataattttactgtctaaaagtaacaatttctttaattttcgagaatacatcaaaaatctggatagagtgaaacggatgtgtttttgaaaaaagatttaaattctttctaaattcctcgggtaaaaataaaatggaaaacaattccatcctttaaataattaattataatgcatttttcttgttcataaaaggaaagcgctccgtctgcgcaaagtatccgatttttcatgatcaaaatgacaccgccaacagattttactttgaaatttcaatcaaaaatatg

SEQ ID NO: 106262 - DNA, 72 bp, Heterodera glycines
  Promoter: Source sequence=SeqID_13267; Location=700..771; Strand=-; Gene=SeqID_77102
aacatctcctcctactctgacattttaaattgctgtcacatttagtcgaacagggtcggaaaaccgattatg

SEQ ID NO: 106263 - DNA, 319 bp, Heterodera glycines
  Promoter: Source sequence=SeqID_788; Location=1511..1829; Strand=-; Gene=SeqID_61290
aaattagaagccaaaatgcctgattttaacctgaacatattgctacacaaaagcgtgccctttgttgataaagtaaaattatgaaaattatttttaacaaaataattatttaaaagaattcatatatgaattaatttagtatacatattttgtgctgatcaattgtgtggctgagcaacaaacgcaaatttttgacaaattttgtcagttcgttgacgggcgaatccgtcggcaaattttatacgatttggacccaaaaaatgggccaaacattggcacacatttgtaccccgacatttaccagcacaactgcgaaatg

SEQ ID NO: 106264 - DNA, 107 bp, Heterodera glycines
  Promoter: Source sequence=SeqID_10531; Location=1410..1516; Strand=-; Gene=SeqID_73761
ttatagttaattgaggaggataattattgtgggaattatcgatttgaatttttttgatggaaaaagaggggaatggaaaaagaggggaatggaaaaagaggggaatg

SEQ ID NO: 106265 - DNA, 171 bp, Heterodera glycines
  Promoter: Source sequence=SeqID_3208; Location=1..171; Strand=+; Gene= SeqID_83712
attttcatgatcacttttgtgatattctcaatatttcaatttcttatatccaaatgtattctgtataagttttcagtaggaaattgtaatttgggggttattggcgatttcaaatggatcctcccggaacactgattctgtttatatttagatcgtaatgatctgaaaatg

SEQ ID NO: 106266 - DNA, 610 bp, Heterodera glycines
  Promoter: Source sequence=SeqID_32639; Location=621..1230; Strand=-; Gene=SeqID_62933
ccaaataaataaataaaattgcgttaataagcttaaaaatttataaaaaattaaaacttttattacttgattttattaaaaggaaacatggctgaagtgaagcacggtgtttttgagcaatttatagaatgcagggagcaacttcttcgactgccgaggcctctcaaagttcaaaagaattaaaacttaataactagaataaatatagtctataatcaataactagaattaaatatagtctataatcatattgaaaagaaaaaataattttgctactgtaaaatgcattcggtaaaaatcttataatttatacaattaaaaaaaattaaaattgataatttagtttatttataataattaatagatgaaatacatttagaatgtgtatgtttttgggatgatttttatttcattataaaagtttattatattgaaaataaataattgaaaattcaaaatttcaaaaatcagtttaatttcttgtaaaaataattgatactaaaagaagatcaaaatttttataaaataaaataaataatatcaattatgtataaagaaaacccaaacatgatgtataaatttaaaaaaataaagaaatcatttaattatg

SEQ ID NO: 106267 - DNA, 60 bp, Heterodera glycines
  Promoter: Source sequence=SeqID_22970; Location=1238..1297; Strand=-; Gene=SeqID_53670
tacagggtaagtggcaatttaatttgggaaacaattggtttagattatttcggcccaatg

SEQ ID NO: 106268 - DNA, 761 bp, Heterodera glycines
  Promoter: Source sequence=SeqID_3623; Location=1097..1857; Strand=+; Gene=SeqID_51162
ttttctaccgtttcccaattccttattactgtatgccttttttcctttatttttctctctcattgtcagtgtccaaagttgcctggtttttgttccaaaaggatggcaattttacgatgggccattataattttgcggtatgaaatgttttattattttaaatatatttgattgagccgttattacaagagctagtaaaatcaaaattatggacatcgcaaaagaattcaatttgcaattaaattttagtgtcgcgagcaatcgaaattttgaaaaaactttttttattactcaaaatacataaatattaaaaagataaaatctagaaaaagaatcccagaaaaagagttttattactcattggtacaagggatggcattctgaggccccaaaaaattttcggaaacagattttgttaaagaaatgactaatttaacgaatttgagcaatttttaagaaaattatgaatttagggcaaaattattgatttttagggtccggcagagctgataggcgccgccgggaaaaattgaaattcaggcaatttattaacagaatttgttcaaaaattcaagtttttttgaaaaaaactcaaaaaatttccgaaaatatccgactttttatcaaaaatttcgggaatcggaattccgtgcctcaatttaatttcccaatgcataaaatacagttttactgctggcgagatttgttttaatttgatttctttcaaggaaaaattccaattcggatcacagcccaacatg

SEQ ID NO: 106269 - DNA, 275 bp, Heterodera glycines
  Promoter: Source sequence=SeqID_4937; Location=2119..2393; Strand=+; Gene=SeqID_56284
cctttaaaatgaacaaatcgaagtcaaatgataccaattgacatttgctttttcaccacaattttttctatttgttcagtggggggggggggggggggggggcgtccgtttggtattatgaagagagtgcccgcgaactgttctatttcgccgattcgttggacgaccgaacggcacaatttgtgcgccaattggacaaaaggcgcgaaatgtggcaaaaaacggcggaggcgaaattggagggggcgacaaagctttgtctggtgcacaaaatg

SEQ ID NO: 106270 - DNA, 65 bp, Heterodera glycines
  Promoter: Source sequence=SeqID_40546; Location=1..65; Strand=+; Gene= SeqID_68846
acagaacacactttgccaagagcccaaccaaaatcggctgagtttgcctcaacagcaaaagaatg

SEQ ID NO: 106271 - DNA, 143 bp, Heterodera glycines
  Promoter: Source sequence=SeqID_12360; Location=2662..2804; Strand=-; Gene=SeqID_75963
atttataaaatttaatttaatttttattttttcatacatattttattcaagaaaatccaggctctaacatattaaaaaattattttttcctttacccataatattaataaacattgcaaatttctttcagcaattgaattatg

SEQ ID NO: 106272 - DNA, 795 bp, Heterodera glycines
  misc_feature (93)..(94): n is a, c, g, or t
  misc_feature (174)..(174): n is a, c, g, or t
  Promoter: Source sequence=SeqID_8670; Location=1..795; Strand=+; Gene= SeqID_68815
acatgaacaaacaaatgtttaacattttttctaaaatattgtgaattttgatccaatgaaagtgcattgaaccatatgttatttttcaaacanncataaataacaattttatgattatttgatcttaaatgtaaacccaaatttgtctcataaatttaaatattttttgaaatntaaaatgagataatttaaaaaactgaaaaaactcttgtctttttttttgcttaaatgaaaatgatcatttttagaaatatgtttataaaaatgtaaaatgtacactatcattaaaaataaagggcgttttaatgaatttggcctcggtttttggcacgtaaacttcaaaaattggtataatttaggccctataaactctattaaaattaaccatgacattttgtgtataatttttttcatatttaattttttttgtaaggatgcattttgtgtaaatatgaaaaaaatagagaatgaatgcatttttcgtttttattatgtttttgtttaggaatattgtgcaaaaaattgaaaaaatatgattgtgtttttttttcgagccgaaaacataggaggtagaagcaacagtatctaaaaatattttttttgtagttttttgcaggtatttaggaattcggagttcgggaaaaatagagagatcccttaaatagtcgatttaaatttggatacatattagatggaattgtttgtaatgtgatgctcatttgctctctaaatacattttgggacgacaatttgtccattcctccgcttcttcttttcgttgaatgtcccccgatg

SEQ ID NO: 106273 - DNA, 464 bp, Heterodera glycines
  Promoter: Source sequence=SeqID_18662; Location=923..1386; Strand=-; Gene=SeqID_83328
ttttttgcataattgttttttcagagggtcagaactttttcatcaacccaataggaagaaaaacttggagcctggcttgtcggcaccgtctatcccttctttcccaaaaaacccaaaataattttcatttccttcaaatttcccgtgcttttttatttagataattctgagttgatggctacatcctcctgtgctgattgtttctttttccctttcgtcactttgagtttgaatggcgctggtgataaaattgaggccaactttggccccaacttcagatttgatttggtcactcattgaaggaagaaaatatcacttttgatcagctttattgatttttttcctttttcttttcctcagtattttcataaaattattttacttaaatatttgatgaattatctcaaaatttggcattttgtcagtaggatttcgtatttgtctcaccaatccctaaacttatg

SEQ ID NO: 106274 - DNA, 491 bp, Heterodera glycines
  Promoter: Source sequence=SeqID_8469; Location=2524..3014; Strand=-; Gene=SeqID_68182
tttctattaaattttttgctgaaaatacccaaaataatgaaaatttttcgatccttagaggtcaaaaagtctttaacagagggggccgttttaatgtaataagattttttgaaaaaattcccaaatatgcacataaatttggaaaaaatattcatgtgcgtattattggcatccgtaatataaatcaacatttatttaagcgtcacaggattaagataggggaaaatttttatttttaatgtttttaaatttctgaaaaggtaggggccggttgtttcgatagcagtctggattttactagatttaaatttgggataacattattacacgggtccaaaaacagcgtagatttccgtaatatataatttatttgagaaaaattaaattaataaattcatttctgttaatgaaggacacatatatgtgtctggtggttaagccttctttctttcgttgtctgtcctttgggttcaattccccattgggatatg

SEQ ID NO: 106275 - DNA, 320 bp, Heterodera glycines
  Promoter: Source sequence=SeqID_13523; Location=1000..1319; Strand=-; Gene=SeqID_77423
ttatgactagggctgggatttttctgttttaacatatttttttgcagcttagttttggcgagagaagcccaaaaatagcattttctccgaacaatttttgatttagagcgacttataaaaacataaaaacacatattttggcgttttggcacataaaagcatatcgcacatatttgggctattttggattttttagcacatatttgggcatttttgagaaaaatcgtaagaaaaatacaagaaaatctgaaaatgcaccctaaaaattgactactttacgtttcttaagaatttagaaaatttctttatatatttaaatg

SEQ ID NO: 106276 - DNA, 1003 bp, Heterodera glycines
  Promoter: Source sequence=SeqID_5874; Location=1667..2669; Strand=+; Gene=SeqID_59516
ttatgacttatacactcccttccttaattaatcataatttataaatttcactctactgaaacatatgtaaatctgttgaagttgatgactatattctcagattccaatattatgcttcatagatataatttcattataacccttctttctgcataaaatcttcaattggtaaaaaattaaggaacaattaggtctaaaattacaattatacagataccatacatacactaccagaaaatcttagtaatttatcataatacttaaccatactaaataattgtaaaagcatctcaccaaacattgttccgcctttgaaatgattaattgatttttagctatattacacaaaataatttacgactcattattaattaaaattcttttacgtcattctcggtaatttggaataattaaacaacaattagcccccatatcataataatatttcgaataaacatttttctagaatataaaaattaatttaatttaatgaatattataaatttagaatttaaacaaaatagtgatggtaaaaaaaaaattgattttaagaaaaaattctttattttatgcagttgaaaaagacaataaaattagtagttactaccacctccccccttccggtccctttaacctagtagcggtcagtcattagcgctcaaattatcacaaccgtgcgctcaaatggcccctgcgggcgctcatgtggtacgcgcgagtgctcaaatgacccggcgtcgcttccctcccgacagctgacgccctttcccttctccattaggctttggttttgcgaattatttattttatttttaatttaaattatttttaatcaataaaaacccttcaataggtttaggttcacccccgcacccatccaataggtttaggttcactcccacacctattcaataggttttggttaaccaataggctttggtttggaacggtggttttccaacccccaaaaagggggggagtaactactgaaatgcacagaatg

SEQ ID NO: 106277 - DNA, 551 bp, Heterodera glycines
  Promoter: Source sequence=SeqID_19534; Location=1..551; Strand=+; Gene=SeqID_84266
ggaaaaacgggaaaaaaccgggaatttcccggtcccggtcaaaactggtcgaaaccgggaccttgatactcagttgtccgtgttttggtcccggtccaggcgcactctagaatagatcaatccacgccataaaaatatttaaaaatttcaagaaaaatattaaaaaaatttagagcttttttttaaacctacatagatgatactaaaaacaaaatttgtgaatctccagaaaaaaaaacaaaaaacttaaatttttcttaataattactattttcggccctttcttttggcactttcgccgcctttacgcttctctttttgttcagaaattgttggctaaccaccggggccaaagcccgatttttgaactcccatttatgttaagagaatgcaaaaggaaattattaatagcattattgattgtggtttaaaatttcattctttgcacttttaatttgatttcatttaataatttatttttccccaccttttagcttttgccagcacacaaattaattctgaactcagcttccgatgtttttgaggcaatg

SEQ ID NO: 106278 - DNA, 788 bp, Heterodera glycines
  Promoter: Source sequence=SeqID_10242; Location=950..1737; Strand=-; Gene=SeqID_73391
gatggggttggccggcgcgctgagacgtgcaccaagacagtgcactcaattggtcctcgatgcgtcaattgtccgatgcgtccaatgtccaattcgatgcgtccaatgtccgaattcgatgcgtccaatgtccaaattgccaatgcgtccaatttccaatttgttcggctcgtccaatttgcaatttgttcggctcgtccaatttgcaatttgttctgcgcgtccaatttccaatttgccaatgtcagatacttttcacttgtaaaaggggaaagcaattatgaaattttgatgagacaaaattaattgaagtaatttaggctggaaccggttttccgccaaaatttgaaatcgagcagtttagttttgtgtggcggaaaacttgctcagaaaacctccggtttgctggttgcaaaacacaaatttcaatgaaattccaatgaagaaatttaatttcaaaaatgtgatgagaattgcaaaaaagcggaattgtcgattaaaaacaattttaagtgaataatgtaagagagcgatgggaaaaaaatgaatggcttaaatatggcggatgagaccgccgtcaatttgcgagagatatgtgtcggagataacaagagagaaaatgaaaaatagaatttaataatttaaatgatcgaaaaagcatttaaaattaaagcagaattaataataaaaataaatgagaatttgggcagaatttgggcagaattgagtgatcgaattaaatgttgtcagatttgccagccctctccattcgcaacttcctcctcatg

SEQ ID NO: 106279 - DNA, 769 bp, Heterodera glycines
  Promoter: Source sequence=SeqID_8903; Location=2830..3598; Strand=-; Gene=SeqID_69589
atctaccatttaattttattaatttacccacatttctcataaaataattaagaatttacttaaaacttgttaatttaaactgcatacaccaaatttaggcccttttccaaatttgctttattaattttattatctattctatttatttatttttggtttggcaccactggacccagctaaatttcctattttttaaaaactggaaatttttaagtcaaaatctatttctttaaaaattctaaagagtaaaaattgtaaatatcaccatattttttggaaaaaatctaataagaaattggaccaaagttttcaaaaatggccagcggtgccatatcgccccacctttttgaaaaaaattatacgagtatttaacgattttcccggctttgtgtttttggcgataaaaagccagtttctttttgttattacttttatttaattttaaatttattaaatgttcgttcttctcgcagctcatttgtgaattcccgttctattgaaactataattaaattttttcgttaacacatttccaaatttggattagttttaattactttagattaaattttcaaaattattactgcaaattgctttggttctgcgcgttttgaagtcatccatcactcaaattgtggtccaaaaagtgatctttgataatcaaaaataatttaaaaggccgacgtacaaaaatatttaaaaaggccgaatttggagcaattaaattgcattttcaaaaatctccaattccattttttctttccaaatg

SEQ ID NO: 106280 - DNA, 1003 bp, Heterodera glycines
  Promoter: Source sequence=SeqID_17511; Location=533..1535; Strand=-; Gene=SeqID_82016
ggaaaattaattatttttttttggttactctaaaagggaatcttttttatggtcataagttctgtcggtgttataataaatttccattcgtttttttttatacgtgtagtgaaaataattcataataatccaatttattgttttatatattgtaatttagtttatatttgatgtaaatgtgaggaagatgtttgaggtttttctgtagaaagaatagtgggacaaaagaaataaaattgtaaattgaaaataataacgtttatttaatatattaattaataattaagtaacatttagtcgaattctaatgcgattaattatatcgaaattaatttaataaatcaattaaattctcatttatgcatgtttccatttattatgtgctcctttaagatgcgacgcgtaaactgcattagagccatttcaaccaataaatttgaagaaattttacattcaattttgaaaaatttatgtccatattttgacatttttgccatttatttacatatgggggggcggtgtttgaaataatctaattagcggtcatttgccccgcctgcgggcggcaaaaacattgcattacattacaaattacactcgccactcattcactataaaaatgaaaatcctggaaaaaagccaatgttagcctattattccccaagcagtgtgtttcaaagcagaatttaaaaaatatatttttaaatatatttaaaatgtatttttaatttattatcattaaattaataatattttttaatttgtttgctgaaattgttcgcctattcatcagaacatatcagaaaaatcagtacatttaacgatttttattaataccagtaacattagaaaaaaatgggcaatattcgatgaaagtaattattctaaatattttgcattatatgtaaaaatgaatttgtggtatttattatattttttaatatttttgtattgaatccggcaaaatccgtccgaattttgaagaaatatttggcgatggatg

SEQ ID NO: 106281 - DNA, 418 bp, Heterodera glycines
  Promoter: Source sequence=SeqID_16221; Location=547..964; Strand=-; Gene=SeqID_80593
tataccaatactacattcatttatttaatttaaatattattattattattattattttttttttaatttatgtattgaacttttccctttaataatcatttctcacttgttgtgttttttttttgtgtttatttaatttaatcagctccgcagagcttagacaaatttgtgtgaatatatatatatgtagagtagctccgcagagcttattttaaaccatcaaatataaatgcgagaaataacaaatgaaccattgggacgaatgatgtcagggtgccatcggaaaggtgaatttccgggcaaaataaaggatgggtgaattttaattccagatgagagctgaacacttttgagaacaacattgacttgatgatctcttctgaagtgttcaagcggaaaatttgcttgacgtcgtatg

SEQ ID NO: 106282 - DNA, 1003 bp, Heterodera glycines
  misc_feature (603)..(603): n is a, c, g, or t
  Promoter: Source sequence=SeqID_3404; Location=1875..2877; Strand=-; Gene=SeqID_84548
gaggagaggaagtgagagagagagagaggagaggaagtgagagagagagtgaggagatgaacgaagagagcaaacgaaagagagggagagaagataaaagtgaggagaggaaagaaggagaagagagcaaagaaaaaagagagggagagagagaagagggagaaagagagagagaggagaaacagagaaaattcgagggagcgagagaaaaagcgagagagagagagaaaaagagagggaaagaaagagaggagggagagagagtaaagcgacagagaaaaaagaggaaataagagaaagaaagagataagagagagaggattagagagataaagaaagagtgaaaatggaaaagtgagagagagagtggaaaggaaagaaagatagaaagagagagcaatagagagagagagagaaagagagatatgagacaagaagagagtgagagggagaaagtacagagaaatagaaagaaagaaagggagagaaatgaagaagggaaagtgagggaaaggaggaactgagagagagaaagaaaaaatgcaagagagagggaatgcaagacagagaggagagaacgcgagataaagacagagagaaganaaagcgagagatatggatgagaaagaaagcgagaaagagagagcaatgcagagagagagagaaagcaacaaacaaagaatgacaaagggagatggagatagaaagaatgagtgaggtggggaaagagaggagatgagagagagaaagtgaaagagagaaaagaaatcgaaatagagagagaaagtgagacaaatagagaaagaagagtatgacaagagaaataaagagaagagaaataaaattaataaataagaatataagttgtgaaaaaaataaatttaaaaattttaattaattagtgaaatttttaaattctgaaaacagagcggttggcgccgcgaagcagcgcccaagcgctcgttgggatttaatttgctaagaaaaatcaaaatttgaaatg

SEQ ID NO: 106283 - DNA, 57 bp, Heterodera glycines
  Promoter: Source sequence=SeqID_704; Location=3447..3503; Strand=-; Gene=SeqID_59298
tcgtctttgggcagccgagcaatgccctagaactgtgaacaagtacaagaccaaatg

SEQ ID NO: 106284 - DNA, 88 bp, Heterodera glycines
  Promoter: Source sequence=SeqID_36750; Location=1370..1457; Strand=-; Gene=SeqID_65994
attttttccatgtttcagttggatttgtaccgtcgtgtggatggacattttcccatcttttgaccatgcccaactcggactcaaaatg

SEQ ID NO: 106285 - DNA, 150 bp, Heterodera glycines
  Promoter: Source sequence=SeqID_7443; Location=445..594; Strand=-; Gene=SeqID_64840
tttcagagggattacataaagttgcaaattggacactcattttatactcaaaaacttggccacgcccatccaaattcaaatttgactccacccatttttcaagcaaatttaaattaccatcccgaatcccaattcatttttgccaaaatg

SEQ ID NO: 106286 - DNA, 519 bp, Heterodera glycines
  Promoter: Source sequence=SeqID_15858; Location=1766..2284; Strand=-; Gene=SeqID_80190
tttctcgtgccaatttcatcgtttacattcgctttcgcttttctttttggagtgttcgggttggtattccgacctttgaattgttcaacaattcaactggggagcgattgacactgaaacagatttatgatgagtatgttattaatcttacattatcaatcatttgggttcggtgggaccgcattaggccaaaaacccaaaaaataaaatttaaatttcaaaattttagatttcatttgtaattttttcttctaaattgttttttttaatataattcagccatcctttcgtgatttttaacgtaaattttttcagtcattttgtcttattttgaagaaaaaaaaattccgaactctggttttaaaagagtttgagaagacttaatcatttgttcatacataatgttctctctttttaaattttgagaaaaatatctttaaaaaacatttttgattactaatccgctccctagtgataagcgtagctttttgctgattcgttgtccaatttcgcgagatg

SEQ ID NO: 106287 - DNA, 214 bp, Heterodera glycines
  Promoter: Source sequence=SeqID_3149; Location=408..621; Strand=+; Gene=SeqID_83420
agtgagtgaaagagtggaaaatcgaagatcagacatactgattcatcattggggtgatgtaacacattttgcaattttctcggttagtaaaaccgtcgtggttggtgccggatacattgcagtcgaattggcatcaattttggctgaccttggctctgaaacccatctgctgatccgttatgatcgtgttctgcgcaattttgacgacacaatg

SEQ ID NO: 106288 - DNA, 561 bp, Heterodera glycines
  Promoter: Source sequence=SeqID_27765; Location=245..805; Strand=-; Gene=SeqID_58432
ttttgacttacaattaatgtttcttgtcggcatttctcgacagaaaaacccagaaaacgaaagaaaccccccaaaaaattggcacattgaaacgaaactcgaaacgaaaaagaaaaggactttctaatattttaagactttattgtaaatttgaattaaaattattttacatttcatttgatatatttattattttattttggcctttttataataaataacaagtctgattgtgtacttctcaaaatgtaattattctttttttgtttcattcccccgggcatcgcttctcatcaaatgttttttcatttgatggaccatttattcataaatttgcttcattaattaaaatgcattccatgttttatattgatgccaacaattttgccaattacgccctcattgggaaattatcaaacagaaaaagcttaaaaaataagtcgaatcatttgcaaaatttgtcaaaacatttttgatcaattccattaagcaatcattggaatatattcaattaaatgtattcttttctcgccatttttctgtttttttcgtttctccatg

SEQ ID NO: 106289 - DNA, 114 bp, Heterodera glycines
  Promoter: Source sequence=SeqID_17664; Location=1596..1709; Strand=-; Gene=SeqID_82195
caaatttttgcatctccaaataaatccatccaaattaaggaattgttggacacgagccaaggattttacaacaaagaagaggacaaagtgacattggccattgatgtcattatg

SEQ ID NO: 106290 - DNA, 166 bp, Heterodera glycines
  Promoter: Source sequence=SeqID_483; Location=2943..3108; Strand=-; Gene=SeqID_53924
tttgatttcaaccatatttattgcctttcaatcgctttaaatcggaaaatacgctattttttacggatgtttaaactgttatatctcgtcaaatgttgttttaatgggttttacactatacattcagttgatcccaattaattttagagagtgaaaacaaaaaatg

SEQ ID NO: 106291 - DNA, 115 bp, Heterodera glycines
  Promoter: Source sequence=SeqID_36854; Location=878..992; Strand=-; Gene=SeqID_66073
ctgtcgcaaaaaattttaaattttaatgaattttggtcattaaattcttctgattcccccttcagggccaattctacacgattgcgaaatcggaaaaaaacagtccaaaaaaatg

SEQ ID NO: 106292 - DNA, 1003 bp, Heterodera glycines
  Promoter: Source sequence=SeqID_3727; Location=4492..5494; Strand=-; Gene=SeqID_51643
tcaaatggcgttggttttttgctggccgattttggctcgcaacgccgccgcggctgacccacgttcggtcgcggtttgtttggttgacccgcttttctgcccataaaatgccttagtcagacaaatattcctttttttcttttcccttttgtctcttccgtttcttttctctcatcctttgcattgactgagtttttcttttactttttctcaaacatttattttctgcagttttttcgtcgatacgaaagttaaaaaaaacaccaaacttttagtctcaaaaaacctttcctcaaatcattgggcaaattaaaaaaaacattttccatttataattattttaaatttacaaattgaatttgctgtgtccaggtattaacaattcatccagaacagacgggttctggtagaaaatttgcgaaatttctgcgcgggactctcttcccgccaaactttgtctcccaatccttcaattaattcagattctcatcaacttttcgccacttgataatttttagagatcggcctggacctggatccaggtccaggccatttttcggcaacctggatttttcctggacctggattttcgtccaggaaatccaggtcaaatgtgaaaaaaatccaggtccaggcaaacaggaaaaaactggattttcctggacaaaattttagaatttattatttcaagtgaccgaagttttttcaagttttcaaaaaaagattaaataaatttaaaaacacattattattataaatcagatatttttaaatgttttctaagcaaataattaattttttcaaacattttttgatttttaaaatgagtttcaaaaaatccaggtccaggcctggatttttcctggatttttgtccaggtccaacatggaatccaggtccaggcttttttcaaaataccgatctctaataattttgtttcttacctttttaaagtttttcagcttttaattccaaatttggccgaaattgtttttacacaatg

SEQ ID NO: 106293 - DNA, 934 bp, Heterodera glycines
  Promoter: Source sequence=SeqID_16439; Location=1950..2883; Strand=-; Gene=SeqID_47365
ttcattacactttccttttgctaaattccactcaaaaagttaaaattgttgatcagctgattttgtacaaaaacgaaagaccactggccaaaaaatggactcattataatgacgataatgagatcaaattttccgccttcgtaatcagtttaatgggctaattaattatgttggcgtactgtacgttttattatcgtaatccgcccacaaatttttttattgtgctaaaaatgatggtcttttttcgacgataaatgaatgaatgtttttcaccatacaaaatacaccccgggggggctatcagcacaatttaagagcaaattgttgcttcttatcagttttatcgggaatggtatttattggctcatccttttgtccacagcaaacattagctcacaaatcaactaattaatgaatatttccctccccgacaccaaaaagtctccctcccattttatcattttttcactgctatatgtaatcaaaaacagtcaagaagtttgtaaataaatttgttttccaaattgccacatcttatagggcattaaaaatccgaaaaataaaacaaaaattccaaatgaaaatgttttaagctaaaataaaaatattaacttctccaccttttcattcattaattaagctaattaaattcattaaattaaatacaacaattgcattttggcgggtatgcaaaatttgctaatttcgtgtttttaaatcaaaaatgaagaaataattaaaaataaaataaaaattttgctatttgaaataatgccatttttagaaattaggacaaattgttgctcatttgtcagtggcttatattagttaggatgattgttgtttaaattaatttgtttgtcatttttttccttaattcgtaattttcagattaatttgctgctcatttcctacaatttgtgcatcaaaaatg

SEQ ID NO: 106294 - DNA, 698 bp, Heterodera glycines
  misc_feature (68)..(68): n is a, c, g, or t
  Promoter: Source sequence=SeqID_23322; Location=1509..2206; Strand=-; Gene=SeqID_54026
agtgtgcagggatccacccagagcagaatataaaggtaactcgccggtgggactcgaacacatgaccncagcaatccgtgccgtgctctgactgagctacgggcgctccttttcccactttctcccacactccgcttccttctggcataacaatagaagacacgtagagctatcgtttaataccaagattggttaatttgattaagtttgagttaagttatgttcattttaggttcggctcacacgaatttgatgacacataatcggctgataacagcacctcggaaaggctcaaagtaaaaaaagggggaagattgttgtaatagataactgtaaaaaaatatttctaaattttttaaaagcggaattccgggcaattaattattttttaattaaaaaatgttacgtaaatgtttacaaattgtcgtcattccatcaataaattgtataagaaattgattggatttgtcagaaaagtgaagaaaaataaataaatattcttatttcttttattacttcataataaatacaatttaaattttcaaattctcctcaaaattattaaacaattttttttttgttcatttctaaataaatttaaataacttaaaaaactttgttgactaaaaaaagctaaaaagacttgagaataatatgtattgcatgtttaaagactagtttttatccaaaattaaatg

SEQ ID NO: 106295 - DNA, 219 bp, Heterodera glycines
  Promoter: Source sequence=SeqID_12902; Location=211..429; Strand=-; Gene=SeqID_76641
attgtgatcatgaggaaggtgatcagcagaaggcggcaaaagtgatcatggggatagatgatcagaagaagatggcaaaagtgatcatggggatagatgatcagaagaagatggcaaaagtgatcatggggatagatgatcagaagaagatggcaaaagtgatcattgggatagatgatcagaagaagatggcaaaagtgatcatggggatagaagatg

SEQ ID NO: 106296 - DNA, 542 bp, Heterodera glycines
  Promoter: Source sequence=SeqID_932; Location=2174..2715; Strand=+; Gene=SeqID_64442
ggtgggaatttgaatttggcatttatttattatttatttggcattttatatatatcaatttatattttatgggacaagaaaaagaagaatatttcatgactgagtacagatctaaaacttttaatttctcagcgtaatcataaaaatcccaatttttgaggcgctttttcaaccaatttttatttaaaaagaaagaaaaaacttttaaaatgatcattttcaaattttcaaaaatgaatcaaataaaaaattgcggcaatttttgatttaaaattttaatgtttaaaactttccccattagtctccctcaattgacccctttttgtcccccattccccccactccctcctcacccattaacacgctctttctgttaaagatatctcccctctccccaagcacaagtgcactcacaatgcacccaaaataatcgaatccataattcccccccccccccccccccccattaattgtcaattggatgaccaaaaattatttagcaaaatttactaattgtaaaagtggaaattcttgcaggtatg

SEQ ID NO: 106297 - DNA, 407 bp, Heterodera glycines
  Promoter: Source sequence=SeqID_2542; Location=890..1296; Strand=-; Gene=SeqID_80294
ttttttaggccaattaagaatacacttaggcaattgaattaattgtgtttattctgaaaaagttttgacaattttaaaaccactaatgatttttttttggtcccattttcaccaattaattaattcattttcttttgtctatgcgcattcttttcatttcgttttgggtaatttgtcaaattgagtcggagccctccctaattgttaataaaatttgttgacacataaattaactgaaaaatatttttttattgccaaaaaatgtttaaaaatacacaaacaaattaaggtcatcttcaattcatttcaaaaaatcaaatttaaatttaaataaaatttggatttttcgttaaaatttttagaaaataaaataaaaatgtaattttagaaaacaaaataaaaatatg

SEQ ID NO: 106298 - DNA, 325 bp, Heterodera glycines
  Promoter: Source sequence=SeqID_38713; Location=1483..1807; Strand=-; Gene=SeqID_46577
tgttttatttaacgatttctgcctccattttaattttttatttcctaaatattaaattttgatttgtttgaaaaaattcttccagcctttaatgttttagtttcattttctatttttatccattttaagagaccatgatttcaaatcttcccgggcagggtggggttggatcttcgaaagcagacaattcctttgtccgccttttcccaaccggtcaaattgggttttcccaaaaatcaccgggcccattaaaaacctagcccgcctctctctatttttacattacaaatttattttgttttagccacaaatagctctgataatg

SEQ ID NO: 106299 - DNA, 463 bp, Heterodera glycines
  Promoter: Source sequence=SeqID_8620; Location=415..877; Strand=+; Gene=SeqID_68700
tatcttgaattatactttcatgatgattccaagttgcaataggaaacaagggtccatggccagcatgaccatgtacatatgttctgtgttaacaaatattatatttgttaacccatttatgtaccttccaatatagtcaaaaactgagattggttggcctccatcttgaataacttgaacattcaattcttgagcttttaagcgaagaaaatattggatgtgccagccgcacgcgccgtttgtttttcactttgccaaaacagccggcgcctttgctttccgaaagatgtgccagccgcacgcgccgtttgtttttcacttcagcattactttaaattcttaattcttacacaacacaaaaagtattttgacaatgacataaaatgaaaacgttttttctatttttacattcctcttttcgataattttttgatgcattaaataaatattttaatgcagaatg

SEQ ID NO: 106300 - DNA, 246 bp, Heterodera glycines
  Promoter: Source sequence=SeqID_20815; Location=1708..1953; Strand=-; Gene=SeqID_51397
gtaaaaactataaaaaataatccctggatttcctgccttttaataaatgcccgatcaatatcaaataactgacttagaacatataacccaaaaatatgacccttcaataattctaatcaatgagacctggttaaactccagaaatacggtagacgcggaacttacaataaatggtcataccaaattatttatgcaaaccgaactgaaaaaaagggcggaggatcggcaatcctaataaaaacaatg

SEQ ID NO: 106301 - DNA, 781 bp, Heterodera glycines
  Promoter: Source sequence=SeqID_17564; Location=257..1037; Strand=+; Gene=SeqID_82077
tctttttcatccatatcaatgatttgattgatgttctgattcattatttgggtggatttgttgttcattttctttctttttcaacaacaatttctctttaatatcatttgctataagtagctactcaccaagattttgggggttgcatttcacccccgccatttcagtcccagtggaaagggacgtttcagtaccaaatttaaacctttaaaaaacatctataataaatatatccaatcccagaagaggtaaataattgaaaaaacatctggggccgtagcaaaagaaggtggttatttgacgaggtcatttaactatggttatttgacctggtcatttgaccacgaaatacgagaaaaacggtagcaaaagaagatagtaaattttctgctggagcaaccaccagtcaccgttttttaaccatgaactaacttcttttgctataccaccaactttctaccacgaaatttttatttacatatatatatatattttgcttcttttcatggaaaacaagaagtcaataagttgttttgcaaatttgcagctgaaaggatgaatggatcaatagaaaatgatcatgaaatatatttttattttttgttggtcgctaatattgttcgcctatttttcattataaataaaccaatataattttgcatctttttcttcgtccaaatgttaatatatccttccgagtaaaaatattcagaataaacttaataattttatataaaaattattaaagaattaatacatattctcttatttactaaaaatg

SEQ ID NO: 106302 - DNA, 338 bp, Heterodera glycines
  misc_feature (42)..(42): n is a, c, g, or t
  Promoter: Source sequence=SeqID_10059; Location=1..338; Strand=+; Gene=SeqID_73125
cttggataaaattccttcctcatccattttttagcttatcantttgcccaacaacaaaaccaaaaaaaggattaatttatttatttgaaagatatttaattgattgatgataatgacataattttgcctaattactttttgtctacaaatgccgccaccctataaaaggcgaacatattcagcacaaaacagcaaatgttcattaatatatttggcactgctgaattttatttcccaatttacatttctttaaagttttgctatttgtaaattttatttaaaaatttttaaaatatttcttagattgcacaatacactttctttaatttgaaaaaatg

SEQ ID NO: 106303 - DNA, 189 bp, Heterodera glycines
  Promoter: Source sequence=SeqID_623; Location=526..714; Strand=+; Gene=SeqID_57744
ttatgctgtcattagataatcatgtcacaaatgaaagccgtatttcttttttttatttttgggcattattattgctcgcttcacgaaatcggctgaaggaaagagtttgttttctttagataaaagcaaaattttaaataaaatttatttcttagaaatggcgatgccgggaatgtgaaatccgggatg

SEQ ID NO: 106304 - DNA, 152 bp, Heterodera glycines
  Promoter: Source sequence=SeqID_12774; Location=864..1015; Strand=+; Gene=SeqID_76486
actttattatataggattatgaattcccgaatttatcatatcatatatactttcttaaccattattaatctagtaattgtaaagcttatggcgtcgaagttgttgtttcggcaagttggtccatgttctggtgaatgttttgccccaaaatg

SEQ ID NO: 106305 - DNA, 114 bp, Heterodera glycines
  Promoter: Source sequence=SeqID_8177; Location=1..114; Strand=+; Gene= SeqID_67218
tgacctgcagttttagcagaatgggcattttaactgcttcgaaagtgtgcactttgccacggctttcttccgctcgctctatgacttggtggtggggcccggagaaaagcaatg

SEQ ID NO: 106306 - DNA, 83 bp, Heterodera glycines
  Promoter: Source sequence=SeqID_16931; Location=960..1042; Strand=-; Gene=SeqID_81361
atttttagaatttaaatccttgccatgaaagcccttgtttacaaggatactttttttagtttaataatttgttaattcagatg

SEQ ID NO: 106307 - DNA, 244 bp, Heterodera glycines
  Promoter: Source sequence=SeqID_2352; Location=1..244; Strand=+; Gene= SeqID_79268
gggtaatttaaaaagtgagtcctttatatattgattttttaattgattggcgccatttcgtcgctcagctgatcagttactccttggcgtcatccgacaaagtaaatcaatgagaattatgatgatgaggccataactaattttcatcgagaccgaaaatttcactaaactctaaatctcgaagagaagctatcaattaatctgggttcgaactttttgcttagctgcctttgacttcggcatg

SEQ ID NO: 106308 - DNA, 1003 bp, Heterodera glycines
  Promoter: Source sequence=SeqID_14159; Location=3041..4043; Strand=-; Gene=SeqID_78164
acataacttttttgaaacttagccaaattttttgaaattttgcagattagtagaaaaccttagggctaccgaatgatatcaagatttcttaattttgttggttctaataatgttttggtcagagtttttgatgatcaaaaattttatgtttaatcaaaaaattttcgttataaattgttaagatatttttattttcttaatatcttcgatagccttaatattttctactagaatgcaaaatttcaaaattcgtttaactttcaaaaaagttatgaccgaaaatgtctgaaaacctggttgcttgagtactttttgccacaactttgttcaaatttgaccaatttttgaaaattaggtgagctaatagagaactcttaggcctatcgaatgatatcaagaatatttaatacgattgattttgacaaaaatttgggcagttttttgttggaaatttttatttgatggttttttatataacgccctttttgatggtttttattagggcagatcgggaccgggaattttgggcaaaaccaggactgggacttttcgggttgtaaaaccgggacttttggctgggaaaaccgggaaaaagacaccgagaaaaaacccgggaattccccgggcccgatcaaaaccgggacttcggtactcagttgtccgtgttttggtcccggtcccgacctaccctactttaaacacatgaaaacaaaccaaaagcaatttaatccttcaatgagatatgatttacgccgtttttgaaccaactaaattcgaaaaatctttttgatcgaattcaggtacggggatatttggttatttcttcccaaaattctagtacaaggcgaaaaaatatgaatcaatataaatcaaaataagccatattccttaattttatcattaattagttacctaaatcgaatcagatgagatgaatatgaatgattatctaatttgtcaaggaaacagaaattttgattttagttaaatatttctaaaaatg

SEQ ID NO: 106309 - DNA, 262 bp, Heterodera glycines
  Promoter: Source sequence=SeqID_41900; Location=1..262; Strand=+; Gene=SeqID_69934
aagcctaaactttttggcctgtttaaaaaggaattaaaaatttttaaaaattttattcatctcccttttgatagaaaaagcatcagagagccttatttaacttttaattaacatttggtgcgtttcagagcagtttctgaaaaaatatttatgaattgattttgcaaaataataaataattaatgaaaaagtcagaatttcgaaaaattttaaaaacaacaagcgttggcattttttcaggttaagttagtcctttacaatg

SEQ ID NO: 106310 - DNA, 397 bp, Heterodera glycines
  Promoter: Source sequence=SeqID_2062; Location=3846..4242; Strand=+; Gene=SeqID_77608
agcaacaagcgaacataagccagcttgtgcgtgaaaatttcgggtttttgcgtgttttatcgagaacaaagtccccaacaaaatgtagccgaataattagaaaagcaaacaccgatcagctgttagcactggtcgaaatttgtttaaacattgtctgctcccgcttccaattgactactcgacagaaaaaacgtttaatgcctcatgtggagtttgtgcgatgcatgagcagagcgagaagcgagcggggcgcgaaacggaccattgttcagaaaggagcggggattggtacattcgctgccctattgacacctgtactcattgaattagcaaaatcagttatatccaaaactatataaacaattccctaacaattattgttgaatcattttaaatg

SEQ ID NO: 106311 - DNA, 131 bp, Heterodera glycines
  Promoter: Source sequence=SeqID_21030; Location=377..507; Strand=-; Gene=SeqID_51613
ttcccgtgtaaacataaacaacaaaaagataaaaccatagaaaattaccccataaatattctcgcatcctcagtctgtcagattttaattcgattttatctttgggttcatatttctcggctatctaaatg

SEQ ID NO: 106312 - DNA, 832 bp, Heterodera glycines
  misc_feature (50)..(50): n is a, c, g, or t
  misc_feature (52)..(52): n is a, c, g, or t
  misc_feature (58)..(58): n is a, c, g, or t
  misc_feature (60)..(60): n is a, c, g, or t
  misc_feature (97)..(97): n is a, c, g, or t
  Promoter: Source sequence=SeqID_19234; Location=1..832; Strand=+; Gene=SeqID_83977
ttttaaaatttttgctagttccctattcctaatgggaccccaacaaaaancngaaccngnccaccttttctttttcggggcgcaaaggccaaagggncgccacgggacgaaggccgctcggcggccgcagagcgcaagcggcagttcggccaatgacaggagaagaatcaaacaatgaatcaatcaatcagcctttgtttggtggaacaaattagagtttgccaatcacttttaatttccggtgggccaaccccttgacagattttgttttcaaaagtccccggaggaccaattcccgtttcccggtgaaacgatttttagtaccaaattttcccctaccgtaaccttcaaacaatgtcccggtgacaaatatttattacggtgcgaaaattcgaaattaataaataatttttaatcggagagagaagatgttcaacggattaaaaagttaagcgaatgagaacagatttttaatttttccatctttcccccttttttccgctcacggacattttccgctttttgttaaactgtgaaattccctatcgcttcttttcttcttgtctccaacgacttataaagtgatcgcaaaagcaaaggatgaaagatatggatgaataataaaatagagaaatgaaatgaaatttaaattaataaataattaaatgcaaatttgttcaaaaattattttctccgtctcttccgtttttggcatttaattctttcggcattctctggcatctcggcttcgtcggtcgtgggcgccgacaacgtttctaaacccgatcgaattttttaaacctttatatgaaaacatttattgcaggaaatg

SEQ ID NO: 106313 - DNA, 167 bp, Heterodera glycines
  misc_feature (23)..(23): n is a, c, g, or t
  misc_feature (38)..(38): n is a, c, g, or t
  Promoter: Source sequence=SeqID_9633; Location=1..167; Strand=+; Gene= SeqID_72139
gaccaaactttgatgacatattnggcgacggatggacnaaagatgagagtgatcaaacagtaaaaagtgacaaaagaagcaaaataaaaattgaaattgttaatttcttcaaccaaacggtgatgaaatgggaaatgacccaattgatcaaatgaacggttcgaatg

SEQ ID NO: 106314 - DNA, 330 bp, Heterodera glycines
  Promoter: Source sequence=SeqID_4790; Location=767..1096; Strand=-; Gene=SeqID_55727
ttgcttttgctttcccatttcgttttcctttttttgtatatttttcttttttaattagtcgttcgtttttcttttttctgcagggccttccccacgaaaactcacctctcaattattttgattattctaattgttttctataattgaaacaaccaattttttgtcttatgcttttaatttgtatataaaaagaaaataaaagattaaagaaaacgcattatttttcctgacatttaaattaattgtaaattttatttaatattttctttgattttcgttctcgtaatttcgttgcattttgtcagtgttattttttcgatgaacaaaatg

SEQ ID NO: 106315 - DNA, 390 bp, Heterodera glycines
  Promoter: Source sequence=SeqID_6915; Location=1..390; Strand=+; Gene= SeqID_46326
ataggcgccgcccttacaagattgagaatttttaccagatttttagcagatttccattaaaaaattctttattttgtggttttttgattggaggattttcccccaaagcctcaaaatttgtcaaaaagccacaaaaatcctcaaatcctcattttccaaaaaaaatcctcattgacctatcaaaaagccacaaaatgaggataaatcctcagatctggcagccctggtttagatgagtttggtttaccccgcattgacagaaaaaaaagttattgcctaggaaactgaggacggtctttattggacctaaagggcaaaagagccaactcatactttggtataacctataatcagcaaataattatttcattttagcacaaacaaattatg

SEQ ID NO: 106316 - DNA, 198 bp, Heterodera glycines
  misc_feature (39)..(39): n is a, c, g, or t
  Promoter: Source sequence=SeqID_18121; Location=1..198; Strand=+; Gene=SeqID_82701
caaaaaaatttttaaactttttcgtcagatttcaaaaanttcatccatttactaagggagtaggtagcaatttgtgctttccatgtaaatcctatcttccaggtaccactagatttctgaccgttgaatttatgagcgatttttgggacttaaattcttaaaatgtaatacgattttttaaaaatttagttggcaatg

SEQ ID NO: 106317 - DNA, 134 bp, Heterodera glycines
  Promoter: Source sequence=SeqID_25319; Location=1980..2113; Strand=-; Gene=SeqID_56072
atggtgagaaaggggcgcggattttcagttacgaaaaattgcaaaataattaacaaaaatagtgaaaaaatggaaaaagttgatgaaaatagtgatattttttacaatttaaatatatttctagggatgtgatg

SEQ ID NO: 106318 - DNA, 63 bp, Heterodera glycines
  Promoter: Source sequence=SeqID_21899; Location=1997..2059; Strand=-; Gene=SeqID_45682
ggtcataattttttttactttcgattcacacgtttaaaagaaacatttttgtaggggttcatg

SEQ ID NO: 106319 - DNA, 178 bp, Heterodera glycines
  misc_feature (41)..(41): n is a, c, g, or t
  Promoter: Source sequence=SeqID_31053; Location=1..178; Strand=+; Gene=SeqID_61430
cgagactaccccccggggccgaatcctgagcatcattttgncgaggagtgatcagacgaatgagccggccatcagctgggatgaattggcaaagcgaccggagctcagcagacttgtggacggacagaaggacactgcccgattgatgttggacaatgtgccacgtatctgcaaaatg

SEQ ID NO: 106320 - DNA, 191 bp, Heterodera glycines
  Promoter: Source sequence=SeqID_1931; Location=980..1170; Strand=-; Gene=SeqID_76868
ttcgtcctatttcccttggtaattcatcaaggtgctggcacttttttttaaattttcaaatgtccgcttttactgtagagctttttctttatcggcgagccagcacaaagaatgggatttgaatggtgatccgatattttatttgtgatattttgagtggtgcaataatattataaaatgacataataatg

SEQ ID NO: 106321 - DNA, 69 bp, Heterodera glycines
  Promoter: Source sequence=SeqID_4657; Location=2767..2835; Strand=-; Gene=SeqID_55257
tgtctgcaatgttcctttatacacgaattagcttactaagtgaccggatttatacccaaattggcaatg

SEQ ID NO: 106322 - DNA, 163 bp, Heterodera glycines
  Promoter: Source sequence=SeqID_1371; Location=685..847; Strand=+; Gene=SeqID_73090
tttttatttaagaaattattaaaatgatttttggttttgagcggatgaacttgtcgagctgaaaagtgggcggagcctatccgatttcaaaagtataaaaccggcacatttttgaatgcccgcgtctttttccaaatcattcttaattttattcaccaaaatg

SEQ ID NO: 106323 - DNA, 164 bp, Heterodera glycines
  Promoter: Source sequence=SeqID_41582; Location=1..164; Strand=+; Gene=SeqID_69664
tgtagtgatggatttatgaaacgtctattttggcgtttatgaaacgcctccagcggccggatatccgtatgacacgaagtatttacgtgtattttcgctaataaatatttataaatgcttttatattataaagttttgtcagaaagcttcattaaaataaaatg

SEQ ID NO: 106324 - DNA, 216 bp, Heterodera glycines
  Promoter: Source sequence=SeqID_9374; Location=1141..1356; Strand=-; Gene=SeqID_71147
ttattaattatttatttgcacagttttcattttttaaattttactgtcaaaattccaaaagaatgtgaaaaatatttataaaattcaccgttttatttgctcagcttttgaaaattttgacaaaaagcggagggaaaatcctttataaagcggacgcagaacacagaaaaatcataaaattaaaaacataattttaatttataattatcaaaaatg

SEQ ID NO: 106325 - DNA, 315 bp, Heterodera glycines
  Promoter: Source sequence=SeqID_42867; Location=1..315; Strand=+; Gene=SeqID_70675
ttcagcgggtttaaaaatctagaaaaattagtaagcatttgtagtgctccgatacgtatctctgcaaaatttggtgagccgctgatcaattacaaattatttatggacgatcaaattttttgaaatttttttaagtgcaaaagtggatgggtgtctgcaaaaaattttcaccggagtttaaaaaatctaggaaaataagtaagcttttgtagtgttccgatacgtatctctgcaaaatttcggtgagcccctgatcaattacaaattatttatggacgatcaaatttttttaaattttttatagatttttaaatg

SEQ ID NO: 106326 - DNA, 778 bp, Heterodera glycines
  Promoter: Source sequence=SeqID_22166; Location=1097..1874; Strand=-; Gene=SeqID_52825
cggtaggggttagttgcgtctgagccaagcttaatacatcataactttttttcaggctggccaaattttataaatttggtatcattcgaaagctctacatgtttagaagcttttgataagttatttctaagcgattgaacaacttataaaaaagttgaaacatgaacactgccaaaaagtcagaatttttgcatattttaatttatcttttttatatgtcagtatacctatgtatctttgtgatttttaggaagccgatagagcttgttaagagcttcgaatgataccaattttgttggatttggtcaacaaagaaaaaagttatgatgctctaaacttggctcagacgcaactggcccgtttcgaataccatggccaaagaatggacaaaccgcccatcagagtaaatccccgtgctccattaataaggaataagtgcaaaattgtctttttcatgcattaaaaagcgaaaaagtttattaattttagacaacaaattaaaaatgccattgtgagaaggtatccttgtaataataggaaaatcataacaaagggtaattatgagaacgaataaataattgaacaaaatgcaatttggatggatttatccgttgctggccttctcctgggaagggacttcgttcctcttcattggccctccccttccttctcctcttcctcctcctcatccccaccatcgtcctcctcctcattttcttcatcgtcgagtgcttccacgtcaggcgcaagaaaatattgcagcggatttggccaaatg

SEQ ID NO: 106327 - DNA, 321 bp, Heterodera glycines
  Promoter: Source sequence=SeqID_1183; Location=2611..2931; Strand=-; Gene=SeqID_69477
attttcaccattttttgcgaacttttctttttttaacaaatttttttaaaattgacaaacttggaggtgttttttttatacaacgacaaaaaaattttgcatttttaattttaaatccattttttagttgtttattgtattttttaagtttatttaagcaaatattgaaatataaaccttttttggcattttgatgatttaaaacatatattttgacagtttttagtccatatttggccatttttgagctttttggtccatatttcaagcatttttagtccatattttatgcacatatttagcgttttttagtcgattatg

SEQ ID NO: 106328 - DNA, 62 bp, Heterodera glycines
  Promoter: Source sequence=SeqID_11595; Location=2524..2585; Strand=-; Gene=SeqID_75044
ttttttaataaaaatttaattttattttttgaaattcaattagttaattatattgtaaaatg

SEQ ID NO: 106329 - DNA, 585 bp, Heterodera glycines
  Promoter: Source sequence=SeqID_483; Location=194..778; Strand=-; Gene=SeqID_53925
aggactcaaaaagcgcgctgttgttgcttttttccacttttaagtatttatttctttattttacacgtacctattcttttcattaacaacattttaatgacagaaggtaattttcagaaattctatttttggtcagtcaaaatttgccgggctcagaaattaaaattcaaaccgcaacaaaagctgtcattttgtcattcatgagttaattttgcacatccaattgattgatcatcgtcttaaatcatttgcaattcattgccttaaattacattcatcgtatttaacaaaaaattctctgtttttgtttatttcaatttaatttttcattgtgacattttccttatgcccaaatgtgcctcaaaaattgtttgtttttttttgtcaaaaaatagtcaagtgatgatgatgttgcccataaattctaagtgattggatgattcggattttaaatattgtttttttactatttttgtttgaaatctcataaatgaatgaaattgtaaatttattgtgtctattcctgtatttttcaaattaccaaaaaaagacaatttgtggatttttcgaataattttgagaatg

SEQ ID NO: 106330 - DNA, 122 bp, Heterodera glycines
  Promoter: Source sequence=SeqID_6435; Location=1563..1684; Strand=-; Gene=SeqID_61567
tttattgtttcggcttatttaccgtactcccccacccttttttactgtctcagcttactgtatccgcacattggcttatgtccgtttcgccggtggtccagcgtatgctcagcgtggaaatg

SEQ ID NO: 106331 - DNA, 194 bp, Heterodera glycines
  Promoter: Source sequence=SeqID_18232; Location=1205..1398; Strand=-; Gene=SeqID_82832
tttggcctgaaggaatgcaagagcaactgaaggcgcgggagttgggattgcccgacccgcatccgattgtgccgccgcattggctaaatccacccaaaaaggaaaaaaagaaaaaggtggaagggcaaaggaaccaaaaatgtataaattttaactcgttttgacagacgaaaactgttccaattgctcaaatg

SEQ ID NO: 106332 - DNA, 1002 bp, Heterodera glycines
  Promoter: Source sequence=SeqID_26313; Location=1..1002; Strand=+; Gene=SeqID_57065
aaataaaatttttatgtattaaaaaaaatttattaatttttgcaattggaatgcccttatttagtgttgtttttagtgggattctgtttccatggcaatgaaaatgattccctaggattaagttattccttctttatttaccaaaataaatttggtttttgttgggcggacaaagatagtaggtatcccaacacatttcaaagtggattattgtcagttttgtatagcattggaagtaaacctttgcatattttgaataaggtctttttgcttttttcataattaatttatgattaggtatatgatttttagaatgtacggaatggtcatatcaaaagaatcgccgatgaaggcgaaataaaaacttacaacggaatttattaatatttcatctattattagacattcaatcctccgttatcgacttggtcggaatcaatgtcaggtgggacattgaacaatgctcacattcattataatcattaatattttatgcccaactttcttctcttggcctcttgaccctatgaaaaatcttggaattaaattaccttattttgagatgactgtcaataccctgcccaactctttcactctgctatttcagattgtacccaaaaggggggatttatttaatgacctttcaaattggcagccgttttctgaatttttcgttcaagcgatttccgctcaagttccttcattgaaagattctttgttgagggaattttctgcatttaaattgaacacgcgaataaattagaagtaaaatcgttctaaaagaatttaaactgttaggtaatcaaggtcatttcgtttagctgattgcttctcgcttctcgaggcttgatcagaaaagcgtcagttgaaaatttaaactttattattacttttaaaacttttggcataatgtcttttttctttttgttgtttccttttttccagagccataaccgaggtaacagccgtttttgaccaagtttttcaaatttagaaaaaatg

SEQ ID NO: 106333 - DNA, 240 bp, Heterodera glycines
  Promoter: Source sequence=SeqID_4501; Location=4103..4342; Strand=-; Gene=SeqID_54681
tcagttcgttgtgtaggccaaaaaagttgacaatcggctgttggttggtgtgcgatttggactttttgttcaggcgcaagcggcggtaatgttttcgcacactgtcagcaaaatttgaattttatgcattaaaatttgagcaaattttaattaaataattattattaaataccgtaaatcggggagaaaattgcccaaacaaaatttgtcgtaaacggctggacaaattttaaaaaaatg

SEQ ID NO: 106334 - DNA, 497 bp, Heterodera glycines
  Promoter: Source sequence=SeqID_1791; Location=2444..2940; Strand=-; Gene=SeqID_75994
ttttagcttagaatactgggataatatttctttctaaaatgaatggattagcatcgaaaaagatatatttttattctaattcgagttgttctattgcaaattggaaaagcctgcgaaaggacataacctttgaaaaggacggtatcaagattatatgaagtatgtatagtgcaatgaaaagcaaagaatcaatgaaaatgcattgaatgaaaagattgccttttttagagtccgatttattaattgatcaattttggcaaatattaattacctagctaattaggtaaaacaaattttcctcatgtttacctattaaccgttttcatctacctaatctgatgattttttgagataccaaaattttgaatttggcagtatctctttatgatggcaaatgtttttcgcgtgtgtttcgtgttgttttgtgttattttttgtatttaagcaatgccttgccactgcccctgccattcttgcgcttgttatttgttgtaatg

SEQ ID NO: 106335 - DNA, 76 bp, Heterodera glycines
  Promoter: Source sequence=SeqID_875; Location=4051..4126; Strand=+; Gene=SeqID_63067
cctaaataaagggaggggacaaacaattcgagaattacagcaaattagtttcataaaattcataaaacgcaccatg

SEQ ID NO: 106336 - DNA, 83 bp, Heterodera glycines
  Promoter: Source sequence=SeqID_29466; Location=1..83; Strand=+; Gene= SeqID_59962
cgcagactgaacctgaagagaagcccaaaacatttgcttttggattgcaaactgatcaaaccggtttgatcgattcggagatg

SEQ ID NO: 106337 - DNA, 1003 bp, Heterodera glycines
  Promoter: Source sequence=SeqID_6260; Location=1415..2417; Strand=+; Gene=SeqID_60904
cgttattttcaataacccagggttcccagtcactgtacaaacatttaaagtctcttttgaggtcttagaaatgttctgtgaccggaaatggttaatgaaatttgttcgaactcctaaaagtgggtctaaacgtcgttttggagcaaaaataacaacatttgacccccttggaggaacccctgtctggaaatgtcttcctgatcatttttgaagagttcgaacaatgttcgacttttcgacattttgttcgaactcgttattttggtctgaatagggctctaatccattgcgcaagtatttttgacgctttattttaatttgtaattaaaaaaatatatatttaaattaatttttgaatataaatattagaaataataattagcgaatgggagcgccgtagcatagtggttaacgcttttgattaaatgctttggggttctagtccgcacggcgctcccattaggtaggaattaacatcatttcatttcatttcatttcatttcatttcattacattacattacattacattacattacattacattacattacattacattacattacattacattacattacattacattacattacattacattacattacattacattacattacattacattacattacattacattacattacattacattacattacattacattacattacattacattacattacattacattacattacattacattacattacattacattacattacattacattacattacattacattacattacattacattacattacattacattacattacattacattacattacattacattacattacattacattacattacattacacacacacatttttttataaagtttttgttataacaaccaacattttggtatcactacttcattttagtactaatcattgtcattaaatttacaaaagctcgtttttatttatttattatttagtttagattttattaaaaaatg

SEQ ID NO: 106338 - DNA, 1003 bp, Heterodera glycines
  Promoter: Source sequence=SeqID_334; Location=26..1028; Strand=+; Gene=SeqID_82939
gcctctaaggatttttttttttgatcattaggcacacattctcttttgatcagtgccactccccaatttttctttgatcattaggcacacatcctcttttgatcagtgccattctccttttaatcaattggcacatatttttctgatcaataccattccccttttgatcaattggcacatattatcttttgatcagtgccattccccaatttctctttgatcattaggcacacattctcctttgatcagtgccattctccttttaatcaattggcacacattttttctgatcaatgccattccccttttgatcaattggcacacatttttttctgatcaataccattccccttttgatcaattggcacatattatcttttgatcagtgccattccccaatttttctttgatcattaggcacacattctcctttgatcagtgccattctccttttaatcaattggcacacattttttctgatcaatgccattccccttttgatcaattggcacacattttttttctgatcaataccattccccttttgatcaattggcacatattatcttttgatcagtgccattccccaatttttctttgatcattaggcacacgttctcttttgatcagtgtcgttctccttttaatcaattggcacacatttatttttgatcaatgccattccccttttgatcaattggcacacatttttcatgttgatcaaatcgccgcgatttttatttgatcagtctctttttcgatcatttcctttgatcagtcccaccctgaaatattcatttatacaaatatccatgccatctatcatctatgattctttcatgcatgcattattcatgcaaacattcattcatgctagccttattcaatcattcattcatgccatgtgctttcatagagtcatgcggttataaattttcatgcattacttataaatgtaataaatattataaatggtgcggaattagcttatcgcattcagatg

SEQ ID NO: 106339 - DNA, 143 bp, Heterodera glycines
  Promoter: Source sequence=SeqID_13706; Location=272..414; Strand=+; Gene=SeqID_77623
tatcaaaggtcgtttattgattttattcactgtgcgtggcgaactctcccaatatttgctggcgataaacattctctctcatttactcattttcattcacacaaacattggtctgactgaaaagcacttaactgatcaaaatg

SEQ ID NO: 106340 - DNA, 745 bp, Heterodera glycines
  Promoter: Source sequence=SeqID_32192; Location=1..745; Strand=+; Gene=SeqID_62519
aaaattccgcaacatttttattgcccttgtgactttaaagtggggcaggcaattaataaattgggaatatttgaaaaaatgatttttaggtttatctttctccactaaattgttatgctatttttttggaatttttcgtaaaaacaatataatttcattaatattaatttatttgtttttcttcataaaatgattttctgaatttcttacgatgaaataatcaatgcaaataattgcacattgattactggaaattgatttcttcttttatttataagcatttccaaagccgcccagcttctcatttttatgaatttttttgtttttctttaatttctttcacatttttatggctctaaattattttttgttcgtcattttaatgattctcataaataacggcaagtttataataatatttaataaatagtcttttgcttttttcttttaaaatgttttgtgctttttcacatattcgactgttgtttaagttctgtaataaaagagaatttttttttgtttgctgatttaaaaaagtttcaattaaattgagtgataatttgcaaatgccattcgaaagagaaagtttaagcatttttagaaagcgtttaaaatccgtttggttttttcattttttctgttttaaggctgcgcgcaagattttgagttgggccttcccttaaaagatttgctaacgtccaaattttcattgcaaaattcaaaaccattgaaagaatgttttatg

SEQ ID NO: 106341 - DNA, 449 bp, Heterodera glycines; identical to SEQ ID NO: 105225
  Promoter: Source sequence=SeqID_18172; Location=1028..1476; Strand=+; Gene=SeqID_82756

SEQ ID NO: 106342 - DNA, 64 bp, Heterodera glycines
  Promoter: Source sequence=SeqID_14788; Location=1..64; Strand=+; Gene= SeqID_78931
tccataaaaaaacaaatttggacctcggaattccgatcttctgtttccgaaaagcctcggaatg

SEQ ID NO: 106343 - DNA, 559 bp, Heterodera glycines
  Promoter: Source sequence=SeqID_6067; Location=839..1397; Strand=-; Gene=SeqID_60201
tcacggcacccgaccttttggctagtcagtaataagtagggatcggatttctaagtttttacttattttttctgtggctttaactcgaagagaaatgtacgaaaaacacatattttgttcgaaaattttgcgttttatcgcccttattcgaccttagaattccttatattgggtattcgcccttaaaaatccatattttagatgttcgcccttaaaataagtttttgcccatattttggcgtttcatccttatgttcgcctttatttcgcgatttttaaaatttttcttataaaattcacaaattattgaacaaaattgcaattaaaaaagatttttttttgacacgatcacattttttggaaaatccaaaattttcactgaaaaataaaagctactcatggggtcatatttaagcctaaagctttttgacaaaacatttttaccttccaacaattggtgctagtgcgttttataaatccgccagcatatttttttgcatatatcattaataatattaaaattttatgcaataatttcagctatattttatacaaaatg

SEQ ID NO: 106344 - DNA, 69 bp, Heterodera glycines
  Promoter: Source sequence=SeqID_106; Location=1..69; Strand=+; Gene =SeqID_69858
acgtcagcatgtcaaagaggacgtgttctttgagagcgccatgaactggggggtcaagggcgatggatg

SEQ ID NO: 106345 - DNA, 382 bp, Heterodera glycines
  Promoter: Source sequence=SeqID_4288; Location=714..1095; Strand=+; Gene=SeqID_53895
tcatttggacaatttgcgtcgtctcatttcatcaacaattctcactgatcttgcttgatcaattgaattcaatcagttccggccacctgtttcccgccgcggtgattgatgatttcgatgatccaaatgcaacttctgctggccaagcgttgtccaaatgggtgcacacgccgacaccaaatggccaaccgaagcgactgttatgccaattatgccgaaatagcgtagaaagaaacgtcgattgggtcaacagtttcaaggaggtgttgtgctgcttacatttttttataaaatatttcaattttcgtttccatttttgtttagaaatttatttgtgccatcacttcttgtgccagctatacaattacgtttgatacttatg

SEQ ID NO: 106346 - DNA, 260 bp, Heterodera glycines
  Promoter: Source sequence=SeqID_44973; Location=1..260; Strand=+; Gene=SeqID_72374
gcgcaaagtgaaccaattttttcaaggttaaaatatttgaggaatcttcagcttttggtattcgttctaattgatcaaatttataattcaaaaacaagaacactcgagaagaaactaagcttggtcgggaccacaggaattcccgtatttttagatccccggtttttgaaaaaaaaattaaagcttaagtacgaatcataaatttttatcttaataaaaacatgttaacaaaaatttcaagggtgacaacgaagaatatg

SEQ ID NO: 106347 - DNA, 155 bp, Heterodera glycines
  Promoter: Source sequence=SeqID_20523; Location=1..155; Strand=+; Gene=SeqID_51055
tttacgctttgctaaaaaattttattcaaaaaagtataactaatatttgtacatagttctagatttttttttttacatattttatatacatattttgagacttctcatataaaaaatttgtagccctattaataaataattaaactacagatatg

SEQ ID NO: 106348 - DNA, 109 bp, Heterodera glycines
  Promoter: Source sequence=SeqID_26635; Location=736..844; Strand=+; Gene=SeqID_57386
agctcaagccctatgtgttggtcaacagaaagcgaccggtgccgcaaattatcaaccaatttgctggaaaattgtttcgtttttcagaaaaaattagtgccaaacaatg

SEQ ID NO: 106349 - DNA, 806 bp, Heterodera glycines
  misc_feature (33)..(33): n is a, c, g, or t
  Promoter: Source sequence=SeqID_30605; Location=1..806; Strand=+; Gene=SeqID_46227
ttggaaatgccaatttgttactcaattagttgncagaaatttcctcatgagattcttgcctgtttgaagttttaacattcttacatatcacatatatacggatttgtgtcaaccataaaataatttttcattgttttgataaaaatattggttaatcgaaaattttttttttgcgaattagagttttaaaatttaacttacctatataccttttagttcaattttatattatgattttgtgtactgtagaattttaaaaaagttatgttattctgtttattgtgaatttatattaaagattttttgcattggttttccaaaaaaatcgttttagcgagtcactcatagtctggatgaaagattgggcgctatatgcaaagtggtcaatttttaattttatcaaaaagtaaagggggaacccttttgttttgtgaaatttttttgtgataaaaaaccatgaaaattgtgttatccggggttttagaggttgctgatcacgaatctgacatctgattcgaggtcatggacccaaaaaaccccagggaataaattttcataactatatattgaaaaacttgcaaaacaatagggtaccccttttgtttttactttttgataaaattcaaaattgaccaaaaccgttttgctcgactccccgtcttacaagaaacatgaacctgtaatgtttctaaaacccgtactcaggtcctcccagcttcagtcatggctttaaaaagcgctaattaccaacgtacatacatattcagtttttaatcactttagaaaatcatattaaactaaaaatg

SEQ ID NO: 106350 - DNA, 680 bp, Heterodera glycines
  Promoter: Source sequence=SeqID_11195; Location=389..1068; Strand=-; Gene=SeqID_74546
ataaattcagtgatttcctgaaacttgaacatttccgaccaaacaaaaatgcactactttccagcagaatttgtttggggccaatattttggttttgcaaaaatgttataattttgggttggatgtctctgaacagacctaaaaatgtatttttgaaaatttgggattttcgaatccgggggttgggaatcgtcggatgtcagattggtggtcaaggcaatattttaggccccattttttcttcaaaaattcatataaaagacggagaaaaatggcattgactgtcactttttttttgtacaaatgttggttaatcagcaggcggcggcgccgtgcaaatgtttattttctttgcttttttagctcctccattttgtttctaaattatccaatcacttttttgtttaatttaaatagactaaaattagtttttttggttcacacaaaaagacgaaattgaccaactgaataattgtgtccgttttaaataaaagtccggtaaaaaaagattttacgggaacagtaaaatgaagaaattgggactttgctccctgaactctgtgttggaaaccatggtttacaaaaggaatctcctgatttcacataatttgtcttttttagtttccctaagctaatttaaatccgtcaaaaactgtcttgtaatttgcgccaacaaaatg

SEQ ID NO: 106351 - DNA, 462 bp, Heterodera glycines
  Promoter: Source sequence=SeqID_15585; Location=820..1281; Strand=-; Gene=SeqID_79875
tcccccgttctccaaaattccttggaaaaatgcgccgcaaaaatttgtttttttagattaaaaatgcactgaatttgctaatttacttcccaaaatcgttaaatatgataattggaggcgaaaaatacaaaagttgatgctatattaattgtataaagtgttatacaagcgatttaagtattttttgttaaatgttcttatttttgaccctaaaatcttattttatggcctggatgttcttattttgaaattttttcgatggaagccctgcattagaataaaaaataaataatataaatcacaattttttatttttaaaaatattttttcagagctctaagattattttaatgttttgtagtttgtttaaacagaaaatttttgcataaataaatacccatcaataataaaaatcattctttttaaaaaaatatccaatttgagaatatttttaaagagatg

SEQ ID NO: 106352 - DNA, 464 bp, Heterodera glycines
  Promoter: Source sequence=SeqID_10700; Location=3193..3656; Strand=-; Gene=SeqID_73953
tttttttttggtttctataggaaaaattatattaaatttattggaaacttattataataatagggctaaataggtacaaaataattattaaacaaatttatgcacttattcactcaaaaaagcttttttttctattttaaagtaaaaccaggattgtatctactgagttatcaaaagaataaaaagggtaacatttttattcaattcagttgtttttctccaaaatgaattttcttccatatttttttagcaccggcgttgcctataggcaccaccttggaaaattttttagaaattttgtctttatcacaattttgaccaaaaaaaaaaattgtccaggacgggatataggaaaaaatataaatatgtttgctcagagatatgaaacttagacttgggtgtagcaaagtattttaaagaaattgaaaaggaaaaaaacttaggaagatatataacaaaaaatg

SEQ ID NO: 106353 - DNA, 136 bp, Heterodera glycines
  Promoter: Source sequence=SeqID_24908; Location=827..962; Strand=-; Gene=SeqID_45895
ggtgaggagccgtcaccgtcccaccccccccccccccccactttccacattttaatgtcttttcaactttgtttagttgccgcgcgaggacgtagtggagctgctgccgaacgatggggacttcctggtgcgcatg

SEQ ID NO: 106354 - DNA, 606 bp, Heterodera glycines
  Promoter: Source sequence=SeqID_28918; Location=1..606; Strand=+; Gene=SeqID_59486
tttatgtattagaaatataaattaaaatcccgtgtatattaaataaaatttttgaggatgttttgcatgaaatttgaaaaataagaacttgttaaacaagtttgtgaacgaattttaccaagctaagcgtccgaaaaatgggttgcatggcaaaacttacaatagcaactcgtacataagttagactaggcctaggcattaagccgaaactttaggctaggtctaggcttaaattttatttttacaattttatatattttgcgtttcgaattttttacattttgacatttatacgttatgccatttttgcttttggcgataatttaaagttaccatttttgaattttattaaaaaccgaagggggatccatttgtttttgtaaaatgttttcctatcctctaaacttgttgtttgaggttttaaggattgttacagatcacgaatttgacttctatttcgaccaaccaaaacctaaaaattaatttttattgaaaatttctagaaaacaaacaagtccgttaaattttaggaataaatttaatgtcggaccggaccaactctaattttcaaactttttacttttaaggctgttcctatcaattatg

SEQ ID NO: 106355 - DNA, 1003 bp, Heterodera glycines
  Promoter: Source sequence=SeqID_3310; Location=194..1196; Strand=+; Gene=SeqID_84167
tttaatattttggcatttttagcaatacacggcgaagcctaacggcaccgcaggcccctttccttattcctgaatttttttttgaacaaagcccactgctaacattgagcgaaaagcaacaaaaaaaaagtcgaactttattggttgacctcattgacaattaattaccttcgaccactctccgatacctggaacattcgaaaaaacttggtcgatccaccaccctttttccatgtatgcgaaagccaaaatatgcgaaaatgcgaaaagcgaaatgcgatttttttttaaattttaccaatagcttttgaggttgtgatgcaaaaaaaaatctgcattttccggttcgatctttttctcagataaaaaaatgacaaattctacccatttggtggttaaaatttcaaaaattaaggtaaaatgaaggtccggcggtgccgataatcgccgccggaaaattttttggaaattgtaataaaatatggtaggaaaagttgcaaaattttcaaaaaatttactgtatttcaaaaaaataaatcgcaaaaaaggcaaaaaaatgcaccaaaaagtttaagataaaagcttcaaaccaagttaaaaactcgttttcgtgcatattaggctatagcaagttagcaaaaaaggtaatattagagttgcacgggaccgggaattttgacaaaaaccgggaccgggacttaccgggaccagaaaagtcgggaccgggacctcgattttcgtccgggactgggaccaaccgggaattttcccaagtgaaattttttgaaaaaaaaatttgaaaatttgagtgcactttgttacgaaaaattgcctatatttaaatgtgtttgtggggagaaattcgaagaatttttccattttaacagaaaataataaactgaagcattcgttttaaaaattaaattttcaaatatattcatttcttaggggtggaaatttcgcatttcgcgccaaaaagcgaaatgcgaaacgccaaaaaatg

SEQ ID NO: 106356 - DNA, 359 bp, Heterodera glycines
  Promoter: Source sequence=SeqID_7406; Location=1874..2232; Strand=-; Gene=SeqID_46411
agttgtatgaaaacgcgctaagaaagttgaaaaaacgcttccactaaaaaataaatgatttacattttaccctgttgttttttagtttcatattgttcttttcatttctcctattattttgttacccacccatctcaatttccattttccattgtcttgttccttttttcagaaatattttggtgaataaatattgtttaaactaaataatacattattttggtaattaataataaacgattcctaatcgattttgagtcaattatttattgtcacaggcaaactgtttcttctcattttgtagttcgggctgactttagtgatttatttatttattttttttgattttctgtcagatg

SEQ ID NO: 106357 - DNA, 127 bp, Heterodera glycines
  misc_feature (55)..(55): n is a, c, g, or t
  Promoter: Source sequence=SeqID_41177; Location=1047..1173; Strand=-; Gene=SeqID_69363
gaaaggggtcaaatgcgataattaattaacagggggagggcgggggaaatgggcngggtgccaaaaacccccgatcggttaaggactgatcccgagacttttcggcgtcaacaaagactgtgtgatg

SEQ ID NO: 106358 - DNA, 1003 bp, Heterodera glycines
  Promoter: Source sequence=SeqID_875; Location=5158..6160; Strand=-; Gene=SeqID_63068
cgtttcggcacttggccaatgcctccgtccctccacccgccgaccgtcctattttctcggggccctttaaatttgcgaatttgtgcatgtgccaattgatttgtcttttatgctttttggttaatcagtcaatgaaatccgtcagcaaatgatgcaatcggctgccaattcggttttcgggccgcgccttcgccgcaagtccgccgctttgatgctaaccaatgaattgcgtcgcagggtccttctccccccccccccccccaaaaaaaggcgatcacttattctgtttgtttagttcgcgtgtttctacctgctcttttgaacaggtccttccgaagtgactgtctattttagagaatggatttttgaaaaagtctgggatcgggattcggaattgactttttgcgtccgtccgttgttccatttgttcctcttttcttttaggccactcaaatgattggccccgatggtctgtgggctgctgtccgtgctaatttccctcactttcttaagggctgacttttctcggcgtcaatttggtgcctttcgggaatggctttcgctacaatttgcccgtttcctccgctaacattgcttcttctcgaaagacttccctttttattggaccatcgtcacgaaaaccttcggcattttttgtccaaaagtctttgatcaaaaaggagaagacacgtttccaacgagtgaccgaagtgttgctggtcagtgattcacagaccatcagaaaagtggcgaattgcgaaatctgatcggctgaattagacggaccaatcgaaacgcaatagccagacaatttactaattcattctccgctgatcagtccgttgtccccactaatctccgcctttttccctttccactttcaaagagtatttacgaaaagtcccgggtccattaccttttgccaattctcgtccttgtcatttactcttttcttggcggggccattttctatacaattgaacatccagcggaacagaacatg

SEQ ID NO: 106359 - DNA, 1003 bp, Heterodera glycines
  Promoter: Source sequence=SeqID_2033; Location=592..1594; Strand=+; Gene=SeqID_77415
ggacttttatttattttatatacctatttggagtttttatacatatttacatatttcggaatctaatacatacatatttggtacatattttggactttttagcatttttttctaaattgagaatttttgataatttataaaaatttcatgtgaaaaattaaaaatgttaaaaatatgttcaaatttttttgatcgaataaagggaataatttacccttaaaatggcaaaaacacctcagattttcttggggcagattattccctttgtgccatcaaaaaaaccaatgcattaatttttaaaaaccgtactaattgtaatagagacccgggaggctctatttttcaacccacctcaaaagggggactttatttcagggggagggggctctaattcagtggggggctttatttttcaaccctaattttttcaaaagtccaacaaaaaatggcgattttttgaaaactttttactaaaaacaaaaaatttctacgggtttccgggttaattccaaaattcttgttcgttttggatgaaaatgatttttttgttggcagattcttgggacatgggagcacagcaacaggatgtaaatttcacaaaaatgctgatttttttattcacttcggagttgaaagggcctaaaaacccaaaatttgcccattctcgacagatgtaactaattaaacattggtttttgggccaagggttcagattcgattgcctgtaaattttttaaaaattatttttgggtttttttgagttcgggtcagggttcggaattgggcgaagtgaatgtcaaattcttgatcagtggtcccaaaaccctcgagaaacaattttaaaaatatttgcaggcaagtggattctaactcttggcccaaaaaaactgaaaattgcggattttgtgtatatttcttttcctatactttttcagaacagtgatattatccccatccaaaagaggctaaaatgtagaattgaagaagcgtatcgcccgaaatg

SEQ ID NO: 106360 - DNA, 100 bp, Heterodera glycines
  Promoter: Source sequence=SeqID_17085; Location=1..100; Strand=+; Gene=SeqID_81514
gggtaaacccaactcatccatatccaattcatccatagcacgatacgagtcgtcgccgtggcatttaatgtcacgactaagaccgtacaaccaaaaaatg

SEQ ID NO: 106361 - DNA, 333 bp, Heterodera glycines
  Promoter: Source sequence=SeqID_24585; Location=972..1304; Strand=-; Gene=SeqID_55321
ataaaaggtacttcctcctactcttctcagtcattcattcgccctcattttttgcttttatttgtgttcgaaatgtcttccgtttttatgccccaaattcttttttcttcgtcccattgcttttctcctttggcttttgcctgcactctctgagttgcttttgatcatcaaattttaatttccattacaaaaattttttacttttttcagtcaaaccgaagcaccaatgaattcgttgtccctcatttttgcttctttgcgtctcatttttcgttgttcatttgttattcttttatcaattccattttcagtgtatttgctgtgcctttgatg

SEQ ID NO: 106362 - DNA, 209 bp, Heterodera glycines
  Promoter: Source sequence=SeqID_25861; Location=1218..1426; Strand=+; Gene=SeqID_56632
gtcaaaataggcaaaatttatacaaaattggtaaaaaaatttagccaaattagtagggatgagattttaggcacaaaaaatcgcaaaataggcattaaataggcaaaaaatatatattataaaaaaacaggttcaggactaagaaaccataaaatctttttaatgataagtagggttaccaaaaaattcctgcctttaaatttcagatg

SEQ ID NO: 106363 - DNA, 76 bp, Heterodera glycines
  Promoter: Source sequence=SeqID_5718; Location=1285..1360; Strand=+; Gene=SeqID_59018
ttgtagcatgacacccaaaattaaattaatttaaattaaattatatatttttagttaattaaattatttttacatg

SEQ ID NO: 106364 - DNA, 473 bp, Heterodera glycines
  Promoter: Source sequence=SeqID_36446; Location=514..986; Strand=-; Gene=SeqID_65754
atttattagaatagacatttcgcatatgtttaaaggttatttattgcataaatttgtttgtgcattattatttatttatgtacatatgtatgtgttacggagtggaacactattcgacaatttttaatcaaaaataataaataattttggtaatacatatacccgatggtaggaccccttttttgaatgatgcaaaaaagaataaaattttcgtaaacaaaaaatttttggaattttgttttctatttttagtgcagtatttaaaaaaaatttcggcacgattcttaggggctgtatatggaattcggattcgcgatcactgatctgcaacgcataaaactatagtgaacaaattttcacgaaaagatgataataagaccatagctgggacttagaacttgtatcaaattaatagattaattgttggttaatctctattacgactaacttcaatcgtttctcaacaaaatatg

SEQ ID NO: 106365 - DNA, 211 bp, Heterodera glycines
  Promoter: Source sequence=SeqID_7690; Location=1..211; Strand=+; Gene= SeqID_46460
aataacgtaataagcaatcagctacaaaccaccccggccatatatcctatgagaaaaattgagatcaggagtcttttcatcccgcgtggcacttctgacctttcacacaatgtttttacaagcattgttccgagacgtttaatcgtcgggtttgtttcaaccggtgcgtataccggaaatcctaaagagtcacccttcgtctttgaacatg

SEQ ID NO: 106366 - DNA, 155 bp, Heterodera glycines
  Promoter: Source sequence=SeqID_16349; Location=1892..2046; Strand=+; Gene=SeqID_80742
accgttcccaattgtgaattcatcaattgaattcgtacaagttggcgaaaaagaaatatttgtcgaattgtttccggcaaatctttttgctgaggcggacgattcgcttgggtcgcccattgttagtgaacaaccttaaattggtatcgaaaatg

SEQ ID NO: 106367 - DNA, 377 bp, Heterodera glycines
  misc_feature (47)..(47): n is a, c, g, or t
  Promoter: Source sequence=SeqID_4477; Location=1769..2145; Strand=-; Gene=SeqID_45821
aaattttcagacgcaaatttccaagtttaaaatgttaatttttcacngatttgtgagttttattcgcccggtttcacgttccccagaattcgttcaatatttctttctcccattcattctttgtgctcttttttcgcaatatttgctacgtatgcctttggttgtgccatttaccaattacacatttcattttcattcgcttcttcacttacaaattaatctatctatccatcgtttacatttagtcagcatttattttcttttaaaaataaattgagaaaatattaatgttggttaaagtttataaattgccataattaatgtgatactatcgttagcaaatgaaccattttgctttttaatgaattaagcgaatg

SEQ ID NO: 106368 - DNA, 125 bp, Heterodera glycines
  Promoter: Source sequence=SeqID_13286; Location=1..125; Strand=+; Gene=SeqID_77127
aattttttagaaaatttaataaaaaataaaaatttgaccgaaataaaaaacacgagtacaattctggatcaaaaaagcgaaaaatttatttgttttttaaatttttgttaacaaatctcagcatg

SEQ ID NO: 106369 - DNA, 107 bp, Heterodera glycines
  Promoter: Source sequence=SeqID_5514; Location=1288..1394; Strand=-; Gene=SeqID_58306
acgagtgggacaaaaatgaaagagacgaaaacgaagaagaaaatggcaccgaaacaattgatcaaattcaaaatgatcaaaaaattatcaaaaatgaccaaaatatg

SEQ ID NO: 106370 - DNA, 1003 bp, Heterodera glycines
  Promoter: Source sequence=SeqID_17323; Location=422..1424; Strand=-; Gene=SeqID_81794
gcaaaaaattcgatagttttttcaaaatcaaagagcaaaaaattcgggagttttgaaatctttttttaataaatttcccaacagcaaatcggcagagaaattgaaaaatgaaatggtaattttgttattcatcacaaattctctttaaatcatatatgaagccttttcctaggcccaattcaatttttttaattagaaaaaacctcaaaaaccaaaatttcataagaaaattaggtttggtgattttaagaaagttatccgacaaccatttttagtggttaaagtcattcttttgaggtgccaattttacattttattgtattccgctaagaaatccaaaaaccattccggcacaaaatgccaaaaggcaaaatggggatttaagttttaagaatctttttagttatttgttaaatttttaatacattttttttttataactttacatggtaatgaggaactagagctaccgtatatgctctaattatagcccatgggggattatttttcaacctcctcagaaaaggggggataattagagacgggtggattatgatagagggattatttttcaaaacacctcgtagactggggtgggggataattggagactgcgggattaatagagactgggctataattagagcatatacggtatctttcgatattaagattgtttaaattgataaacttcgagcaaaggttatggatttatttattctacaaatatgattgaatactaataattaaatttaaatatttaatataaattatatttttagaatccaatatagcatccaagcgtacgttgcaaaatgcccataggacaacgctacatttctcattataaattgaatggatatagatttattgcatgatttttctttaaaaaattgttttacatataattatccaagttaataaagtaatttttcgcttttcttaagagctaaaattttatttagccttttaattttctcttagaaattctgtctgatttatg

SEQ ID NO: 106371 - DNA, 1003 bp, Heterodera glycines
  Promoter: Source sequence=SeqID_10934; Location=4079..5081; Strand=-; Gene=SeqID_74242
atatagcataatcacctattttttaattgattataatatcaaaatcaatgattcactaaatattggccactgttactacggttatacaacattagagcatcagtaagattctacatagcaaaatagcatccatagttattagaaaattatatacaataattaactaaaaatagcgataaatattttaaaaaatattaataatttaataagggacacaaaataaaaaagttcaaataatttatgatgttttaataaaatgaaaataagatttgctgaaggttcttctacatttatgagaataatgcacaataaaattaggcaaaatatgaactaaaatatttttctcatatacggagaggctcaaagaaaatgcataaatttgtcaattgatgtgcgtgcgtcagcagaaaagaattcgaatctttaaatcaaatattaaaataaatgaaaaaataattatttaaatctaaatcaaattattaatattaactaaaaattcaaaaaataataataattattaactctttgttactcatcttttttaggtcattactttgccgtaatgttttatgaccttaatcattaatatttaaaagtgaaccatcaccagcaaattgttcattttatccgttctcattacaatgcatatatgttcattactcgaattcttaatgagttcgaattgttaaggaatttcctatgtttcccaaattcttatggagaataaaaaaaaaattcttttgagagtttgtagaaattcccttcattttttccaacgatttatcatattttgcagtgctcactcataacaattctttggtcacggcttaatgggcgttttcaccaccaaatttttgaatatgatagggaataactccccatttgcgcctcccatttttgcgtctcgcattaatttgtttaaaaatgaactgtatcacatttcaatcgagaaataaaatttaatttgtcccaacattttcattcttattattgagttgccatg

SEQ ID NO: 106372 - DNA, 177 bp, Heterodera glycines
  Promoter: Source sequence=SeqID_780; Location=2321..2497; Strand=-; Gene=SeqID_61026
tggcaggagaatgaaagtgggatgaagttgaaaaattttacttttatttgcgcaaaagtgtggccacgcctacactatttgaaaagagtcacggttttagacatgcccgcccactaaaagccaaaacattttgcctgccaaaaacccagaatcattttaccaatttttgtcaaaatg

SEQ ID NO: 106373 - DNA, 293 bp, Heterodera glycines
  Promoter: Source sequence=SeqID_11792; Location=1248..1540; Strand=-; Gene=SeqID_75293
ttgctgttgttgtcgctgttgtcgggctggctttgtgggtgcttgatgtgtgatcgttgagagcgttgcttgaagtgttgctgctgctgagtgaggagaatgtgcaaaatccacctccttatatacaaaattcgggtgcaaaaattcatgcagcaaaaaaaagtgtataaaaggcgacggttttcttcacttttcaccagtgccagccagccttcaactcaacgcaacatcaacaccagtgcgcgccaagctcatctacacatttcgtcgcgacaactcatcacttcatcatg

SEQ ID NO: 106374 - DNA, 238 bp, Heterodera glycines
  Promoter: Source sequence=SeqID_19305; Location=1..238; Strand=+; Gene=SeqID_84045
ctaaattctcctctctcttttcctctcaccttctctcttccttcacccctctctctctccccctcttcctctctctctctctctccctctctatctctctctttctctctctctctctccgaacaaaactatcagcaaacatttcccaatgtttcctcctcttttttttgttggtgtgattcattagtaaacaaaaaattccaaattttctgtcattccctaacaaattcagtggatg

SEQ ID NO: 106375 - DNA, 545 bp, Heterodera glycines
  Promoter: Source sequence=SeqID_42316; Location=1..545; Strand=+; Gene=SeqID_70235
tagagctcgcattttgtggcatatgcctttttttctgcgcacttgtttcgacatattaagcataataacatattttccacttggtttgaggcttctattacataaatgcctttttttggtattttgccgtttggtgccttttttggcgttttttccgaaaaattccattaaaaatgctataaaatatggaaatatacccctaagaaatgacctgaaaaatttttagaaaatacacccctaagaagtgaaaaaattttcgaaaactgatcgccaaaatttctttttttttcttgataaaatttttaagtttaaaaattttcctctttcgtagaacattataaaaaatttaataatcatttaaatgaacaaaattaagttttatcattaagttttacgtgttatgctccctaaaaatccttaataaaaaaagccttttttcatgcctttttcggggttttcctgtctttacaaatagtactcaaaacttaaccttatcccatccatcatcatatccaatttgacacttataaaaactttgaaaaatg

SEQ ID NO: 106376 - DNA, 95 bp, Heterodera glycines
  Promoter: Source sequence=SeqID_16297; Location=2629..2723; Strand=-; Gene=SeqID_80686
cgtttcgtggacatgcgacatcgttgggcgtacgagcaagcgcagcatcggaaacaaccttaagtgaaactgttcaaaacattgacgtggagatg

SEQ ID NO: 106377 - DNA, 816 bp, Heterodera glycines
  Promoter: Source sequence=SeqID_263; Location=665..1480; Strand=+; Gene=SeqID_80331
tccggaagtataagggtcaccaagcacatacaaaatcaagggttgacaaacccaatttaaaaaaaaaacacacacacacacacacggatcaccaaacccaatcaaaaaaccgaaaaaggacaccataaaaagccaaacataattaaaagtcataataaaccctacagcaaacccatcactaatttaaataattaagtggacagagcgactcctaattcaattactccgacgaccaaagccaacacgaaaaagaaacaagtggcgaaaagcactacactgactgaacttataaaattaaaaacacaaacggaatacaaattaacgaaacttcgcccaaaacatacggagaatatattgaaagaattttatgaaaaaaaggagcaaataattaacaaaaacaaataaaattctgtgatcaaatttttaaatttgtgataacaattattaattctgtgatcattaaattttaataaaaattatttaaccagtgataaaacaattaaaattcgactcgatagtgattatccactaaataaccataaaagggtacttagttaattattttgaatttttaaaatacaaactatgtccggtacgcttcgtagcaaaatacccctccttaatcgcgtattaaaaagggaaatagaaacgatcaaaacaaaaattgaggaaaacaaattcgaatatgatcaaaataatcccggagaatgcatgcggatattcaataaaacaaaggaaattatccaaaaaatagagccaaattttgaaaaattaaaagccttaaataaaaggtggcaaaatttaatgagaaaaatg

SEQ ID NO: 106378 - DNA, 918 bp, Heterodera glycines
  Promoter: Source sequence=SeqID_44973; Location=509..1426; Strand=+; Gene=SeqID_72375
atgaaagtgatttgagagcagacaaattgagagactttttatagtagcgccaagccagacaaatgccataccttccaaacacaccaaaatgacacaacatcaaaaaaatagactcttcagctattttaccataaacaatgtattaattaattaattattaataattcaaaacaccgcagccaaactcaaattatgaccggaagtgacacacataacaaattcagaaaacctaattttgcacaattgctttcaaatttaattaattagggaagaatttagtgattcataaatcattcaaaccattaaatttaattagtgtattttaattggggaatatgtctaaaccaaattaccacatcaaaacatcaattcatttttatgacggaaatgacgcaacaaattcttaagtaattatatttttattaagatattttaaattttagaaaagaataataattacaaagaaaaataaattaaaattttaacagcaactttttttttacattattcgtttttgaattcatctttttagtcgaagaattaagttaaattacaaaaaataataataatacatctttaaaactattttatggtttagtttttaatttagcatttaacataaacattcatttaaacaaatcatgtgcttatgactaactcggattggcataacacttgaattggcatttctttcttatttatgaaagaatgaaaaaattgtgcatatgacaccaaagaaattataaatgtcaaaaaatatggccatataaattgcgattaatgcttttgggttttcaaaataaattttcaaaaataattttccgcttttaataatttcaaataattttccgcttttaataatttcaaataattttccgcttttaataatttcaaataattttccgctttttccaaatg

SEQ ID NO: 106379 - DNA, 660 bp, Heterodera glycines
  misc_feature (68)..(69): n is a, c, g, or t
  Promoter: Source sequence=SeqID_22984; Location=1..660; Strand=+; Gene=SeqID_53686
ggaaaactgctggctggcacgggaccatgttttttactgcttctttcacaaattctcactttcctcanngttgattttctgagttgaaatttcgatggatgtaccgtcccatccacttttgttttttcggttgattgcttctaataatctattggattaaaatattttccatcttttttctttggcggaatttcgaatcattttggcttaggccgaattttgacgggcaaagaacgcattttattatcatattgaaaaaaagaaaaccttcgaatgcgtgcgacacgcgacttttcaattcacctgccttttttaattgccttttcttttttgtactttaaaaactgaacacctgggcccggtcaataagaaggtggttaaatgaccgggtcaaatgaccatggttacttgacctggtcgaatgaccacgaagttggtgctaaaccgcatcaataagaaaatgaccacgaagtgccgttttgactaccaacactatcttcttattgacccgggtcatttaactacatgcaattttggggcagattcacataaaaattttgttttttttcttctatttatgtgataatgagggatacgtggtcctattagagggataaaattaatttataattagtttattttaaagaattttaaaaaatg

SEQ ID NO: 106380 - DNA, 69 bp, Heterodera glycines
  Promoter: Source sequence=SeqID_4972; Location=61..129; Strand=+; Gene=SeqID_56407
ggtaaattcattgacacttatattcctattgttataatttagctctttgaaaaagtgagcgaaaaaatg

SEQ ID NO: 106381 - DNA, 81 bp, Heterodera glycines
  Promoter: Source sequence=SeqID_18676; Location=1..81; Strand=+; Gene= SeqID_83340
tccgtccccagtgccgccggcgaccgcgactttccgcctctcgacgtccgacggcgtcgtgcccgatcactcacggaaatg

SEQ ID NO: 106382 - DNA, 264 bp, Heterodera glycines
  Promoter: Source sequence=SeqID_27056; Location=761..1024; Strand=-; Gene=SeqID_57782
attatcaatgttatttataactagctctccatcagacattgacattttgaaaaaagccaggaccttgatatgtgtattttctggacaaaatctaggaaactctaaaggttggcaatacacaacatttttcaaatttacgcctctgaggcgaacgcaataatttattagcaaatattcgcgttgctatcagaaacttgcaaaaaattcgaacagcgaattaaggttttttaaaatgtgaaaatcgactaacagagaagaaaaatg

SEQ ID NO: 106383 - DNA, 226 bp, Heterodera glycines
  Promoter: Source sequence=SeqID_5900; Location=1..226; Strand=+; Gene= SeqID_59614
caattggggaggaggccgccaggagcaatttagccaaagaaactggtcaagcaaccctcgatgccattattgtgcccgtgctggacattttgcgtacaatttccatcaacgccgtggcaatttcagaggaaattccaaccaatcgttccgtcaaggaaaatggtcaaatcagcaacctcgccaatctcagggacaatggcaaaatcggcagaatcctgttaacatg

SEQ ID NO: 106384 - DNA, 63 bp, Heterodera glycines
  Promoter: Source sequence=SeqID_18604; Location=2439..2501; Strand=-; Gene=SeqID_83255
tttaaaggtgatgaggcgctccattccgtttggcgccgacttgagcaactgtggaagtgtatg

SEQ ID NO: 106385 - DNA, 64 bp, Heterodera glycines
  Promoter: Source sequence=SeqID_8991; Location=480..543; Strand=-; Gene=SeqID_69935
ttccgttgctttgcctcggattccctcgcgcaatgtcttccgcgcccctccctcctccaacatg

SEQ ID NO: 106386 - DNA, 1003 bp, Heterodera glycines
  Promoter: Source sequence=SeqID_24021; Location=1267..2269; Strand=-; Gene=SeqID_54725
aaatttaaaaaaatcctaagcttctttaaaattgtgttaccatttcacacttatttatttggtttaaaaacctcaaaatacagctatagcatgcactgggaatcgaacctgagaccccccttttggtgactaactcacagaccactaagacgaaaaatccaacttaattgtacttggagcccaaaattgactcgccgtgtaaaatgagtaaattttaagctgtatcgtctttttcaactaaaatgagttttaatatagtatttagccatttttgaaagttttactttatatttagcgaatttgaagaaagtttgaaaaattataccctcaatttgcacaaatttatgtccatattttcggcattttatgtccatatttcgcaatttgttttggcccatatttatgagcatatttcgcgattttatatccatattttttgcagccctagtcattaggattaattaaaaaatagctttaattaattcgcacacaagatcaaatatattgcaaattgaccattttggtaagatctgttaataatcacaacaaaatttcaaattttcttcggcggcgcccatcggcaccgccgtcgtcctccttccaccaaaatttttagatttttttgaatattatttatttattttttaaattcccgattggtcccggtcccctgttgagaatccaagtcccgccacggctttcctgtcccggcagtcccggtccgggtatttctaaaattctcggtccaatgcaactccaaaattaaggcacgcctttaacagattttcatccattttttaacatttttaattggcgaaatgttttttttaattaaaaaaaaatctgaattgttttgaaatttagcccaaaattcgggtcggaattcccgcgccatctctgatcagttgttttttaaaattcttctaattttgtctagcatttttttatttaaattttttaaagtagattattattattattatattttttggcttatgaaatg

SEQ ID NO: 106387 - DNA, 459 bp, Heterodera glycines
  Promoter: Source sequence=SeqID_34613; Location=1..459; Strand=+; Gene=SeqID_64358
ggtcgtaaagaatggccgccgcttcggctgctgctctctccctaacccaaatttgtttagtgcccgaaataacactcgcgagccttacaatcaaatatcttaaataaatatcttttaaagaacatttatatctttacgacttcgttttttttgccattttgttgctcagagacacaaagaaaaaatatttaaaggcaaatttctgaaaatttgaaatatttttttatttagccagtaaataagcgtaaagaaggcgctggtcgtcatttgttactcaaaaattcataattggacaacggactcaaaaaaaatgagatatgtgagaaaaatacactttctcattttggcgtattgtattgtatcttttaacagagaaaaacaacatttactccgttctatgtatagccttttttccgccttactaattatcttttttttttccttttagaaatataaatg

SEQ ID NO: 106388 - DNA, 564 bp, Heterodera glycines
  Promoter: Source sequence=SeqID_36761; Location=247..810; Strand=+; Gene=SeqID_66001
ttttaaagaatttgaataaagaatgatttcgatttcttgctgggaatcatttggtggtgcgcaagtgggcgtggcctaagtgtgcatatcgtacacccggtcattttctagattcattttaaaaattttcatcttttttttgcacatctggtgtttctctctcctcccctcacttgtcttgtgctttatggggaccgtatcatttaattgtgattttggggacggtataattaaattaatatttttgctgttaaccagggcggttgctttaattacaaaaagctccgtttatcctggcagcaatttgccttttagggcttgaggtctttcgcttgacttgactaatttcccgagtcgtttaggtgccctgtcgtcttgtgcttcatgggtggcggtgtgctgctcttcaggccatagtttgtttatgtttttttttttgactattttccatgcccaaatatttattattcattcaccatttcacgccatttccatgccggcgatcgcatataaataccgagattttactcattcctcctcactccactctcagattaaaaaatg

SEQ ID NO: 106389 - DNA, 203 bp, Heterodera glycines
  Promoter: Source sequence=SeqID_31930; Location=588..790; Strand=-; Gene=SeqID_62246
ttgcgaaccgaattgtttaaaggtggacaaattaatttttgttaaatttctaaaaagctagttggctagcaaaagattaaaatgagttcgccaatattggatataattcacgggctagtcaatcggttagaggttgaattaaaagagatattccgataaatcccggtcaaaatgcaaccccaaatacagtacaaagacatatg

SEQ ID NO: 106390 - DNA, 461 bp, Heterodera glycines
  Promoter: Source sequence=SeqID_42459; Location=1039..1499; Strand=-; Gene=SeqID_70347
tctaaacagctcgaaaattaataatgataaactgatccacttcaagttctaaaagacaactaatgccaggataaacgatgctttataaataagcaatcgccctggttaacagcaaaaaaaaaaaaaaaataaatttattttattatacggtcccttattctgtttttattaattatatggtccctgtatttatcagctaaagaataattaaataaatagatgagaaagagggagggaaggaagaaaagatgactcgggagcaagtgtaaaaaaaataaaatgatttctcgaatagacaaggtgtgtaaaatgagtgagtttcgagaacggattgtcttgaaagataaaccacgcccattttcatggtagaggtccctccgagcttacacttttgtaccagtctcgacgtttttcggcaatcagcaaaaatcaagaatcatttataatattttgtcaaaatg

SEQ ID NO: 106391 - DNA, 489 bp, Heterodera glycines
  Promoter: Source sequence=SeqID_10149; Location=2508..2996; Strand=+; Gene=SeqID_73251
aagtccaccagtatttctacataaagcaccggatccgcctactgtacccttagctgaagtgcattattgagtaccacaacaagggccactgcaaatactatcccttgccgccggcccaagcttggaagacggcgtaaaagaacaaaaggaaatgactcagatggcataaacacttgtccatttttctattgttgatattctgatggactacccaagaataaatgaaagtgaactcgcttttcccatcccttcggggattattgtcagcggtccgtcctcatcgggcaagacccagctggtccttcgcctgttacggcatgccaacgtgatgtttgacccgccgcccaaggcaataggtatgtgcaaaggggtttctgtgcagtgggctgttgctatttagtatgggcatacggtgagtactcgacgcagattcccgatctggagcggcagggagttgtcccccacgcaggtgccccgtctgacgagatg

SEQ ID NO: 106392 - DNA, 902 bp, Heterodera glycines
  misc_feature (94)..(94): n is a, c, g, or t
  misc_feature (174)..(174): n is a, c, g, or t
  misc_feature (274)..(274): n is a, c, g, or t
  misc_feature (302)..(302): n is a, c, g, or t
  misc_feature (333)..(333): n is a, c, g, or t
  Promoter: Source sequence=SeqID_12736; Location=1..902; Strand=+; Gene=SeqID_76436
ttttcatttcatttttagaggggaaataaattaagacttaaggtcacctcccttccacggggaaacgttttatttgatttattattacaaacancgaaaatctatgaataatgttatagttgaccccccatttgttaatagtgaccataatgcattcaattcagcataaattancaggttaatagaaatgcttcaaaaaaattttataattcaaaaaagcaaattatttgaaaataaatgccatactctcaatggttgattggaatttattttnttctgattgccctgatatcgagcttatntacctaaaatttatgtttttcctaaataatntgataaggaattatgtacccatacaaacaacaaataaagttgaaaaactgcccgaacatgttttgaaattaatcatttatcgtaaacagctttggaaggaccttcataaagaccatataaaaatcaaatttttagaagtttcaaaaaaaatcgatgtagaaataaataaattttataaaaatcgtgaaaataagtttttgcggaccttagactctaaaaaacattttcaatttataaattctttccttaaaattaaaaatactatgatacctgcatttactgataaaaatggtctgatcctcttctcagataaggaaaagtcgaatgcattagcgcaacaatttttttccgtttttacagatcaaaatttagaacaatttcaatgcctagaaaatactgaaaaaaacatcgaatattttaacataaccccatatgaaatttatttctctctttccaaactttcaaatgctaacaacacttgtattgatggaattcccaacatttttttgaaaaattgtaaagaaaatttagtccgaccacttttccatatttttagtttctcattgatg

SEQ ID NO: 106393 - DNA, 631 bp, Heterodera glycines
  misc_feature (601)..(601): n is a, c, g, or t
  Promoter: Source sequence=SeqID_579; Location=2332..2962; Strand=-; Gene=SeqID_56555
tttgaagctcggagagtaaagtagatgccgacacgagaccgagtgccgcgcgggattttgcgggatcccagtccgcaatcccgcattttttggaaaatgcgggattttcggtattaatcccgcgggatcccgtcccgcaaagaattttgagttccaatcccgcagcgggatccgcaaatttgattttttgtgcggaattatgcgggattttattgatttttttgaaaatttttctaagatagaatgccaaataattttaaataaattaaataataaatttaattaaagttacctaactcatttttcggcgcccccacaaattgtccaagccacgaattgtccaagccacgaattgtccaagccacgaattgtccaagccacgttttgtccaagccacgaattgtccaaaagagtaaaaacccacgaattgtccaaaagtctaaaaaactcataaaaaggcggagaatgggtctattttaaggttttcggggtcgctgaataccaatacgacatttatatagccccttgcctaaccctagacccacccgaataagaaaaatctaaaaactcggttaaaatatatgctgttgtttgtcttcangattttgttattcaatgatcgaacaaaatg

SEQ ID NO: 106394 - DNA, 104 bp, Heterodera glycines
  Promoter: Source sequence=SeqID_5377; Location=444..547; Strand=+; Gene=SeqID_57818
tgggaaatctttgcacttgaaccttttgaactcaacaaactttttgtccttatttccaaggacagtccttattttctaaaagtacaactcgtttgtaaaagatg

SEQ ID NO: 106395 - DNA, 57 bp, Heterodera glycines
  Promoter: Source sequence=SeqID_15370; Location=2059..2115; Strand=-; Gene=SeqID_79628
atttcataattgccaatttgtcagggcgtttgttgcatcgacgaattcgacaaaatg

SEQ ID NO: 106396 - DNA, 1003 bp, Heterodera glycines
  Promoter: Source sequence=SeqID_1969; Location=293..1295; Strand=+; Gene=SeqID_77096
ttataatatttgtctttaatataattgtttttttaaaatttatcaaatcatatttaaaatgcgttttttgtgttatttgtagtaattttctattaccttgatctccagtgaaaaaattgcatttattatatatattcattactttttgtgaaattaaattattccatttatttttatttttaagttatatttaatcaaattctattaaatgtttatttgtattttatggggtttcttattttattttatgaattattaatttggattgcatttattcaattaaattaaaatgctttattccttctttcttaataatgagattttttaatatcttttcatgcatctctttttttatttgttaaaactatatttttattttttataattataatttatattttcaattgtttgttgtattattgtttatgttttatttttttaataattcaatgaggatacttaatatcagtatctggtattttattatctacataaaatttctttctttgttttctcttttttcaataagctggctccattagtattccgataaaattattttgtcagtactcttctataaatataattattcaaatttaaacgaatattatctcaatagaattattaagcttatccggctcgaacttttattagaaaatatattatttttttaattttaatgaaatacatgtattattaggaattcttttatatttttcggtgctaattcgtttcagaaaatccgccaacatgggagtttataaaattcaacattttagcgaatttttcgacagaacagaaccgagcatggcataactttgcttaaaggcaatcaaatcttggtactatttgatagcccagctttttctctaatatatcgcaaaattttaaaaaaattatcaaatttaacataagttgtgccagaaacattacttgtcttcatacaactttttctaaagttgaccaaattttttacctttccaggctaattgagaaaaatatg

SEQ ID NO: 106397 - DNA, 88 bp, Heterodera glycines
  Promoter: Source sequence=SeqID_18824; Location=1948..2035; Strand=+; Gene=SeqID_83515
attgataaatagataaaaaataaatatataaaagcgaaacagctaagagcactcgtttaattaaacatttagaagagcgcaaaaaatg

SEQ ID NO: 106398 - DNA, 127 bp, Heterodera glycines
  Promoter: Source sequence=SeqID_27776; Location=464..590; Strand=-; Gene=SeqID_58440
tcttgtcgcagtgcggattctttgccaaaatgttgcaggtttcacaccatttcctttcttattatgccaattccattggcgcaaacattgcaaaaaagagtgggagggtgatcgtttaacgaaaatg

SEQ ID NO: 106399 - DNA, 63 bp, Heterodera glycines
  Promoter: Source sequence=SeqID_6982; Location=2774..2836; Strand=-; Gene=SeqID_63478
gctgaaaaaacaacatttacactaagcaagcattaaatgttttctggacccgatctcgaaatg

SEQ ID NO: 106400 - DNA, 322 bp, Heterodera glycines
  Promoter: Source sequence=SeqID_3265; Location=661..982; Strand=+; Gene=SeqID_83963
ggtgactccaaatttacattaaattattattaattaaatatttttaaaaaaattggagaaatatgtaattaacaaatattgtccatttatatgcgtaaaattaaaatgaatcaaaaattcttatatggaatcataagaagaaaaaatgtgagatgtttttcaataacgaaaagttgtattgtttttcattttgaatataaaaccctaaattatacttattattttttcttattaattttcaaaactctgaaaatatggacgaaaaaattccgacttttttgttttcagttgtgccaaaattggattctccaccaaagcaatg

SEQ ID NO: 106401 - DNA, 156 bp, Heterodera glycines
  Promoter: Source sequence=SeqID_9704; Location=1374..1529; Strand=-; Gene=SeqID_72423
ttttttgtttgtttatacagcattttcgggacaaaatttcattgagtatcgttttgcgaaaagattttaatgattccaatgtttggattaggtaatttactcagattaataattaaattttaataattttatttagttggcatttatccaataatg

SEQ ID NO: 106402 - DNA, 420 bp, Heterodera glycines
  Promoter: Source sequence=SeqID_36865; Location=1..420; Strand=+; Gene=SeqID_66080
taagtcaaaaatcatctcttcaattttaatgttttttgccatttaaaatttagtctttttaaaataatttatgtcagaaatccgtggtttttttgtttgcatccttttgtataatgtttatgaattttgcagaagcaatggaaaaaatatacataagcagctccaatgttacaaatatattgtgtattgttacctctcaatttttaatataattttatttatttaagcattttaataaaataaaattattttttataaatttaaatttaaaaactgaaagcttgaatttattttagagtttctcatagccaacaaaccgttgccggtgatcaaaccaaggggatgactaagctaattcggaaaaaattttattaagaaaattcaaggaaataaattcacaatttttcagtaacacaaatg

SEQ ID NO: 106403 - DNA, 401 bp, Heterodera glycines
  Promoter: Source sequence=SeqID_43426; Location=418..818; Strand=-; Gene=SeqID_71098
ttagtccagtcataaaaaggcaataatgaattaattagatgatgccactttttcgtccccacgcgtcgttcgccgttctttcgtttcgttgcgtcccccgcgcgtacgcgcagcaccacgcggcgcacgcgcactttgcgcgttcaatgggtgtccgttgccggtcattaatttagcatttgcttaacactaatcacctcattttgcttcatttgtctcttcgttttagaaggaaacagttggcactgctcgaactttctgtcttttccgcttccactgcttcgtgcgttcaatttccttttgaatgtgccgaagtgttggcctcccttcgttttggcattcctccgtttactaccgtaaaaaatagaaacaacaccggtaatacggtagagaaatttatg

SEQ ID NO: 106404 - DNA, 815 bp, Heterodera glycines
  Promoter: Source sequence=SeqID_3858; Location=2458..3272; Strand=+; Gene=SeqID_52180
ggtggcccaactgattttggacattcttctgaaagcgttcaaatgggcggggggagagagtggggaagagagaagagaccagcagacggacagagatgagcgaaatgatcagtggaagagagcgaagtgatcagtggaagagagcgaagtgatcagtggaagagagcgaagtgatcagtggaagagagcgaagtgatcagtggaagagagcgaagtgatcagtggaagagagcgaagtgatcagtggaagagagcgaagtgatcagtggaagagagcgaagtgatcagagtaattagtggaatactgatcgaagggcgattagccatggaaatctgtcatgattaaattgttaaaaaattcatttatgaaaaaagaaattgggcatttctgtaaaatttcttttaaatatttttataaaataatatccaaaaataaataaaacaaaacgatggaatcgatgaatgaataggacctgggcagacaaaatgaatgaatgaatgcattgtgtgctgattgaacgcggcagcccattgtgtgccggcttatccaaaattaattgacagcaattaacgacagataatagcaaaacaattattattacccatcgaaatgcattcacttttcatcattttttgttttttcttcttccgttgcgtttttgcaacaaatggtaattggaaaatttccattcaattgaattttgtggcataattgaattgttacattaagaaacaaaatttgggagcgatgccgacgaaggcacttttggcaatggcacaatggcaaaggcacagcaaagtccgcgcatcaaatg

SEQ ID NO: 106405 - DNA, 154 bp, Heterodera glycines
  Promoter: Source sequence=SeqID_15074; Location=539..692; Strand=+; Gene=SeqID_79244
aggggacaaaatgttgaaaataaatgggagaaaagagcatggaattgaacaccgaacaataaatttgacattttgcttccctgttgtttgtcttatttttaattctgacagatggctgaacggcaaagacggcgatgtttgggtttgggtgatg

SEQ ID NO: 106406 - DNA, 140 bp, Heterodera glycines
  Promoter: Source sequence=SeqID_12921; Location=629..768; Strand=-; Gene=SeqID_76670
acggcataatgatgccgattatgccatcagcttaaatgtgaagacaattatgatttatgccgacaatttgttttacaatttgatgcaatgaaagcggcattttgaaaacccacaaaaatcctgagcttaaaaaattgatg

SEQ ID NO: 106407 - DNA, 754 bp, Heterodera glycines
  Promoter: Source sequence=SeqID_12489; Location=567..1320; Strand=+; Gene=SeqID_76125
tttacctgtctccgccccttggccaatttgccatcgttcgctggcgtcgaaatggacaatgcccagcggtgggtaggccgaatgggccaccagtccgccagtgccatcgaaactttcgctgtcgccgtgcccaaattcggcaaagaaaatatcaatgtcggcaactcggcgcgagtttagcggcaaatcgcgcgaagccggcgacgcatcgatcagacggagggacggcgactgcgcggagaaagcggcggcaacttcccattttctgatcgcttctccgatcactattcttgatgagttagaaattacacagcagcagaaacaagaaaaatacacaaatgcattggctttttatgaccggaatttcctcctctttaacactaatgagtcaaaacccttttttagcgggggcccaaggggttgtgccacatttgcgccccaatgaaaaagaaaaaaaaattttctgctttggccattgtttaaatgcctcacttaaatgataggaaattaattctgtttccagactcaaccacgtgaaggtagcagacattgagtccacacaaatacatcacaaattctaatgaaaaatctatttatataaaataatttaaatactcaaaaatatttgctataatacatttagttggacaaacacaatactttattttttgtgttttcattttatttttttatattttctttgtttttgtattattttcttgttttttattatttcttgtttttttaaaagatg

SEQ ID NO: 106408 - DNA, 315 bp, Heterodera glycines
  Promoter: Source sequence=SeqID_24169; Location=378..692; Strand=-; Gene=SeqID_54881
cctgcaaatcctgcattttaaatttgcaggatcccacgcaggattgcggattcttagaaattttgaaaaaatttcaatgaatttcaaaagtctgccgaattcattccgagtcgcaccgttaagtgtaatggatattactaaacgacctaatctctttgatttttgcttataatcgcaatatttataccaaaatttcaaagatggttgggcagaaaaaaaaatcggaaattaaaatatttttgttgtggtttatttgcgccgatgtaaaaagataaaaaataattataaaattaaatttattcaaggcaaaacatg

SEQ ID NO: 106409 - DNA, 150 bp, Heterodera glycines
  misc_feature (22)..(22): n is a, c, g, or t
  Promoter: Source sequence=SeqID_28195; Location=1470..1619; Strand=-; Gene=SeqID_58840
tcaataattacaatgattttgnaaaaattccccatttgtcggctaacaataaaccaaaatttaaataaatccacgattgggttttggtttggttcattttcctgattaagctatgcttccgatagcattgagttgcaaatgcgaaggatg

SEQ ID NO: 106410 - DNA, 1003 bp, Heterodera glycines
  Promoter: Source sequence=SeqID_2572; Location=408..1410; Strand=-; Gene=SeqID_80462
ttcatgagaaatttcataaaacaattatgggtactgaagattgaaactccatttttggaaaaagttttaaagaaacaattttcatttgcttctcattcaatacaaaaagtaacttacctaacaaccaccaaagaaaacaacttgtttttcgtgcgttttaggtcactgggaaatcaggaaaaatgagctaaaacctaaaagccggagcaaatgaaaaaatgtatgagtgatcagtaagacatccaaaaatatggaaatccattttttcctgtaccatatttccatatttgtccatattttggttttaagtccatgttttatgtccatattttggcatgtctccaaaaaaccctattagaacggcccccatcagttaaattggccgttttgacaccaacgaccggaaaattttccaaaaaatggaaaattttgtttttggtcggttttctcaaaaaattgcttttttttcttcttctaaaacgagttattatactatattcagccattttaaatgtattttatttgaatttaatgaattttgaaaaattgaaaatttgcccctcatttcgggaaatttatgtccatgtttttgctattttatgtccatattttgtgatttttggtccatattttatggccgtatttcgcgattttatatccatatttttggatgccctagtgatcagacaattattaagacaaaaatactggaataattttttgtgttaaacctgtaaaaggaaatgttaaattgatggtttaaaaatgggaaatttatctttgatgcgtcatgaatagatcaatcccaaaaacattcatttcgcctactaacacaaaatcggacgtttcattttgttgagttaataaataaaaaattatatttaaattaatttttttttgatgaataaattttataagtttaaattaattttttttaattgatagaatttcatgtatttttttaattaaatttgttaaaaaatattttcattttaatttaatg

SEQ ID NO: 106411 - DNA, 118 bp, Heterodera glycines
  Promoter: Source sequence=SeqID_33893; Location=452..569; Strand=-; Gene=SeqID_63820
tcttcgccccgaagaatcgctctttttctttatcaacagcgttatcccccaggttttggttgctttaatgttttccatttatgaggtttaccctcagatgatttcctttcagacaatg

SEQ ID NO: 106412 - DNA, 334 bp, Heterodera glycines
  misc_feature (159)..(159): n is a, c, g, or t
  Promoter: Source sequence=SeqID_13604; Location=2473..2806; Strand=-; Gene=SeqID_77509
taaaaaactggaaaccgagaaccaaaaaaacccggagacttttctggagttgagacttgagaccaaggttttcgagcatccctactcctttccctgaaatattcgtttgaacgccccaaagtcacttgggtaacctatccttttgttaggaacaccctnttcggtgactttgaaaattaaaatttttcagaacccatcggcagaattacccaaaactgattaaatgcatgaaaacaaattaataaaatatttttaatttttatccttttttaatcaccgaatatttttagccagaaaatacaacattttgggggggctgatccgtcgatgtatg

SEQ ID NO: 106413 - DNA, 88 bp, Heterodera glycines
  Promoter: Source sequence=SeqID_11392; Location=248..335; Strand=-; Gene=SeqID_74783
atagttagtccttttgttgaatttttagaaattttatccgtcaaatcggcttttggaattttaatgagtaaatcagtaaccgtaaatg

SEQ ID NO: 106414 - DNA, 561 bp, Heterodera glycines
  Promoter: Source sequence=SeqID_9279; Location=1..561; Strand=+; Gene= SeqID_70844
cccccgggtggaaagaagaaccgtaaaaaacagcctttttattctttttttatgggaccagtaaaagtcagtattaccctttcatccgatgctcccacgggatttcccccgattccctccggctttactaaagcaaagacaaacagaaaaataaatgataaataacaaatatataaatgacggaggaaagacaattaataaaaatgaaatgaaggagagaacggcaagtgacccgaatgagtgaaagggtcaacattaaataaacactatgggtcaactccactgtgcagagaaaagcctagtactatctcgtcgttttcttttttttgtaatttctctcactttggcgtactatctctccggttttaatcatgtaaaaaacaacattcacttcgctacgtttaactttttttctatacgttaaatctataccaaattttgcatatcgatagagaaagaaattaggaacaaaatgtaagggtttttaagagcaaaaaaagggttaactaaaaagttataacggtttctcttgtaaaattcttattttttaaattttagatg

SEQ ID NO: 106415 - DNA, 373 bp, Heterodera glycines
  Promoter: Source sequence=SeqID_27371; Location=648..1020; Strand=-; Gene=SeqID_58062
taaatggacttccatggagaatatatgccaaaataaatacaaagatgggaagcactgacaatgagaaatgcttgggcttttaccttttgtgcgatgcttcagaagaaggtgctaattaactgctcattagtgctaatgaacagcgacaattaatggcattaagactcaatttggcgctgctgtgttcgttcggccacttttcgaattgtctcgcaaaagaaagcggcggataattccactgggactttttgtgaccatatttttaacaataaaaacagctggtggggtttccctaattttattacttttgccgtgagttggccatttaattttattccttattaatcgattatgggcaattaaggaattgatg

SEQ ID NO: 106416 - DNA, 129 bp, Heterodera glycines
  Promoter: Source sequence=SeqID_33069; Location=1..129; Strand=+; Gene=SeqID_63245
ttgaatttgaagtgttaaaaaatgacaggagaaaacggacaacagtgaccacgcctgatgcgcaatggcttaaaaaaagttgaaaaaagtaaaaaaaggggtaaagcgggacaggaaaataagaacatg

SEQ ID NO: 106417 - DNA, 1003 bp, Heterodera glycines
  Promoter: Source sequence=SeqID_15977; Location=775..1777; Strand=-; Gene=SeqID_80334
tctctctcttctctttctctctctacacaacctctctctctctccctctctttctttctcaatctccctctctttttttcctttcctcttttctattctctcgtcacatctctctctctctctccttttctctagctctcctcacctcactctctctctttttgtcctttcctcttttctattctctcctcacattactctctctcctttctttctccttttctctcgctctcctcaccttgctctctcatccatccttttctctcttccctcctcacctcactctctcacttcctccttttctttcttctctattcacctaaccctctctctctctcttttcctccttttctctctccctctcactctcttctacaaaactaaaacggaaaaagatgaatattttgaaacatccatttgcaaaatttcaagaaattctcaactgtagaaaaattttttcaactgggcaaagttttttctttttctctcattttgacgcactatttccatgtctctaacatatgagataacacatggttcattttcttgctaataaactattttttcaaatttttatttaactttgaaatattcttaagaattttcccatcaaaatgagcacaaaatggttttgtttggtttacccttcaccaagttataagtattagaaatttagttaaaatcaatgataaaacatatagtgtctaattccgctgtctgtttttcattggcgttttgttcacttttattttcaataatttttaatgtagtgtctgacttatatatcgtttcaatactcattttttttatatgtaatgatacgcatttttattcaaaatgatgatatatgagtaagggatatagtaagggataagggatgtccagccaccgtttttttttagttctcgaagctctcgctcagttctcattttcctggataattcgcgcggcatcaatcgcattttcaatgccgaactataattagcattttttagagaacatg

SEQ ID NO: 106418 - DNA, 771 bp, Heterodera glycines
  Promoter: Source sequence=SeqID_24347; Location=1..771; Strand=+; Gene=SeqID_55066
tcatcatcttttatacttaaaatgccaatttcaaatgaaaaacagagaaaggaaaccaaaggcatgccaaatgttcaactctttgtttctcaattattaacctaaaacgctttaatactctttttttgggctcatccttgtgctaagtttggttactttttctgccttttgtctcccaatttctctctttttctctttcattcgcttttttgcgcccaaatatttgcggggggggggaaatgaaaggcgcagccgacgaaactttgtgttggccaacagcagcagcaaatcgtaccgatttttgtgctccttttatcccatcctttcccaaaccgagtaaaagtgaaagttggccgaggaagggataaaatgaataaaaagcggagaattagaaaagaaagattcataggggggaaagggggaaaaaggggggagggaagggtgatcgatcggtgatcatccaattgagttggagggcgctgaaatttgaatttggtggaacgtttacagccaaaggaatgcttcgtgccttttcccttttccattcattgccatttttcattcggttcattaaggaaaaacaaatttcattcttcccacaatttgtcatcactttgagcagaaaagacggggatttttaatgacttaagcatttcattaattagacaaatacaataaaatgtattttggaaaacgaaaaaaagacctacatacattaaaaaaatatatatatatatataataaataatcatttttaggacctttccgatg

SEQ ID NO: 106419 - DNA, 58 bp, Heterodera glycines
  Promoter: Source sequence=SeqID_16948; Location=364..421; Strand=+; Gene=SeqID_81377
agtccttttttatttggtttttttgaaaattaaaaataaatttaaggcccagcccatg

SEQ ID NO: 106420 - DNA, 420 bp, Heterodera glycines
  Promoter: Source sequence=SeqID_8928; Location=3567..3986; Strand=+; Gene=SeqID_46669
ttgccaccatcaaatgaagtttgaattctaagtggacattttgttttgacaaaaagtttatgtttaaaaatcatgaaaatattatctggagtcgagagtattcagatcatgaatctgaccaatttttaccaatccctaacccgaactcgaacacaaaaatcgaaaatcctattttttcaattgattctgaattgaatgaaaagatgttaaaataaattaaaaatttaaattttttctttcgccaatgcgcttacaaaaaaatttggctcgacactaattgactatggccatggccatgaatgacatcaaccacactaaattttaagcttttcgcctactaccatttttaagttcaataattattaattaatatgttaggagaagaaaaattaataaaaatttcgctagacaaataatatg

SEQ ID NO: 106421 - DNA, 626 bp, Heterodera glycines
  Promoter: Source sequence=SeqID_13167; Location=1..626; Strand=+; Gene=SeqID_76989
catgcaagttttgaaaagtttgaataaacaatattgcctcctatgtatggcagaggattattattataaaaataagtgcttataattaaaaaattgctattttcatcgtttacacaaaaaaaaaggctgctgggcagaaatagaaaagaggagcggctcttaagatgtaaaatgaatgacattgtatcagagatttgtaaaatttattaatattatgagaatattgtctagaccaaaagtgccgattaattcgtatattaatcaaaaaaatttgcttgcagaaaatattttaaaagtttgaaacaaaaatagttaataaaaagaatatatttttaaatgcaaaaagtaataataattaatttttatacacaaatataaagtttttttttaatttcttttcaaaatttgttgccaaataaatttattcaaattcttatatggcagtggaataataaaatgtcagctttcactcacggcaacatttgctattttgctcatcgtatttgctattcaacattgtcgctcgcagtcttccttttggcaaaaatttagaatgtatttgtgatcaaagcatttttttgtaaaataatatgaaattttaattatagattataaaatttaaaatg

SEQ ID NO: 106422 - DNA, 1003 bp, Heterodera glycines
  misc_feature (497)..(497): n is a, c, g, or t
  Promoter: Source sequence=SeqID_21987; Location=134..1136; Strand=+; Gene=SeqID_52628
aaatttttgttgaaaatctgttatcaaatctcactcaaattttcaaaatttccccccgcggcggtgactatcggcaccgccggaccacctttttcccaaaagttttctggaaaaagtgcgcgaaaaaagtgatatgaaaagcaacgaccatttagcccaaatgattaattgcttgaaataattgaagaaattttgatttgaaaattttctttaatttaatttagttttaacttttggattttattaaataaaaaataatataatttaattttgtattattttcacttgaaataaattaaaatttgaaaaccgggaaccgggaaaaacaagcactggtaagaatgggggtctgagtggaaaattagtaatgaaaattagagtcaaaggaaaaaatattaaaaaaatgattaaaaatattctttaagcgtgtcgcaactaattgttcaaatgcactagtggctagtccccttgacttttgtcttcttctttcccctggnttcatccctctacggaaattaaaatattttgaattttctttttgtatactcatggttttcctatcgacaaaatatgatttctcatattttttttgtttatatatattttattattttttaaaatgaaaatacgtacaaattgagcctaataaatccaaaaaacctgcctttttgttgataatctgttaacaaattggactcaaattttcaaatttttccccggcggcacctatcggcaccgccggtctcccctttctccacaaaagttttttggaaaaagcgcgccaaaaaaatgatcagaaaagtaatataaatttataataatattcgatcatttagtccaaaatgattattttaaaaaataatttaaataaattattttgaaaattttcattaatttaattatgctttaacttttggattttattaaataaaaaacaaaataaaaatttaatttagtattattttcaattgaaataaattagagatcgacattttgaaaaatg

SEQ ID NO: 106423 - DNA, 243 bp, Heterodera glycines
  Promoter: Source sequence=SeqID_15665; Location=817..1059; Strand=-; Gene=SeqID_79966
attaaataattttgataatttaatttattatttaaaagaattttacacacaaacggattcactgagaatgaagtggaagagagaaagtgcatcattttttcaaatacaggtgcaaaatattatttcttcttaatgtatataattttgaattttactgtgttattttcattaaatttacactaaattaaactaatttttattttaataaaaaaatttgaatataaaaatttagtaagaagcatg

SEQ ID NO: 106424 - DNA, 285 bp, Heterodera glycines
  Promoter: Source sequence=SeqID_668; Location=2858..3142; Strand=+; Gene=SeqID_58583
cctgtttcgggtttgaggagtaaagcaatttgaaaaattaaatttgtttaaaaaggttttcagcataaataatgggcaaagtgcaaataaaaaaaaaatcggattccacctaagaaatttgaaaagatgccatctcaaaaggaactcagaaacagaaaatggcatttatctataaaagagtgcaaaaataatgccaagacattcaaaactgtggaaaatgccattaattagtggaaatgtcgcacccggggcggggggggggctggagaatggtgggtgagaatg

SEQ ID NO: 106425 - DNA, 370 bp, Heterodera glycines
  Promoter: Source sequence=SeqID_20648; Location=1..370; Strand=+; Gene=SeqID_45594
gtaaatagattaaaaatttcgacgtctccatactttcactactttcgttcgaaagcttttttttgggctctacaacatgtgtatgagttttttatgttgccgcactctaaaatggtaccagctagtgatcagtttaacgccaaaatagttgaaaatagttttttttcaatttttaggtgttaaaaaacgaaatcgtatccctagatatgatacacgccctattcattaataatttcataaagacatatatgtagaatcaaactcagaaaaatactgaagatataaaaacacccaaaggtttaagcggtttttatccttcttttgaattcttttattttaataaatttgatttatttgaaaaatagaaatg

SEQ ID NO: 106426 - DNA, 170 bp, Heterodera glycines
  Promoter: Source sequence=SeqID_41355; Location=1042..1211; Strand=+; Gene=SeqID_69502
ttttcactgctcctcccaatgcttatccaccatagagcatttatctgttgtcactgaccaaatttatccgatgccataagcttcccgtcatttccatgcataaaacaaataccaatttcgcattattttaggaacatttgcatttttatgctgctgtaattctgcaaatg

SEQ ID NO: 106427 - DNA, 553 bp, Heterodera glycines
  Promoter: Source sequence=SeqID_18137; Location=1..553; Strand=+; Gene=SeqID_47496
ataactttcatcttttcaattcattcatcaccttacacgcacaaatgagctgttttttgatgaaaaaaagtgttcatttggaaatggaggggagtaacttaactgatcggacacaaatgttttttaacacatcaaatgagcgttaaacggttccacaatgatatgattaatgtccaaaatatgctttttaatttcaaatgaacgagtaataaacccgaaacaaaaatcattacggcaacaattagcaagttttttgccattttgggttcatataaaagcgaataagcagttaccattaacagcagaagaacatccatttgctcagcaatttgaaactccctataatttttaaaatttatataaaataaatttaataattttgaaatgactctttatttccaattctttcatttctgattaaaatgcaaaaaaaaaaaaaaaaaaaatttccacagagaaaaactaatcccaaataagtcaatatttaagaaatcccaagattttaactagtaatatgtaattgaaaaatcacaaaattttaccgtaaaatatg

SEQ ID NO: 106428 - DNA, 1003 bp, Heterodera glycines
  Promoter: Source sequence=SeqID_10381; Location=352..1354; Strand=-; Gene=SeqID_73571
tatgcacgaaatgctaaaatatgcaaaaatatgcatataaatcgcgaaatatgcaaaatatgcatatgggaaatacgtcatagaagcttcaaagcaagctaaaaacatgtttttcgtccgtttcaggcctcagcctcccgcagtccaggaaaaaaaatgcatgtgcatataattcccaaccctaatgattacctatatgagttaagcaattagagcgaatgaaaacctgaaaaattcacataaacttttgcccaaattttcgtttttcaagtcgatttggggggctaaaatttactcactgcatataaccatgaaggagtgatctgatgaaagtctatagttttggaacagcaaattttggaccaaaaatataaaaaacatttagttttattgttaatttaattctgaggtatgcctgataaaaattcaagctgggttagcctaagggtagtaagtgaaacacaatatgtttctggattttgaacagtttacaaagagagtgattttttttatcaaattgaacctttaataatatgtaggtaaatattttggacttttttcttatatatttttatttttttacatattttgaggattttacacggaaatttttggaaaaaatccaaaattttggcaaatatttttgtacatttttttcattttttttacttattttgaaaatttatagtgaaaaaataattttgaaaatgtacccctgaaaaaacaaaaggaaatttttaaaatattacaaggtgattctaagcctattaaagtcatttttatggaattttgtgcctattttatcatttacgaggattttttttttcaaaaaataaccttttcaaaaattttatcatagttggacttttctttaaatatttcgggatttttcttacatatttatgtcgaatatttagacaactttttgtgcatatttttggcagccctaataagtgagcgaacaaacaattaatcggtggtgtgccgtcttcctgcttcaatg

SEQ ID NO: 106429 - DNA, 974 bp, Heterodera glycines
  Promoter: Source sequence=SeqID_7887; Location=2772..3745; Strand=-; Gene=SeqID_66286
ttttgagacaatttattttttggaaacatcattttatttatttttatttctcaaaaatatatttttttttaaaaattatataattgaaataaacaaaatcattttaatcgttaaattatccattcatttattcgtatttaaaaaaagaattcaatttccaaaaagccaaaaatgcatttttcaaaaaataaattcaattaattaaatgcacaattttcattcccatagatttttcttttaaaaattataaaaattgtttccaacaagaaataatgaaaggttctcgaaaattgccgatttttctctatttattgtttttgttttgggaccggaaaattgcccctctccccctcttgcctgcgggcagcaattccagttttaattagaccaaaaaccatttacttaattgactataaaaatctttaaaaataacccgttgccaaatttggtcattctgctgctgctacctgctgcgttgcagatgatccaacaatttgagcaacatcatattacttctttttaatcacccttgcattgattaattattgttaattagttaaatttaaccactaaataaataaaacggactaaattggggcaaaagggaggacactcaaattttgatcattgcaaaacgcaaattaaatgtcaattagactcaattaaggcaattttagtcaatttcgccctaaaataatccatttggtgattcagcactttttgtctgtcgctgccgttcttcgcccatttttacaaaattaaatttgacatttgtgaatgaaaaccacaaaaattggcggacaaatgagacgattgggatttgttaaatcccattcgcctgggataatccagcagaatctaataatcctctaagttttaaataaaattattgaaaaattcacgcggaattattttataaaatataaaattttccaggttttcattccttatcaaagtgtgatacggtaataatg

SEQ ID NO: 106430 - DNA, 677 bp, Heterodera glycines
  Promoter: Source sequence=SeqID_4782; Location=407..1083; Strand=-; Gene=SeqID_55692
ttttgctcccccatttgttggcatttttttaaaaataaagtacctaatacatttttttcaaatacagccacccccgtccgtgtacaaataaataatcaaactatacctaatttagttatacttaaaatgtttccccgttttgtgtgccctttaattgtggtgtttttgctgatggctctgttcgacaacagttggaagtgcagtgccttttttgatcctgctaaaacaccagcgcctccgaccgggaagccgactgccaagtcgggtgccattggtggtgtgcgtgtgggccagcagttgttgcttttgcccatgccgttgttcatggcgctgtcgctggccggcaattgtaaaaaaccgtatcgtatttgctctattaaagcccccccccctcctcctcatataccccccgaacccagtttcgaacaaaactcgaaaaaagtagaaaattcatttgtcaacaaaagtacagccaaccggacttgaacaaaaattcgaaatctgaaaaatttgaatttactacttttggtttgaatctggttcggggttcgaattgggacaaattagataccagaaggttttcccgaccctaaaaaccccaagacaattcttaattaatttttttttgtgaatctccgcacagattacagtaaagcaccgatttttgtcaaaaaatg

SEQ ID NO: 106431 - DNA, 577 bp, Heterodera glycines
  misc_feature (42)..(42): n is a, c, g, or t
  misc_feature (54)..(54): n is a, c, g, or t
  misc_feature (66)..(66): n is a, c, g, or t
  misc_feature (158)..(158): n is a, c, g, or t
  misc_feature (179)..(179): n is a, c, g, or t
  Promoter: Source sequence=SeqID_13472; Location=1..577; Strand=+; Gene=SeqID_77363
gcagaaatgctccaaaattattggcaagaggcatcattcgtncgtctatgtctncatggcaagtcncattgtgatgtcccaaaacgtgatggaacgttacgtttttgtgtggactacggggctttaattcgatcacccgaaaagatagttcccgctcncaaatatcgacaatactcttntaatgcttggaggacgaaaatacttcagcactttagactttatgtccggatattggcagataagaatggatgaaaattccattgaaaaaactgccttttcgactgagtacggtctttacgaatttacagtaatgccatttggtctaaccaatgcagtggcaactttccagcgatttatgtcgcgtctctttgagggaatgattaatgactttctgttcgtttacattgacgatattttaatcgcatctaaatcctttgatgagcatctgaaacaccttgaagcggtcttttctcgagttaaagcagcagaattaaaactaaaatttgaaaagtgtcatttttgcacaaccgaattaccatttttgggccacatcctcacaagggaagggattaaaatg

SEQ ID NO: 106432 - DNA, 189 bp, Heterodera glycines
  Promoter: Source sequence=SeqID_4014; Location=1527..1715; Strand=-; Gene=SeqID_52813
ttttttacatatacactcatcaatctcaacacaaacacatgtgtaacttattgtttcgagttgattttgctcctgattatatataaatattggtgatatttattcgagagcggattcttttttcgtttttaatcgaaaaagaatattgtaattgccaatttgcaaaagcaacttttttcttcagaaatg

SEQ ID NO: 106433 - DNA, 962 bp, Heterodera glycines
  Promoter: Source sequence=SeqID_2490; Location=5014..5975; Strand=-; Gene=SeqID_80031
tttttttatataaaaaaattctttattcgaactccagaaaaaaattgaaaattttttaatattttttgtaaaaatagaaatttaaaagtttgattctacaaaaagactatttttattttgattctctttatttattcttttttgctgcacaattggtggaataattttttttcaaaatttcatttttttttatttttcaaagtcgaggcctcaatgtatggacacagtagagtaaaaatttttttattttttacgaaaattggttgaggccatgtgttcagctctgtgatggtggtgctgagtaccaaaattgaggcgtgaaattcccagagcagataattggggattaaattttgcggggaaaaaaattcgcatcgaaattcggtggcattttgggaaaatagacctctaatggctgcacaagagtaaaaaaaaaaaaatttttttttcatttttttttgttttttgaggaattggctggcgcaaatggattcagctctatgatgtggtgatgagtgccaaaattgaggaggtgaaattcccagagcagataattagggattaaattttgcggggaaaaaaattcggtggcattttgaaaatctattgtgttatttaaaaaattcacttggaaaatagatatattcgagagttttgttaaacaaatttcgccagtaaaataagcattttcaacagtcgagaaaataaaaaaattttcagtctaaaattttgaaaattattcgatcaaatttattttttttctttatattccaaggtcgatgtcattatgtcctccgatcccatgggctatatgctggtcaacgagcggatgttggagatgagcccgcaaatttcttcgccgtgttagtcactaataaaacaattttattttcaaatgtttacctataaaatttttttttaaaactattgtattttttccacatttgtaggagttggagatg

SEQ ID NO: 106434 - DNA, 99 bp, Heterodera glycines
  Promoter: Source sequence=SeqID_16458; Location=838..936; Strand=-; Gene=SeqID_80858
tgggtcggccaaaggcgtcgaaacggccgaatgttagcagcaaagcattggcagcaggcacttaattcatttttaaaaaatcaaatttctttgccaatg

SEQ ID NO: 106435 - DNA, 193 bp, Heterodera glycines
  Promoter: Source sequence=SeqID_22992; Location=1044..1236; Strand=+; Gene=SeqID_53696
caaattttattactgtaaaactttgtatccgaatttaataaaaataaacgaaaatggcattggcatgggacgcagaaaccgaaaaggggagaacaaatcgccaaataaccaatctgttgaactatccaaagctttcgtttgttttgctctgctccttttttctttggttttctttttaaaaatttccgcaatg

SEQ ID NO: 106436 - DNA, 713 bp, Heterodera glycines
  misc_feature (30)..(30): n is a, c, g, or t
  Promoter: Source sequence=SeqID_40009; Location=221..933; Strand=-; Gene=SeqID_68445
aaacaaaaaaatcgattttttcaagtgtcncgtttgcgtgtactcaaacatttatgggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacatttatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggctcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacatttatg

SEQ ID NO: 106437 - DNA, 679 bp, Heterodera glycines
  Promoter: Source sequence=SeqID_25631; Location=1..679; Strand=+; Gene=SeqID_56381
cgtttaatgtaaaaactaacctttagttttaaattttcgccaggttattgtctgtcggaacgcgaaggtgtggtcggcactcctgagaagccgttgtccgacttgggcaaagtcagctaccgttcctactggtggtgggtgctcatcggggtgctcgaccgagagcaggtggagtccaacatttcggtagccgaactctcgcgcctctccggcattcacacggatgacatcattgagacattcaaatcgttgcaactgattaaatattggcgcggtgagaaatgccgacgaatgaatataaaaaacatgcgttttccttttccgttgtcaggtgaccacgtcgtgcgcataagtcaaaaggtcgtctcccagataaaacaattgcatcttttccatccgccaaaattaattctccgcaaatctgcggtccgttggcgtcgcgggtcgacagtctctaacgaagtcggaagaaattgtagggaagaacggggccgttcaatctcagcacattgattcattttccaattatcaaataaatatttctgaagctatttcttcctgacaagttacaatatttgttttcgaacaatcatttttctttgcaattttttaaatcaaagtttattgtctttcaattagccaacaagcgacagttatattgtgtgactcgcccaaaatg

SEQ ID NO: 106438 - DNA, 581 bp, Heterodera glycines
  Promoter: Source sequence=SeqID_15116; Location=1..581; Strand=+; Gene=SeqID_79299
tccacgctgcattgataaaaggcaacgcagattgaacacttgaaaaattattattaaatttgagcattttttgatcaaaaaatttttgaaaataaattcaaattttagaattaaagtgtctaaaaaattaatgtttttttgatatacaatgatgactagggttaataatatacttaaaaaactataaaatatttgattttgaaatttgcaagtataaacttttgtatattttcgaatttataattttaatcatctgacaaatgcaaatatattgaattttgaaaaatttccttctctttaagctcaaattttttcgagttttaagggtatattttttgaatttcctaaaaatcaatcataaggtgtattttgcatttttcttatcatattttatcaaaaaaacgaacgcatattctattacattcattggtaaatgccgatttccaaggaatccaagacgcaatgcccagatccaaggatatacttataatccgaggactaatgggagccctcttgcttaaaattgacaatcaaaaattaaaataatttaagacttttttaattcagcggaaaaaactatg

SEQ ID NO: 106439 - DNA, 98 bp, Heterodera glycines
  Promoter: Source sequence=SeqID_34937; Location=185..282; Strand=+; Gene=SeqID_64621
tccttcctttgccaagggtgcgtaattaacaaattaatgagccgaaaattggccccctgctaataattgtccatcccacccttccttcggccgcaatg

SEQ ID NO: 106440 - DNA, 420 bp, Heterodera glycines
  Promoter: Source sequence=SeqID_7237; Location=1..420; Strand=+; Gene= SeqID_64224
tgtctgcctattttcccagcgtcgttggtatgagcaaaaaaaaaaaaaaaggtcgttcgggcgaaagtttttcaaaaatacacccctaagaatcgggcgaagaattttcaaaaatacacccctaagaatcgggcgaagaattttcaaaaatacacccctaagaattgacttttcggatcggtaccccccccccccccccaagcccaaatcctggatacgtccctgggcgccatgttatcagaaattggaagagcgaattgagccctcgtaaaaaactaagacaaatcatagccccgtcccaaggcctattttacgggaaaaagccggaattttagttttttctgcatttatttagggtatgtttcacaatgttgatttgcatctctctcctcaataaattttctaataaattttagtatg

SEQ ID NO: 106441 - DNA, 453 bp, Heterodera glycines
  Promoter: Source sequence=SeqID_13728; Location=827..1279; Strand=-; Gene=SeqID_77644
ctaacgagccgtttgtgtgatggattttttgttttgttaattctgtgtttgcctgtcattttactgtccgctcattcgtaatttgggtatcactttattggcgctaaattgtttgcttattctgacaacggtatatgaaaacagctcaatgctatttaatttactgaagcggtattgtaataaaacaaaacttgatctcattattaatttaaagttggtttggcgcattttgtgatcgtataaattagcagtttaatacccaaaacaaatatgttattgtttaaaggcagcattgataaagttttgtttgatcggatgattggtccttttacatttaatctggttgtgtcttcgttttcaccataatatttctaattgagagcgttgacaccaaataagcatcaataccatctttctaaactgttaccctcaatttttttagatttaattatg

SEQ ID NO: 106442 - DNA, 155 bp, Heterodera glycines
  Promoter: Source sequence=SeqID_26502; Location=1..155; Strand=+; Gene=SeqID_57232
ccagcttcaaactggccgtgcatcgttttacaaggatctgtgcgtgctccatgatcgtgttgactcgttgaaaaaggtcattggctgcaacgaccaaattttggaagagtttgccactgaccaaagtgcgcaattggctgtagggagggaaaatg

SEQ ID NO: 106443 - DNA, 721 bp, Heterodera glycines
  misc_feature (67)..(67): n is a, c, g, or t
  misc_feature (77)..(77): n is a, c, g, or t
  Promoter: Source sequence=SeqID_7711; Location=1..721; Strand=+; Gene= SeqID_65709
tagtgatttttatataaggtattaatcaccaaaaatgtctgttatttgggaaattgctagaacaacncaactatctnggggagctcaattttcactcactatcaccctggaggagtgatctgatcaaaatggtgcaatttagttgtttgatctgcatcgaatgttctcatttatgaatgattcagattttatcaagtgcacgaaaaaatttttttgaagtttgatcaataattctgttatagtatgacaaattttgggaaaatacataaaaaataattgttttgtgtggttcttcttttgataatttttccaattgggtagttcacatcatttgcgtttttatttttggcctgtctataattcctacaggcaattaccgtccttgatgatagagggtaaatttctcccattgtgaatgaaaggtgtggggaaatagaattgcatgaaagaaattataaccaaaatgttccagattgaatgaaaacaaaaaatgtgatgaaggatgggaaatttgagattctttgcctctagggaggggtggacagcagatagcgaacagtaaatttgatgaacgataatttagaataattttgataaaatgtatcggacattatcgccttcttctgacactgcaagggcgaatacggattcgatccaatgttgccgtgcgcttgggcccgatcgcaaatgcgagcaacctacgtcagaatatggcaacatg

SEQ ID NO: 106444 - DNA, 534 bp, Heterodera glycines
  Promoter: Source sequence=SeqID_16614; Location=1..534; Strand=+; Gene=SeqID_81028
gacacaaaatttaagtaactattttattttttcttcataatcttcacattataaaaaagtatatcttctatatatctcttgacttaaattgattaaatatttataatttcaaatttctcggttactaaatgtttcaagatagccctgaaaaatgccgttttctcggtaggttgttcaatgagtgccgtgttaacaaatatattcgcagtttcattttgcaaagcatgtttgggttcaaacttcactcataaaaacaattaaatatgtgtatatttttaattaaattaaaattttttaaaattttcatggtttttgtttttcaaatttataaattctatattttgtgagaaaaagccttggtcttttttgaattctaaacacataagcatttgtcattttttgcttcgcctattttgctgcactttcattcttcagttattttgcataattattattattattatttatttttaaattttgccgtgtaaaaaaaatcaaaaaatttttcaaaatttattttatttttttcagatg

SEQ ID NO: 106445 - DNA, 587 bp, Heterodera glycines
  Promoter: Source sequence=SeqID_1641; Location=1..587; Strand=+; Gene= SeqID_75008
tccaatttcgtttttttaaaaatatggtttcatgtcaatgtaatttatatgtatgtaattagcactttgttgctgtgttttttcattttccagatactcccagcaattcaatttcaatttcatttcgatttatgataatataattccattattatttaggtgtttctccaatatttgcttctatatttttccttaaaattattcaatcaatttgtaaaacgtggcttttattattatattttttattaaatgaaaatatatataattttttattacttttttgatatttaatatttctgtaacttttttgcttcatcccccgtcatttgatttcaattattattatttatttatttttgaatggctcgggttcgcttctgctactttttccgcttcgttacggtcactttttgcttttggtttacggtaattgttgcgcaacaacaaacacaacaagttggtttgacatctaataaatcaattttcaaatatatataaacatattaagcaatttgatcaaccgttttccgcatatttgggaggtgaattcgaaacaaacgcatggaaaacgaatggcatcaaaaatg

SEQ ID NO: 106446 - DNA, 116 bp, Heterodera glycines
  Promoter: Source sequence=SeqID_38004; Location=524..639; Strand=-; Gene=SeqID_66957
ctcagtaccttaaaatacccctagaaagtttttcccaggattttccaaaaaaaaaaacggggaccagtaaactgcaggattgccccatttgttggaccaataaacgaattgtcatg

SEQ ID NO: 106447 - DNA, 1003 bp, Heterodera glycines
  Promoter: Source sequence=SeqID_18739; Location=439..1441; Strand=+; Gene=SeqID_83409
cacttttctatgaatttatctaaatgccaaaaaaaaatcaaattctaaatatccgtccaatacatttgcgatttataagaattgaaaacacagcattttattacaaataatgagttcaaactcataaattttttgccaaattaaatgaatatcatccactaattacattttgacatttggccatatttcttcgaatttaatttcatttaatgccaaagtgacaattcgctgatttacccactttgaaaatgcacgcacctgcaatttgttaattaatgcatttgtctgaatttctcaatattcattaaaaaattgtctatagaaaaatttattattgcatgttgaagagtaacaatttttgataatctttcagaaattggaaacgaaataaatttttattcgttatatcaaatgaattatgaaactttttgccacctattttcccattttagtatttaggggggtttttagaacctaaaaactaactattttggcatgttttagcacctaaaaatcgtatcattattaattaatttcaattataataaagcaaaaaaataataattttttaaattgtattttcatgatatgacaaaattttaataattaaacaattttaagcattctgtaccggttttcatgaaaatcattgcgtgacttcgtgtaaatcttttaaaaaagttggctttgcgtgttagaacaacggcattaatttttcttttattcagaatttttattattgcatgctcacagacaatgtttaaattaatcttatttctaatggaatgctttgcagaatttttcgttttaaataattattttaatttaaatgtcataatgttcaaattttattaaaagaatttcattttcccttcttttagtcaaaaattaataatgcataaattttaatgcttttcctttatttgttgcaaataattttagctaaaatttatactaattataaccgttttgtttaattccattaaaacaccaattaaaaatg

SEQ ID NO: 106448 - DNA, 592 bp, Heterodera glycines
  Promoter: Source sequence=SeqID_36142; Location=896..1487; Strand=-; Gene=SeqID_65540
cgatttgtctcatcgagacgaatcgaatgatatatataatttatataaaaaatcaaaattaggattttaccaaaaaaaaatttatggggttgggaattttttttttttgaaaattagagtaagcccattggaaggtaaaattttaatctgtaaaatttttgatcaaaaatttacccttttaaggtatatggcttggcgccaaaacgtgggcgccaaaacgaccctggcgccaaaacgtcggcgccaaaatgaccctttcccagcctaaacagctttaaataaacgatttaaagttattgtataatttttgaaagaataactataatctttcaaaaatcataattatgttcctaataaaccgaaagaacgagttttattaaatttaagctgtttaggatctctaagattgaaaaaatgtatgtttgagtccgattttggacataggcacaaatgtccgaggcgcaaatgtccggcggggcgcaaatgtctggacgaattccccatccctcccgatcatgcttttaaattaattacatagattttgacaacacgcaaaaataaccgagaaatttggagtgtgtaccatacaatg

SEQ ID NO: 106449 - DNA, 200 bp, Heterodera glycines
  Promoter: Source sequence=SeqID_37180; Location=1..200; Strand=+; Gene=SeqID_66322
ttcttgggattttcccttgtaaaaatggaagagccgatctcgagttaaaaacttaagtttcacaaaataaacttggaatcgttagagggggtcaaaatatgggcctatgcaaaatttcaagaaaattggtcaataggaaaaattttttttcaaggacaacaaaatcaaatttatttgcaacatttttagcattaaaaatg

SEQ ID NO: 106450 - DNA, 1003 bp, Heterodera glycines
  Promoter: Source sequence=SeqID_1417; Location=289..1291; Strand=+; Gene=SeqID_73412
gaaattattggcgtgctcataaattgttgtacatatttttttttgagtattatatgaaaaatgtccaaatttttgttgcaacctttgggtcttatttcacactaaatggaaaagcatttgctttttatgcggctttttttttgttatttatgaggtaataaaaatgaatctaatcaatgatatattcatgatcagcgaccccgaaaactcttgattgaaagcgtataccgtacatactctttttatcctccatggggtattatttttcaacatcctcagaaagggggggggggataactggagactgggggattaagatagagtaggaatgtgatctgaaaatcaatttgttgacagattttgtcgaaaaaatagtctaaattttactattctggaatgttttttaagaaaataaagaatttttaggatgacgccgcaaattttagaaattttggctagtttttcaacagatttttgtccaaaaatgaacaaatttgtgtcaaactttgaatttcttgaaaaataaagacgctatgccataaaatttcaaaattatgaatatattaagaaatccgaacaattttggtcaataccccaaaatctgaacatttcttagaaataagaacatatcaaatccctgagatagagggattatttttcaaacgcctcttagactgggggataattgagctttggggattaatggagattgggggataattagagaatattcggtaaacactggcactccttgataaaaaattaagcggaaaaatttttcaaatgttcaattgaagtcaggggttcgatcgaaaatttttgaaaacaaggtcatagctaatcaaaaataaattttggaccgaaattcaaaacattttgtgtatcattcgaaagcttaacatgtttagaagctttttctaagacattgcttcgcgattagacaattatcaaaaaaattataacataaaaatagtaaaaaaaaaagttatagtccaaaagcatg

SEQ ID NO: 106451 - DNA, 151 bp, Heterodera glycines
  Promoter: Source sequence=SeqID_22724; Location=905..1055; Strand=+; Gene=SeqID_53411
attaattaaaatgttttttgaaatttttaaaattaattttatcttttttaatttttaaataaaaattattcagcaaaatttctttctgattgccaatttcaaatatttggtcgattttgccgagcagcaaaagattttccggcagaaaatg

SEQ ID NO: 106452 - DNA, 333 bp, Heterodera glycines
  Promoter: Source sequence=SeqID_42878; Location=1..333; Strand=+; Gene=SeqID_70683
tgaaatctatccgagtcaataacagtcaatctattctttccgttgttgatttcgttcagttgaatagatttggtgcaatatattgaattttgatgaaaaataaattttcgactttttgttcgaatttgagttcggggttcggaattgggcgaaatggatgcggattcgtgatcagcgaccccgaaaaccccagaaaaaatgttttacgtgacttttaaaaatttgaaatttttgccaaaaaaggggggggggaacaaaccccagtattaccttattttttttcttcacttttcagtgtttttaatttttcacaattcgctaccttcgccaatg

SEQ ID NO: 106453 - DNA, 1003 bp, Heterodera glycines
  Promoter: Source sequence=SeqID_598; Location=2431..3433; Strand=+; Gene=SeqID_57253
attgtccgttccatttctgtcattcacccggtccccctcattcaatgatcagtgattggcccttcacttctatcccatttcgctgtgatttgccccaattgtgataatttccagacccccggttttggtctttgttctgtggcgccggtggtccccttcaattctttcccatcccggtccccaaatcatttgtgattaatcccccggtgatggcttttttcctgtgatcaatttgtgataatttcgttcaccatttcaaatatttggtttaattacccaagttcgaggtcatttcccggaataaattttttattcattctgtgtctcgtccctgcctgcccctgaaccccgcaccgtggaattcatttggcccgaccccagagcaagtcgggacaaattggcgctcctgggtggattggctgtgaaccacggactgaaatcgacggatcccggtgacaaagggggaagggaaaagcaaattagagagcctagacaagaccctctgaggcttgtctagtgttcatagtttcgtgtagttattgtcctccgaggcataacttcacgagggacgtagcggacttagtgtttaccctctgaggaagcacttcgtccgaacagagggttggaaggtgttgtgtagtggacgaagtacttgccctccgaggaatacttcgtacaaaagggtgttcaagcgcgcacaaggccattgacaaataaggaaaaaaggcaaactaacagtcctccgaggctttagtttagccataaggcaaaaggcaaactaacagtcctccgaggctttagtttagccataaggcaaaaggcaaactaacagtcctccgaggctttagtttagccataaggcaaaaggcaaacaccttgtcctccgaggcaggtgtttagtcacaaaaggtccaggaccaaggccagactgatctcggaaaaagacacaaaacaacaagtgcaccacaacacacacacacgcacaaccaaactgcacgcaatg

SEQ ID NO: 106454 - DNA, 70 bp, Heterodera glycines
  Promoter: Source sequence=SeqID_32346; Location=629..698; Strand=-; Gene=SeqID_62663
aaaaaaaaactaattaattcaattaaagtaaatttgcctaaagggccgcatactttacgggccaagcatg

SEQ ID NO: 106455 - DNA, 390 bp, Heterodera glycines
  Promoter: Source sequence=SeqID_18968; Location=583..972; Strand=+; Gene=SeqID_83702
aacggattaacaggagatgatcattagagacaccatagtgccgcttatacagaacgataattctactaattgatacctatttttctaattgagcccccctcttctcccctgccccggtggttcattttgtgtggggctttacgtacataaagtgggtccccttaaaaatggggacactctccaactcacattatttaaattcataggtttttcctctttgttctttcaaattcttgaacctcaagtatgaaagaacaatatttgctttacagcaaacaaacactttaaaacattctttgaaacttatttaaaatatttgaagatttaagcattccatcagttaaattcggcaaaatttaaatttaaacaatttattgtaattttaaaatg

SEQ ID NO: 106456 - DNA, 87 bp, Heterodera glycines
  Promoter: Source sequence=SeqID_5858; Location=2425..2511; Strand=+; Gene=SeqID_59462
aggcgagcacagaatttttaaaattacatttatttttaattgttttttaaatgtttggtaatttaaatgtttgtttaggatgtaatg

SEQ ID NO: 106457 - DNA, 101 bp, Heterodera glycines
  Promoter: Source sequence=SeqID_44160; Location=918..1018; Strand=-; Gene=SeqID_71687
acattgatgggcggctgcacagctcttttaacttaagctgtgtgcattttaccctgccagccccgccaacttcaattgccaaaaatactgacgcggcaatg

SEQ ID NO: 106458 - DNA, 186 bp, Heterodera glycines
  Promoter: Source sequence=SeqID_42012; Location=617..802; Strand=+; Gene=SeqID_70026
tttttaaaacttttataatttaccccaaactagcgggtgcgtgaaccgtcggatctgggctgggaaaaagcgcttcgcgctttgtgagcttcgctacctaggcgcgttttagtctgttagggtctttgcgtcagccgacatgcacttggtttcctccaataattggagttgacacatcgcataatg

SEQ ID NO: 106459 - DNA, 385 bp, Heterodera glycines
  Promoter: Source sequence=SeqID_21233; Location=1..385; Strand=+; Gene=SeqID_51823
ccattgactaattagtcagttccttatgatgtaattccttccttacaaataaaaaaaataccaaaacaatgaattgcaataaattaattttcatatttttttgttgctgtgattgtcccccgaattttaagcaaacgattaaaacaaaaaatgatcatttggttgtactcgtgtagactaactatatcgcatcaatttccaccgggattttaccttttggtcctttaaaaatcaaaattaaaacgcactttccatgacgtcacctcaaaaagccacaattacataaatcaccatttcaatcacatttaaccttttagatttaccgatttcaatttgtgcataagaaagcattcattttgcctattcctatttttcttgataaatg

SEQ ID NO: 106460 - DNA, 220 bp, Heterodera glycines
  Promoter: Source sequence=SeqID_43056; Location=76..295; Strand=+; Gene=SeqID_70824
tgccctccaatgtgatggctttgggccggaaggttaaaaacacgtgtagggggtgacctatgcgcgtttttggctctccaaaaatggcccaaatcatcgctcaggagaggggtcatgcccgatttttttttgggtggccattttctttcattttcgatcaaatcttattgttttcagttttcataaaataaaataatcaaaatcaattttagaaaaaatg

SEQ ID NO: 106461 - DNA, 545 bp, Heterodera glycines
  misc_feature (60)..(60): n is a, c, g, or t
  Promoter: Source sequence=SeqID_24919; Location=788..1332; Strand=-; Gene=SeqID_55663
attttattcataattttgtcaaaaattattcatattttcctttgtagcctttttaaatanaattaaaagagtttgttataatgttcaattttaattaatttttaaattaaaattaatttttgtttgagccacagacggacgaatattttttagctcttcttaaaaataggcttaaaattataaaagtccgtttttttgcatgtttcaaaaattttcccagcggctcctttaggcaacgccggcactcttcttttccaaaaaaatattttttgaaaaagcatgtcgcgaaaaagaagattccgatgaatttttcattttaattgcatttttattttaaaataaaaaaagaaaaaattatttataaataaaaagagaaaacccaaaaatgaatcatgaaaaaattgcggaaattttttaaatacaaatcaatattagaaaatgagttaattttttattaaataaaatcaattgtctttagattcacattatttacaacaaattgtttcagatgatttaattcatttttattatttattcaaaaaatg

SEQ ID NO: 106462 - DNA, 555 bp, Heterodera glycines
  Promoter: Source sequence=SeqID_4085; Location=685..1239; Strand=-; Gene=SeqID_53118
gaaaaatatttgttttcattttttgttttgtttccattgtctattgttgaaacttgcatattttatttcaaaattcaacaaatttattaggttttgaaaataattagtgctgttttattgttttccctacatttacttttgtgtcaaatggttgctgaacccaataaatggataactaaaataactaacacatgaacataaattcgatcgtaaggatttattgaaatttcaaaaccgcgaatattttttaattagctctaaaaacaaaattaaaatttatttttattgttttttgcctaaggcacagaattatcccatgcaatctccgctcacatcgccacttgctcaaaatgctgcagcgacaccgcctttaaagggctctttcccacttgattatcagcaggcgggcatttcactgattaactaattgctttgtattttgcgggataattagctaattaccacaatgggaagggccgaccgattaggccactcattttgcattaaatcattgatgttttccctggtttattttaggtctgtcacctggagatg

SEQ ID NO: 106463 - DNA, 309 bp, Heterodera glycines
  Promoter: Source sequence=SeqID_13795; Location=1616..1924; Strand=+; Gene=SeqID_77725
tttaattaattaatttaatcaatttggttaattataatttagaaaatagagaaggtctatttcgataatttcaatgttttcatatattcaattttaaaaatcataagaaaaaaaagtatttttatgaaattattaaaaaactaaaatacttttatttaaaaatatttcataaaaaaagtacaaaaaaaaacaaaacaaattttttgttttaaagcgatcgtggacaattccagggatggcacagtgatcgtttccttcggcacttttgccgatattaactcaatgaaaagggaaatgaaaatgaaaatg

SEQ ID NO: 106464 - DNA, 125 bp, Heterodera glycines
  Promoter: Source sequence=SeqID_6830; Location=3609..3733; Strand=+; Gene=SeqID_63020
cgtttgccatcatttcttgcataataccaaacatttcacactgtttttttcagtactggaaaacctcccgtgccggtgacaaatgaggcggtcaacgaagtgcggacggcactgatgcgggaatg

SEQ ID NO: 106465 - DNA, 555 bp, Heterodera glycines
  Promoter: Source sequence=SeqID_32518; Location=1..555; Strand=+; Gene=SeqID_62821
aacggacacttgaaaaaatcgatttttttgttttcggggcagtccccccgagccgatgcgcccagatttatggggagaccgaatccttccggaatagcttccctatagcctgtactttaattctgcgttggatttttgctcctcataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataaatgtttgagtaccccaaaacggacacttgaaaaaatcgatttttttgtttcattaaatatttttttcagaaaagtcatg

SEQ ID NO: 106466 - DNA, 296 bp, Heterodera glycines
  Promoter: Source sequence=SeqID_5206; Location=5123..5418; Strand=-; Gene=SeqID_57269
tgtccatccaaaaattcttagaattagaaaaaaatatccttatcaccacccacagtaatgtggctctttgtcgtttagcctctgatattcttcctaatttagaccaaaactccaaagcccttctcattctctctgcctccgcaaaagaaaaatatttttccctttttgaacctttcatgaaaaatcttctaatcaaaactttagctgacttaatgtgcaaaaattaacacgaaaagaagccaaaatcattaataaatataaaatcaatgctctgaaaaacccccagaaagcagatg

SEQ ID NO: 106467 - DNA, 357 bp, Heterodera glycines
  Promoter: Source sequence=SeqID_8776; Location=2581..2937; Strand=-; Gene=SeqID_69191
ttatttagtttcgttttaattacttgctgctggttcattttgtagttaataaatgcttaactgtcaaaacattaaaagtaattaaaaaaaagattaacaaattatttgaatgtaattttttttgcatatccactcgtacgaaaacggcggtacgaaaacgtccgccgtacgaaaacggcggtacgaaaacgtcccccgtacgaaaacggcggtacgaaaacgtcccccgtacgaaaacggcggtacgaaaacgtcccccgtacgaaaacggcggtacgaaaacgtcccccgtacgaaaacggcggtacgaaaacggcggtacgaaaacggcggtacgaaaacggcggtacgaaaatg

SEQ ID NO: 106468 - DNA, 91 bp, Heterodera glycines
  Promoter: Source sequence=SeqID_45127; Location=1..91; Strand=+; Gene= SeqID_72496
aagtaaaaatcgtaattacgctcaaaaagcttctcaaacaattttagcgcttccaattccttctacaatcgcctttatacatcccattatg

SEQ ID NO: 106469 - DNA, 384 bp, Heterodera glycines
  Promoter: Source sequence=SeqID_17099; Location=1959..2342; Strand=-; Gene=SeqID_81531
taatcatcattttaaaaatttaaagcatataaaaaatattaaaaagaaatgaattggccgaaaattccatcattgatcatataatgtaaaatttggacattttttaatataagggatatgttttaacaaaattagggaatacaagaaaatcaaatcaatagcgcaaaatttaactattgtaatgcatttgtaattttaatcgccttataatttataattttccaatattagataatatataaaatatacacacacaaaaaccaatccataaggaaaaaatcaactaaagaaattatgaataaatacaatatttgcataattaattttacattatcttttcttcaaaaaatttaattattaaaatttttccattcacccaaaatg

SEQ ID NO: 106470 - DNA, 397 bp, Heterodera glycines
  Promoter: Source sequence=SeqID_5748; Location=2818..3214; Strand=-; Gene=SeqID_59113
aaaattcaattttcgaaaaagttcaaaatatgccacaacaccatttcaaatgcaggaattactatgttttgccttctgaatcgagactcctttttatttaatgcatttggctgcatattttgaatttttcgaaaattgaatttttgttcgagtccgggtcaggggttcgaaatgggccgaaatgatatcagcatcaaattctacggcccacataaaacagttttatttcgaaactttttttgaaaattttctttttcaaaaaaggggggtacaaagtacactattaccgagcctgggaatcatacaaaaatggagcaatagagcagttcgcgcacaataaaaaacaatgtaataaataaagcttaaggcttagcctagcacccaaataataagcatg

SEQ ID NO: 106471 - DNA, 649 bp, Heterodera glycines
  Promoter: Source sequence=SeqID_30759; Location=1..649; Strand=+; Gene=SeqID_61152
ttttttttggcttccaaaacttcatcgaccctggttcttttattttctttcaaatcgccccaatttttttttacagctaaactagcccctattaagcttatttccagaaaatctcgcatgaattctcatttttaaattttttatagatttttaaatgttggattttttttgcttaccaaaacttcatcgaacctgttctttctattctctttcaaatcgccccaaattttttttacagcttaactaggcccaattaagcttatttccagaaaatctcgcatgaattccatttttatttttttaatagatttttaaatgtttggatttttttttggcttaacaaaacttcatcgaacctggttctttctattctctttcaaatcgccccaaattttttttacagcttaactaggccctattaagcttatttccagaaaatcccgcatgaattctcatttttaaattttttatagatttttaaatatttggattttttttggcttaccaaaacttcatcgaacctggttctttctattctctttcaaatcgccccaaattttttttacagcttaactaggccctattaagcttatttccagaaaatctcgcatgaattctcatttttaaattttttatagatttttaaatg

SEQ ID NO: 106472 - DNA, 508 bp, Heterodera glycines
  Promoter: Source sequence=SeqID_2470; Location=3981..4488; Strand=-; Gene=SeqID_79881
tcgtcaatcgctccccggtccgatcattgatcagatcaaaggccaaaacggacacatcttccaacgtaacgtaaaacagagatgtcttattaatgaacggacgtaaaaagcggaagacgatgatgaagcagacgggcgaagaagcggaggcaaaagccgaaaaagggaaaatcaaaaacatttaattaaaatagtatttgaaataaagagaggcacgaaaagctttgattgggattttcgctttcatggattcatcatcgtacagtactattcaacacccaaattcccttgtcgggaaatcaaatacatttataagcattaagggcacgaaaaccaaattttggataggattttctcttttttggggaggcgatcccagtcaatgaattttataagccctatccgatccgacagccatacgtgagtatgcgatcaatcgaagcgatggacaatctttgagaaaggacggtgccacctgacgacaatcgcgcattgggcacaacaaatg

SEQ ID NO: 106473 - DNA, 188 bp, Heterodera glycines
  Promoter: Source sequence=SeqID_16093; Location=1..188; Strand=+; Gene=SeqID_80448
agtaaaagcgcgagggggagcgggtcgaagtccaaaatttcgtgggagtaaacccatgcgaattgatgatatatattttcttattttgctgtgaaaagtatgggattggcgccgccgggaaattaaaagtttgaggcaagttttggcacgtacattccttttacagtttcttcgtcgtcctcaaaatg

SEQ ID NO: 106474 - DNA, 638 bp, Heterodera glycines
  Promoter: Source sequence=SeqID_27787; Location=682..1319; Strand=-; Gene=SeqID_58452
taatgaggaattcgtaaaatccttgtcgcttttagaattgcaaagagccctttgagattagtaattaagacttgatttctgttttttgtttgtcatatcattaaggatttgtttcattcaaactttgggattagggtaagttgatcaaacgaaataataatttataattcatatattatttatctttcataactcgacagattgtcctagatctaaaattctgcaaactaaattttcaataatatatgatccttaaaataattatctagaataataatatttatgtagacagcgtgaaaaaaatatattataaatattttacctatgacagtgaatgataaacaaaaatgaaataattaaatagcattcttattcctttatgttttgttttattttgtttgttttccacgtctccctcttttattattttgcctccgtctgtcccaatgaccgcccatttccgatttttgttttgcaaatgtttggcaccaaatggcctaattgctcaattaccaacatttaaattgccttagaataaataattttattcaattttctctcactaatatttattattttgttatcactgaaaccattgtaaatgattgttataattaatacaataattacagaaaatg

SEQ ID NO: 106475 - DNA, 174 bp, Heterodera glycines
  Promoter: Source sequence=SeqID_4420; Location=3863..4036; Strand=+; Gene=SeqID_54382
tgctgaccaacttggagcctcggccgcccccggctccagcgggtcgtcttccgcggttgccgcctttacctatattccctttatacgagaggcttttaaacacaatgctctccgacctttcgacgcatttcctcggctcttttttccgcccggcttttcctccgctttgaaatg

SEQ ID NO: 106476 - DNA, 515 bp, Heterodera glycines
  Promoter: Source sequence=SeqID_22799; Location=1576..2090; Strand=-; Gene=SeqID_53500
cgtttaatatgtatagtagaagaagaaaatgatttttcattaataattttttgctccaattatttaaataaatttgggccttttaaaatatattagctgtgcaagaggggagggggtcgagaaaaaggaagacgaggcaaagaaaaggagaaaaatgagaaaagggagcggcaagatcaaagaaaaggtctcgcatttgcgtttcgaacgcaaaaaaagtgggacttgaaaattgacaaatttccttaagaaatttcgctaaaattttccaatttttctgcgttcgactttgcaaaaaaaaaatggtcgaacgcaaaaatttgccttttttaaaaaaaacttaaaatttccaatttatcgactaaacaaacttttttccttgcgtctataatcctagtgtttcttaaaaaaggagcggtacaattaccgtcggtaacttttctataaaatttggtttgtatctgtaatttttttagtttctacggtttattgcatataaaatgggtttaaaaatg

SEQ ID NO: 106477 - DNA, 194 bp, Heterodera glycines
  Promoter: Source sequence=SeqID_33485; Location=821..1014; Strand=-; Gene=SeqID_63538
catcagttcttcaccatggactacgattactcgacctttggccgttcaatcagcagcaacctcgttggtattatccgtcgaacggtgccgggaattgcaattcaatggtagcaaatggataccaacaacaactgctgcagcagccaaataatcttatcaacaattccttttatctgcagaccgaatttgcaatg

SEQ ID NO: 106478 - DNA, 533 bp, Heterodera glycines
  Promoter: Source sequence=SeqID_4508; Location=1489..2021; Strand=-; Gene=SeqID_54711
agcaaaggacgaagagcaattgggttggagcgacgaaaggcgtaaaaagtggagaggaaaatggcaccgaagaggggccaaaggggcagagagaagggcagccaaagggacagcagaacagcggaaatgaccgcgtcgacgaacgcggacaaaacagccaaagcctaagtcattccgtcttgggagtgccgaattgggcacttaccacgacgcgttcattggctttgacattttggcacggatactccgcttcctcagaaagcaaagccttggaatactctgacatcagaagaaggaaaacggaacaaggctaggaggagcaaagttgggctaatcaaagcaaatcccaacaaaacgactgatttattcgagtgggggttgagagggaatacggatgaatgaatgagcaaaacgggcatttgctctcttcccgcgtcgttcggctgattttatctcatcggaggcgaaaatgggcggggacagaccaaaggacggcagaggaaaagcattcgaacgggaaaaataaagaaatg

SEQ ID NO: 106479 - DNA, 1003 bp, Heterodera glycines
  Promoter: Source sequence=SeqID_11812; Location=562..1564; Strand=-; Gene=SeqID_75313
tttaatcattaagcaaatactttaaaaaattaaaaacgtccaatatttaaatgacattttttaaaaaataaaaataaaacccgttttttaaatgggcgttcactcatatttacgaaaaaattttggaaattcgtattcatcaatccttttcagaaaaaatattttttttaaaatagaaatttttaaatcatccataaacagaggttgtctcaggccaaggacaaggacggccccagccagaggggaggggggagggcatacgcggggtacgtaccctcctcaagacatttttaactatattatttccattagaattaattttgtttttttatgaaaatgcttaattgacgaaatcttgccatttgctaataaaagaaatgataaatacttaatcaaaatcttatttttcccgaattttagtgcctgattattctaaaccgtattttaaagaaataccggtttaacacgtatgacattatccaaattggcatataaaatttttggcacttattttcataaaataagcctcgtcatttaattagttcaaaataaaataatgtccattgattctttgggctaggccacgtgacctgctggacggaatgccagtaattaattttgacaatttggacacttcagtgaccagccgttttgtgagcgaaagctaatcaaatgtgtcttctaaccaaaatggtaaagcaattaattttttaatgatttaatttttgacaaaagtaatccaataaaattaattttatgtatcgagagggtattttttcaaaatacggatcaagataagcaaataaaacaaacttagtttttaattttttagttcacaccattgtttcctgtgcatggtcaagaagggcacctcaccgattaacattaaacttgaaaattttgaaaaatcttttaaatacataatctctttaactatgacggcattttttgtaaaaatatgcgaatttgctaaaataactatattttttagaaatattccatg

SEQ ID NO: 106480 - DNA, 162 bp, Heterodera glycines
  Promoter: Source sequence=SeqID_13909; Location=2529..2690; Strand=-; Gene=SeqID_77859
aaattttacgagtttatacccctacacttgaaatttttaccaactatttacgcattaaattatattttttttatgtggaaaattccactttctttcataaataatattatacacacgcaaagttaaaaaataatttttaaatctactcgatcaccacaaatg

SEQ ID NO: 106481 - DNA, 56 bp, Heterodera glycines
  Promoter: Source sequence=SeqID_16885; Location=1105..1160; Strand=-; Gene=SeqID_81317
ggtatacgttttttaaacttctatttgaacaaaaaaaaatgtttaggggaaaaatg

SEQ ID NO: 106482 - DNA, 95 bp, Heterodera glycines
  Promoter: Source sequence=SeqID_28754; Location=768..862; Strand=-; Gene=SeqID_59329
tcaccaaatcattcctccaacagcttacccaactcttaagtatgtcctttatgtttatttgttccttatttttctgttttaggcatttgaaaatg

SEQ ID NO: 106483 - DNA, 82 bp, Heterodera glycines
  Promoter: Source sequence=SeqID_1182; Location=1..82; Strand=+; Gene =SeqID_69404
ctgcttctgctgataatggtggaaaacgtgaacagtcgtcaatcgtttggccgagttggaaattttaatgaacggtgccatg

SEQ ID NO: 106484 - DNA, 744 bp, Heterodera glycines
  Promoter: Source sequence=SeqID_3688; Location=1372..2115; Strand=-; Gene=SeqID_51466
tgtgtaatgtttgcatgtacgttcatgtaaacaatgttcatttccgattctgcttttttaaattaaaattaaaagaattaaaattttagcataatttttttcaaattgttaaaaattcaatcagtttaagtgccgctttgaattcgtttgatcggcaattaaatcttttcaatgcattaaatatattctctcagatttttcccgaataatttacatgggtcagggtcattcattttcggcaatttttgctcacatttcattaataacaataattaatgaaaattggcgcctcatgtcaattttgttcctcactcacatcaagcggagatgggtcgcgcggataagagaggaccaaaaatggcatttagatgaagatttgtcaaggtcaacaaacagaaacccaaaaaaaaacaaaaaaagaataaaataaatttaaatttttttcatatgccattaaaaatgcccaaatttgaagttttcaaaatccaataacccatccaatttcactgaaaatttaatttgttatgtgcgtatcaccaaatttgaccaatccatctcttgccccccatattcatcgcgcggtgaattggacggggtcgtcgtaaatgaatgggcgtcgcggcgggggcgccgccggcacaacgcgccataaatgcccaaaatttgaatattccgtccgccaagcgagtgagtggcatacggtgaagagggtgagagagtggggaatgaattaaagacaggatg

SEQ ID NO: 106485 - DNA, 229 bp, Heterodera glycines
  Promoter: Source sequence=SeqID_12973; Location=677..905; Strand=-; Gene=SeqID_76729
atttaatggccattttcggcctccaaaaagtcaaaaaacgccaaatttagctcattttttgaaatcaaactcactcatttgacatcatttatttttagtaaaaattggcattttcagcccccccccaaaaaaaaaaatcaaaaaatgccgaaattttgctctattaaaaaaaacaaccactcatttgactcgctttcctcctacaataggccaaccgcctcaatgcatg

SEQ ID NO: 106486 - DNA, 565 bp, Heterodera glycines
  Promoter: Source sequence=SeqID_30616; Location=406..970; Strand=-; Gene=SeqID_61013
ttacggggcagctgcctcacgagccatgcttttggggtgcttccatacgttggagctgtggtataccgctcagtgctgcacatgtgaaagcctgtgtatggctgctgcgtggcaatgtgtcggtggcgggccgcctcgcttggttggttcgctgcgccaatgtgggatgcacgctcgtggggcgacctaacggctgtgctggcgtctgtgcgtcgttgagcggttgttgtggcaggcacataacacactgactggggatggtggtttcgttcccggtcttacgtgccgtaactagcggtgtgtttgtgcttgctgctacgtccgtggccgtgatgagacgacgcggtagggcccgtgcttggcctagcacgtggcttaagactcaatgagtgtcagctcgggcaccgccagctttttctttttttcattatttttttacacttctgttgaagaatgaattctagtcttatcggtggatcactcggctcgtggatcgatgaagaacgcagccaactgcgataattagtgcgaactgcagaaaccttgaacacaaaacattcgaatg

SEQ ID NO: 106487 - DNA, 148 bp, Heterodera glycines
  Promoter: Source sequence=SeqID_23856; Location=795..942; Strand=+; Gene=SeqID_54548
ggtcttaaaacatttataaattgatttaacgcaaatcagcatctttcaggatttgaacttgttgtattttcgtatctcgtgggacttggaatttctgaaggaagcacaccaacacgtgatcccttccgatgcattcactcgaaaaatg

SEQ ID NO: 106488 - DNA, 662 bp, Heterodera glycines
  Promoter: Source sequence=SeqID_30039; Location=1..662; Strand=+; Gene=SeqID_60487
tttcctggatttttgtccaggaaatccaggtccaggtccaggcaaaacacgaaaaacctggattttcctggacaaaattttagaatttattatttcaagtgaccaatgtttttttaaattttcaaaaaaagattaaattaatttaaaaatacattattattattattaattagatatttttaggtgtttctaagcaattaattaattttttcaaacctttttttgatttttaagatgagtttcaaaaaatccaggtccaggcctggatccaggtctcgaagagcctggatttttcctggacctggattttcctggatttttgtctaggaaatccaggtccaggtccaacatggaatccaggtccaggtccaggtccaggcttttttcaaaataccgatctctagaaaaaattaatgttttatttattagggctgaaatggttttaccgagtaccgagaccgaagaatgacaatgagtaaaaaaccgagaccaagaaacgtgaaatcataaaatccgagattaactttttagtttttagcaatttcaattttagtacatatgtagaatttctcctctcggtgatttcaaaaacccgagacagagaagtgaaaaattgagaaatttaattcgagaaccaaaacatcccgaacagccctaaaatg

SEQ ID NO: 106489 - DNA, 146 bp, Heterodera glycines
  Promoter: Source sequence=SeqID_12451; Location=1164..1309; Strand=-; Gene=SeqID_76078
ttcaagaagaatgctcaatttgcaaaataggacacaaatttatactctaaaattttagtcatgcccattaaattcaaatttgacaccgcccattttagcgaaattgaaacaaccggccaaaacccaaattcattttcgtcaaaatg

SEQ ID NO: 106490 - DNA, 218 bp, Heterodera glycines
  Promoter: Source sequence=SeqID_18692; Location=387..604; Strand=+; Gene=SeqID_83360
tcttctaccgtccacatgccattgctaactcgccagttgtctatgagcaaatctcctgtcccatatgggaataccgcttgcgcacttcactcaaactgtcggtcaacgcaaacttcacgaaagagccgtccgtgtcactcacacccggcattactttccgttggaaggatttgagcatcacacctattgcctcttcggttcctccggccccaatcatg

SEQ ID NO: 106491 - DNA, 429 bp, Heterodera glycines
  Promoter: Source sequence=SeqID_1584; Location=3640..4068; Strand=-; Gene=SeqID_74627
aataagatagaattaacaactataattggatataatatatataaccacataacattatgtcaatgttgtataaatatataaaagttatagcttataacaaatttttctaccggttaattactacctaaaaatgatctaatttatattgctgttcgagagtctcggcctcaagtctcggtccatgtcgcaagtctcggctttaacctttttgtttcttaatcaatcgctttaacatttacaattaaatatataagaattgatagaaagatgattatataatttatatctggttcattattttaaaaatttttttgaaatttatttaattttttagcagatttattatcaaattatgaatttacaaggatttttggaataaatgacattttttcatttttgttttccaggacaagtcataaaccaaatatg

SEQ ID NO: 106492 - DNA, 424 bp, Heterodera glycines
  Promoter: Source sequence=SeqID_3102; Location=1..424; Strand=+; Gene= SeqID_83193
aaaaaattttgaatttaaaaatttatatatgcaattttgattttttttttttttaattttttttatgctcaaattaaaatacttttttttgtatttttgcatcaaaattttttttcaaaagttcttataaaaagttaaaatttctcgattttcaagagtgtattttttcatttttattgcatttttcttatgaaaatttgccaatgaccgaaatatgctttaaaaacgaaaaaatgctttatagccctaatcataaggtacagcggggaaaattttttttattgaaaattattttctaacgaatctcttcaaaattaaaatgagtattgggggttttcgagggcgctaatcacgaatccgaactgggatttgcccaattccgaatcccggacccgaataaaaatgaaatatttttccagggatg

SEQ ID NO: 106493 - DNA, 843 bp, Heterodera glycines
  Promoter: Source sequence=SeqID_3354; Location=582..1424; Strand=-; Gene=SeqID_84337
acggacgaagaagacgcgtccattgagatggaagtcatgtgatgaatgtgcagatttgttacatttaaatgttttttctttcctctgtgaataatatacgctaaaatgagttcatctctttgcattttctatttatcggttcatttcgttaatttcgttaattttacggcaataaattataaaaatggagtcaaacagctattagaaacatttctgtcgttttctgtttgttcaattgaatttcattttcgcctcatccactgaatggaaaagcttcaatgccttcgcacggttcgctccaaaacagcacattcagtccgttcgcttccaactgagcgcttttgtttttgtccaccagcgcaacggcacagcctccccagccggcacctgtccatttagacacttctcggcctcccccccttttcagaaatttgtaaaattgaaaataatcttggagcgaacatttcctgaggacttacagacccggaactgaagtggctaaatacctttgggactgaaccgcccactgacttaaaacaaaggcacaaaaatcccaataagggcatttaaaattttttaaagtattaaatatttctaaaacaattactaattaatttccttttaagtcccttcactttggccatttccgattcgttttccggcgcttcctccaatggcgccgtgcccaaatggcaccactattttttggcgggttggcgcggcattttggagagtttggcccaacgggagggtgtcaacacagaggcagaagccttacaaagagttttagcttcgaaaataatcaaaatttcattgtttttttgtgcgtaggccaaaggaatg

SEQ ID NO: 106494 - DNA, 194 bp, Heterodera glycines
  Promoter: Source sequence=SeqID_17152; Location=2263..2456; Strand=-; Gene=SeqID_81591
tttttcatatcgtttttacaaatactttttttacaatgtgcaaattaatttctttttcattaaaattatcgtaaattcaggtatttgtctttaaattgttaaaatcattgcccgtctcgaacctgcaccatatatatttgtgcgtttctgtttattaaccatttatttttaggggtaatttctaaatttagatg

SEQ ID NO: 106495 - DNA, 1003 bp, Heterodera glycines
  Promoter: Source sequence=SeqID_2675; Location=1513..2515; Strand=-; Gene=SeqID_81026
caattttaaaaataatttatacgactgcataaatttcttttaatagatcacttacacttattttaatttaaacgaattcagtaatcatcaattgttccatttgttttttaattttaattttaaataattaataatttaagaaaaagtgaaaaatgaatgaactgtaaaattgtaaaattaagcacggctttgtaagttttccagcctggtccgtggcccaatttgttatgtcattttctgtgcgagaaaatgcttattgtaagagtgacattaattgtcgcattaaaaatgcggttttaagatattagctttgtcttctttagactaaattattgtgataattaaataatgacctcatttgacttttaaagttttaattaatttggcattttgtttatttttttgtgtctttcattttcattttatgttttttggctctcttcgcccggacttaaaaatttgtgatgcggattgtgtgtggtaattttaatggtacttttaattgttgtgttgtttaaatttaattgattgggattgctgtggctttaagtgattttaaaagtcttccttctcattcttctccttcgccccgttttggaattcggcaaaagagcagaggaggaccccggcaaaaaggcggctaattttacgacgtggcgctcctggaaaaaggtgacgatcaacgcggtactatccggggcatttgtagactataagtccgacagcgtctccaaaaaagtgaaaagtaactcacaagctgcgagattcggaaaagtgaaaagtaaatcacgagttggaaggagtgtaaaagtgaaaagcaaatcacatttggtggagaaaagcggaaagaagtcgacagttatcagctcggtaaagtaaaaccgtcaacaaagctgagtttttatcaaaacggtaaagtaattccgccgcttcgatatccgacattggcacttcgaatttgaatttggaagagaaattgaaaaacggcgaagtaaagccaatg

SEQ ID NO: 106496 - DNA, 259 bp, Heterodera glycines
  Promoter: Source sequence=SeqID_14867; Location=837..1095; Strand=+; Gene=SeqID_79018
atttcctaaaaatttttgcgcgctgacatttttaatacttaaatccatctaatcataatttaagccagcttgtaatttgctttctattcagattgaattttataaatttgtacacgcttttgtattgacaataaaaattagacaaacttcggaccgaaataaataattcatgtaataacaatcaatgaatatatacattttcatctaatttgttgtttatttgattttcattgctttcctacagaatatagtgaagatg

SEQ ID NO: 106497 - DNA, 1003 bp, Heterodera glycines
  Promoter: Source sequence=SeqID_16255; Location=111..1113; Strand=+; Gene=SeqID_80634
tgcaaaaaagccaaaaatttggaagttttttattaataaatttttacaggctagaaaatcttttgctttttgcaaggctaaaatagagcacgtgaagagctttcgaatgatatcaagatcgttagatttggttaacaacaaaaaaagttatcgtccgaaaaaacagaagcctgatttaataaattaacgcaatatttatattaataaaatttgaattaatatcagttcacttattttcttcaattatttgcagaagatatgtatagacagactcaactgattttttaattttttcagaatttagattgattattcccatgttcaccgtaattgttccatattatccccccccccccccccgtatttaaggggtgctaggtcatttcttaaaaactgccactatgggcgtttcttaaatactgccaagttgtagtaaaataaaaaatgtaagacatataaattcgtatcttggcccaatttcatccaaattaataattattggtatcattcaatagcattaagtgttgtctatcagaatagaaattttgaaaatttttttacaaaattttaaaaaagttatggtcataaattttcaataaattttcagtcaaattattttaccagaacttttttaaaactcgatggaattttttaaaattttattcataaatagagaattcttaggactatcgaatatataaatttattttctcttaattgcattttaatgccttgaaaattttaattttttctggacaaaaaattctgacttaaggttttgtggagttgaataaccatatctttttatatacttaagtaaaaaatttaataaaataatattctgatagagaacacctatagctattgaatgataccaagaattattaatttggttgtatttgagctaagttatgaatttatatgtcttacattttttattttcctacaacttggcagtatttaagaaacgcccacttggcagtttttaagaaaaacgcccatg

SEQ ID NO: 106498 - DNA, 511 bp, Heterodera glycines
  Promoter: Source sequence=SeqID_7497; Location=1690..2200; Strand=+; Gene=SeqID_65001
cgtacactgaatcgtcgtcatgaatcgtcggcactgaattgaccggctccgtacaattttattcaactttgtagattttttcattcaacaataaaatgaataaataaaaaatttcactttgtttgatcaagcgctagaagactttgtgtttgtaaatcatcagatgcctcggaattccgatttccgaaaatttttcaaaatattctggaagaaattcgataccattttccggtggcaggtgatttcgccagtgagtgaattcgccagtgagtgatttcgccagtgggatttcgccagtgattgatttcgccagtgagtgatttcgccagtgaactatttctctttttctcggcgtctgtatttgatttcgccagtaagtgaactcgccggtgattgttttcgccagatcggaccaaattcatcccatgggcaaattaatactaaagataaactgcgtgccgatttgccaattgaagttagggcagcttctgctccttcaccatcaaatatg

SEQ ID NO: 106499 - DNA, 125 bp, Heterodera glycines
  Promoter: Source sequence=SeqID_28184; Location=327..451; Strand=-; Gene=SeqID_58828
agtttgagaataggttaaggacatttcgtccccaagtcctctaatcattcgctttaccgagtataactgcttaacgagctccagctatcctgggggaaacttcggagggaaccagctactagatg

SEQ ID NO: 106500 - DNA, 70 bp, Heterodera glycines
  Promoter: Source sequence=SeqID_12753; Location=1146..1215; Strand=+; Gene=SeqID_76461
ggtgccgcaaattatcaaccaatttgctggaaaattgttttttttcagaaaaaattagtgccaaacaatg

SEQ ID NO: 106501 - DNA, 351 bp, Heterodera glycines
  Promoter: Source sequence=SeqID_15385; Location=425..775; Strand=+; Gene=SeqID_79647
tttctgagttcaaattatcaaaccctttaatttttctcgatcaaacatttgacacaatttgggtaattgaaaattaatattaaaaaacaattttttactgatgagaatcaattgaaattataaattttttattgataacaatcagtgattgttaagcatatttgcaaaagaaggttatctttttaatccctcaattaatattttgttttttaaattttctaattagataaaattaaaaagagaaatttgaaaattattaaaatttcccgaaaatgtcaaatctatggacctttcattacccgtagaaaaaatttgattgcttagattcaccggaatggcattgtgtcaatg

SEQ ID NO: 106502 - DNA, 226 bp, Heterodera glycines
  Promoter: Source sequence=SeqID_39848; Location=233..458; Strand=-; Gene=SeqID_68330
gctgaaagttaaaaaaaagtgattaaaaatgaatgaaataaatgcgattaaattgcaggaaaactcccgaaaaattaataaatttgtttaggaaaaaagggctcattcattgtcagtaaattctagaaatttaagcacatattccggaaaccaaaaagggtgtccaataaattcagaaaattggcctggactaaattgaaaaaaaaaaaattcaattccagaaatg

SEQ ID NO: 106503 - DNA, 107 bp, Heterodera glycines
  Promoter: Source sequence=SeqID_18880; Location=664..770; Strand=-; Gene=SeqID_83582
attaattttgcaaaaaataaataagtaatgaaaaagtcagaatttcgaaaaattttaaaaacaacaagcgttggcattttttcaggttaagttagtcctttacaatg

SEQ ID NO: 106504 - DNA, 1003 bp, Heterodera glycines
  Promoter: Source sequence=SeqID_17695; Location=28..1030; Strand=+; Gene=SeqID_82224
catttcttttgtttgcctttgttttccatccaaaaaataatttgcatttggcgaaagatttgtttatgttttttttgtttatgcatttatcgtcttctgagtttttagggatttgttgatcacgattgtccctttttattatatgacctttctcccaacattggcaacaaaaatatttgagtataaaaatggttgggtgcacaatttatgttgcatattttccaccttgactttttagcatatattttgtttgcataattttgcgattttatgtgtatataatttgcaccgtattcatgcgccttccacccccttgcacagtatgccaacccacaaaataatgtactgtatctgtatgacttttttttttactgcctttcaattgaaattcaattaataatttggttgattaaattgtcttcaattgaaatttataattgattccacattttctaatttcgaataattttgtgccgcaattccttcctctgataatttccgcagtttcccaatctctgataaaaggtgccgcattttcgaatgcctaataatatgatactgcgattccttcccatggtaatttccgcagtttcccattctctgataagcgattcctttgcctgataatttccgcagtttcccaatctctgataaaagttgccgcattttctaattccgaataatttgatgccgcgattccttcccctgatcatttccgcaatttccaatctctgctaaaaagtgccgcattttccaattttgtgtatttgattatgtcgttccctatgcctgataaaacagggccataatccctaaatcgttcacaatttaaacttttcccattcaccctttcgcgcatttgcttttctaattggcctatcactgatttagtgccattgtcatttctaatttttatcccatccattgtttgtctttatgcatttcaattttacaagtatactttaatcacatcatccctttattttgttagattaacaaaatg

SEQ ID NO: 106505 - DNA, 873 bp, Heterodera glycines
  Promoter: Source sequence=SeqID_4044; Location=380..1252; Strand=+; Gene=SeqID_52939
tatttaaataattgttgttttcacaatcagctttttgcaattgttgcaccgaaaagcgcctttttggcatcgatggtcattggatgggcatttttggaaaatgctttacatgtgttgggccaggatttcatgaattagccgggaacgcgctaaaccccggcattttctgggtgtttggcgtcagtgccagatttttccgcatttgatagtttagtcgatttttttgggtttttgaatttctatggtttttttaaaaaagtcatagacaaaatcatgattttttttaatctgagttctgattcgtaatcagagtgtttttctgcccctgagaaaaatgctttttaaaattttactatttttccatcgggaccactattctgctcttttgcctatatgtatatacttacatctaaatctgtaaaaccctgcgggttttgatataaacgaaaacaatttttttcattttgttgcttttacatatgtagtatttcggtcctccccccaatgttgtgaaaggcgtttcattctctgcgtatgtgatgggaagggagagagaagggggggggggggcaaagcaaaatggaaaatgatgaggggggggggggggggaagtgtagtttacaaaaaattaggattttcttgaatttttaagtcttattaatcataacttttgatgctgaatcgcttagcttttgcttactaatatcttctaaacacgtagagttttcgaatgataccaattttgaagaaattaacgaacgaacaaaaaagttatggccattcccgtttgaagttgtatgaaacgccattgtacgaactgctaccgacccgttggtggtgctgctggacggaggggctgccacgaccaaaatg

SEQ ID NO: 106506 - DNA, 139 bp, Heterodera glycines
  Promoter: Source sequence=SeqID_883; Location=2281..2419; Strand=+; Gene=SeqID_63277
ggtaaggcatttgaaaagtcacaaattcgtcatttatttagctaacaataaactgttttcccacttcagttggatttgcaacgacgtttggatggacattttcccctgttttgatcgtccccaactcggcctcaaaatg

SEQ ID NO: 106507 - DNA, 161 bp, Heterodera glycines
  Promoter: Source sequence=SeqID_36876; Location=808..968; Strand=-; Gene=SeqID_66091
atttttgatgttccactttccaatgcaggatcaaccgtgtggagtgttggggtggtgtcggtggacaacgggtggtcaaacagactgcccaagggtcagccttcgcgtcgttcaatctgtacaccaatgtggaccgtcggctgtccagcgggggcacaatg

SEQ ID NO: 106508 - DNA, 1003 bp, Heterodera glycines
  Promoter: Source sequence=SeqID_3803; Location=3910..4912; Strand=+; Gene=SeqID_51942
aatttatcaaatttataaaactaattttagtattttttattttaaaaaaatattttcaataataaaattcatcaaattatttttacggtttttatttcaaaaagcatttcctatataaaaaatttagttgatttgttaaatttatttttactatttttatttcacaaaccattttcccaccataaaatccattaacatatatgtatataaaacgttttttttccttttgcacagtaaattatgtacacattttgtggaaagattttttccctagataataggcaatttaatcgtcgtgtcgtcctccaatcccaatatatcccttcccattcattcattctttcatctcatttatgtggtggtgctgctgttcatctgtgttagttagtccgtccgtccgttctgcttgccacaccaaaaaaactttttgccatccatcccatcattatcatattcgttttgcctttgcctttgccctccgcccctcccccaaatgacagaatgccaatatgtattttttttgattttttcccccaacattatgccaatgcaaatgaatgggatgggatgaaatgagaggggggcagagagaggaagaaggacggtttacccaacacaaatgtacacaaaacattgtggttgggtgttggattgtgtgtttgttgtgtataaaattggattctcaattccccattttgctcatttacgccgcggtacacattgaaaaaaattttttgagtgaattctgctggtaaatttttttttgaataccacctaaatttgaaagatttaatggatgtctcaattcgtgctcctctccattagggaaagtttttttaaatggctaaaaaggctcataaatcgggaattgatcaaacttcaattaacctctcctttgttaatccgttttgattttccataatttaaaaaaaattgcacttatttaattgatttcagaaaaactttccacgccttatcatcccctaaacactttgtaaaaatg

SEQ ID NO: 106509 - DNA, 564 bp, Heterodera glycines
  Promoter: Source sequence=SeqID_12942; Location=437..1000; Strand=+; Gene=SeqID_76693
tgttgccaacaaccggaaaaacaaccggaagatttcacgtttcatgttgtcaacaaccggaaaaacaaccggaagatttcacgtttcatgttgccaacaaccagaagatttctgcatatttgggcctttttctttttagggcatagactcgcaaattgcgaaatcataagccatgcaatttcatcatttattgcctatgccatatgaatattaatattatttgtgcatcagtgggcgtaaacggaaattaattttaatcgatgtttgaatgttgttgacattcattctttcggcaagcgtttttttatgttatttaaattatttatttttttctgactggcacagtggtagtgagcagagatggcatggaattccgatttccgaataaatttttttcagttgatcaaagcgcaaatgcatttttttaaatttatgcctttttaattttattggtataccttcgaattttttaattgtcccattaaattgttcttttgaatttaattttaatattttcgcaaaaataataatttaattgacttaaatattttttagaatataatg

SEQ ID NO: 106510 - DNA, 778 bp, Heterodera glycines
  Promoter: Source sequence=SeqID_12511; Location=752..1529; Strand=+; Gene=SeqID_76158
ataagtccgtcgagattctcgactccattgcctcccgtcccggagtctcagttgggtctctaatttcctggaaaacactatcatccctaagctttcgggataattctcgacattgggggtcaaccctcgggtcataactggtctgactgatcagctgatttaagtgatcagaatgatgccacctttcccgcttcttcagatggcgtgtgtaaagaagcgcccattgtgcaggtgaagccccaaacttcgcagccccaatcgcccgcggcgcacagtccgccggcacagccgacgacgcaacaacgcgccaaactgttgaccaccagaaagtaagaaaatgccaaaaaacaaaccaaaatttgaatcggaaaaaccaactcacaattcatagccaaggggagggattaaacaattaaaaaaggcaattatgttaattagcagactgacaaaaatgccataatttattttaaaaattctttaatttacgtctgttttgctaatcccaatttgaatagatttaactacgctttttgaggacattcaataacattgcttaaatgttctatttgtatgccaaaacgccaaactttttttttcgtttaaccgctgcccctttaccgtatttacacaccatttcttggccagctccgcttcgccgtccccaatgcatggtacggtagtcgcttcgccgccgtccccgctgtttggtacagtaggcgccgcgcccgtcagtccatcgtcggttggcggagcggcgaccgcccgtggcggcgctatg

SEQ ID NO: 106511 - DNA, 1003 bp, Heterodera glycines
  Promoter: Source sequence=SeqID_6667; Location=3028..4030; Strand=+; Gene=SeqID_62408
tatttggcatccaagcagaaacgcaagcgcagaaaaagggattggaactgagatgaagacggacggggagaagcagaaggttgggcgagagggtggacagcgaattgttggagaagtcgaccctaaagagtaattattgagaggagactgatcagtgatagggaaggatgaaaggactgatcagagacggaattgtaggagcaattggaacatactgatcagtgatcgagagaaagaattgatcagagaaggcattagagggtaattggacaatactgatcagtggtccgaggacgggggaaaggactgactcaaaaagaagtgagttgttggagaaggcgcccggggacacaaattggagctttggattgttggccaatcggacgaattgcaaatttggcaatgcggcgaacgcccgcctttcgaccaaacgcagaaaatgacagtcgcaaatttgaagcgtctttaggcgaaaagtgaagcggattaattggttaatgtatttttattgcctgaagcattggctgggccaattccccttcggcaattttctcgatgggatttccgctgaaatttagcattcgcagggccacaaattggcggatgtccggcggagttgcggtgaaattattccaggaaaggtcgagagattccaactaaatttaattttaaaaaataactgaataatttaattacttggaaaagtggagaaaaggagtcatagtcgaatttgtggagtcgattatgagacaaattcagaagacggagatgttgggcagcgaaaaaagacgaactctgagggggggggggggagtgatcagagaaaggaaggacaaaatcagactctgatcactttgagaagagtgaatcactcactaatgagccaaagatattttggtggataagcgaataattaattagtcaattaattattaattttgctttggataattaacccatagattggtgattttgtgacctgagctgaggccaaataattatg

SEQ ID NO: 106512 - DNA, 537 bp, Heterodera glycines
  Promoter: Source sequence=SeqID_3614; Location=4549..5085; Strand=+; Gene=SeqID_51126
acctgccaaattaattattaataagattatgtattgcccttttcccgaccctcaaaaaatgatgggattcggagtttttgagaaggcattatacagttaaatcttacttaaaattaagacatttttttgtgcaatttgattttcggcttttattctgagtttttggctaacggaccatctcgtataaaaacggttgttaatgtaaaacaaatgtcagaatcatttttacgcaaatttttattttataaatatattaaaatgaatattgataaggttaagattggggggtttcaaatttctgaagtgtatgtatgtacctgccgaaaatttggatttttgactgcatttcttcccttcaatttggcccagaaataaagattaattatgtttttttttaaattttaatttagaattcgatttcgttggcgatggagcacggtcaagatcagcgtaagcatataaaatacaacaaattgtttttcttttttacgcattcattttcaaaggcatttttgcaagaagtgtcccaccggaatg

SEQ ID NO: 106513 - DNA, 192 bp, Heterodera glycines
  Promoter: Source sequence=SeqID_15456; Location=874..1065; Strand=-; Gene=SeqID_79719
ctccccacccccccccccaaggcccctccgcacccgaattttttaaggaaaaatagtattttttgctgaaaattttagattttccctggtggtacccccccccccccagacctagcctcaaccaaattttccaaaaaatttcgctaaattttcaaaaaaccgacaatttttgatgaaaatctgctaaaaatg

SEQ ID NO: 106514 - DNA, 603 bp, Heterodera glycines
  Promoter: Source sequence=SeqID_8685; Location=601..1203; Strand=-; Gene=SeqID_68848
tactttgttaattagtgcgtgtaatcatcaaatgtaattcacatgaaaaacacattaattaacaaaaaatgaatatgcttaagtaattcaacgaaattttattcgcctattaaatcattttttataattttttcttcaacaaaacgtaaatataatcacacaacggaaccagtccatcaattaattacgatgtaaagcataaaaatagaagaagaaaatgcagtaattagctttaattcatatgaaaggcatgcccattaattaacggaaaatgactatttaaattaggcgtaaaaattcaatttcttataattaatgacgaaatgtaaccatcaattagtcttttttcctgtttggaagcattacataataatatcaaaaaaaattcccattggctttaattttgttttgtcttagtgccaaagtcagccaaggtttttatttatgtaaagattttcaaaaaaacgaatactttttgtcacgattctcgaaaataaagtcccaaatctcgagaccgaattagtttagttacatgataattaatattttaaataatttattaatttagaaagaaaaaagttatcatctataaaactgataatg

SEQ ID NO: 106515 - DNA, 236 bp, Heterodera glycines
  Promoter: Source sequence=SeqID_19019; Location=1..236; Strand=+; Gene=SeqID_83757
attataacaattaacgataatatagcttaatttagaacaataatccacatatgattatggtaatcaaaaaaacattaaaattttttcaaaagacaaagacaactttgtaatataatgaattttttaatttcaataaatgtgtgttaaactcaaaattaactttccaaccttaaatggattattgaaaagctaatcgaaatttttaaatttattttagcccatttcttccggcaatg

SEQ ID NO: 106516 - DNA, 75 bp, Heterodera glycines
  Promoter: Source sequence=SeqID_43609; Location=1..75; Strand=+; Gene= SeqID_71232
ttctatgccaattaattgattaatatttgtataattaattatttattcgtttataggaatcgataaatgaaaatg

SEQ ID NO: 106517 - DNA, 490 bp, Heterodera glycines
  Promoter: Source sequence=SeqID_15994; Location=1..490; Strand=+; Gene=SeqID_80353
tttccatttaattttggctactgtattttttgattatgcctacagtatcggtgatgccgttcttcaaatgccattgcttaaaacgcaaaaacatcaaaatttgttgaaatcaaataacggacgaaataaattcttgcaacattatgaagtgaattaaaatttttgaaatttcatttttcgtcggctattagtaaaaacatggggccttcaaataaaatttcaaaaaaaaaaccgaaattcaaaggcgagagaataaacaacataattagcaatatttcgggaagttttggaaaaacctcttactaaattttcgaaatattttggtatttaaatgtattccaagagccataaaacacataaatatagaaagaattttggcaaaaaaggacagttatgaaatgaagtttgaaattgagtccctaaaaaataattttcaaaaaaaaatatttaaaatatagtttagaaaaaatttttcatattttataggatg

SEQ ID NO: 106518 - DNA, 385 bp, Heterodera glycines
  Promoter: Source sequence=SeqID_24358; Location=636..1020; Strand=-; Gene=SeqID_55077
ttctgatgatgaactacaattaattttttattgtaattattagcatttttacatgtcaattaagaaattttattaatttttctatattccagttgagtaaatttagtttctattatatcatttttatatttttaaactcgatttcaataataatattaaaaatttgaatatccaattaatttcaatcaaaaaatagatgaacgaagatagtattgagttattctaaataatttaatgattttaactgcaaaacaataagaatttaaccggagtgccaatttccgaaagtctttttgtgaacaacaaaaagcccttggcatggcttcaaacgttttgttgcaggtgtcaactatttttatttaatccattttttataacaaggatg

SEQ ID NO: 106519 - DNA, 825 bp, Heterodera glycines
  misc_feature (19)..(19): n is a, c, g, or t
  Promoter: Source sequence=SeqID_35734; Location=538..1362; Strand=-; Gene=SeqID_65218
ttcatttttagtccggttntattgatattataattgtttttctattaattataattattgggtttattattgctaggctttttttttgccattattagtaaatttacttttttggcactcgtaaatcttccatcttcctttttcaaaggttagctttttcttttatatttaattggtcttttaattaagcaattttactgatttgttaaaaaacgtgctggtttcattttaaactctttcatcttattaaattttggctgataatgaattttcttattttgcttttagtgaatttaattgaatttccgtcggttttatttaatctgttaattaaattgttttactaatatttttattataattattttcttgatgtctcgcaaaaagttgtaccaatcaatcatattgttttttatatatgtattggttggtaaatcgaaattccaattaataaagcaataatttattcagttaaattttatgaattattaatgtttgaactctttgggtagtaattttttgctttttaaattaatttttttatataccgactttgtttgtctatatgaaatagattttttaaatttaaatttaattaaaatcaaaaaaatatattgttttatttaattctttaattaaaatcaaaaaaaatattgttttatttaattctttaattaaaataaaaaaaatattgttttatttaattccttcgtccatttttatttacatttcaagtcaatcttatcgtctaagactcgtttggacaatagttgaaaattatttttttttattttctcgagttttcagtgcctttcgaatcaaatg

SEQ ID NO: 106520 - DNA, 902 bp, Heterodera glycines
  misc_feature (566)..(566): n is a, c, g, or t
  misc_feature (568)..(568): n is a, c, g, or t
  misc_feature (599)..(599): n is a, c, g, or t
  Promoter: Source sequence=SeqID_15028; Location=1133..2034; Strand=+; Gene=SeqID_79192
atttatgagaaatctgaaaaaagagatactattgtgatgaaattactactaatatttgtcatttgatatttgagaataataaatatgaaaattcatttttaattatagatacaggcaaatcttgatcagcatttaccagggctgtcaaaaatatgcaaatgcatttttttcctgaattctacgtagcctatgaccaattgttactctttagttagtttggcccctcctgcttttctacatttttgctttacggggggcggtccctttgtactctccccgccccttatgactccgcttatttaaactcttccctttgaactcccctttccacttttgtcggatccggatcccgaccaacctcccctttcccgttacgagttggagaatcacaatgatgtatttaatttcagaaaagaacattggaaagtacgcacaaacgaatttggaaaaaatatttaaatgcgtggcttttgggacagaatttgaatgtttttgaacaatgaagctgataagattctgttgggaattcgtgaacatttctaatttaatgatgagtgactttcgananccaatggggaaaatgagacttattgggaaanagttggagaatttaacggccaaattttagaacttcaaagaattcccgaaatattaatctcccataatgaaagcaaaattgaaaataaaagggacaatgatcaaaatggggatttaatgcaaaaacagagcataaatgctattactgaaaaagatttgttcatgagtatattcgatttaaatgaagaaattaataatgaaaaaggagaaaaaacaaaaacgaattaaaaattaatgacaaaaaatctaatgaatgtcataaaaacatggattttataacaaaaagttttagcagcgagacaatg

SEQ ID NO: 106521 - DNA, 387 bp, Heterodera glycines
  Promoter: Source sequence=SeqID_5927; Location=3765..4151; Strand=-; Gene=SeqID_59704
cgtgtgtcccaatttcgagaggccgaatcttataaatttaaaatgtcctttgatttctaagatttgtcctttattttaaaattttgttttataattttgggaagttcaaaaattttataatggaaagatatttgtttcgaaaaccaaaaaaaaaacagcaaaaactttctttctttttttgtaaatttaagttttcaattttaaaaaatatatttttctttcttttccaagagtttgctgagaacggaatttcgtcggacgccaaggacttcatctcaaaactgctcattctcaaaaaagagttagttttttttgcgaggggggattttcaggaaattttcgcgagaatttccaaattttcaccccttcccccttaggcgtcgaatg

SEQ ID NO: 106522 - DNA, 555 bp, Heterodera glycines
  misc_feature (31)..(32): n is a, c, g, or t
  Promoter: Source sequence=SeqID_11310; Location=1..555; Strand=+; Gene=SeqID_74690
agaagaattcgcccatttttacttaaatganntaaatagttgaaaaagtttttcaataaaaaagaagactttaactgtaaaaattaagaaatttttgacgttcgatcaagaagtgatccctgctgaacgtgatttttggttcttttccaatattttttttttataacgaatccatttttaagtctgatgagtccgtttcagtcccagctgtctagtcccttgtctttgtccttttagtttgtcctcttgtctgtctcttaattcccaaaagtgcaagaaaagaagcgaaaaacgaaggccgccctatgtcccatgtcactttgccctttgttttgcctttgccttcctccgttcggttgctcagtgccaaccaatcacagctgtccgtccgtccgtctgtctgttcttacaaattagttctatttgctgagtttgctatattgcattttgtttccgcgttctaattttgtgctttaatttcgaaattcctcttctgaattactgacaaaaattgtactttagggcctaattctgactacctaattttgcgaaatg

SEQ ID NO: 106523 - DNA, 97 bp, Heterodera glycines
  Promoter: Source sequence=SeqID_12005; Location=2108..2204; Strand=-; Gene=SeqID_75529
ggtgagttccttattcctttcctgtttatgcgtttcttctgctgtttagaatgttcctcctcgcaatccttaccaccagaacaggaaaagcgatatg

SEQ ID NO: 106524 - DNA, 217 bp, Heterodera glycines
  Promoter: Source sequence=SeqID_14507; Location=365..581; Strand=+; Gene=SeqID_78558
ttttcaggtctaatcgcacaatggtctgacattaatttgcatatatttgaaaaaaatatgtaatttactcggatgtctgctgattatttgatgcgttgtaacaggaaattaattatttagtcaatacaaaaatataaattatgcgtttctcgtcaataatattaaaattatattcatattaaatattatttccattttagttttttatttttctatg

SEQ ID NO: 106525 - DNA, 84 bp, Heterodera glycines; identical to SEQ ID NO: 101616
  Promoter: Source sequence=SeqID_1271; Location=918..1001; Strand=-; Gene=SeqID_71159

SEQ ID NO: 106526 - DNA, 416 bp, Heterodera glycines
  Promoter: Source sequence=SeqID_13492; Location=2033..2448; Strand=-; Gene=SeqID_77379
ccttaaccttgtatttttttattttattttttttaactgaatattattatttaataaatcacatacttttattttacttataatttcatttatttcatcaaataaattctctgaaactgttaaaatttcgttaacagttaataaaaaataaataatatttgttgatagttttttcatgatagctaataggaattacaaatgaaaatgcattttatgtattaaaaatttatttgcattttataactaaagaaatttttaaattgaataaatatataaattaataaaatcaatcaaaatgattaggaaatccggcagaattaataaaaaaaataagcatttatatttaattttcacatgaacattgttaacgtttaaatttcatatatgtattttctagggttgcacgggtcccgatg

SEQ ID NO: 106527 - DNA, 1003 bp, Heterodera glycines
  Promoter: Source sequence=SeqID_11485; Location=3026..4028; Strand=+; Gene=SeqID_74901
taattatacggcccccatttcttttttccattttaaaatcgaaaattgtgaaaattcgttaattgatttgtttatttgacactgttgcagcactctttcctttcttcattgatttgtttattttttcatctttaagggctactgtaattattttggattaaaataatgatgcaaaaaattattcaaaaatcataaattacatttagataaaaaaaacattcaaaagccaaagggttagaaaaaataaatgtgcatcaaagtataaacattcattgagtaaataaataattttaattatttgcaaattaaaaattatttctttttttaaataataattaattaattagaacattttttaaaatttaataaataaatattatttaattatacggccccccatttctttttcgctttaagtcaaaaattgggaaattccgttaattgatttgtttatttgacccccttcccttctcgccacccgaactcgccatttcccttatccctcgctgcaacccttcctcgccactctcgctgccgagcaatttctcgccatttttctcgttgcaatgtactctcgccacactctcgcccccctgccactcgctgctgcctactctcgcccccctgccactcgctgctgcctgctctcgcccccctttccccgctgatgacgtcattttttccctttatgagagcaaattaatgtttatcatccattgccaatgtggccgagtggttagtgcgtcagtctggccgccccctctggggttcggatccgcttggtgcggggaatttttgatgaattttaaatgaatttaaattcaacgtctttgacctttaagacgtttaaaataatttaaaattaaataaatttaattaaaataatttgcataaagtcgcgcagtcaaaaaagtcgcgcaccccctgcaataggtttgggtttcaaaaaaaaagtcgcgcaataggttttggcttcagtactgaaaagtctggcgctcaaatg

SEQ ID NO: 106528 - DNA, 108 bp, Heterodera glycines
  Promoter: Source sequence=SeqID_38982; Location=709..816; Strand=+; Gene=SeqID_67659
tgtaaataacgggcaagaaacaattgatttttaatcttaatttagtcgggctttttgttgggaaacctcttggcaacaatttatgctcgggcgctggttcataacatg

SEQ ID NO: 106529 - DNA, 936 bp, Heterodera glycines
  Promoter: Source sequence=SeqID_9263; Location=221..1156; Strand=+; Gene=SeqID_70796
aaattggcgagaagtgatgtcaaaaattaaataatttgaaaatgacttgcgtcccgccgtacattagtattaaccggactgcaccgtgttttgtgacttgaataattaaatttatttatttaattttatcgatcactgatttttttgtggaacgacctagtaacaccgaggggaacaacttggtgggggggaggagtgacatccattggatatttctttatccaaaataattcatcattttttttatcaattttcatattaatttctgtcggcatttatttatctttttttgccagtatgataaagaaatttttgcagtaaattttttttaaagcgttctgtgcctaagtcattttataagacagttatgtttggcattttctgacaatcattgctgataaaagcaaataaagttttgaaaataaaataaaaatgcaatataaacaaaaattaaaaatacgcgaaatggaaattctttctatagcttttattataagaaataattcgtatttccaatgacatttttggctcagacaatggtattatgcaatataggaaactacgaatttattgacagaaatattaaataccaattatttgcttaagcttcctttcccgaatctattataaaaacaataagttcctcaaattgtaaagcatattttttttggggtccaatttaaatgcggggatagaaatacactggtaagattttgataaaattaactatttttgatttaaaatctgataataaaatattcgaacttcagagaatttttactattaattcaagaaagttttaaaatttgaccaaaaaccgcacaaaaaaacaaagcgattcaaagaagtattttaaatattcaaacatttttctcatctttcttttccaccaatcatttccataaatggcaacaaattgtgccaactttcagaatg

SEQ ID NO: 106530 - DNA, 242 bp, Heterodera glycines
  Promoter: Source sequence=SeqID_19467; Location=1332..1573; Strand=-; Gene=SeqID_84185
gctaaaagaaggcctctgatcagattatgaaactaatgtaatcttccgaaattcccacaattatatttattttatactaactcggctttaaataaaagccaggcaaaggaaagtattgcgaattgccttttattgggctcataaaatgcgattggacccttcatggaaattttttcaaaaacaaaacaatcaatcacaaaacaaaaaacaaaaacttgattgatatttctctattacagatg

SEQ ID NO: 106531 - DNA, 699 bp, Heterodera glycines
  Promoter: Source sequence=SeqID_30312; Location=223..921; Strand=+; Gene=SeqID_60727
tgggtatctgtcatccggcacccggacagatttggaaaattgagatattgggactccaataaatcgtaaaattttaatcattcaataggatcaacggaaatagactaaaatatgttaaataaatggttgtattaaatagtgacaacaatgacatttagataattccttcacaaatctctccgaaaatgtaaagcaaaaatattctgacttggaaaaattagaaattgtaaagaaatttttcgaattaaaagcaaaacgagtagcagcgaaagataaagcaaaattaaatgagcaaattaacaaagaaattgccaacgaattgggcacaggcgtgacaacaatttacacttggaaaagagaatttaatattggtgagttaaatggcaaaagttcaatgagtaattaatgaataagtaaatttattaatagcatttagattaaaacatttatttaaaaaagtttactgtaaaaaagtcaattaaaaaaacacaaaaaattgattaaaatatgttcaaacctattcctattgttaaatatgtgaaaatgacaatatataatagcaaaataattaaataaaatattgaagtattaaatgtaattaatgaataaattaaatctattaataacatttaattacaaatattttattttttaattaaattaatgcttttctccgtttgaatatgaattttaggaatg

SEQ ID NO: 106532 - DNA, 122 bp, Heterodera glycines
  Promoter: Source sequence=SeqID_32042; Location=816..937; Strand=-; Gene=SeqID_62355
cttaagttttacaaataaaactactaattttatcggaaattttctttttttctccggttttacttaaaatttggcgacaccctttttaagcccgaaaaggcatttaaatttgtgtcaaaatg

SEQ ID NO: 106533 - DNA, 329 bp, Heterodera glycines
  Promoter: Source sequence=SeqID_12835; Location=2492..2820; Strand=+; Gene=SeqID_76564
ttctaatttccaaattgagttacaaaaccctgactatttctctccttaaatacctttttgtttggttaatttataccttttaatattagtaatgacacatttttcaattttatttctgaataaacattcaaatgaaaaatacaagtgtaaaatagaaaataaagagaaatgataaaaagaaagtatgcaactcttttgatagatttgaaggcatatcagaattcttagagttccctttgaaaaaagtgagcaaacacacccagggaacggcttcacccttcggtccccaatccaaacactcacgcaccaggctgtgcattacaataatg

SEQ ID NO: 106534 - DNA, 87 bp, Heterodera glycines
  Promoter: Source sequence=SeqID_23265; Location=208..294; Strand=+; Gene=SeqID_53976
tgtaaatggaaattggaaaaggaaattccaaattcatttgaatttagcacggccaaagtttgtccaagggttggccaaccgggaatg

SEQ ID NO: 106535 - DNA, 581 bp, Heterodera glycines
  Promoter: Source sequence=SeqID_9644; Location=504..1084; Strand=+; Gene=SeqID_72180
aactgacactttttgttgtacgcaaatgcgtccccacattttgcttgttttcattttcctggttctttcaccactagtaattagagcagctgtttcctacgaaacccattcaggtttttcaactgtttttttatttgtttgtaattgtgagacacggttcattattattaattaatacggtttcaccacacttcgtttgttcttcttcccgaaatattcatcttcattaccactaagtgtttatcatattccttctttgaactgtccaaacactaatttattctgttgtctgttattgaatgtctatctgttatacctaattccatttgctgttaaatacaaacccatttcattgttgccaatttaccaaattacactttcctttagtacggtaaattctttcggttgttgcattgtattgttaaagttactgttgccttaatatccattcgaaaatgtggagaataaagacaatgcgcgaatttctttttttcgattctttgccgtcgatttccttcgatttaatattatttttttaaatttgattcttttttcaacacaaataactttgttaagcaatg

SEQ ID NO: 106536 - DNA, 86 bp, Heterodera glycines
  Promoter: Source sequence=SeqID_12588; Location=1..86; Strand=+; Gene= SeqID_76249
tttttaatcagaaaaaaatcatttaaatgcctcaaaaaatgaattgccatttaattgaagaaaaataaaataaaatcttgaaaatg

SEQ ID NO: 106537 - DNA, 165 bp, Heterodera glycines
  Promoter: Source sequence=SeqID_167; Location=3962..4126; Strand=-; Gene=SeqID_75821
atttcggccgttattgggctgaagccaatgttgattaactgttgcataggaataaaatttgaagaaaaattttttaaatttgatcaaactgtttcgccaaacaattatttttgcatttaatcactcttttccttgaaaaagaacaccccaacagcctcaacaatg

SEQ ID NO: 106538 - DNA, 631 bp, Heterodera glycines
  Promoter: Source sequence=SeqID_5133; Location=1..631; Strand=+; Gene= SeqID_57030
gagtaaaagttggacaaaatggtagacctggaagggaatcgaaccctcggcctttggtgcggtgatcggcttcccacccaaaccagtgctcttaccgtctgagctaccagaggctatctcccattaacgcttcccttttatggatcttttgactccgctttaagcgttttaaccgtccactagcttaatccttacaggtggatggacgatcgttcaatgagtttggtgagccttatactgtgaaagtggaaaaaacgcactcagtgaaaacattgaaatggaagatcagtcatgagattggcattttgcccaacaggcaaacactgagacataacaaccaatttgccattgtgcttaaggtatcttaacaattcgtacaaaggcaatttgtacaacacagggttggcttaggccgcagctttaggctttggctcaggccaaaatttgaggcttaggcttagacctaagtttgaggcataggctcgcacctaggtttgagggcttaggccaagtttgaggcttaggcttggccaagaattgggcttgcttggcctaggcgtaggctttatttgtaaaaaaattgttttgtacaagttaccattaactcattcttaaggacgagaaaaaaatg

SEQ ID NO: 106539 - DNA, 734 bp, Heterodera glycines
  Promoter: Source sequence=SeqID_10465; Location=2205..2938; Strand=-; Gene=SeqID_73674
ttaggaagagaggcatggcaaagcaacaccacaacacattgatgatggatgggagaagagatacatttgggagggtgtgaaatgggcggatggataagaaatagcggaacaaaggaaatggaaatatgggagagaaagtgaaggggggggacatgggcaataatacgcacacccactcatcacacaacagtcatccatttttagttggattatttccatttttgtaacggaaactttcattaattgatagcaaaataaaaaagactatactaattatgtactaaaagaaaaaagatgagtgaacggcaactaaaaagttatgatgttttaagcttggctcagatgcaactgacccctaccgcacaaaaagggcgtttcgcgaaaaatgcaatttgaacaaaagagagcggccatatcagtacagttcttgtgataaaaataattttcaattatttcaaaatgtgtttcggcctttaccataaacaggcaaagcaaaccaagttataattaagcttataaaaattaagtttttttaattttaaaaaatcataaagaagcagagaaaacttaaaataatttaatttcgcccagccgttgacccgccactgtacaaaagaaaaactaataaaattgaaaaaattgagatttttaaaattatttattaatcattaattatttagagaattcatttagtattattttattttttggactatatatgatcgtccgaaatg

SEQ ID NO: 106540 - DNA, 311 bp, Heterodera glycines
  Promoter: Source sequence=SeqID_12915; Location=892..1202; Strand=+; Gene=SeqID_76657
tattcctaggactaaaaaaagaagttgtttttttgttggatttaaagtaaatcaaataaattaaagctaacaacaagaaacatctctattaattatggaaatttgtgggtattttctcatcagcaaaaaaaacaaacaaaaaaaaaaacaatgtataggtgagataaggacgaaatttgtaaagtatagaaaatgaaggatttaaaggatttatgtgaaacaaacaaaaaaaaaaagaaagaaaattaaacttggctaaatgtaattaaaattttgaaaaattataaaaaaatttgaagggctctcgaatg

SEQ ID NO: 106541 - DNA, 177 bp, Heterodera glycines
  Promoter: Source sequence=SeqID_20344; Location=1..177; Strand=+; Gene=SeqID_50857
tttacccggccattttgctgctcgcccgcagcactctcaccatgcgtcgacaggactcctacaaaatttttgtgtttcttaaatcatctttaattaattcaaattttacctgtgtcgcttccacacagtcccgtctcagtctctgctgaaattttgttctggtgaaggagcacaatg

SEQ ID NO: 106542 - DNA, 72 bp, Heterodera glycines
  Promoter: Source sequence=SeqID_11150; Location=2621..2692; Strand=-; Gene=SeqID_74502
ttttggtcaacaaaaagtatcgcctatttgttgattattaatagcgtcttctttcaaaaaatagaaaaaatg

SEQ ID NO: 106543 - DNA, 1003 bp, Heterodera glycines
  Promoter: Source sequence=SeqID_44576; Location=59..1061; Strand=-; Gene=SeqID_72048
tgcacagccctccgtctctacgcaagcgcttttgtgaggtataaaatttctcaaaaaaagagatagacatttttctgggattgagtataaatttaaaaattccctcaaaaataaaaggtctattgcgcaccgccctccctatcatgctcgagagcatttgtatgtgtataaaatttatcaaaaaaagagatagccatttttctgggatagagtataaatttaaaaattccctcaaaaataaaaggtctattgcgcaccgccctccctatcatgctcgagagcatttgtatgtgtataaaatttatcaaaaaaagagatagccatttttctgggataacctctaaatataaaaatcctctgtgaaataaaatggcgattgtgcacagccctccgtctctacgcaagcgcttttgtgaggtataaaatttctcaaaaaaagagatagacatttttctgggattgagtataaatttaaaaattccctcaaaaataaaaggtctattgcgcaccgccctccctatcatgctcgagagcatttgtatgtgtataaaatttatcaaaaaaagagatagccatttttctgggataacctctaaatataaaaatcctctgtgaaataaaatggcgattgtgcacagccctccgtctcatacgcaagcgcttttgtgaggtataaaatttctcaaaaaaagagatagccatttttctgggatagagtataaatttaaaaattccctcaaaaataaaaggtctattgcgcaccgccctccctatcatgctcgagagcatttgtatgtgtataaaatttatcaaaaaaagagatagccatttttctgggatagagtataaatttaaaaattccctcaaaaataaaaggtctattgcgcaccgccctccctatcatgctcgagagcatttgtatgtgtataaaatttatcaaaaaaagagatagccatttttctgggataacctctaaatataaaaatcctctgtgaaataaatg

SEQ ID NO: 106544 - DNA, 381 bp, Heterodera glycines
  misc_feature (24)..(24): n is a, c, g, or t
  Promoter: Source sequence=SeqID_35329; Location=515..895; Strand=-; Gene=SeqID_64906
ttcattttttaaattgccattgcntcaggtcaaaattaaaattcgatttgcgtcggtcgcctttttcgtctttcgccatgaattatttctcttttcttattcttttgaatattatttttttgaatttggccctttcttccgcaatcgaagggacggcaaacgaagaaagcggtaataaattaattagaaataaaaattaataaaattgaaaattaaatatttttagttaaaagacaaccgaaaaagacatttaatgtttttatgaccaaactcaagaaataaaataaaagaagacaaattcacgagacgaaataaaaagaaagtaatgaaagatggacacaaaaacaaagacataaattttgatttaataccatcaaaatg

SEQ ID NO: 106545 - DNA, 1003 bp, Heterodera glycines
  Promoter: Source sequence=SeqID_1149; Location=8657..9659; Strand=-; Gene=SeqID_68760
tcaaaaaatagtcaaaaacaaaattgtcaaaatcagtcaaaaaaaaaaagagagagaaagaaatcacacattcaaaaatcattcaaacacaaaaaaaaaaaaacgttataactcacaaacaactcaattcaactgttattcaaactgtactggtccaatgtctacactgcgcaagatgctttcgagtattaaaatcctgacagtattacgaattattaatagaaaaacatttaaataattaactcaaaaaaaaagataaagcaacaattcaaaattatgcaaatcaatttaaccaaactcctgccaaattgccaaatttaaaaatagaccaattctccaaaatttcaatcatttcacaaacataaaatttaattattttcgatattcaaaattcaaattcaatatctttttaacaattaaaaacgcaaaattgcaaaatttttctcacgattaaaagccgattcataatcagatttaaaaaaagagattacttattccgtttttctcacgatacggcgaacaaatttcaatttaatgaaaattcacagcgctcattctttattgcgattaataaacatgatatgacttccgccaaagcacaatcggagaaccgacctttcgcattaatcactttggaataaaatgctaataattattattatgactgacaataactcattaaattaaaaaaaaaacacaagttaaagcagtcaaattttttcaattcaaaataatcattagtcattaaacaaatttagacaaaacaaaattatcatttctattcaaaatcaatcactctcgccctcaatccccgaacttttataaatttacgtttctttcacctttacggccacaaatcttcaactcgtcagagactttagagtctattaacccgcaaataaacatggaattcggacaaaataatgatgatgcgcgggtggaagtcgtagccatagaccgacaattttgggcgggaaaaacaaaagttacagtagcagacatg

SEQ ID NO: 106546 - DNA, 584 bp, Heterodera glycines
  Promoter: Source sequence=SeqID_9956; Location=1342..1925; Strand=-; Gene=SeqID_72998
ggtggcttaatggggtttttctctttttgctcgccggaaggcgggcgttttgctcgcgggaaggcgggcgttttgctcgccgaaaggcgggcgcattgctcgccggaaggcgggcgttttgctcgccggaaggcgggcgcattgctcgccagaaggcgggcgcatttctcgccggaaggcgggcgatctcgccggaaggcgggcgttagctcgccggaaggcgggcgttttgctcgccaaaaggcgggcgcattgctcgccggaaggcgggcgttttgctcgccgaaaggcgggcgcatttctcgccggaaggcgggcgttagctcgccggaaggcgggcgtttgctcgccggaaggcgggcgttttgctcgccggaaggcgggcgttttgctcgcgggaaggcggccgtttgctcgccggaaggcgggcgtttgctagccagaaggcgggcgtttgctcgccggaaggtgggcgttttgctcgcgggaaggcaggcgttttgctcgccggaaggcgggcgttttgctcgcctgaacttcgaaataaaccgcttatttttcagctttgctcgcatcgccacatg

SEQ ID NO: 106547 - DNA, 480 bp, Heterodera glycines
  Promoter: Source sequence=SeqID_44995; Location=702..1181; Strand=-; Gene=SeqID_72391
cccccaaaatgatcgaaaaaaaaattatcaaagtttcgaaaaatcaataagattggtcagattttaaaaactcataagtaggtaatgatattttatactctaaaaaatcccaaaaaataggcaataaagaaaataggctctgaaaagcctaaaatttagggtataaaattacaaatttttcagagtaacaaaattaagccaaagcagtattgagataaacaatttataaatgaattttggagatccatttttgagaaattgtgattcttagggatgctttttaaaacttttcgggtcgtttctcaggggtgtattttccgtttttaatgaatttttgttaattttgggcactaaatatcattcctatgaaaatcgtactaaattgcatattttcgctggtagttttattttatcgattttttctgataggtttgggtgtcagggccaaaaaggccggaaatttacaaaagcaataccatg

SEQ ID NO: 106548 - DNA, 106 bp, Heterodera glycines
  Promoter: Source sequence=SeqID_656; Location=2518..2623; Strand=-; Gene=SeqID_58303
catccggcacaccttccgtgacggcagtgatgagcgatccaatctgaaggtgcgcagtttccgcctctcctactccgtcgagcagctgctcaactttgacgccatg

SEQ ID NO: 106549 - DNA, 127 bp, Heterodera glycines
  Promoter: Source sequence=SeqID_26657; Location=1..127; Strand=+; Gene=SeqID_57409
tccttcgcttcgaggattttctttacgttcagaaattttatgtcaatgcatccaaattggctgcttcggttatttcgattatttctttgacctttcatccccactttttcagatttatttggatatg

SEQ ID NO: 106550 - DNA, 232 bp, Heterodera glycines
  Promoter: Source sequence=SeqID_21545; Location=1..232; Strand=+; Gene=SeqID_52160
ataaaatgaaattgtccaaattccatgaaatttttaaatatcagttatcatttttatgcaaaacttttatgacagttcaatgatttactgattaggaatcatttatttatttaaatgattcaaaattttgtgattttctgaaaattttatgccccaataagtggaagtgaacattggccaaattgctgggcccggctgtgccacccagaccaacaaataccatcgcaaaatg

SEQ ID NO: 106551 - DNA, 849 bp, Heterodera glycines
  Promoter: Source sequence=SeqID_8459; Location=2842..3690; Strand=-; Gene=SeqID_68146
tccccataattcacgagtgggatggaataataacctttattccgaaggtggatcatacaaatatgtgattgattagttggggaagggtgaaccgattcgtccggggcaaattgggggagaggtggaattggaagagttcgggattagccaattccccctcccgaaagagtgaatggtacaatgtgctggagggcagcaaaagacttaaagtgggcggagcagaaatgatcaactaatgagagattagggcatactgtacttagtaaaaggtctacggtaaacacaaaacaatgagctacgtcacaaggaaaatgcttaagaaattctttaaaaaaaagttcgccaaaataagtatattagagaaagttaagcgagactaacgtgaaaaatagactttttttgacaaaaatatttcaataaatcacaattaaatgaataaaaatttaaattccctggcgctggcgcggaattatacattcagtaaatatttttgaaaaatcgttagtcaaaaaacatcaaatggaaaatttttgacataaaattattcataacttcgcccaaaattaagcaaatattaagttcttgatatatttcggtagctctatgtgttcttttatccttcaaaatctcaaaaaaattcgttaagtttaaaaaaaaaaagttatgacccgaggaactcaaaaaaccggacatacaatccactaattaacatttgaattcaaaaattgaaaataatcattttacgtacaaaatctgttatcaaatcacgattaattctcaaattcggacccccatttttatttatttatttattttttttgcaaaattgacctcaaagtggcaaaaatg

SEQ ID NO: 106552 - DNA, 293 bp, Heterodera glycines
  Promoter: Source sequence=SeqID_11238; Location=1520..1812; Strand=-; Gene=SeqID_74596
ttgctgttgttgtcgctgttgtcgggctggctttgtgggtgcttgatgtgtgatcgttgagagcgttgcttgaagtgttgctgctgctgagtgaggagaatgtgcaaaatccacctccttatatacaaaattcgggtgcaaaaattcatgcatcaaaaaaaagtgtataaaaggcgacggttttcttcacttttcaccagtgccagccagccttcaactcaacgcaacatcaacaccagtgcgcgccaagctcgtctacacatttcgtcgcgacaactcatcacttcatcatg

SEQ ID NO: 106553 - DNA, 67 bp, Heterodera glycines
  misc_feature (9)..(9): n is a, c, g, or t
  Promoter: Source sequence=SeqID_37369; Location=621..687; Strand=-; Gene=SeqID_66459
ttttagaanattttatccgtcaaatcggcttttggaattttaatgagtaaatcagtaaccgtaaatg

SEQ ID NO: 106554 - DNA, 183 bp, Heterodera glycines
  Promoter: Source sequence=SeqID_416; Location=4963..5145; Strand=-; Gene=SeqID_51901
attgaattatctgtgtcttaagattttggcgcccatttttcatgctacaaatcaactccaaaaaaggactaccaaagtttcagtaacaattccagtgttccgtgtcatcatttttgccttagaaaagggggaagacctaagaaatgtcagaatttcaataatagatgggttgaaaaaaaaatg

SEQ ID NO: 106555 - DNA, 131 bp, Heterodera glycines
  Promoter: Source sequence=SeqID_22386; Location=319..449; Strand=+; Gene=SeqID_53056
tggcggcaccaagcccattgattttgccattaatcgccgactaaataattcacaaaaatgtgtaagaatttaaattgtttcttttaatttaaattttgtatagccaaacattcattgactgattaatgatg

SEQ ID NO: 106556 - DNA, 186 bp, Heterodera glycines
  Promoter: Source sequence=SeqID_38158; Location=1..186; Strand=+; Gene=SeqID_67058
attttatttattattacgcgcgttttacccatttaacatattaaattttctgcgccaaaatttcaatcgaattaaatttcatattaacttaattgatcattcgttttctcaatttcaaagcttttgcttcttgcggtctcctttgagttgccatctcttaattaggctccattttctgccaaaatg

SEQ ID NO: 106557 - DNA, 80 bp, Heterodera glycines
  Promoter: Source sequence=SeqID_18301; Location=837..916; Strand=-; Gene=SeqID_82893
ttacaaaatcccttttattacaaattgaacatgcggccatttattttgaaaattggcattttatagggggacaaaaaatg

SEQ ID NO: 106558 - DNA, 299 bp, Heterodera glycines
  Promoter: Source sequence=SeqID_1803; Location=1073..1371; Strand=+; Gene=SeqID_76067
ttccattccggtcctggtatgtcgtccgaacctttttccgaccagctccttcagtgccttcactcggtcctcaggatgattgagcttgtcgcggagtgatttcggggaacagccgagaatttgggcacaaaattcgatgacaaggaccattgtagcagaacaaatgagacatagctgacaaattgctggggcttttatactcccagaaaattaggccacgcccacttttgaaagctatttaagccgagattttctcacacaatcaaatcattcttgcaaaatcatcatcaacaaccatg

SEQ ID NO: 106559 - DNA, 288 bp, Heterodera glycines
  Promoter: Source sequence=SeqID_20386; Location=1962..2249; Strand=-; Gene=SeqID_50907
tcttgaaaagggaaacccgatttagacagggtcagtaaaacaaatccatatttaattttctttatcacaccccctttttgcatattttaatacaaaatgtataaacctgtttgacacaatgcgtttttgccgagtagacaatgaagaggacaaagtgaaaaaacataatcattctaatgctaaataaaaatttaattaattaaatgttaatatttttatatgccgaggaataaacccgtttctgtctttactcaatttaattgatttacaatccctcctctccctatg

SEQ ID NO: 106560 - DNA, 284 bp, Heterodera glycines; identical to SEQ ID NO: 103000
  Promoter: Source sequence=SeqID_37292; Location=644..927; Strand=+; Gene=SeqID_66399

SEQ ID NO: 106561 - DNA, 835 bp, Heterodera glycines
  Promoter: Source sequence=SeqID_10196; Location=5287..6121; Strand=-; Gene=SeqID_73308
ttaaggttttccaaaaaataaactaaaaagtctcagtaatattttttctctctgttgtcattttgaatttttttctatttatctgacacagaaacatacaactatttgccccccttaattaatttattttttgcaatttaattcattaaaaattttaaattatgtaaattgggtggcaaaaaaaaatttttttttgtagccagtaaaattggtaatgatcaaaatgggcaaaatgggtttgccaaatgtgcacaaatccatgagtttgctaggattattcctctgatcaaactccagcagcagttcatcttccctgcccttatttgttaggggggggtgatcaatttggggaggaccatcttcccccgtgggaatgggagggatgcttccaagcggaccttgcgcgggggatcaataaaaaaaattccatctcacgacggtgggattaatgggcaaccgatggacgacgacgattggtgctgaatggaatttcaaacataatattttcaaatattagcaatttagtgagccaatcaaaaccatagagggttcctaactaatttgttagcaaagccaaaaactatcatttattttccaaatgtgaacaattcgtgtcaatgttccatcaaaaatatatatgggtcaaattgtgccttctgttctctccaaataaatttcacttttacgtgcacatgtacataagaaaacgtgaaattacaaattacaattttgtgggtctaaaacgatttaacttttacgtacacttttacacaagaaaacgtgaaatacaaattacaattcatttttgggtacatttcacttttacgtgcacatg

SEQ ID NO: 106562 - DNA, 101 bp, Heterodera glycines
  Promoter: Source sequence=SeqID_24608; Location=1..101; Strand=+; Gene=SeqID_55350
atgacaaatgtttgggcttttatcttttgtgcttccctccgaaaaatggtgaaaatgggagaatttctaattgaattaattaattttgattgccaaagatg

SEQ ID NO: 106563 - DNA, 500 bp, Heterodera glycines
  Promoter: Source sequence=SeqID_17114; Location=1082..1581; Strand=-; Gene=SeqID_81554
aaaattaaaaaaaaatttttttttgttcttttttatcataattgttttaagtaacaaataaacggtgaattaggtatgtgtttattgggtacaattcagcgatttgtgaccacaaattataaaaaatatccggtcctccaaattgcttacgccacaaaaaatccgaaatatatgtggaaaaaagtgatctgtgactgccaaatctcactttatgctcatctttgaacttctgccacgtcgattcaattgtatttgtatgttgaccagtaacagaattgttacttaaaacaattatgataaaaaagaacaaaaaaaatttttttttttaattttgaccaaaatataggatacaaaccaaattagtacccttagggttgacggtgaaaggaattcctggtacttatatgggttcgtacgccacaaatttaaaattttataatcatctaaggttgcttcgaaagtcacatatatggttttcaggggcgctgaacacgattatg

SEQ ID NO: 106564 - DNA, 67 bp, Heterodera glycines
  Promoter: Source sequence=SeqID_5783; Location=2896..2962; Strand=-; Gene=SeqID_59209
agtaggaaatacgcttaaaaggagaaaataaatcgtcaacccccaatatttgttttaggcaaaaatg

SEQ ID NO: 106565 - DNA, 102 bp, Heterodera glycines
  Promoter: Source sequence=SeqID_25917; Location=713..814; Strand=-; Gene=SeqID_45965
ttgccaaattttatttcgcatttattttttcaaattccctaaattcatgtgaaacgacgggttgccgagacagtgcacatgcgacggatcttagccgaaatg

SEQ ID NO: 106566 - DNA, 263 bp, Heterodera glycines
  Promoter: Source sequence=SeqID_15404; Location=742..1004; Strand=+; Gene=SeqID_79670
gggcctcgcgctttcgggacgagaaaatgtcggagccatgcttttttcggggtcagctattatcagggttgggctagattaaaccagcaagggtgggggttcgagtttggcctaggagggccgggggggggggttactcagggctggttttttttttgatttcacaccgctttttgggatgagccttaaatattttatatgaaattttctaaaagatttcgcactaaaaatgatcaattttagaatttttggctaagataatg

SEQ ID NO: 106567 - DNA, 121 bp, Heterodera glycines
  Promoter: Source sequence=SeqID_36468; Location=1..121; Strand=+; Gene=SeqID_65768
cacaattttatttttaaaacccctcaaataaatattaaatatttatgaagcatatgactaaattgttaaacctaatattttaatgagcatttcttaatattttttgaaattatagccaatg

SEQ ID NO: 106568 - DNA, 328 bp, Heterodera glycines
  Promoter: Source sequence=SeqID_16111; Location=829..1156; Strand=-; Gene=SeqID_80468
ttgttttactaaaaatgaaagaaatgaaataaaataatcaatgatttttaatattgcattaaaaagttgaaaataaatttaatattgttaattaattaagaaattaattaattaggtaattactcgtttggttgcgccagtagatttgtgtacaacaaatagattgtgtataacggataaagcacagaaagaatcaagagaacggcagaataaaatttggcatttctttttctatacctaaaacaaattaagtaaataagataattaatatttctttattatgacaattaaaacaattattattatcagtttaaaaactgaccaaatg

SEQ ID NO: 106569 - DNA, 135 bp, Heterodera glycines
  misc_feature (80)..(80): n is a, c, g, or t
  Promoter: Source sequence=SeqID_29907; Location=1..135; Strand=+; Gene=SeqID_60365
ctttgcttttataatctgttttaatggaaataaatttcatttaattataatgtgatctaataaattaactttacattttnaattagatgcattatacgcattttaaacttcatgatttttaggtacctaaaaatg

SEQ ID NO: 106570 - DNA, 477 bp, Heterodera glycines
  Promoter: Source sequence=SeqID_6746; Location=1677..2153; Strand=-; Gene=SeqID_62727
aaattttaaatttttattacaaaataacaaatgttgatttctaattgtttttcttatcagaaatgataattacttaatgttttctcgattaactaggaaataatccaacattcattcttctccttcaccttattttattgataattttgttcatattttaatttcgatttttccacaattatttgctttttcaatcaattaattaaatcactccattactttttatttttatgttttacttttattattttttaaatcctttttcctcttccgcctgatgatcgttcgtctctcttttgtcgagagtgattaaaattaaaagggacggacggaatagtgaaaagaacgaaaacagtcattcttttattataatttactgcctgcccatttttcaataaaatattactttatttatacataaatttaggaaaaataattttttgaaatttattttatgaattttattttttcagcatg

SEQ ID NO: 106571 - DNA, 425 bp, Heterodera glycines
  Promoter: Source sequence=SeqID_11514; Location=1424..1848; Strand=-; Gene=SeqID_74939
ttttctcccaatggcatttagttatttatttttattaatttagcaattaatttttaagggattggtcaaatgttcctgtcgaattggaaccgctaaatgccgttccattaaacccaattgtgtgcctttggccaccgcccaaaattggccaatgttcaatgaatgtaatctctcctaagtttcctgaacaaaatgccgcgtttaatactaataaatttacatataaaacaatcagtgaggaattaaaaattggtaaaattaaaaaaaattttgaaacttttgaaataaaataaaattcagccaaagaaaaattaaaagaaaatcctcaaaattggaaaagaatttttgaaaaaataaaatatgaacaaaaattcaaacatttcgctgccattttctgttgtgaagccaatttggagaagcaaatg

SEQ ID NO: 106572 - DNA, 305 bp, Heterodera glycines
  Promoter: Source sequence=SeqID_27798; Location=1..305; Strand=+; Gene=SeqID_58460
tatttttattctattcatgaattcccgggggattttggggtcccttatcatgaatttgtcaggtatttgaccaatgccgatttcctaacctattttgcattgataaaattcaaaataatccactttttaactagcgcccattaatttctgttatttgaagcgtaagaattgcaaatttagcgtttgggagaaaaatttgcaattttaaaatttataattttaagcttactgttgttagcacacatttagtaaaatattttggcattttttaaaatccgttccctattaatcactcagatgcaatg

SEQ ID NO: 106573 - DNA, 402 bp, Heterodera glycines
  Promoter: Source sequence=SeqID_16632; Location=2111..2512; Strand=-; Gene=SeqID_81043
ttgtattgtactcaagcattgaaattggtcaaagtaaaaaaaaatggcaaaaataaatttaataaaataaattttcgtaaataaatattttctaacttttttttaaattttcctaattttttttaaccccattttttaaaagtaatttacgtcaattatttgtttaaattcattttgtttttgaaattaattatttagcaaataatatttctctttaagaattatgatttattaatttttaattatattttaattattaatgcatttttaaaaatttaattagaacacctttgtttaaattcaatttgtttttgtaaataaatcatttcgaattattattttttaaattttaaattttaaatttttttaatgttgctttaaaaatttaattagaatgccatg

SEQ ID NO: 106574 - DNA, 375 bp, Heterodera glycines
  Promoter: Source sequence=SeqID_10035; Location=839..1213; Strand=+; Gene=SeqID_73093
aatatctcttaggaaaaatttttgaaaatacctaaaattaaatcaaaatctgaattgatgcgcgagtggttaacagtgagtttcactgccgaaaacccttgagaaattttgatttgaaattgcaaaaacaagcgatataatttatgaggaataaaattttttatttattttttttgtgcatatttggcaattttatttgcatatttatgtacatattttggtcatttttcgtgcatattttttgcagccctgattattaataataaaaatttaaatctattatataaacgaacataactatcgcctttttcccaaaaaataaattttaaaaacacaaattttgatttttaaatttagcaccaaattttaaaaatg

SEQ ID NO: 106575 - DNA, 428 bp, Heterodera glycines
  Promoter: Source sequence=SeqID_45310; Location=1..428; Strand=+; Gene=SeqID_72631
ataataaataattaatgaaaaagtcagaatttcgaaaaattttaaaaacaacaagcgttggcattttttcaggttaagttagtcctttacaatggagaaggcctgcaaaatttggagagattatatcgattttagtgcgctaggttcgatgaaactttttaaaatataagcctaaactttttggcctgtttaaaaaggaattaaaaatttttaaaatatttattcatctcccttttgatagaaaaagcatcagagagccttatttaacttttaattaacatttggtgcgtttcagagcactttctgaaaaaatacttatgaattaattttgcaaaaaataaataagtaatgaaaaagtcagaattttgaaaaattttaaaaacaacaagcgttggcattttttcaggttaagttagtcctttacaatg

SEQ ID NO: 106576 - DNA, 229 bp, Heterodera glycines
  Promoter: Source sequence=SeqID_18487; Location=944..1172; Strand=-; Gene=SeqID_83103
atattaattaactaattagttaattaggtgtcacaatttttcaattaataaactcttaaaaatgggggaagcttttcaattttatttatgcttgctaaataagccaatatttcattctgctgcacagatttggacactttcaatggcattccttcggttgtcgtcggcgccagaaaactgagcgaggaagaacggacggaatgcgcaatttgcctatgccaaatcgatg

SEQ ID NO: 106577 - DNA, 494 bp, Heterodera glycines
  Promoter: Source sequence=SeqID_29631; Location=1..494; Strand=+; Gene=SeqID_60109
agataaacattttttggtcaaagaaattttttttgtttgcgtttcaaatatcgtaagattgtttgatagggccagacaagagaaggcaactgttggtatcaattttgcggtaaaaaaatgagaaaaaagagataaccatttttggtcaagaattttttttgtttgcgtttcaaatatcgtaagattgtttgatagggccagacaagagaaggcaactgttggtaccaattttgcggtaaaaaaatgagaaaaaagagatagacattttttggtcaagaattttttttgtttgcgtttcaaatatagtaagattgtttgatagggccagacaagagaaggcaactgttggtaccaagtttgcggtaaaaaaatgagaaaatagccattttttggtcaagaattttttttgtttgagtttcaaatatcgtaagattgtttgatagggccagacaaaagaaggcaactgttggtaccaagtttgcggtaaaaaaatg

SEQ ID NO: 106578 - DNA, 138 bp, Heterodera glycines
  Promoter: Source sequence=SeqID_43133; Location=1..138; Strand=+; Gene=SeqID_70883
aaatttgggacaaaactctgggcggaggcagctctgtcgcgctggtcagatcagatgagatggctctttgtgagcatcctggtctatggccagccgagtaatgccatagaattgtggaacaagtacaaagaccaaatg

SEQ ID NO: 106579 - DNA, 566 bp, Heterodera glycines
  Promoter: Source sequence=SeqID_28765; Location=131..696; Strand=+; Gene=SeqID_59338
ttggcggccatttcctttttaaaagtttccctttattttcaggttcctgtacatttcctttgtgagtctgcatttttttaaaataaattccatcgccgcaaattttttttttatttttcataaattttggtctttaattgaaatttttgaaaaaattttgtacaaaattccattgtactaactaccatgccatcacaaagcccatttgaaaaaaacttgttaagaaaattcagggaataaaaaaaaattgaaaacatttttcttgaaattttgagcattttatttttgctcttcgagactcgttttttcgccgtgttattttcaaaaaatgcattttcgtggcacagccggtgacagtttttgtggaatttgtttagattttgctccttaaaaagcaatttgcggtttttggcaaatgggttccccactttttgccttttatgtgcttaatgatcctttcaactttcccgataacatttaatcgcttatgagactgttaattgatcagtttttccctcctcttcgctccccaggttttcatgataccgaagatgaaaagggccatg

SEQ ID NO: 106580 - DNA, 492 bp, Heterodera glycines
  Promoter: Source sequence=SeqID_40579; Location=433..924; Strand=-; Gene=SeqID_68862
aaggttcgccaaaatgttttaagccgataattcatttaaaaagtactgcaaaaatccaatattgtttttcttgatatcatataatttaactatcgaaaaatcggtttcatgtcagttcgtacaattggcagtttgttagatagaattaatacaatttttttaagaattttcaactaaaacttagaatttttttcaaaaatcaaataaatttagtttcaattttaaacatttttatgtttttttaatttcaaaatttattttgattttttaaaaaaaaatcaatgttttaattgaactcttaaaaaagagtgtttttttgtacgaaaattcattgtacgaaagaactggctattgactccgaaatatcattaaaatccctgctccccttttttaaaataatttgtttaacgaaaattatttcataaaatatttaatatttaaatttaacaaatcatctccatcattggttatttacaggtgaacgaactcatg

SEQ ID NO: 106581 - DNA, 1003 bp, Heterodera glycines
  Promoter: Source sequence=SeqID_15623; Location=389..1391; Strand=+; Gene=SeqID_79911
tttggaaaattggctatctctttttctgctcaacagtaattgttagagaaggaagtaattattgattaggtgtatgaccccacgccacttcgccatcttccccctcccattcccctcattcagttgattattgtgcccaccaatttgacctctccaatttattctctgcattaattattttatttatttctccggcaaataaacttatttaatttgttatcttcggacataacaaattttggcgcagtcagcaactcaacgacagcgtttattttccaagctttatctcgtgctgatattgcttgtggtgattcatcataaaccgatctttgccatattttacggcacggtttatcaacaatctgtgcaactaaaccgcatcttctatctctttttctgctcaacagtaataggaattccaaccgcattctcagaataattacgccgatactaattgttctggaatttgtttctcggcgcgtttgtttgggaaaaatttggaaaattggctatctctttttctgctcaacagtaataggaattccaaccgcattctcagaataattacgccgttctggaatttgtttctcggcgcgtttgtttgggaaaaatttggaaaattggctatctctttttctgctcaacagtaataggaattccaaccgcattctcagaataattacgccgatactaattgttctggaatttgtttctcggcgcgtttgtttgggaaaaatttggaaaattggctatctctttttctgctcaacagtaattgttagagaaggaagtaattattgattaggtgtatgaccccacgccacttcgccatcttccccctcccattcccctcattcagttgattattgtgcccaccaatttgactctccaatttattctctgcattaattattttatttatttctccggcaaataaacttatttaatttgtaaaaagggcatcccgatttatgccgcgagccgcctgcaacgctggtcaatg

SEQ ID NO: 106582 - DNA, 645 bp, Heterodera glycines
  misc_feature (19)..(19): n is a, c, g, or t
  Promoter: Source sequence=SeqID_1518; Location=4909..5553; Strand=-; Gene=SeqID_74152
ttttctaggtttttatttntagagcctaaaaagccaaaaaaaaatttaaaaaaatttattttgaactattttggtgttttgcccaaaatttgttaacaaaaatgcaataaaaagcaaaaatagacccctaaggatcggtctaaaaatttttcaaaaatacactcctaagaatcgacaaccgaaaattaaaaaaaatacacccatgagaaataaaaaattttctcaaaaattcatttccaaaattatttatttatttcttaacaagaatttgtgtttaaaacattatttaactcaatactgattttgtagaatttttttacttttttgaaaaattttgtcattacactcctaaagttgagactttttagtgcctattttgggggtcttttagagcctgaagcctacctaccgtatttgctctttttatatgccatggtatattatttttcaacctcctcagaagggggtagataattggagattggtagactaatggagactgggagattatttttcgatgatttatttagtggaaaatttttttgaaatttattttgaacatgtcgccaaaaaatgtcatcgcgtcaaaaaaaaacatttttattgcatttatgttaaagaacttctgaaaatgactccaaaatg

SEQ ID NO: 106583 - DNA, 669 bp, Heterodera glycines
  Promoter: Source sequence=SeqID_20464; Location=1..669; Strand=+; Gene=SeqID_51000
tgtcttgctgaatgtaattctcccacaaatgtttgttgttctatttaactatgccatatatatgtgtatttttaataattgtaatatgtttgccctgtttatccatgttttatggtcatttattctcattgccgaataaaaacggtaaaaaaagtggttgaagtaccgagtcaaaagctctttctattcgagatttaattgagacgagtcgggatttgttgcttaatgatccaatcaatcgcaaaatgcctttgtcattttgcatttcgacctcccttttccgtcattctctgttcctttggtcgggaagggtactgataaaatcccgatccatgtcgaacccgagcaattaaaaaaggatcggatacagaggtcggaattccggattaaaccttttcgttttttaatgcttacaaaacattttccatagctttttacaaagactttttctattctcagagattattaaatccaatttccaattgaatttttaagtaccatctcaattggagccattcttatttaggtcgctattttgctcgataattaataaaaaaaaagagtaagaattaagaatgagaaaaaatgaatagataaatgagtcaattataatattttcttttgctcttctccaatttttgagtcatcattttgctccttgaaaaaatg

SEQ ID NO: 106584 - DNA, 299 bp, Heterodera glycines
  Promoter: Source sequence=SeqID_10334; Location=3408..3706; Strand=+; Gene=SeqID_73518
actgtgggacaaaaacggagagtgaattaagggatgaattgaaaatgtataacattctattaggaaatttcgacaaaaaatctcaaaatttcccacggcggcacctatcggcaccgcccggacccaatattcctataaaattttcaaaatttgacccaaaaattgtttaaaatggcaaaaaaatccctaaaccattttttgatagaatattttaaaaacggttaaaagcttttggaccgttcatatcaaaatcacttggggggaaaacactcactgtgtaaagactgccttcgaaaatg

SEQ ID NO: 106585 - DNA, 302 bp, Heterodera glycines
  misc_feature (34)..(34): n is a, c, g, or t
  misc_feature (85)..(85): n is a, c, g, or t
  misc_feature (127)..(127): n is a, c, g, or t
  misc_feature (209)..(209): n is a, c, g, or t
  Promoter: Source sequence=SeqID_33639; Location=659..960; Strand=-; Gene=SeqID_63644
cgacttaaagtgaaaattaatatgcatttaaaanttattatttaatttactttttatttttatataaaatcgctaatttaatatntaatttgaaatttatttttaaactttttatgatttattagtntattaaaaaattatttatttttcttcaccgataaaattgtaaaatattattctttttaaatatatttttattttataaattntaatataactttctctacgatttaaaatcgtataaaataataattaattaaattcatttgcctattaaattttgcagaaatatcatgagaatg

SEQ ID NO: 106586 - DNA, 276 bp, Heterodera glycines
  Promoter: Source sequence=SeqID_27078; Location=189..464; Strand=-; Gene=SeqID_57794
tatttcagtcccatccctttaaacagatcttcaaatggcgcattttcatcgatggtccgccggatacaccatagtgagtgggcggcggcggcagaggaaaagtgcaaatcaatcaaattaattgtttccccattaatccctcctctcccctttttttagcgcgggatgcacgtttacggcactgctcaaattcccagcttcgttcccgtcttatccgccaacaatgactttcctcaccgacattcttcatccgaacagtaagaaaagcgcgcaatg

SEQ ID NO: 106587 - DNA, 362 bp, Heterodera glycines
  Promoter: Source sequence=SeqID_43305; Location=639..1000; Strand=-; Gene=SeqID_71005
ctccataactttgtgagttcggcacggatcgagaccgggataagaccattggaaagagcagctcgagctctacaagaaggtatggaaagaaaaaatagttatttctgggactttttcagaaatcagaattaattctccaatgtggcccaaattttaggcccccagccacagccccttgcttctcccagttttaagtcttggatttgtcaaataaattcaagacttcaaattaataatcaaaaattctcttaaaatttttttgaacccaattcaaaaaaggaaaaaaatttgcagtcaaaaaattattcgaatttctccaattttgtttccataatttccgaaagttattcggtatcataatg

SEQ ID NO: 106588 - DNA, 249 bp, Heterodera glycines
  Promoter: Source sequence=SeqID_8970; Location=4555..4803; Strand=+; Gene=SeqID_69850
aatctgctttgtttaacaacgattatcaaacggaatttattagatcaaatgaacattttttgtttttattaccaatttattatttgcaatgagcttttgattaaaaatgactttattaacaaagtgaattatggggttctcaactggtatttaaatgatgccatttttattataatttaacacacattggcattttctatttttatatacacactaattaattaaaacttgttagcatcctcaccaatg

SEQ ID NO: 106589 - DNA, 368 bp, Heterodera glycines
  Promoter: Source sequence=SeqID_20386; Location=438..805; Strand=+; Gene=SeqID_50908
tggccgatcggattctgcgccacggcaatgtagagatgcagttgtgcaaactgctctcgcatcgttaaaacggactatttcgtcatcgtcatcatcatcggcatccccaccacctgaggaatcattgcccgcagcatcgtcgccaccatcaaaaaagcggaaattattgtccacttcggtaccaaaaggcttatcggaagtggacagaggtactgtaatgcttatttattattattatttataataaacatttgttcattttttaaagattgttcatatagatgccgcctctttgacaattgccgcattcaggcagatgaaacagctgctttccgaatggagatgggagaacgattggatcagaaatg

SEQ ID NO: 106590 - DNA, 105 bp, Heterodera glycines
  Promoter: Source sequence=SeqID_13031; Location=1864..1968; Strand=-; Gene=SeqID_47099
ttttcgtacagaaacaagcaggtgaaccacgcccgaaacatttgggaccgggcggtgaccattctgccgagggccacgcagttttggctgaagtactcctacatg

SEQ ID NO: 106591 - DNA, 107 bp, Heterodera glycines
  Promoter: Source sequence=SeqID_30848; Location=1302..1408; Strand=+; Gene=SeqID_61243
aggagccaaagcagaaagtcatagaaaagcagcagaagaagagcagaaaaagcgcaaaaattcgcactgatagtatctatgttggcactgttatagaaaatgccatg

SEQ ID NO: 106592 - DNA, 878 bp, Heterodera glycines
  misc_feature (59)..(59): n is a, c, g, or t
  Promoter: Source sequence=SeqID_8301; Location=1..878; Strand=+; Gene= SeqID_67628
ttttgtgatattttgcgctattcttttttcgtttttctaaatgtcaactcagaaatgcncaataccttcacaaattctttctgttttccttggcaatataaacttttaaattcatcaaatctttcaatgaattctttctttttctgttcataaaaactctttttcatcattttatttttatttaaattcatttcttttttcatttgtatattttttttttgcgattttgcgcctaataatttaccaatttttgtctcaattctgcttctgttttcccaaagatattttccaattgccttcaatttctctttaattgcatcaaactttgtgataatttgtcttttaatatttatacgaaaatgattttatttgataatgtattgcatcaaatattatttaatttaactataaaaaattcaataaaaataatttatacatggcattttttaatgccatatgacaccgtcaaaaaataataattttaaatttttataatatgaaaagtttgaattcattttatttactcagccattttctgccttttaaatattttattaaaatccagcataaatggcattcataaatttgtttgattagttgtattggtaattctcaattatatttcactttcattaatttcatcatttgatttaaaatttaaaaaaaatcaattttattcaataaaaatcttattgtgataataaatgcattatttttaatttttttatttatcttaatttaaagaaataatttagcaatgaatttacttcaaattttcttatttattgttatgataaacgcacttggttgttcaaatggtattaaatttaaaataaaaaaagtaaatattaatctttctttctagcccagcttaaatg

SEQ ID NO: 106593 - DNA, 264 bp, Heterodera glycines
  Promoter: Source sequence=SeqID_39859; Location=1005..1268; Strand=-; Gene=SeqID_68336
aaaagaaggaaaacaacgaaatgaagagaataaaagtctttaattgaaaaatattataaaataaaagagaaaataaaggaaaaaggaagaaaatatccaagaaaagaatggagtaaaataaacacgaaaatagcgaagaaattggggacaaatcgcacatatatccaacaatggaataaagaatttggtcttcaaaaaattaaatgctataaatcaaaaactgatgaacaaaaacttgaaattgttcagaaatttattgaaatg

SEQ ID NO: 106594 - DNA, 73 bp, Heterodera glycines
  Promoter: Source sequence=SeqID_16189; Location=1..73; Strand=+; Gene= SeqID_80551
acgccgggaattcaaacaaaatacacaacggaatggtaaacatggaggaatcgacattctttgcaaagcaatg

SEQ ID NO: 106595 - DNA, 878 bp, Heterodera glycines
  Promoter: Source sequence=SeqID_9750; Location=870..1747; Strand=+; Gene=SeqID_72577
tgtcgtgccatttctgagttttttggacatttcatggaccttaccgaccctcccccccccctcacatcggcacttttttgccaaaaattccgacaattcaaattttgaatcctaaatagaagaaagaaaaatatataatgaagaaaatattgatagagagagtgtgaggaggagagagggaggaagagagagagagtgagagaaaactcattaagcccaggagaattatcaaaaaagattatattaaagacatttccggagttaatgaatggccaaaccaatcgttggcgcgggggacagtcaaataaatggacaaagtcgccccgggggatgtaattaaataataattatccgtctgtccttttttttggtttgttttttccgcgtggtgccattcaaaaaagcattacccttactctttaatgaacactggcagaaaatgataaattacttgaaaatttaaatttaaataaattgtctttctttttttccctaagcattgattaaataattatttctccttccccccccccccctccgttatgcttttgacacgttttgaatggcttttggaaagtgttcattttttcttctctctctaaaacaaaaccattttaatttactataaaatggggaaagtttaatacaaatacaacaaatgattaatggaaaacttttttcacattttcatatttatttataactggcaaaatttaaaatattattttaaatgtttttttatcggaaatttgccactttttacagccaatcactggcaaattcaaggtaaaggaaatattgtgtcaatctcttcatctcaatttgatcagcaaaacattcgttttgtttgcaattttcaaagaagaaactaataaatg

SEQ ID NO: 106596 - DNA, 501 bp, Heterodera glycines
  Promoter: Source sequence=SeqID_604; Location=154..654; Strand=+; Gene=SeqID_57368
tctgaaaacggaatgctgttctggcgttatatatcggttgaagtgtttttatggttttcctgagcatattcggtcgctattcaaacatctaaaattgaagtaaagtgaaagaaatactcctctccctctagatgaaaagtgacgttcaaaattgaaaaggattggagacgaaaatgttattcatccacttaaccctcagattccaaaagctgtgcatcagtgtatttgatttatagtacaaacataatgccaataaaggaaaataaatttttaattctttttttttccttagctagtgtataaaaggtggaccatttttgagttcttcatactaacattttatgcaactacctattttcttttgccgaaaagtgaggggcgccatcggtattattgttattatttcgaccacttcatttaatcgcttcatatattcgtttaatcattttttaatgaccattcctaatttagccaaatattcaaatataaataaaaccaatg

SEQ ID NO: 106597 - DNA, 199 bp, Heterodera glycines
  Promoter: Source sequence=SeqID_8347; Location=589..787; Strand=-; Gene=SeqID_67757
ttgaccaggtacacctcgcacaacgatgggttaaatatcacatggaaactcaatttcctggcctcgaataaattaaccctggaaatctcaaagaaattaaaaaagattttctactaaaaattgacaatttttaatcaattttcctaacaaaatgcattaaaggctaccttatttttttgaaattttgaccccacaaatg

SEQ ID NO: 106598 - DNA, 1003 bp, Heterodera glycines
  Promoter: Source sequence=SeqID_14471; Location=885..1887; Strand=-; Gene=SeqID_78515
cattttataattggtagttttttcgattttgaaaataattttagaaaattaaatgattattgaaaaaaatatttctaaaaaataaatcatttaaaaataaacaaagctttctttttctcaaaaaatagcaaaaactttataaaattaaattttttttttcaaatcctttttttccttatatttagttctttccaatatttaatattagagttgagcgggaccgtgaattttgggcttaaccgggaccgggaccttttcgggttgaaaaaccgggaattttttgctgggaaaaccgggaaaaaaccgggactagtcccggtcccggtcaaaaccgggacttcagtactcagttgtactcagttgtccgtattcgggtcccggtcccgctcaactctattttatataaattaattctgtttataatttacattttccaaccaaatattttaaaacaattttatattctcaatgaaatattttatttttatatttttcataaaattttgcttacgtaagcgtataatatttattatttttaataataatagtaattagtcgatataaccaaatacaaaatttaattgtatgaattttcgcattggcaaattcatagaagcagaaaaatagtaataataaaatgtataatttatatttaatattgcaaatatatttaattgttgtctagttttgtttgttgtttacatcaaatttgctgcttataacattaataaattcaatatgatattattactttttcactgttcgacagaatcacaaatttattcattttcataaaataatgaaaaaaaaaataataaattcttttttttaagtattcatttattcagaaaataaaaaataaattcatatttatatttttttaatttaaaaaaatctaatacaaattaaaatgaaattcaaagtcatatctataaaatatatttttatttattaaatatattttttaagcataaattttagatttcaatatttggatgtaatg

SEQ ID NO: 106599 - DNA, 214 bp, Heterodera glycines
  Promoter: Source sequence=SeqID_3918; Location=1..214; Strand=+; Gene= SeqID_52444
ccataattagtttgagtaccccaaacggacacttgaaactatcgatttttttatttcataaatattttttcagaaaatgctctgaaacaaaaaattttcaaaattctgagtctcctattattttatttttttttcaaaattttgaagggcgggggggggggcgacataagggatataaacatgaaaatagactttttatcaaatcgagtgcatg

SEQ ID NO: 106600 - DNA, 797 bp, Heterodera glycines
  Promoter: Source sequence=SeqID_24191; Location=679..1475; Strand=-; Gene=SeqID_54903
tattttatttccatattttagcatttttccataaacctctatgagaagggcccccagcagctaaattagcctttttgagcccaaaaaccgaaaaatttttcaaaaaaaatcattttttcgccaaaatttctcgagaatattgaataaatttaaattttcttaaaaattaataaatttatgtcaaaaataagcaaaaaagcgaaaatttcgcttttgttgttgattttgcgctaaaaaaattaataaattttagctttcatgtttttttttcttataaaatgattgcacagaattgccgaaaaaattcgagaccaatttccgaatgttgaccgactaattgccaaaacgaaagccgtctttgtcaaagcgccttaccgagtcaaaaaatttggaaatgtatctcatatgcaatttcaaccaataaatttgaagaaattttgcactcaattttgaaaaatttatgtccatattttgagatttttgccattttatgtccatatttcgcgatttttggtccatattttgcgattttatatccatttttttggcatccctactaattatattaaaaattcattgatttaaattcctttaatccaccgaacactaaatgcacttaaaaaattgaaacaacaattagttgagtaaaatgttattatatatcagataagaaatagacataaaaagcacaaaatttgataatcaaattgattttgtccctaataattaatttgtgtaaaaaataaataaataaatgacgcaccattccttatgaccttgatgtgacgtaaaaaatg

SEQ ID NO: 106601 - DNA, 80 bp, Heterodera glycines; identical to SEQ ID NO: 101884
  Promoter: Source sequence=SeqID_5045; Location=3844..3923; Strand=+; Gene=SeqID_56701

SEQ ID NO: 106602 - DNA, 425 bp, Heterodera glycines
  Promoter: Source sequence=SeqID_6244; Location=1..425; Strand=+; Gene= SeqID_60859
tttcaaagagtgacgaatagtttgtgaattatactatatcactctcatattacaaacaaataatgccaaattcttttttgatgggaatcatataaaaaagcagacattcatccgctttgggttttttaaacacacttttgacccttcttcattctccagcttattgggaaaaaagagggagcccatcaatgaatgcatttcataaatgttgtccagaaaattgagggaggtaaactcaacacttgagggattatggttaacgatataatcttaaagatcatagggatgctttaattttggatggaagatttagaatggatgttaaaattaatttttaaaaatgaactaaaacccactggtctaaaacagcaaaaatatttcttaattttttagacattcctcacttccaaacggtcataataatg

SEQ ID NO: 106603 - DNA, 1003 bp, Heterodera glycines
  Promoter: Source sequence=SeqID_20855; Location=473..1475; Strand=+; Gene=SeqID_51437
aaatagaaaaaatttttggcctgagcgggacatttgagtcccgggcccataactcgttaggggttggttttatcgaaaaaacgcattagggcaaaattgtagagttttttaagctctatcgaatggtgtgcatatggccggaaattttcaaaaattttcgagctaggccccctagaaattttcggaaattttttttgggttgaaaatgggggtcaaaaatatttttctggggtattttgatgtgctgagcacgaatatgatgtttatttttcgtttcaaaatttttggaattttttaaaaattcaaaaatattttccaattttttggcccacgggattttgggcgaatattgaaaaattcatatctagcctaaaggttgaccaattttgagcaaataaagcccttaaaaatagagaaaaatcaggagaattttatgggatttatttgggttttctaacatcaatatgaaaggaagttattccagaaaattttgaaaattttagatttttcagaaaaaaattcagaactcgcttctgaaaagtcattctgtaaaaataataaactacaaaaatccgcaatttttttctctataatataaattttattttacatttttatccctttttaaaaaaaagctcccccccccccccccacaatgttcccaaaaagttttttggaaccgcccacaaaaacgcgatttaaaaaattaatagattgttaatttattcaaaaaaatccagaattttgggactcagaaaatccaagattcccccccccccgcatgaaaatttaaaaaaaaatttctatataatggaaaaattcttcgaatgcctcccccaatgagtacatattttaatataggcaattttcgtaacaaagtgcagtcaaattttcaaattttttttcaaaaaaactttcacttgggaaaattttattgattaaattgaaaattttgaaaattttgtttttaaatgcgtggtccgcggccgcggcaatttgaatg

SEQ ID NO: 106604 - DNA, 167 bp, Heterodera glycines
  misc_feature (15)..(15): n is a, c, g, or t
  Promoter: Source sequence=SeqID_6036; Location=3848..4014; Strand=-; Gene=SeqID_60099
ttcccttgtttctcncatttttgctaccaacaaatgttggatttggttgacaaagaaaatttctaaccttttaccttatttaaggccttagtttggactttttcgcgcttaaaaatccgttccctagtcatcattctcggcccaattgtgctaattgccaaaaaatg

SEQ ID NO: 106605 - DNA, 473 bp, Heterodera glycines
  Promoter: Source sequence=SeqID_1535; Location=5891..6363; Strand=-; Gene=SeqID_74315
aaaaaacattttaaatgaataatgggagaaaatttttcctatttatagtcgaacaaattgaatttagttataatttatttaattttataatttatttttatttaatttaactttaatattaatttatttttaatttaatttactttaattaattttattatgattttaatctctttaattaattttatttttattttgaattttattttgaattttatttttattttttatttgtttaataacaattttttaattgttttgcgaacattaataatattcgatgatgaggagagtaaaagtataataaatgactgtaaaagagataggacaaaatgggagagcggaaagggttagagaggaaatagacaacaggaagggcactgggaaaagatacagtgcgcaaaaggatagagaaacgataatgtgagaaaggatagagggaaagtgacagctggaacggacagagcgaaatg

SEQ ID NO: 106606 - DNA, 423 bp, Heterodera glycines
  Promoter: Source sequence=SeqID_43620; Location=1..423; Strand=+; Gene=SeqID_71239
tttatgaaatgacagaaagtactttctaacctgtatttcttgtcttttgttcttcttcctacacctttccatgcactaacatacctacctaccttacattcctctcggaggaaaacaatcgagtggaccagaatccgctaataaaaaaataaaatactcggccttaaaaacaacataatgtgaataaaccaaagccgaaactcaacgaagccaaattgtttttcgaagcacaaaattaaagtccaaaaagtctcaaaattttctaagcccgaaactctgctgccccatgttttaagcgtaggccgattcacccacacagccaaaagtgtatcatcatcgtcattttatacacgaacactcaaattaataacgtatctctccatctgtagaagactgagtaacgatacatttccggtgcatatg

SEQ ID NO: 106607 - DNA, 426 bp, Heterodera glycines
  Promoter: Source sequence=SeqID_24369; Location=1..426; Strand=+; Gene=SeqID_55092
ttcattggcgaaagaaactcaaaaaattgaaagccaatctttttttaagcatttcttgtgaaaaaaatattgaatccaaaaaacgaagtccctttcttgtttggcattttcacggaatatgggcgcatcccctcattcattcattcatcaatgcccacccactcctcaagaggaaggaatggtggaagattcttagatttgggcaacgcgcacttctcttcccccccccccccccctccctctctttcttcctctctcttcccatcatctattcttcccctctcacccttattccctcacttcgcagacttcaagccctgcaaaaacctgggcgacaccgaagaattcctcctgcaactcgaacgactcacacgcgaactcaacaatacaggagaagacatcgaaggcccaccgaccttcctcatg

SEQ ID NO: 106608 - DNA, 799 bp, Heterodera glycines
  Promoter: Source sequence=SeqID_14639; Location=344..1142; Strand=-; Gene=SeqID_78734
ttttcgcgtgagggccattttcgcgtggccattttcgcgtgagggccattttcgcaaaattttttaattaatttataaaaatccagaattttgggactcaagattcccccccccccccccccgaaatgaaaatttttaaaaattttcttcgaattcgtcccccaaaacgaaactacaatatttatgggaacatttttgaatattggcaattttcgtaacaaagtgcactcaaattttcaaaattttttcaaaaaaaattttctcttgaaaaaattcccggttggtcccggcttttctcgcggtcccgatcccggtcccggtcaaaaaagttggtcccggtcccgacttttctggtcctggtaagtaccggtcccggtttttgtcaaatttcccggtcccgaccaactctagttataccaacctaaccttttaaaaagtacgaattagaaaatgaaataggaaaatttatcatacctaatactaacaccaaaatttcttattaatttttaaaaattctcaatagtgtcgaatttactcactgtcgaaatggtccagtgtcgaaaatgctggaaaacagtgaaagtttttgaaatagttcagtgtcgaaatttctctatgtcgaaaacgtagtgtcgaaattacttagtgtcgaaaatactcagtgtcgaatttacccagtgtcgaaattaccagccaccggaaaatttgtgggtgatggattgcttgagaaattaaaaaatggcggataacaatgcttcttctgctggcgttaaatcccttaaaatttagtgatgaaatg

SEQ ID NO: 106609 - DNA, 222 bp, Heterodera glycines
  Promoter: Source sequence=SeqID_29184; Location=887..1108; Strand=-; Gene=SeqID_59722
atgtggcccaattttaggcccccagccacagcccctttcttctcccagttttaagtcttggatttgtcaaataaattctagacttcaaattaataatcaaaaattctcttaaaatttttttgaacccaattcaaaaaaggaaaaaaatttgcagtcaaaaaattattcgaatttctccaattttgtttccataatttccgaaagttattcggtatcataatg

SEQ ID NO: 106610 - DNA, 1003 bp, Heterodera glycines
  Promoter: Source sequence=SeqID_10815; Location=2065..3067; Strand=-; Gene=SeqID_74085
aggagaattttaaaaatgtgctttttacaacaactggcaaaacaaaagtgaaaaaaagcaaaaccaaataggtaccaacaaataatgtagaaagtagaaattaaaaattctcattgaagcaaaaacagaaataaaaaagggcgggggcgggggtgagccccaaaaacctgtcccgtccccggggacgggggcggggctcgaaccctagtttttagcatagtaaaaaaatgctctttgaaagttataatttttggataaaaaagaaattgacaaaagttatgggtcctcaaaaacctcaaaaaatgactttgattaaaaattaatttaggtgagccaaaaaaacgtaaagcacttcaatttttcaaatttgacgaatttttgttattttttgactgaaccggttttgaggggacctataacttttgttgcattttatcgcaattccatgcgtttaagggtttggacggttcagtcccaaagccatttggccatttcagtcccgggtattaactcttcagggattggtttccgcaaaaaaattctttcgtatcctttcattacagaccgagagctatcaattggtgtatattttgaccattttgggttctgggccatatgatcaatattttcccacgtaaacgacctcgaatttggtcgggttttcatagtaaagaaagaataaaaattttactggtcacgttccatgtatgactcaatttcaattccgtggcacgataattctccgagtccaccggcgcaccgctgcgcattgaacaaattttatataacatatatatatatatatatatatatatattcgctatttttaatggggccctcttattttttgttcaggacaatcatgtcccgatcttcatctcccgcatcggccgactccaggccagacaccgacgaagtttcaaattttgtgcatgggacgcaatgtccctgcgccctgcagcacctgcgagctactcagctcagaatcttccgacacaaaatg

SEQ ID NO: 106611 - DNA, 159 bp, Heterodera glycines
  Promoter: Source sequence=SeqID_22012; Location=1..159; Strand=+; Gene=SeqID_52646
ttcattggtaaattccgatttccaaggaattcaagacgcaatgcccagatccaaggatatacttataatccgaggactaatgtgaggccgcttgcttaaaattgacaatcaaaaattaaaataatttaagacttttttaattcagcggaaaaaactatg

SEQ ID NO: 106612 - DNA, 191 bp, Heterodera glycines
  Promoter: Source sequence=SeqID_18936; Location=2911..3101; Strand=-; Gene=SeqID_47553
ggtgggaaatgccattttaaatcactaattaaaaagttaatcaaatttgctggccgaaaaaaaagaagaaaaagaagtggctgacagggacggtcccaggggggggggggggcaagacctcaccacacgcgaaatttttaaggaaattttgctgaattttaattttttgttggatcccctgatcaaggatg

SEQ ID NO: 106613 - DNA, 162 bp, Heterodera glycines
  Promoter: Source sequence=SeqID_4272; Location=1263..1424; Strand=-; Gene=SeqID_53838
gctgtaaatttttgtcaattaatggaaatattttttcaaaaaaaaaaccatttaacattccgaaaattattgaatttttttttattaagcaacaaaaaatttataaaaaaattaaaattaaatttttaattatattttaagttaaacaattattttaaaatg

SEQ ID NO: 106614 - DNA, 281 bp, Heterodera glycines
  Promoter: Source sequence=SeqID_25354; Location=1..281; Strand=+; Gene=SeqID_45926
gaaaatttttttttttttaaattccaaacagaaatttcaaaaaaatccaagagagtttcaaaggaacaaatttttgaaaatttttcagcgatttgtttggaaaagttagtaaaattcatcataaaattttaataagtcgttagaaaattttcatattttttcttataaaaagaaatttctagttatttttttgaaaatttctacttgtaaatttgggcttttgcctccctttggaaaattgttggccacctatttaaaattgtcagaaagtaatattaatg

SEQ ID NO: 106615 - DNA, 330 bp, Heterodera glycines
  Promoter: Source sequence=SeqID_3276; Location=533..862; Strand=+; Gene=SeqID_84031
ttctcgacggggaagacactttgcgacttccctcattgccgatggagcccgtgtggatgttgagcagcatgtccatgggcagttcggcacgtgggatggtcaccgaattggggggcagcataatcttgcgcaatacgccgaagtcgcattgggagcgaagctgccggaagcaggtcgagtgcacgctcaggttgcaccactgacaccggaagcccgagaagcactccgccgtgtagcagcctttcctgcataccgcgcacttggcgtcccttgccaaattaccctcgcgcatgtggtgctgctgtttgtgagtgacgaggtctaacgatg

SEQ ID NO: 106616 - DNA, 110 bp, Heterodera glycines
  Promoter: Source sequence=SeqID_2057; Location=3038..3147; Strand=-; Gene=SeqID_47148
gagaactggtcaagaattcctcgaaatgtattctgttcactatagtggagaaattaaatgaagttcgattagaattaataagagatttattcaacattcaagaccatatg

SEQ ID NO: 106617 - DNA, 1003 bp, Heterodera glycines
  Promoter: Source sequence=SeqID_42900; Location=215..1217; Strand=+; Gene=SeqID_70697
cattttataaaattaaatattaattatttttattcaaattgtatattttattttcgaatattcttttaaatcttttcacttttgggtaattttaaacatttaattttgttccttttatcatttcagggtatatgtctataaggcttaatgtatacaataaaaacattttgttattttcttattcgattgaattttgaacttatttttgtgttaaataactgtagagctttgtttttgtttaaatgataaatagtttattttgttaactttttatattttaatttttgctttcctttattttaaaatgctgaccttatttttttatttttaaattattttcaacaaattaatttggcatagaattttttcgtgatataataagtgtattttcaaaatttaatatacctaaaacatctttggaattacaataaatttttttcatctttttccatttaaaggttttcttggaaatgtaaataatatttattagtaaaatttatcactccatctgcagaaaagtgctgctttcaaggggtcaaaattggaattttttgttggccccgccgggcattaaaaattttttgcttttaaaaattgactaaaatggcaaaaatcattcatttatggtgaactaatttcactcaaaatttcaaaaaaaaatttcccggcgccgccggcccttttttaaatttatataaattttgtttctgggagaaaaattcaaaaaataaaataaataaaagaaaaatcaccattttttctacaaattctccgctaatattttcatccattaactccactttaaaagttccatttgaaaagagtgataaaattgcttcataatattttaagaaatgattttgttaaaaaatattaaattaattatttaatttaattaaataaacacatgaattattttaaataagttttgactaaaaattttatgctttgaataatcattttcttacttttttcttttttctttttagagcatattatcatg

SEQ ID NO: 106618 - DNA, 56 bp, Heterodera glycines
  Promoter: Source sequence=SeqID_14884; Location=1..56; Strand=+; Gene= SeqID_79042
ccgtggggaattggcgcaccctccgcacaaaatgggcggggaatgtgcgggaaatg

SEQ ID NO: 106619 - DNA, 568 bp, Heterodera glycines
  Promoter: Source sequence=SeqID_17362; Location=2207..2774; Strand=+; Gene=SeqID_81846
acgagggagaaaacgaagcaaatacactcggattagtcattcattcatttgtggcaacttatttccgttaaaaatttatcaaaaatggcttcaatgagaaagacagacaccctttaacagtcagttgtttatgccaattgcacagtctaccttcatcccccctccctccaattgacatttttgaggctttctttttgcccaaaggtgcaaagaagccaatggcaccggcattgatagcttttccatcaaaaattcagtgtacaattgtatctgacggctaatgcatctgctgcttaaaatacatctgctgtccctctcccattcgcactttcttcatatttcatttgccagattcaattaaggccatgcgaagttttggcggaactgcgcctcaatgggcaattaaattattccatcatttgtcagccatcattggcttatttacttggcttttcctttccttctcgccaaaagtgatgcttattcactttataaggtgaaaacaatccgctaaatttggaagtgttaggttccaattaactatttgtcctccttcgacttggccatg

SEQ ID NO: 106620 - DNA, 523 bp, Heterodera glycines
  Promoter: Source sequence=SeqID_604; Location=1296..1818; Strand=-; Gene=SeqID_57369
tttttattgggatttcgtcgtcactcgccgccccaatccgacaaaattgggaaaaagtaaggggggggggtctgaatttgaaaattagcaattctccgtttaattttgctgattttcatgcgtttggtcccggtcccggtttgtccaaaattcccgatcccgtacaactctatagtcttgaggaaaggaacgaagaaaaaaatttaaatggaaggaaaacattacgccaaaataatatcgaagttaaatttaaatttaaactttaaaaaccgtgtatcgagaattgataagcagattttttgcgacaacattccagtttttcccgaaaaggggaatatggttcccaagaaatccttgcccgcttcttaatacgatccctaaaaaggttaaatcctaaacataattgtttatcccttccaaaaacaaattcatatatattttctcttgtctgtttagtaaaaaaattgaacgcaatttaagtcaaatggtgcgccagaagcacaacttttcagctgagaaaatg

SEQ ID NO: 106621 - DNA, 113 bp, Heterodera glycines
  Promoter: Source sequence=SeqID_12962; Location=3500..3612; Strand=-; Gene=SeqID_76719
attaatatagtgagtatatcaattaaaattcttaatgaatcatctttacggaattttttgatgaaacaaaaataaaaattgagacaaaattcacatacattttgcgtaaaatg

SEQ ID NO: 106622 - DNA, 494 bp, Heterodera glycines
  Promoter: Source sequence=SeqID_42582; Location=1..494; Strand=+; Gene=SeqID_70440
ataaaaaatgacgcaatttattaatatataaatcatacatgacaattttaaattactaaataattacaacattaaagccttgtgaagaattcaggcttgggaaaataaactaaatgtcggtaattttgaaagaaagtaattttgaaaactaaagtccgttagacaattttccataagtatttattaaaatgaaattgttcaaaaaaataaatttcatctcatcttttaagcaacaatttttaaataaaatttattcaaacatttttacttaatttaatgattgaaattaaaaaaattaattgttataaaaaatcaaatattcaaaatatacataaaattgattttaaatcaatatagtaaaaatgcaaggatatatataagaaaaattcaaataggaaaaactatatacagccaatgttaattataagaaattatttataccaaatttcaaaaatataaaataaataattatttttttaaatcttttaataatg

SEQ ID NO: 106623 - DNA, 102 bp, Heterodera glycines
  Promoter: Source sequence=SeqID_7356; Location=1..102; Strand=+; Gene= SeqID_64582
aattttaaaattttagagggaaataaaatcttcctagtgaaagtgcggaagcagaaaaggcgcaacccaaacattgtattccgggattcgttcaacctgatg

SEQ ID NO: 106624 - DNA, 98 bp, Heterodera glycines
  Promoter: Source sequence=SeqID_15153; Location=2452..2549; Strand=-; Gene=SeqID_79345
acagttttcaatcgcaaattgggcgtggcgatgtccgcgacggcgtcacaccgaacttggaaagtgccgagaattgttccggcggagttttccaaatg

SEQ ID NO: 106625 - DNA, 902 bp, Heterodera glycines
  misc_feature (39)..(39): n is a, c, g, or t
  Promoter: Source sequence=SeqID_23277; Location=457..1358; Strand=-; Gene=SeqID_53989
cagcgagtcagacatatctacaaggaggaagacgaaagntagtagaacaaaatgaaaaattgcaaaatcaaattcaaaacaatgcagtcatagaaaaaagcaaatgatgaaactactagaaatctcacactttaaataaaaatttccgtctcagttacatttgttgttttcattacttctaaacaacctctatataaagtcaaaaaatttccaatttcgtcactttcggaatcaaaattttttgttgcaatggcagcgcagcaacctattttacgccgtattatttccaacaaaggaaaacagcaaatttacgaaaacggttttctttatctttacgagaaaaacaataaactcgaccccgatcttcttttcatgagttggaatttcgggaagaagaacagacatacgaaggggaaaattttcttttaattgataccgggcatgaagacccgcacagagtggttgtgttcgggaaagaatcggtcattggatgggtttagcttgtgaaaaacctttacgttgacggcactttcaaaatttctcctcgcccttttcacaatggtcaagtttttatgatcctgggcaaaacgaaatttgcagacaagtaggtgtttattagggctatcgatgataccaagaatgttttatttggatgcttcttgaaaaagttatgttacattaaagttgcaaaaaatttttatggtcgtgtgaactgtaatagagccgaacttcttcccctcccctctccgccgcttctccaaaccgattttttttttaattttcaaattcttccagcaataatttcatctattttatttttatttttttatgatttcgagatttttttattaataaatgaatgaagaaaacgaatattgttttttgtttgttaatttcagatg

SEQ ID NO: 106626 - DNA, 484 bp, Heterodera glycines
  Promoter: Source sequence=SeqID_5704; Location=2396..2879; Strand=-; Gene=SeqID_58975
aaaatgtggaagtgaaagaagaagagagtgaagaaaagtcattaaaaaaatatcaaaaagtgcaaaaagaaaaaaaagaaaatttttgatcatttttggatatcttgccaagaatttgagtgcaaaaaagctactttcgtaaaaaataaaaataaaatttccaaaaaatccccaaaatatgtgctaaaaaaattagtgaattaatgacatcagatgagaatgaaaatgtgatatttgtgatagttaccttaaaaaccttcataattatagttatctcatattaattactacccaattcgctgataaaaggaaaatttaataattgaattattataaaaatgttgtcaaattaatgaaataatgattaaatgtggttaatattgattgaagaaaaattaagccatgctataaaattaataattacaaaattcattgcgaaaaatatttttataaaaataattcattatatttttacaaaaaaatg

SEQ ID NO: 106627 - DNA, 57 bp, Heterodera glycines
  Promoter: Source sequence=SeqID_787; Location=1965..2021; Strand=-; Gene=SeqID_61289
aattatatttattccaacaaatatggttatttgaacggtgcaattttgacaataatg

SEQ ID NO: 106628 - DNA, 95 bp, Heterodera glycines
  Promoter: Source sequence=SeqID_2410; Location=1195..1289; Strand=-; Gene=SeqID_79592
ttgtataatcttaattggactaaatatatcaatagtattatttaatccatttagaaaaataatacttcaataataccttcttataattcaggatg

SEQ ID NO: 106629 - DNA, 69 bp, Heterodera glycines
  Promoter: Source sequence=SeqID_17921; Location=2011..2079; Strand=-; Gene=SeqID_82475
ttttcagcccattgaatttgtttaatttaaatcctataaattattttagaaaataaattgtaaaaaatg

SEQ ID NO: 106630 - DNA, 673 bp, Heterodera glycines
  Promoter: Source sequence=SeqID_27322; Location=183..855; Strand=-; Gene=SeqID_58013
agactaacaatctcctctccattacaaacaagatcaaaagcatctgctataatatcctcatttcgtatattcttttttaaaaacaaatctttttaaaagctgataatgcaatcttagaaggttgtaaaaatgagttaaaaaatagcataaagaatgaaatagaaaagtgtactcgttacagatcagaaataaaagatttagagaataaagttattggattatgattctgttggcttttcttcttctgatgattctgttggcttttcttccatagaatgatataaacctataattatcgaacataaagaacctaactataatctaacaaaagagtaatatttttttaacttcaacggtcagatttatttatttatttgttcaaaaattttttccatttcccggcggaattcgggtaaaaaaaatgacgaaattttatggtaacgcgaaaaaggtcccttttgcggttccgctttctcggtgacagccccgtttactgttccctgaaaattttttttatcggtctctagtttttcgaatgaattttcatcagcttgtcagagtgatcagtagggtgagaacttttagtggcaaaaaatcccaaaatacagccacactcaaaagtattggagcaaaaaaaaaagtttttttttaaaatccgattttatcagaaatg

SEQ ID NO: 106631 - DNA, 298 bp, Heterodera glycines
  misc_feature (9)..(10): n is a, c, g, or t
  Promoter: Source sequence=SeqID_12611; Location=1..298; Strand=+; Gene=SeqID_76271
aattgtatnnagtttggtggggagatttgtgcccaaaaaaattaaatgtggaacatttatttaaatttaaatattctttattttaattaaattggataattttaagtaactttattatcacttggtggaatttatgaaacaaccttgcaccttttgcttttgtctcatctaccaaaaaaaattttccattttttgtgatattatggagagttcgaattcgatgtctctgttgtcagtactgtacgtcctgcacaaaaaaaatttacattattttaatgtcagatcagtgatcacaatg

SEQ ID NO: 106632 - DNA, 376 bp, Heterodera glycines
  Promoter: Source sequence=SeqID_34882; Location=292..667; Strand=-; Gene=SeqID_64577
tttgggcaatgtgacgggccaattggcacgcaccgatttcagcagccgatggtaaaaacaaaccacaacttatgaaacatttgtccaatttttgttttgtttttttgccgaaattgaatcaaaacaaaacctcaatttgcttgtttttggattacagattgcctgcccaaaatgagtgttaattgtaaggcgtagtgagtaggctttaaattggacaaatttttaaaaaaattctttgtctttcgccgggcctttggctttccatgaaactgaaaatgatctgtagctcaggacgttcccccgtctgttctacaaagtgcgtttgtccttcgacggtctctcccctccctccgccgtccgtgtcgatttgctaatg

SEQ ID NO: 106633 - DNA, 235 bp, Heterodera glycines
  misc_feature (159)..(159): n is a, c, g, or t
  Promoter: Source sequence=SeqID_7768; Location=833..1067; Strand=-; Gene=SeqID_65878
ttaaactctacataccgtctttattttaaattttcgaaattttacgcaatacctaataaaaatatatggggccttacaactaatggccgaaccctttcaaaatttttgaaaataacgtgactaaaaattaatagtgacaataaaaaagtggacaatttnaaaaaagcggagaaattttctgcagttatccccaatatcttcaatgttttcttatatttccaattttagaaacatg

SEQ ID NO: 106634 - DNA, 209 bp, Heterodera glycines
  Promoter: Source sequence=SeqID_31401; Location=634..842; Strand=+; Gene=SeqID_61756
agaaaagtgggactaattagagaaaagggcaaacgacttggacttgatgaggcgaaggaatgaatgccaaagaaaaccggacattttctcaaaaatagtgagtgaataatagccgaaatttacagataaagaaattataattaattaaatttacaattcttttcattattcttaaaaatattatttattcgtttaaggagcttaacatg

SEQ ID NO: 106635 - DNA, 377 bp, Heterodera glycines
  misc_feature (107)..(107): n is a, c, g, or t
  Promoter: Source sequence=SeqID_10925; Location=1..377; Strand=+; Gene=SeqID_74227
gaaaaaatcgatttttttgttttcggggcagtccccccgacccgattgcgcccagatgtatggggagaccgaatccttcgggaatagcttccctatagcctgtactntaattctgcgttggatttttgctccccataaatgtttgagtaccccaaacggacacttgaaaaaatcgatttttttgttttcggggcagtccccccgaaccgatgcgcccagatttatggggagaccgaaaaaatcgggaatagcttccctatagcctgtactttaattctgcgttggatttttgctccccataatccacgcccacttttgggtcaaaattattcctagcaagaaatcgaaatcattctttattcaaattctagaaaatg

SEQ ID NO: 106636 - DNA, 621 bp, Heterodera glycines
  Promoter: Source sequence=SeqID_18771; Location=1281..1901; Strand=-; Gene=SeqID_83446
ttactatgatttatgctatataaacaaatctaaaaacgctacgattgcgacaaaagctttagcaaatgtttgtatgaaagtgctgaatgttcattaacaaaagtctgttttatttgtattttaaatagtttattttagagtgcccacgggtaccggagacctgatattgtccaaaattcccggaccccaggtactctagataatattctaaaaagtcaatgattctacagttttgtgcacattttcacattaatctacaaacaaagattaaattaataaatattaataaatttgaacgcaaattcaaggtgaaattcattaaaattgcccgacttattgaccctttctcaattgtttctccaatcattatctcttgcatccatttaggctaacattagcccctttagtttaatgtatgcgtcatgtacattgccccgccttcttcgcacccatcggtcaataaattcttctctccatagccactcattttcattttctgatttttttttctctcaccttgctcgtttatgaacatttttcccctcttcttagatctaagcaaaaattaatcccaataataatccaaatcccttcgcctgcaggcaagaaacagaaaatatg

SEQ ID NO: 106637 - DNA, 330 bp, Heterodera glycines
  Promoter: Source sequence=SeqID_41862; Location=514..843; Strand=-; Gene=SeqID_69910
ttttctggattattttaatcagtgtattattctcttgacaaaaagacacatttttaaccatttaaaaaatgaaaattgtgtaaatacgatcatttgcagggcatattttggtgaaatcttttggcataaaatggttattgagaaagaggagtgacagcagaagcagatcacagatgatcagcagatatgggaggaaaatgtggcatcatagtcagaggaattggaagggggagaatttattgtttaaatatgtatttaataaatttaatttaataataaaatcaattcatttttaatagattattcttttaagttgatcatccgaatatg

SEQ ID NO: 106638 - DNA, 156 bp, Heterodera glycines
  Promoter: Source sequence=SeqID_16346; Location=1..156; Strand=+; Gene=SeqID_80733
atcaaattgcttagcatttgcttagaaaatgcttctcctcatcaaaggcttcgaatgatattgtccaatttgattgcaaaaaagatcaaaaaaaattatttccgaaattagtatttttttaattttttggacaaaaataaataaaaaatattcatg

SEQ ID NO: 106639 - DNA, 1003 bp, Heterodera glycines
  Promoter: Source sequence=SeqID_22200; Location=1263..2265; Strand=-; Gene=SeqID_52864
agggaaacccagggaaaatccccaaaaaattttaagttttgcaaagttttggcgttctgattactaaataaataataaacctatttgcactgagagcacaaaattgggctgttgtgtatagtatatcctttttttgttcgaattgcagttaaactgaaaacttttcggcgataaattcgcaagtccctgcggtgaagtgatctgacccaaaatttgttaatatagaacaattttgtatttgccctttctggcctactcatttttccagaaaaaatttccaacccccagaattttcgaaaattcccgattccaacgttttttttttggtgtacaagatcaccatggaaagatctgatcaagttgggtgatagttttttgaacattcttccctaaaaaacgagagatgaaccaataaatagagagtgtaggcatattattaacgagagatgaaccaataaatagagagtgtaggcatattatttctttaccttttgcatattgatagcgaaaatttcaaaaattgacgtttttttgtaaagcggtctcgaacctccacccttttttcaaataatgccagatttccattggaaagagcacaaaattctgttccgaattgtcctttgaatgtgggtctacgacttatatccacagagcaagagagggtccaaaaatggaccactaaaaaatgactgcaaaaattgtatgtttgttcaaatacttttccacaagttccttccgttatttttgtggtactgaatttctctttcactttgactcattctcagcgcgattaatggtcgcgctccactcctgatccagaacctctcaattttccggggaggtgaggcttgtttcggaagccttgtactcagtgctttttagtcataagtgtttttttattttatatttttaaaaggcaaattaaaagtagcaaacgaagggagctgactattttaagttatgattggaattttttgttaaagtattgaatttctggtcaatg

SEQ ID NO: 106640 - DNA, 209 bp, Heterodera glycines
  Promoter: Source sequence=SeqID_1301; Location=1133..1341; Strand=-; Gene=SeqID_72085
tattgtccaacccctcgggcccatttgcaacaatttaaggcaaacaaaattcaaaagttgtttggataaaatgtgattttcgttagaatttttggttttccgcttttctcattatataaaaataaagtttccaacgcaattaattcttctgctatttgtgtgacatcattcggaactcgtccaaattgtgcttatttctgccaaaaatg

SEQ ID NO: 106641 - DNA, 286 bp, Heterodera glycines
  Promoter: Source sequence=SeqID_8484; Location=947..1232; Strand=+; Gene=SeqID_68232
ggtgagacgaattgacagatgacatggcaaaatcgaattactctcctattttccatttagcaactccgttctcggctggtcaaaagtggtggcgaagaattgaagctgttcctcagcgactatttgctcactgtgtccccaaaacggcgcgccaccgctgccacactgccgaagacggcggagatgaggcggtggtgcctaacgacggtggaagaagatgccaaattcttacgccggcacttcattgacgaagtggactttgccaaccatctgaaattggagaatg

SEQ ID NO: 106642 - DNA, 254 bp, Heterodera glycines
  Promoter: Source sequence=SeqID_457; Location=5466..5719; Strand=+; Gene=SeqID_45719
ttgtgttgttgttgggcgcactgaagtcgttcgttcgttgattgggtgttgtgtcagcagcaagtgtgcaaatggacgaaaattcccccttttatattcattttctgttgcactttttttcagtgggaaatttgaatataaaaaggcgtgaaattgagagaaatttcattctcgtcacattcttaattctattctctgcactattacatctgattgctgctgctcaccgactccatcgacaacgacacgcgatg

SEQ ID NO: 106643 - DNA, 235 bp, Heterodera glycines
  Promoter: Source sequence=SeqID_2121; Location=759..993; Strand=+; Gene=SeqID_77958
gttgtttttttgctttaccagttttttcagaagtgatcgctcgcactcttactgttataaataggccctcgatatgccaaatcttcatttaattacttgaataaataaaattatttaatttattcatgaataataaactgttatttaatttgaatttattattattgtttaagcttggtgtacctatgtttttaattcatcatttagcataattcatattacagaattagaaatg

SEQ ID NO: 106644 - DNA, 110 bp, Heterodera glycines; identical to SEQ ID NO: 98226
  Promoter: Source sequence=SeqID_16829; Location=680..789; Strand=-; Gene=SeqID_81247

SEQ ID NO: 106645 - DNA, 82 bp, Heterodera glycines
  Promoter: Source sequence=SeqID_38169; Location=1..82; Strand=+; Gene= SeqID_67066
attcagaaaacggctgccaatttgaaaggtcacttcctaaatcccccttttgggtccgaactaatcttaacgcccttaaatg

SEQ ID NO: 106646 - DNA, 571 bp, Heterodera glycines
  Promoter: Source sequence=SeqID_17791; Location=1127..1697; Strand=-; Gene=SeqID_82327
ctgataatttctagaacaccgataaaattcgtaattcaacgctataaaactgggttcgaaccatacatgaaaataaatacattttaatttgtgtaacaaagttaaagatttaaaaatcttgttttatttaaattttataaaaaaaaattttctttagtgaaagtaaaccaaaagtcgaccaaaaaaatgactgcccatggggcccaacggcggggcccattcgacccggtccgaattccgagtgtcaaaatttaatggctcctactaatgaataatcagcgattttcggattttttacatcgtaatttagcaaatggaacaaaaaccttttctccttaggacgaattggaacatgcttattcgctaagtttttcattggatgggcagtgcatttttggaggttatcgcaatcggttgcgaattttcgaatgcgaacgaagcggcaaacagtcgcgagaaattaaaacatttggtaaacatttgaaatccgaagttgaaaccaattaaatgtttataaacagtcaaaggaaaatttggcggacaaaagggaattgtgtctgccctttcgatg

SEQ ID NO: 106647 - DNA, 830 bp, Heterodera glycines
  Promoter: Source sequence=SeqID_43867; Location=158..987; Strand=-; Gene=SeqID_71446
gtccccccgaaccgatgcgcccagatttatgggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataaatgtttgagtaccccaaacggacacttgaaaaaatcgatttttttgtttcataaatatttttttcagaaagtgctctaaagcgcaccaaattttatttacaacttaattttagcactctgatgctttagtatcaaaaaggaagatggagaaaaaattttttaaaaaatttttccttatattttggttatatcgttttgcttttggtggggtgcttggaacagtggaatcatg

SEQ ID NO: 106648 - DNA, 58 bp, Heterodera glycines
  Promoter: Source sequence=SeqID_11893; Location=1020..1077; Strand=-; Gene=SeqID_75403
atcatcattaaaattgcaaattgttttacaaatttcagggaatggcactttcacaatg

SEQ ID NO: 106649 - DNA, 1003 bp, Heterodera glycines
  Promoter: Source sequence=SeqID_5115; Location=1114..2116; Strand=-; Gene=SeqID_56973
aactgctccgacttgatggagtccgggaagagagggctccgtcactcgaatatgagggtgacgtggagctggccacatcaaacccgtccgtcaattcatccacaacaagtaattggacaaaaaaattttttggaagggtggcccggtggaaaaatttcaaacaaacaaaaaaatttttttttcaaaaccgttagagtttcgctaaggacatggatctttggttatttctaaaacaaccacttttttttttgagaattcctaaaattttcatcggcataccaaattaattcaaaatcataattctgtaattgggcagaggctcgcactttggaaatttttttcaaggataaaaaacattaaaaaaatttcaacgtttcaattttttcttgaaatatttcgtaattgaaatatatatttttttaatttcgaagttgaaaaaaatatttttttttaaattttcggcaggggcgggggttgcagggaaacgtagtgcacccctataattgtgtccttccaattaagcgctgaacgaattcttcaattgccaccaaaaacaacagcctcacaatccgcaacagtttcaccaccacaatgttcagcaccgtccaccaccgccaggtgaccaacgaacaaacgcatcataatgcgggacttaaattcgagtcatatgtacctaattcggttggccagggtcccaaaaaaaaattaaaaaattcttctttctttacgttgatttttttttttaatttcggaaggggaggggagactcgctttcattattagtaaataggtaaataaatctatctgctctatgtaatggtttaaactcagaatttttttcaaaaaaaaaatctggattttttttcatttttcttaaacattttcgaaaattttgtcgaacggagaaagatacgggggatggcgaaacgtgtgtgcacccgtaactaatggcttttcaaataatatttgttcgttgtgttgctcagattacaacgaagtgatg

SEQ ID NO: 106650 - DNA, 191 bp, Heterodera glycines
  Promoter: Source sequence=SeqID_45149; Location=1..191; Strand=+; Gene=SeqID_72511
cgacgcaattgggagatggatttacagaacagatttcctttatttttgaggaaacattgggactttgcaccaaaatcacgtcccatctcaaaattaaagaaaattcatctcccgttttttgtgcagcacgaccaattcccatcggcgttaagcaagaagtggacaaggaattggaccgtctcatcgatatg

SEQ ID NO: 106651 - DNA, 59 bp, Heterodera glycines
  Promoter: Source sequence=SeqID_25928; Location=1321..1379; Strand=+; Gene=SeqID_56694
ggtggcatttatggaactaattaggtgcaaaaatcgcttaattttaggcattggccatg

SEQ ID NO: 106652 - DNA, 747 bp, Heterodera glycines
  misc_feature (27)..(27): n is a, c, g, or t
  Promoter: Source sequence=SeqID_19289; Location=107..853; Strand=+; Gene=SeqID_84036
tagtgatcgcagtaccggcatctgctntagtgaagaataccggtgccgctctattcaatttacaaaattagttgaaatcttttcaatattctatattaaaatttgttaattattatagaatttaatacacatggcatataaaatacaaaatcatttccatatgtcggttttatttcaagattaaaaataaaatattttgggctttagaatctcttcgaccttatttggctgctcgaatatgtttggctttccttggagtttctcgttggcactcgcgtacatgcaaaatacccatttggtgcctatctgttccgtttcgtcaatttttgcattgacactttttacatcgaattagcattcaatcggtgcaccgctttccttttcccacgtctttacagcaaaatttgcacagaaaagtttgtccatttaactaatgagaaaaaattgtatttggtgttgccaagtggacattttttgccttcgagggaaacctttggggtttttagagaaatttgaattaattcgagaaaggatttttaaaatgccaaaacatttaaataaatattttcgaaaaatggtttaaatatttacaaaaataatgactaaaaatgaaaatttcgagaaaataatgaacaatgcattgaatattatgaaaataaaaacgaaaaaaatcggttttcactttgcattttccaaattttaaataatttaattttaaatttatgccgccatttgttaaggaacatg

SEQ ID NO: 106653 - DNA, 433 bp, Heterodera glycines
  misc_feature (215)..(215): n is a, c, g, or t
  Promoter: Source sequence=SeqID_6771; Location=53..485; Strand=+; Gene=SeqID_62843
agtaaccccggccccaaaccccaaaaacttcccaaaaaagggtccccaagctcaagactcgaaaattagggataatttcccccccaattcaaaaaaaccacccacacaacacacaaacaaatcacaattcagtgagaaaggaccaccccacccgcatcccgcgcaaagagtgaaaaaccaaaagaaaagaaagagcattttcggaccgaccaacncaaaagaaacggagacgaaaccaagcaaatcctcagacagacaacagtaataaaagtgaccactgtgatcaaaaatttctaaactgtgatcaaacccaatttaattttgtgataattgtttacctcaataaaatattaactgattacaatcgcagaagggaataaattggccaaccaaaattaagaaacaacacaaatcatttttaaaggaaaaaatg

SEQ ID NO: 106654 - DNA, 799 bp, Heterodera glycines
  Promoter: Source sequence=SeqID_6163; Location=2750..3548; Strand=-; Gene=SeqID_60566
agttaaaacgaaatacaaattgttacttcattatatctatcaacttcgtctttttgtcatattttttgtctattattattttttgaaatgccataaaaagccctgagggtgactgagcaaataatggggcgtccgtgccaaagttttgaaactttaaaggattaaaagagcaggttccatttggaggtggggttgtaatatatctgaaatatatcactcccatgtttagtattttagggactagggtataataataaacggtataatattactaaatgaaaaatataaatatataataaaaaaaatcccatcagtaaattaaaaaatctaatcagtaaaaatttgtaattttctttaatttacttctttcgcaataaaatcaatttaatattcacatgggcttattttagcgacatattccctttccaatttcactcttaaaataataataatattttataaaaaaatattgattctttttttccctattttactccacaaagcatattttattttcaatattcacttgtatttaatatattgcataattttattcgtttttgaattttaaaagatgaagcctaactttggtaactcaaaatgtgcggtatgcaattgtcagtgtcaatattactattatggggcaaaatgttgtgaaagtaatcaaatttaaatgaaccacaaaaaagaaaaagtgaagaaaaattaaaaaataatttttattaaattttcaaaatttccatttaactcgagatataagaaataattgaaaaatgtccaaaccctcgaatttaaaatg

SEQ ID NO: 106655 - DNA, 654 bp, Heterodera glycines
  Promoter: Source sequence=SeqID_27809; Location=93..746; Strand=-; Gene=SeqID_58474
tatctaatggtatattaaatctgaacttttttaatgactttttactcttataataaattggatcatctaattaattaaaaagattattaaggggtagtaagttttttaaaatagcaaaaaaggaagctaagatttctgtcaaaaattaaaataatttttcgggtttttaataaatttgtaaatattaataaattttaaattagaaaaaaattgggcaaaatttgagcaaaatttaacatgtaaaatactatgtatatgtagttaaaaaaaattctgctccataaatatatatttaaaacactaaattaattctgtggcaaaaaaaatctagatttttttgactaaataaattccaatgtcaattatgcacaaatattttgttctccctggctgctaaattcgtgttaattaattcttagtcggcctatgcattaatcaatgtttaaaaatttttgaaagaaaaccgtcaaatatctaaaaataacttaatttttagaaatatgaataaaaaatcaattccataaggaaatccgaaaacaaaatccaaaaaatatgcattttttaaaatttaattatcaataattaaaaaagaagtgattataaaataattatattgtatctattctatacaaaatctccagttgttgccagatg

SEQ ID NO: 106656 - DNA, 344 bp, Heterodera glycines
  Promoter: Source sequence=SeqID_22823; Location=1181..1524; Strand=-; Gene=SeqID_53533
atgtctcaattcgccctttaaaatgtttaaaaagctcactttaacaaacaaaattatttgtgttttcccttttatttttgccgtttaaaaatgattctttttgattctttttcagttgatttgttgagctcttttcgggaattgctgaatacgagtgctactccctccacgcacacattccctcgcctattcttcgcgctgctaattaattaattaatcgcccttttgtcaattgctcattcatttgacggatcaaacggtcgccccccaccaacaaaatctctgccccaccgaagcacaacgaataattgacactgctcaaaaccacacaatccgaagctatg

SEQ ID NO: 106657 - DNA, 138 bp, Heterodera glycines
  Promoter: Source sequence=SeqID_10058; Location=1083..1220; Strand=+; Gene=SeqID_73124
tgtaagggcaacggatttggtaattaattgtgaaattgaaataaataattaaagtgatttttgataggatggcattctgtgtttgcgaaatttcccatctccaaatgttgtcgtcccttaattttctactttgaaatg

SEQ ID NO: 106658 - DNA, 471 bp, Heterodera glycines
  Promoter: Source sequence=SeqID_4576; Location=1..471; Strand=+; Gene= SeqID_54950
gaaatcggtatttttaatttcggattttttaagaccaagaaatttaagactgagcggagaaatggcataaaaaattttacttatcaaagcaaatatggaccagttgtttttggcactgtctactgagcccgttgcagaggaagaagaattagattttgcttatttggaacttaatgaagatcaattttgaatttttcatataatctatgaattttaatgaaaattttggaaattttataaaaattttaaaaaatttctcttggaaaaatttccggttggtcccggtcccggtcgaaaacttggtcccggtccctgattaaaaaataaatatttaaataatgtttcaaaatttattaaaccaaatttattctgataaaattctgtcttgaatttttttacataaaaaagcaaatccgttggcaatttcagtaagcaaaaatattttataaaaaaattaataagttttagatg

SEQ ID NO: 106659 - DNA, 632 bp, Heterodera glycines
  Promoter: Source sequence=SeqID_45321; Location=207..838; Strand=-; Gene=SeqID_72636
aatctgggcgcatcgttcggggggactgcccgaaaacaaaaaaatcgatttttatcaagtgtaccgttaggggtactcaaacaattattaaaaaatttttagatttttattcatctccctttttgatagtgaaagcatctgagtgcctaaaataacttgtaaataaaatttggtgcgtttcagagcagtttgtgaaaaaatatttatgaattaattttgctaaaaaaataaaatagtgaagctttaaaaattaataaaaaattttaaattcagaattactggagttagcatcatagcagtgcttttccttgtctttttgatgccctcgcaaaatctggttcgcttctgatcagtttataaaaaaaaagttaagcctaaaatttttcgcaaatttaaaaagcaattaaaaatttttagattttttattcatctccctttttgatagtgaaagcatcagagagccttatttaacttttaattaacatttggtgcgtttcagagcacgttctaaaaaatatttatgaattaattttgcaaaataataaataattaatgaaaaagtcagaatttcgaaaaattttaaaaacaacaagcgttggcattttttcaggttaagttagtcctttacaatg

SEQ ID NO: 106660 - DNA, 645 bp, Heterodera glycines
  Promoter: Source sequence=SeqID_18502; Location=1342..1986; Strand=-; Gene=SeqID_83123
tttcgaccaactttttctgtaattcctccaaattttggaaactttatttttatataatgagaaaagcggaaaaccaaaaattctaacgaaaatcacattttatccaacaatttttgaattttgttcgtcttaaattgttgccaatggccaatgggaggcgaaaaatcattgatacaaacggaaggcgcggaaacattttgacataaaaaggccaaaccgttttttattagcctataaaatttcaaaaagtttcgttaagtttcaaaaaagttataacttgagaagctcaaaaacccaagttttttacaacattttagctcataactttcttgaaacttaacgaaactttttgaaattttgtaggctaatggatttggatgccaaagaaaaaagttatagcgaaaaaaaatttgaattttcgaacttttgttcgaattcaggtccgtggttcgaaattggtcgaaacaaatgccagattctgattagctgccccgaaaaccctaggaaacatgctttcatgtcttttgttaacaaaaaaaaatttcaaaaaaggggggtaccatcgacagtattaccaattcttctgctatttgtgtgacatcattcggaactcggacaaaattgtgctaattgctgccaaaaatg

SEQ ID NO: 106661 - DNA, 148 bp, Heterodera glycines
  misc_feature (10)..(10): n is a, c, g, or t
  Promoter: Source sequence=SeqID_37446; Location=1000..1147; Strand=-; Gene=SeqID_46514
ttcattatanatgcattcttaacggagagagggaagcagtgaagagggtggcacatgcgaatgactcaatttgatatgcgagtgattgtctcaatttgtttaggtttgcaagacatgggaatattttatggagcaagtgcaaaccatg

SEQ ID NO: 106662 - DNA, 112 bp, Heterodera glycines
  Promoter: Source sequence=SeqID_28776; Location=179..290; Strand=-; Gene=SeqID_59350
tgtgagtgttgagcagaaaaagagatagacgttttttcaaaattttcagagccaaactcgcccagaaagaaaatccagaaaaattagggtcgtcgctattattccgaaaatg

SEQ ID NO: 106663 - DNA, 68 bp, Heterodera glycines
  Promoter: Source sequence=SeqID_23879; Location=1..68; Strand=+; Gene= SeqID_54569
caaactacaacaacgtcctcctgcaccttcctccacgtgaagactactgcccaaaccaaaagaagatg

SEQ ID NO: 106664 - DNA, 70 bp, Heterodera glycines
  Promoter: Source sequence=SeqID_40590; Location=558..627; Strand=-; Gene=SeqID_68868
ttttgctccagcatccctctctttcgtggcacattgctccgacccttctaaagtgccattctccgccatg

SEQ ID NO: 106665 - DNA, 1003 bp, Heterodera glycines
  misc_feature (25)..(25): n is a, c, g, or t
  Promoter: Source sequence=SeqID_3344; Location=4158..5160; Strand=-; Gene=SeqID_84294
tcaaattctaatttttcataattgnatccggagtcgctcattcttaaagtaataattgcctattttgtcaaattcgttcgttggcatcgctttttccatcattttctcctcctttcgagtctcatcttcttactgagttatctccattttctccgccgttacttactgcctttttcagtggtggtcatcctccatctgctgatgttttgtttgtgctgctagtgaaaggtcgaagaggaaaaggaggagggaaggaaaggggcggcggagtaacgatgggaaggggcagcagacgaatgaatgtaaaaacctcggggaaccgaaggtccaacaggcagtggcgccattctcatttaaatttgcgcgtcattttgaacggtcaacgattcgatttgtaattgctcattgtcggctttactcaccgattcctaagaaattcccacaaaaacaccgaagttatttttggcctcgaaatagtccacttttctcggaacgtcttcggaccggaagtaaagaatgaacagagaaacggacacaggccacccaccctcatccaaagccattcccaacccacttttccttcgcccgtcctttcccatttattcatccgatggtccgtccactcggaggaattcatttcttaactggtttataatttcaaaattatttcattattttacagcacaaattttgtaattgtaaaataggtaatcacaaatttaagaattaattcaatttttattaaatgccggtggacacggatttaattaattggaacaaggaaaattcgtggcctcagtctctgtcttcctcttttaacagttcaaaaaccgaaaaatttcatttaatttctgctgctcgcaaaaaaatttggtagcattttacataaattaaaaaaaaataataattaaatttgatgttaggaatgagaattttttagtcctcctgccgaagatggaaacaatcagctgatgaatggactgcttgatttctgttcaagatg

SEQ ID NO: 106666 - DNA, 531 bp, Heterodera glycines
  Promoter: Source sequence=SeqID_12436; Location=2745..3275; Strand=+; Gene=SeqID_76049
gtcaaaactgcggaccaccaaatcggacattcacaaaaaatgggaaaaaataaatttcaaaaatgaaaaaatatttaaaaaacacaacaattaaaaatgtattaaaaaagaaagcaatgaaaattaaaatattaatcataagtaatttattcgtaataaaaaggggaaataaataaaacagagaataaatataaatgtaaaattaacaattggtggtcattcgtttttaatgttcataaaatatggcgcacgagaaatgacaacaataaaaaaagaagagatttttgggagaaaaaacaaaaaaaatggaagtgagaattgtggcaaaatgacaataattatgcgcaaatttaaatgaataaattatcacattcatttcaacaaaaacaatgaaaacaaaagggggaagagaattaattggcaaattaaataatttggtgtaaaaaagtaatcacttcttgggtcattccaattattttcatcataaatccgcgtccaacacatcctcaaaattttcatggtccaaaaatg

SEQ ID NO: 106667 - DNA, 792 bp, Heterodera glycines
  Promoter: Source sequence=SeqID_10516; Location=862..1653; Strand=-; Gene=SeqID_73743
caatcaaaattaaattttccaaattttcaataaattttcctcccttcttcaaaccaaacataacattcattatgaatgtttttgcacaaaaatgttttagcaataattaaccaaaattacaaaattcaattgcgtgcatccatataaaattcattaatattactaataaaattcattaatattacttaattgtgatttgtaaattttttgatatttttaaatgtttattcaattatttcactttacataaaaaaaattaatattttagtcaattttttaattaagccagctgtgtaaaaaaacggcaatttaagcattaaaaaaaaattgaaaatggcaatggcaataacaaattcagaatttttcttttcaattaattcacgaattttcattcattcatcagattagagagtttaattctttttcgcatattagcccattgtttgtgcatttttgccctaattgtgcaggttcgcccatccaattctatttttgttttgatgaaaatcccataacatttctcattggtaaataggcaaatatttatgaaaaacaacatatactatttaatcaaatatttatttaataacatttaaatcccttctccaacccttgtgtaaataaattgtgtgtttattttaacgcaaaaatgaataatcctagtataattagatgggttttcattttgtatttcagtgctaaaaaaaaacgccatttgctgaaatttaatcgattttattttgttaaattttggatataaattttaagttaattagaaaataaaatataatg

SEQ ID NO: 106668 - DNA, 51 bp, Heterodera glycines
  Promoter: Source sequence=SeqID_4172; Location=1156..1206; Strand=-; Gene=SeqID_53460
ggtttgtaaataaccaaaaatcctttttttaaatttaattttagtgaaatg

SEQ ID NO: 106669 - DNA, 1003 bp, Heterodera glycines
  Promoter: Source sequence=SeqID_18718; Location=169..1171; Strand=+; Gene=SeqID_83388
aaaattcgctttttatcgcaaattgattttttttgctcaattaatcacattattcggattcccccgtcccggaaccgtttaaaagcatatttatatcgacagttaaattcaaaatcaaaaaatgagagtaatctttcgtagattagatattgcacacaaaaaattacaagtgaaaaacaatcaaaaaactgaaaatttctctgcgattcttcccccccccctcattttccgtccatttcgcttccgttgtcgggacgcattttctttgatgtcggagtccgcaagatttcctgaatgtgctgcacaatcagatcaatggccacgtcgttttctgctcctcgcggaatgattacgtcggcgtactttttggtgggcaggcaaaagtcttcgtacgccttaaaggggagggacagaggtcgttttcccgaaacatctttttttttttaatatgagtagaaattaggtagttattttccgaatttttaaaattggggttttttaagaaatcattataattatttgtttcaatttttttcaaaaattttggtgaaaaaaacttggaatttgggaatttttattcattgttagttgtttttcttcatcagcagataatagccttaaaggggagggacagaggtcgttttcccaaaaagtttcaaatgatttttaagacaaaaatgaatgaattttttcaaattaagtagcaattagggaattgttttttaaagaaattattaagtgaacgccccgtgaaaaaatgggtcaaatggtataccaatcgattcatctcaagaagctaagcacggaaaaatatgtctcgagttgcggaaatgccaaaaaaccgctttttgaaccggttcaaaactcgaaaaattgagagatttcgcactctaacttacgatcaaattccgacaaatttggtaccatttgaaagctcttcaaagcattgttttgtgtggttaagcatttgccatttcacacaaaatgccgaagtgagcacatg

SEQ ID NO: 106670 - DNA, 223 bp, Heterodera glycines
  Promoter: Source sequence=SeqID_10358; Location=2691..2913; Strand=+; Gene=SeqID_73538
taaaatttcattaaggtagaaaaaatatgtcaaatgaagcacaaaaaatgagttgtttgcccttagattggttttcaaaaaattccggttaatttttaaactgattcaccattttgatctccatccaaagaattaagcctcaatgtgatgccgttgctggcagaaggcaaaattgatagtcgaaatttgccgaaaaattgtttgaccatcggcggcacagatg

SEQ ID NO: 106671 - DNA, 96 bp, Heterodera glycines
  Promoter: Source sequence=SeqID_23810; Location=1213..1308; Strand=-; Gene=SeqID_54513
cggccgaacaatgttttgctgaagcaggaaacggatattgtccaactgctcggccgaagaaaagacgatttgtctattcttaaagggtgcataatg

SEQ ID NO: 106672 - DNA, 401 bp, Heterodera glycines
  Promoter: Source sequence=SeqID_5975; Location=1079..1479; Strand=-; Gene=SeqID_59882
aagagagatagagagagagagagagagaatcagagagagagagagagagagagaaaatgtgtatagagaggtaaaagggaataaggagacaaagagagaaagagagagagagagaatcagagagagagagagagagagaaaaaatgtgtatagagaggtaaaagggaataaggagacaaagagagaaagagagagagagagaaagagagagagaaagagagagagagagaaagagaggcaaattctgagagagaaatattgagaaatgcaaatgaggtttagagagatgagatagataaaaacataatgaaaatataataaataaaaaataatgaataaaaaaaaaaaaaaaggtaaatcgattcggttgtgctgaattggactttgtcactgggacaatg

SEQ ID NO: 106673 - DNA, 1003 bp, Heterodera glycines
  Promoter: Source sequence=SeqID_819; Location=2096..3098; Strand=+; Gene=SeqID_61944
aaatttttgtgaaaataaaaggaaccttttacttcttaatgtgaattcaccagtttgaaataaatttttattgacacatgataaaattgtttttacaacctttttttgaaattttattttattgaaattttttgctccgctaatatccattttccattgtccgtaaaccgcggtccgcaaacgacccgtcccgttcacttatttttttccaaaattgttaaaagagataatgggcggcgaaaaatataaatattttgatcgaatagattgtaaaaataactgatttgaagcaatttcgagaaaaattctaattttcggccccaaaatctattttttgagcctgagttctgattttgaaaaaaattttcgatcatatccctgatttaaatatgaatttttaaaatttatttcgtgataatatttgtgaatattttttccggggatgacctttttgttatttgatttaacatttgttccaaaatgtccccaaatatatattatctattagttattattagctaaataaaataaagtcatatttaaacaatttagcacatttagcttcttcctttttttcttatacataattttaaagaaagttaaagcattttaaaatcattttacaaaataaaaatgcaaactttgccagtgctttttaatttcctttttccaacaaaacgtacaattgattttacgatatctctgctgctgacattaattagcatttgcaaatgcattcacaacccattcaaccatcacaacacatcaaatgatccacaccatcattttgtgatgaataaaccaaaatataataaattctcaaataagttttttgaattaatgagctttgccttttagttccattcttctctcttcagccattttggatggaattcgatttaattacctaatttgttttattatttatttttttaattttcatattttgaatattcagcaaaatttaagagaagtttttagtttgattttattcataaaaatg

SEQ ID NO: 106674 - DNA, 112 bp, Heterodera glycines
  Promoter: Source sequence=SeqID_18315; Location=2496..2607; Strand=-; Gene=SeqID_82909
tgacgcgaagaaagcgcgtctcttcattacattcacgaacaacagggaatggcctgagttcaaagagaatttacacaaaaacggtcaagtatttactgaccgttttgacatg

SEQ ID NO: 106675 - DNA, 410 bp, Heterodera glycines
  Promoter: Source sequence=SeqID_3230; Location=6681..7090; Strand=+; Gene=SeqID_83803
ttccgtgccacaatcatcgtcaccacagtaggcaccgtcaataccgtaaccggccagtgatcatccgcagcattagcagtaaaagcagcagaatctttttgttggtcgcagcattattcagcgcttttgtcgtcgtttgtaatggacaactgcagcaggtgaattttaggggaaaacaaaaaggaatgatcaactgatgtgatcagtggtcagcctgatcagtcatgggcataaacacagtttgtgcttggtgattagggatgccatttttaggcacaaaaaatcgtgaaatcggcattaaataggcacaaaaataggcaaataaaaggcgcattggcaattaagcataaaaagtcataaataggcaaaaatgatttggattatatgagagcaaagatttttcgagaatg

SEQ ID NO: 106676 - DNA, 263 bp, Heterodera glycines
  Promoter: Source sequence=SeqID_24054; Location=1..263; Strand=+; Gene=SeqID_54748
aaatccttgacatccagatttgcttttggtcataatgtttcaagaaattttaggattgattatatttgaccccgaatttttgactttaattctgttccatggcacaaatccgcgtcttttttttggcattttctccaaatcccccgccccatatcagattaattttttgttccgctacgaccgagttggatactccgaatttaaagaatattataaattaattaataaattaaattttacatcttccagtgcttccagccatg

SEQ ID NO: 106677 - DNA, 316 bp, Heterodera glycines
  Promoter: Source sequence=SeqID_4914; Location=937..1252; Strand=-; Gene=SeqID_56178
catttcatcgccgacgtggccttttctgtgctaaaatcttcctaatgaaagtcattttctgacacatttcattttactacttatggaactactttttattttaaatattaaaaaatcatttttgtgtctttttctcattagctattttagagtgtatgacgtaactgataattaattactattaattgaagactaatgaactttggtaaattgactttttgtgcagttgtaactatttgttaataatcatttaattttttcattgatttttattaatgaaattttactttttagaaaacattttaattttattatg

SEQ ID NO: 106678 - DNA, 171 bp, Heterodera glycines
  Promoter: Source sequence=SeqID_1397; Location=322..492; Strand=+; Gene=SeqID_73263
aaacggagagagatggacaaaagcataattatgagaattgtgtaaattgtaaaattaaataatattaatggcgataattttcaaatttccaggcagtcgaatttgctcgagactgctcgagaaacggaccgattttcggcaattcgtcttctcaatgggcaaggaacgatg

SEQ ID NO: 106679 - DNA, 591 bp, Heterodera glycines
  Promoter: Source sequence=SeqID_20014; Location=126..716; Strand=+; Gene=SeqID_84790
agatcttttaaaaggggaggtgttcgggtggtcaaccccgagagatgaaagaacacatttgcattatttccctttgcatttgtatttttcttttcctctccattttccccactctctaattattgtgtcttcctttatttatgtaagacactattgatttattatgtccattgcatgtcctttcccctcattcattcagttgctttttatgcacttatttcacttcgcctaaatatttgttctcctccaatttatttattcacgccaccgacttcgcccatttttatttaaattgtttaatttatttgttcatcaaataaacattttattgtgtcggttcaaagaccgaacaattggcgacgcccgtcttaaataaagactcaacgacggatattttggcaatttcggacagattccgaattgctattcaactttcttcaaaaaagcaatagacccaataagggtgagcttccgccaggtgcggtttattcatcgaaaaaaaccaagatacccaggtggttgcggtttccgccaggtgcggtttactcaacaaagacaaggaaattcccaaaaagttgatcaacaaaaatg

SEQ ID NO: 106680 - DNA, 363 bp, Heterodera glycines
  Promoter: Source sequence=SeqID_16895; Location=1478..1840; Strand=-; Gene=SeqID_81322
atggtcgaccgaatcgttccgtgtttttgctgcactcattaaattgtctgatggattggccaattcattccattcactatttggcccggttttcgcatttttcttgaccaattaaaccaattagaccgaaatgggcgaggcaaaattcaatttgcgctttcgtttcattgatggactaacggagggaaagcaaagcaaaattttgccgtgttgtggtagggattgttgtgcttggagtagcccaattccaacgcgagcagaaagttctccagcacttggacatttacctggaaaagggcgaaacggaggaggaaaaataaaataaaaaagggagaaagggaggggaagaaaaaaaagaaaatg

SEQ ID NO: 106681 - DNA, 203 bp, Heterodera glycines
  misc_feature (17)..(17): n is a, c, g, or t
  misc_feature (19)..(19): n is a, c, g, or t
  misc_feature (21)..(21): n is a, c, g, or t
  misc_feature (23)..(23): n is a, c, g, or t
  misc_feature (30)..(30): n is a, c, g, or t
  misc_feature (32)..(32): n is a, c, g, or t
  misc_feature (35)..(36): n is a, c, g, or t
  misc_feature (42)..(42): n is a, c, g, or t
  misc_feature (65)..(65): n is a, c, g, or t
  misc_feature (114)..(114): n is a, c, g, or t
  misc_feature (123)..(123): n is a, c, g, or t
  misc_feature (125)..(126): n is a, c, g, or t
  misc_feature (137)..(137): n is a, c, g, or t
  misc_feature (140)..(140): n is a, c, g, or t
  misc_feature (153)..(153): n is a, c, g, or t
  misc_feature (180)..(181): n is a, c, g, or t
  misc_feature (189)..(189): n is a, c, g, or t
  misc_feature (192)..(192): n is a, c, g, or t
  Promoter: Source sequence=SeqID_8330; Location=143..345; Strand=+; Gene=SeqID_67713
ggtaaatttttgagagnantnanataaatntnggnntatttnaggagtaatttaatatggatagntttaagttgaaaagtttatagtttgagagtgtaaagattaatttgaatngttgaattngnnggaatgaatanggnaaaatgtttgggnaataattatttgatttggttaattatnnggagaagnaanattaaataatg

SEQ ID NO: 106682 - DNA, 320 bp, Heterodera glycines
  Promoter: Source sequence=SeqID_5844; Location=1853..2172; Strand=+; Gene=SeqID_59423
aatgccaaatgcgagtgtccgtttcagtcccaattcgactctctttcgaaatgattcggcgtctgtctctgctccgccctttcagtccgtcccttcccattattcccattggctcgtccattcgctcctccctctgcgcgaatacgaatgtcgcgtggctgcgtttgaccaattcggtcggatgggcccaattcgcaccgacggagtgagagcaaagacaaaagagagagcgcccgaggggaaggccgaaattaattcaatgaaagtgggagaaaaggtagggaaagggaaaatgccgaaaaggggagacaaaggcaatg

SEQ ID NO: 106683 - DNA, 62 bp, Heterodera glycines
  Promoter: Source sequence=SeqID_11126; Location=510..571; Strand=+; Gene=SeqID_74466
agtgcgtttgccctccgtttctgctttgatttcctttcgctttcagatgatgcgcaattatg

SEQ ID NO: 106684 - DNA, 352 bp, Heterodera glycines
  Promoter: Source sequence=SeqID_31645; Location=836..1187; Strand=+; Gene=SeqID_61963
attcatgacagcaatgttctgaggtttaggggtagacaaaatttccaaaaaatatattctcaaaacagaaaatcccctaaacctcatcgtaaattttctcatgctaatgtatcggcactgtcagagccacaaaattatttttgggttttttcccttcatttttataccccagaaaactgatgattggcaccatttcccggcaaattcaaaatttgagacaatttttattggtcacgaattgttaaactagtttaaaatgggttttcccattcattgctgtcttggtccattttccaaatcttgtggccatttttcaaaatgtacccattttgttttacaatactttaccatg

SEQ ID NO: 106685 - DNA, 1003 bp, Heterodera glycines
  misc_feature (659)..(659): n is a, c, g, or t
  Promoter: Source sequence=SeqID_17729; Location=1566..2568; Strand=-; Gene=SeqID_82266
gtggaggggatggggccaaattttggggccggatattgggccttatactactgatttgattttgtaaaaaatcacctattttttgatttagatacaacttttttaaagacaaattaaaggttttgtaacgcagacggagaaaaattagaactttgaaacttttttgagaaaaataatccaagttttcaaaaaattttcgccgcgaaatcgcggtcgcgtaccacccttgatttgtgcccaattacaagtctcaattttcctcaaattaataaatttagtttttttgttttgtttttttccatctgaaatgctttttcataccatctatagccatattcgagatttttagcttaaatttcaattgagaaatttaccctcacttttagaaaaaaaacacagaaaatataattagtaccggtagtgtggggcttatccacccctaagcgcatttaatccaaccatttttgtgtctcgttaatccgcccatttgcactagtgctcttctctaagcccaattttactgttgttcgtctcctaaaatttgggcacctttcgttgcccattgaatataaattatgaactggactaataatgatccgaaattctaatacattagctcatttttattttttaaattaaatttataattttgaaattanattttatgcaaagaaagatccaaaatcgaggtcgacagaaataaaaagcgataaaatgctttcggcttatgattgatcccatgaattattctcacctttattttatttaaaatactttttttaagttcataatattttaattcttataaaaaaagacaaccaaaattattgtccttttttaatttattattttattttggtctttgtttttgtccgagtgccgtttcgagaatcaaagaattttcgaattttgtattttaaattaattttcaatttttttacatcatttcttgcattaatttgttgcagggttaggttaattaaataaattgcacaatgaaatg

SEQ ID NO: 106686 - DNA, 349 bp, Heterodera glycines
  Promoter: Source sequence=SeqID_32930; Location=1..349; Strand=+; Gene=SeqID_63153
agatgctgttttgaacgaataaagggcataggttattttgaagaagtgtcaaataacatcagcaataagcctgcaaaatctaatgagtggaaaatacatgagtatagaatttattttcagaaagtgtcaacagacttttggaaaaatatatttgcaatttatcaacaattttgagaagtgagttagaaatgataaacttcacgattcaaaccagttttcggtgctctaattaaccgcgataaaaacatccgaatcaattaaatagcttctgagataataaggtttatcataaaatttcatttaaaaataaaccctcaattattggtatgaacgatactttccaaacatg

SEQ ID NO: 106687 - DNA, 445 bp, Heterodera glycines
  Promoter: Source sequence=SeqID_36898; Location=412..856; Strand=-; Gene=SeqID_66102
ttttctgagccaatgttaagcattttaaatttaaatttaataattaaatggatttaagagtattttttaaatagttaatcaatttccaagagtttttttatatgctattttagaatatattaaactaaaataattcattttgaaagacggaaaatcaattagatcttattttacaaattccgataaaaacttactcaaaaatggaatgaaactgagaaagtgtgggttggcaaaaggcaaaaaaaaattcaaatgcgatcggaattcaatttgctgattgccgaattttttgagagtgtcggcattatccctggtgtataccgaaaaggtgaagcccgtaacattttttacacaaatattatacattaaattaataatggcaaatatttaaattttattgaaggttaattgcattaatttaaaaataattttccaaaaaaaaatg

SEQ ID NO: 106688 - DNA, 313 bp, Heterodera glycines
  Promoter: Source sequence=SeqID_3954; Location=882..1194; Strand=-; Gene=SeqID_52575
acttttggcacaaggcaacgaactgttgctggtgtccgccccgaaaatgaggccaattgtttgctggccgatggcgaagaagaacacggaggaggaggagaatgattaaatgataaatgaatgcctcaacaaatgtgtcttatttatttatattacctacttttcatttttctcaatcgtataaatccaattcatatccttttttttaatgggttcagtaaatcactgaatggtttcaattccatttatttttacatttctatacataaaatccaattttttatcattgcagcagctgctgttttttgtgatg

SEQ ID NO: 106689 - DNA, 69 bp, Heterodera glycines
  misc_feature (52)..(52): n is a, c, g, or t
  Promoter: Source sequence=SeqID_31826; Location=870..938; Strand=-; Gene=SeqID_62132
ccccagcagtttcaaaatttctttaataaaaaaatcaaaatgttccatttanccaaataaattaagatg

SEQ ID NO: 106690 - DNA, 334 bp, Heterodera glycines
  Promoter: Source sequence=SeqID_7882; Location=341..674; Strand=-; Gene=SeqID_46493
gggttgggggggggggcgggacaaaatctcgccgcagaaattttaaaaaaataaaaaatttaaacttaaaactttttcaaggagaaaattcttagaaattttttttataagaaaaatttaatgaaaaaaaaatttgaaaaattttcagcaatttttttgaattttatgataaattactgttttttgaaaaactttaaaaaaatttaacaaacaattctttttgaaattttcttataaaaaattttttaagaattttttccttgggaaatttctaagtttgaaaaaatttatagaaaaatctgacgtgaaataaaataatttcctcgtccagatg

SEQ ID NO: 106691 - DNA, 511 bp, Heterodera glycines
  Promoter: Source sequence=SeqID_7807; Location=4392..4902; Strand=-; Gene=SeqID_66025
catcagcgtatgtttttagaccgattctttttaagacttttgctcatacttcttatgtttcaatcgggctgtagtttttagcaaacatacatgtcccataaatattaagaacccaaaaagtttataaatatagaatacaatttttatatttttagaggtgcgccatttgttcattttttgcgcattgccacatgaataaaaaagtgattgtaccttactataagcacatcattacttgtattatcgctatctgcgaagagtttggccaaaattctcggttttaaaacataagtagaatttatcattttggggcattattaatttttaaaaaacgtaacaaattttcctctaaatttttaaataaatttctttgctttttaatttgggtcagtaaacttagtaaaaagttcagcccgatgcgatcataggaagtatgagaataattatgtacttctaattttgggaaagaatgtattaataaatgtagataacaatcaaagcggatgccatg

SEQ ID NO: 106692 - DNA, 88 bp, Heterodera glycines
  Promoter: Source sequence=SeqID_13948; Location=151..238; Strand=+; Gene=SeqID_77910
ggtaatgtctttttttttaccaaaaagatggcaaaaaacaattgtcggttctttagttttctgttcgataatcatcaccctacccatg

SEQ ID NO: 106693 - DNA, 734 bp, Heterodera glycines
  Promoter: Source sequence=SeqID_20189; Location=1715..2448; Strand=-; Gene=SeqID_84984
ttcgctcttggggagcttcgctacctagactgtgaagcggattcaaattgatcgaatttggttagagagatttttttgaatttttaaaaaattattaggaggttttttagtccacattgagggctcaagacgggcgcttcacgcccgttttttagcttgttagaccgtttcgcgtcctcagtcgggcgcttcgcgcccgtttttcaaattttgttggccttacagagattataagagatacaacagtgattaaaagaggtaaaaagtgattaaaagaagtacaacagtgattaaaagaggtaaaaagtgattaaaagaagtacaacagtgattaaaagaggtaaaaagtgattaaaagaggtacaacaatgattagaagttagctcttgttgtggagatttggaattttttttaaattatctgggacttttaggccgcttcgcggcctcgaacgggcgcctcgcgcccgttttttaaattttgttgggcttatacaggcgcttcgcgcccattttttaaatccgttgaactcatacgggcgcttcgcgcctgttttttagcttgttaggccgctttgcagcctcagtcgggcgcttcgccggtttttcaatttttgttggccttggacgggcgcttcgcgcccgtttctaaattttgttgaacttggacgggcgcttcgcccccgtatttaaatgttgttgagctccgacgaggtacaaaattgttggaagatg

SEQ ID NO: 106694 - DNA, 819 bp, Heterodera glycines
  Promoter: Source sequence=SeqID_1599; Location=3610..4428; Strand=-; Gene=SeqID_74746
ttgcggaaatcgggaaatagaaggatttgatataaaatatgaatacctaaaatgattagtagggctcggattcttagggttttacttgaccgggcccaggctgcccattcaaaaaaaagcccgttttgcagggcgacccgggcccggtccaaaattttggccgggcgctcgccgggccggttttaaaatttgtgaggattaataaaattgaaaataattggcgctactgtaaaagttggcctttttgaaaattttttaaaaaagtcatgaaaatacatttccgggggttttcggggccgctgatcacgaatatgacattcatttcgaccaattttgaaccccggacccggattcgaacaaaaagtcgaaaatcgtaaattttcacttttcaacactgaattcgcgccgcccaagacacatttatgtaattcaatgttaaggagacacactatccatttccagcatatcggggcagtattaggaaaataggatagtgtgtctgtcctatataatgttattatcataaatgtgtctcataagttctgagtaccacatatgtctagagatttgaaattacaatgaaaaatttctgatcataaatccgggtccggggttcgaaattggtcgaaatgaatgtcatattcgtgatcagcggccccgaaaacccccccggaaatgtattttcatgacttttttaaaaaattttcaaaaagggccacttttaatatagcgccgaaatttttgtttaattttattttatgaattcggaaaatttagttccatccatattttgctgatttcccgtttcataatcaaatg

SEQ ID NO: 106695 - DNA, 283 bp, Heterodera glycines
  Promoter: Source sequence=SeqID_3118; Location=141..423; Strand=-; Gene=SeqID_83280
atttaaaaaacccgatttagttacagttttgggcattaaatattttcaaaaaggctaaattgtttctgaattttaaatttgttaaagccttttacccaaaaaattagaattttgaaaagaaattaaaagttttaaaaagcgtatttgttattatgttattttagacatttcattaaaaaagtctaaattgttttcaaactgaatttattaaaaaaaaaaaatttttttttacctttattaagaaacttttgtcataagcgaaaatctgccctggcccttgatg

SEQ ID NO: 106696 - DNA, 575 bp, Heterodera glycines
  Promoter: Source sequence=SeqID_44426; Location=580..1154; Strand=-; Gene=SeqID_71916
tgtgcaacaaatagtgaataatttatgtataggtgtatatcgtactaatgtgattgaggagacggtggatatggtacttgtatactttttgagagagaatgtttggttggctccaaatgttttttttgtcagcggtgtttgtataccaatttagtgacagcccccggtttggaaatgaaatgtaaaacgtttttttttttcttgaggggtgagagttgttcaaccaattgtattctagtttgacatttactttgaatcccggattcaaattcaaaaaaaaagtagtcgcagaatttaatgaatttttggggtttacaactcagttttttgttcaaattcgacattaatgcactagaaacggtcgagaccaaattatgtattcagacaaatgtaattataggcctgtaactgggcaatttcgtaattttccccaaaaaattgttggccctcttgaaacaagtatacgagtacctttgtttaagttaacaattttttgttttgtgacatatctcatctcattgcttgctttcatgtacaatattattaatgtgcactaattacattattagaaaatg

SEQ ID NO: 106697 - DNA, 785 bp, Heterodera glycines
  Promoter: Source sequence=SeqID_6601; Location=123..907; Strand=+; Gene=SeqID_62160
ttgttgcacataaaatatggccataatgccaaaatatgggataaatatggaaatatggacataaatcgcgaaatatgaaaaatataaaaaaaacgggtatagaaatccatcctagaggcttcataccaagctaaaaacatatctttcgtgagtttcaggcctaccacagtccaggaaaaaaatatagatttccataaattgggaaccctattgatcagtgtcagcttctccctaaaatgggcaaaattaattatattaatttgatcgaattttccatatttatttaatctaaaatgcaaaaatgtatcattttaaaacagatcgctgcttcttctttatctccgcgaaccatcgctgaatttgcattttttaaaattattttttcccatcgtttgtccgccatttctcccgtcccatttccctcttttttgctcctccattaattttttgttggccttcgtaactttgcaatatttcttttaaatgattttatgtcccaacttttaatgtcctccgtccgcttacgtttatcagtttaaatccaacaattcaagcaaatcatttgttgaatgaaatgactgaattacattttttggaaatttgcaatttgctgccatcgaaggggacgtgctgattcataattattttttaattgactgaccaataaaaaaggttcccaaaatttaactctgtatgacaagccggctaacatttcattatcacatatttcgaagtcaaaaaattttacaacttttttaatgctttaaattatagtgaaaataatg

SEQ ID NO: 106698 - DNA, 220 bp, Heterodera glycines
  Promoter: Source sequence=SeqID_17936; Location=560..779; Strand=-; Gene=SeqID_82492
tttttacaatgttataaaaatgtgtgggttcttaggtttcatttgtatttacctgttttttatttaaattatcacggaaaaaaacatttttagcccggaaaatcattattaaaacggaactggcacatttgcgcctgtaacatatttatttattcaaaaataaaataaccaaaagaagggcacgtgccgcttacacttttggtagaaatgaggtcaaatg

SEQ ID NO: 106699 - DNA, 58 bp, Heterodera glycines
  Promoter: Source sequence=SeqID_29195; Location=1..58; Strand=+; Gene= SeqID_59729
atcattcaaaaatttatgcaaaaatgacaaataaaaaagctttcagtcattgaaaatg

SEQ ID NO: 106700 - DNA, 129 bp, Heterodera glycines
  Promoter: Source sequence=SeqID_35756; Location=1..129; Strand=+; Gene=SeqID_65238
tatcctcgaattaataaagttttgaattaaaaaatcttccttgttccatgtgaatgaatctttaaatttatttttggttaaataattcaaataaatttcaagattatttttttcaaatatttcgaaatg

SEQ ID NO: 106701 - DNA, 67 bp, Heterodera glycines
  Promoter: Source sequence=SeqID_34893; Location=409..475; Strand=-; Gene=SeqID_64584
atgatccagtgggaccacaggagtgggaagaaatgaggaagaaacgacgaaaaagggcgaagaaatg

SEQ ID NO: 106702 - DNA, 124 bp, Heterodera glycines
  Promoter: Source sequence=SeqID_908; Location=2312..2435; Strand=+; Gene=SeqID_63697
ttgaaattgcaaaagaaatgacccctcgatttagatgctttccttttaagctgctttattatttataacaaatctgtcattttcttttcatttcatctaaaatttttgtttctagaataaaatg

SEQ ID NO: 106703 - DNA, 380 bp, Heterodera glycines
  Promoter: Source sequence=SeqID_8593; Location=1819..2198; Strand=-; Gene=SeqID_68633
tgggggcaacaacaaactttttgttagctaaccacaacatttttaaataatgaatttcactgagagttaaaaattaacgaaataagcgaaataaaaaataaaaaattttgttcggtgaatttcaccacaaaatttacaaatttttaaagagttgatttttttaatcatagaaatggcagccaaaaagatggcacaaattttccaaaaaaaatatggcaaatgccatcatttgtgccatatcccctctatttttcgtcacctcgggccaagtgaccgtaccgccgaccatcacttgcatgccctcgtggaactgttcgccgatgatcatcgccgtgccaccactttgacaccaaacttcgcccggaaaaatcattttgatg

SEQ ID NO: 106704 - DNA, 287 bp, Heterodera glycines
  Promoter: Source sequence=SeqID_22023; Location=1..287; Strand=+; Gene=SeqID_52658
aaacgattgcaaagtgatcgatcactgatcagacatttccttcctcttttttggaccaaatttcctttcacattattatttttagcaagaattaattgttcgtttaatataatttaagattttttattcaaatttatgcaaataacaaaataattaccctaatttggatttaattaaccttttttaagtaattttttttctttaaaatgcgttttcttcacgcgccaaaaacattcgttgcaattttcggcacttttttaatttgggcacccaacggcgaagcgatg

SEQ ID NO: 106705 - DNA, 267 bp, Heterodera glycines
  Promoter: Source sequence=SeqID_32784; Location=373..639; Strand=-; Gene=SeqID_63031
acaataatattattattattattcaactgggtgctccacgaggaaatgtcagtgttcggggccaaaacaccgattaaattcatccattggtggaaaatgccagggatgaataccttctggggaccagccctaattaatgaattaaaaataatcaaaaaaattttaaaattttcattatgttatagcaatttcgatttatgcaattttatcggccgcaatttgtgcgaattgttgcaaaggccaggcaatcacacggtgcgcgagatg

SEQ ID NO: 106706 - DNA, 131 bp, Heterodera glycines
  Promoter: Source sequence=SeqID_38832; Location=121..251; Strand=+; Gene=SeqID_67550
tgaccgaccaaacggcattcaaattgccgaaaaagggagtccccctcattttagtccatcagaacacgcccgcgcaacgcgacgaagtctccacctcttcggccaatccgggccaaaccgacacagcgatg

SEQ ID NO: 106707 - DNA, 1003 bp, Heterodera glycines
  Promoter: Source sequence=SeqID_13920; Location=1438..2440; Strand=+; Gene=SeqID_77874
gaaaaagtgcctgaaacgcaccaaattttattgtcatgttattaatgaacagggctgcaaaaaatatgcacgaaaaatgaccaaaatcactcgcgcacccattcaaatttggatttaattttaggcataatcaaattttttttcctaagagatattcgaatcggaaaatatttgacgaaaaatggcaaaatatgcaaaaaatcggaaaatatttatatttgacgaaaaatggcaaaatatgcaaaaaatcggaaaatatttgacgaaaaatggcaaaatatgcatgaaatatgcagaaaaagccaagatatgcaaataaaagtcccgacttttatacgcaaacacaaaaaaaagaaagtgttttttatgcaagtagtaacccctgccacaccttcgccgcttgacgctaattagaagtgacaggtggcggaggagggtgtcaattagtcactaattgggggggggggtgtgctaattggtcagcggtcaagagggcactaattggtcagccgtagggtgtggggtggtgtcaattaattagggaaacctaaacctatgcgaggggtgtgtaaaattttcatgtactttttttttgacataaaatttgattgatttaaaaagtgacagccgagggggagggggaatttgattggtcagcgaagtgacagatgagggaaaaattcaaatttctgatgggcggggatcggaaaattatgattgatcaacaatgtgacagtttttgatattattaaattattcaaatgaagtgaaataatttgttttgcatttggactttatcaaacttgttatgaaggtgtaaatttgcaatttgttgacgatttcgcgcaatgtttcgaccgaaattaaattgtttgtcacttataaaataggtcaatttgtgaatatttaaggtttccaaaatggaattcattgtaattgctacatttgttccatacttttcttccaaaaattttccaacccattctattgtttacccaaaatg

SEQ ID NO: 106708 - DNA, 671 bp, Heterodera glycines
  Promoter: Source sequence=SeqID_25366; Location=618..1288; Strand=-; Gene=SeqID_56111
aattatatccgcgggcctccgccattttgagttttggcattccgtccattgccatttatccccaaaaatcgtctcgtccactcattctctgattacataattttgttaaaccccgaaacactccgtccattcttttgtcttttggtttttcggctcaatctttttaaaatcatccgttcttttaatagctgtaattttcatttttaacacaattgaaaagcgaatattttcaaatgcttgcttctggtttcttgcatttgtcgtaataaatttgttttggtaaagctaaaattttaattcataaaatagcaagaaaaaataaaaattagtctgatctatgcccaacactttcagattttttttattgctcaattttacgctgattttttctcttcactcaaatttaaataaggaaaatttaggaaatttaatcggaaatcggaaatccgaccccaaaaaatttttattttttctatattacacaattttttaaaaccaatattttaccaatgttaaataattataatcatataataaaaattttccacgtaatattgtgattaaatcatattttcatataattgtagaatttataaatttttttatgtcaccacttcattaataaaaatgtaaaacaaatttattattatttttatattttttaggaaatg

SEQ ID NO: 106709 - DNA, 423 bp, Heterodera glycines
  Promoter: Source sequence=SeqID_23100; Location=1697..2119; Strand=-; Gene=SeqID_53809
aaattttccatttttgacttatttctgcataaatttccaattttttataaaattattttcctattatatttttcgagaaaaaacacctaaaaaaatatgatgtaacgacaatgacttggattttgtttttaagattttgattgaggcacaatattaaaatttttaatactttattattgcgtcatttgaataaaaaaaataccaaataacaaaatacaattttctgtttaaaattaattttttttccggagagatcagatgaatattttttaatattttgtagtttattttatttgaaaaattgtttttatggtaattttatttcatttatgaataaataaatgtataaataaatggccatcaataatcaaaagaaagaattttgtattttttaaaaataattttgagaatttttgataaatg

SEQ ID NO: 106710 - DNA, 439 bp, Heterodera glycines
  Promoter: Source sequence=SeqID_29338; Location=666..1104; Strand=+; Gene=SeqID_59850
tctcacactaaaccaatttactttacttttcatcctttttcctttgcttaattcttaaacacaaataaaccaatcgcattcccccttttgtggacatttggaaaagttaatatttggtgaaagttggaattaaataaggcacatcggagtctaagcttagtcaaatacacaacaatttttggtgccacgacccgggagaaggtcaaaaggctaagcaagactagctgaagcagttcagctgtggtaaaggctctgtgcccaaaccaaatccatcaaatgagctggtcttagttgtgtactaccagccgggctgtttgtgccaatcaccaaatttaaaggagctggtcaagtgtgttttccagccgagctgttgtgctgaaaaaaggactaagtgtcttcaaaaaaaaaattgtttaaaaaaaaagaattttggaaaatg

SEQ ID NO: 106711 - DNA, 212 bp, Heterodera glycines
  Promoter: Source sequence=SeqID_19500; Location=2736..2947; Strand=-; Gene=SeqID_84217
tccttttttatccaacaatttttgcacttttgctgctgatggggttgtaaccaaaaattgtcacgtctcactttaggttttttttcattcttttttttcattctccaaatatttcattcccgtactaaatgaccaaaaaacgacggcaaaattccccaaatttaaatgagggggaggacattctcgcccgtctcgaccgacttgaaaagatg

SEQ ID NO: 106712 - DNA, 1003 bp, Heterodera glycines
  Promoter: Source sequence=SeqID_12322; Location=444..1446; Strand=-; Gene=SeqID_75919
gccagaaaagtaaataaagattatttgaattctctttccttgtctacgtgcatttgaattgtttttgagaatttaaaataattaaaaattatttcgcgaaacggcctttgtgtgactgcatcatttttacacttttcgcgaaatgacctagcaccttcagaaaattttggcattctgtcctttcaaagttcaaaaaacccaatgcggatgccggtgcgctattgggattcaaagtttttgcgggaagggatgccgctgtatttatcccgtaaatccctcattttccaaaattacggactgggatcacgcaaatcagtgcgggattccatcccgcgcgaatcggacaattgaaattttgcttattgatagcgtaattgtaactgttcagataacaaaaatgacatgagaaaaactcaaaagttgtgattttgtcaaattagctgatcatttttatgcagaaagatggattaaacgaactgactgtaattgaattacttttattaagagacggtaattgcaccattactgctttgaagaatacattcgcatttaattagtcgaaaaaatttttctattatttaaacgcgtccgatgaagtcgaaattttttttcttaagtatttaaacacatccggagaaatagaaaatttttttctaaagtattaaacgcacgaagaagtcgaaaatttttctaaaatatttcatcgcatcagaagaagtcgaaaatttttctaaaatatttcatcgcatcagaagaagtcgaacccgattgagtgcattcgaacctacagcattttaattaaagtgcattagcaccatagtctgactctgtactaatccctacccatttctgttttctaaacctaatgatcggcaatcagggttgtatgtgatcgagggaattcttatcgtacttcgttctctaggatttttgaaggaaaatgacacttttcggctgaaaatcgatcacatacaaccccaactacggtagaatttagtaaatg

SEQ ID NO: 106713 - DNA, 543 bp, Heterodera glycines
  misc_feature (47)..(48): n is a, c, g, or t
  misc_feature (54)..(55): n is a, c, g, or t
  misc_feature (64)..(65): n is a, c, g, or t
  Promoter: Source sequence=SeqID_32064; Location=1..543; Strand=+; Gene=SeqID_62380
tttattcatctccctttttgatagtgaagcatcagagagccttattnnactttnnaattacatnntggtgcgtttcagagcacgttctaaaaaatatttatgaattaattttgcaaaataataaatagttaatgaaaagtcagaatttcgaaaaatttaaaaacaacaagcgttggcattttttcaggttaagttagtcctttacaatggagaaggcctgcaaaatatggagagattatatcgattttagtgcgctaggttcgatgaaactttttaaaatataagcctaaactttttggcctgtttaaaaaggaattaaaaatttttaaaatatttattcatctcccttttgatagaaaaagcatcagagagccttatttaacttttaattaacatttggtgcgtttcagagcactttctgaaaaaatacttatgaattaattttgcaaaaaataaataagtaatgaaaaagtcagaattttgaaaaattttaaaaacaacaagcgttggcattttttcaggttaagttagtcctttacaatg

SEQ ID NO: 106714 - DNA, 692 bp, Heterodera glycines
  misc_feature (16)..(16): n is a, c, g, or t
  misc_feature (31)..(31): n is a, c, g, or t
  misc_feature (55)..(55): n is a, c, g, or t
  misc_feature (63)..(63): n is a, c, g, or t
  misc_feature (69)..(69): n is a, c, g, or t
  Promoter: Source sequence=SeqID_42593; Location=916..1607; Strand=-; Gene=SeqID_70449
taattgagcagtttgnctctctctcctccanaatggacatgaatgaatataatgnacaaatanattccnccattttttggtgttaatgatgctaaatgtgggggaaaaattttatgttatgtgaatgaatgggttgggcgggttctcttcttctcatttgtgctttcacattcatattaataaacaattttattacatttggaaattcaataaaaaacaaaaatattttccaaaatccataaataattatttttaaattaacaaatcatctttttgtaaattcaatttattttagcgaagtgatttatgtttaataggattttttttttgttgttgtaaattcgaaataaataaatatttgagaattttaatgttgttttatatatgtttcgtggtttattatgaaaaattctcattttttttgtcaaaattagttaaaaattgaattaaaaaccaaaaaatgatgttttaaataaatattttagttttattttaggatctaaatacttaatttaaaaaattctttttaatttttaaattagttttttttaaataagtttcaaatacttactgaatttaaatgcttttacaatttcccctttttccagtgcttctaatcctgctgagatgttcgaactgcgcgcggaattgaacgcacacgaaaaattggcggaagaaaaaatcacagaatg

SEQ ID NO: 106715 - DNA, 179 bp, Heterodera glycines
  Promoter: Source sequence=SeqID_5075; Location=893..1071; Strand=+; Gene=SeqID_56808
atgaataacacggtggagacgggcgtacaggtacgacctggcccctcgaaccgaaggacaagtccgtattgattgctggcgaagatgaagagattgaagtgcctacgccaataagtcagacgccgggaaaaagccgattgcccaggaccaacaagaaagcgatcaagcagaaagaaatg

SEQ ID NO: 106716 - DNA, 1003 bp, Heterodera glycines
  Promoter: Source sequence=SeqID_7384; Location=106..1108; Strand=+; Gene=SeqID_46410
gtagagttacaatatcatccaaattttgaaagattcaaagcggtttttacccatccgagaattgaatttatctctttttcgcctcagctcggctatgtcttgggttttgaaaaacctcaaaatgtaaggaataatgaaattgctaaatatggaagtgatctccgtggtggatttgcaagctttgccgtctacgcaaaaggtctaaccgagaatatgattgtaggaaattcgttgagctcgctccttcgtgttgtatcagtgtcgggggcggtaccaggcgcgtacacggaaaaaatttacgactcaccgctttatgcacgtgttttgccaaaagaagcatcagaaattgaaattgaattgcgaactatgaccgacggacgactggtaccattttcctatggtacagtgctgatcgtattaatatttaagaaggtgataaatttttaaatcattcattttttgttaacattcttaattgataaaatggtacacactctttatgacacttcggtttcgggctatgatgcattttttgtgcaaaatggttgtggaatcggggaagattcctcctaccaagtttttcgaggagcgccaccatttcagcgagggtggggctcagcacagacgggtgcaggaataggggatatttttcgtggtctctggcgctttttcctaccattaattcgcagagccggagataccgtagcagatgaaacaattcagactggaaaacgttttataaatcgagtaatcgatgaaaagcctggcttgaagggaacagtagagacattggcaactgagagtaaacggggagcggacaatgttttagagaaggtaggatttcggcgctaatttggcacaggaggacgaagaaagcatataaaagctaacaattcctccattctatcacatcaaacgataattggaaaaacaataacaaagccattaattaaaagcaaaaagaggcttcgatcagacgcgtttgggctttattaaaaaaatg

SEQ ID NO: 106717 - DNA, 819 bp, Heterodera glycines
  Promoter: Source sequence=SeqID_1599; Location=3612..4430; Strand=+; Gene=SeqID_74747
tttgattatgaaacgggaaatcagcaaaatatggatggaactaaattttccgaattcataaaataaaattaaacaaaaatttcggcgctatattaaaagtggccctttttgaaaattttttaaaaaagtcatgaaaatacatttccgggggggttttcggggccgctgatcacgaatatgacattcatttcgaccaatttcgaaccccggacccggatttatgatcagaaatttttcattgtaatttcaaatctctagacatatgtggtactcagaacttatgagacacatttatgataataacattatataggacagacacactatcctattttcctaatactgccccgatatgctggaaatggatagtgtgtctccttaacattgaattacataaatgtgtcttgggcggcgcgaattcagtgttgaaaagtgaaaatttacgattttcgactttttgttcgaatccgggtccggggttcaaaattggtcgaaatgaatgtcatattcgtgatcagcggccccgaaaacccccggaaatgtattttcatgacttttttaaaaaattttcaaaaaggccaacttttacagtagcgccaattattttcaattttattaatcctcacaaattttaaaaccggcccggcgagcgcccggccaaaattttggaccgggcccgggtcgccctgcaaaacgggcttttttttgaatgggcagcctgggcccggtcaagtaaaaccctaagaatccgagccctactaatcattttaggtattcatattttatatcaaatccttctatttcccgatttccgcaatg

SEQ ID NO: 106718 - DNA, 147 bp, Heterodera glycines
  Promoter: Source sequence=SeqID_31817; Location=705..851; Strand=-; Gene=SeqID_62100
ttcgacctcaaagagaaactacctgaataatgctgcaacgacgtccgaatcctcacccacgcccttgcagaactacgccgggaattcaaacaacttacacaaagggacggaaaacacggtggaatcgacattttgtggcaagccatg

SEQ ID NO: 106719 - DNA, 231 bp, Heterodera glycines
  misc_feature (50)..(50): n is a, c, g, or t
  Promoter: Source sequence=SeqID_29510; Location=1394..1624; Strand=-; Gene=SeqID_60001
tgtgctgcagcagcggctaaacattatcccgaatactcagattctgtaangcttggtgaaaagaagtgctctcattgtggggcactactcttcccgcatgaggacagcagcctttgctgtcgacagggaagagttgtgttgccgaagcttaacccgcacccaaaagagcttgaagagctcatcacgtgcgacaaacaatcccgtgaagggaaagaatttgtgcggcatatg

SEQ ID NO: 106720 - DNA, 484 bp, Heterodera glycines
  Promoter: Source sequence=SeqID_4476; Location=1191..1674; Strand=+; Gene=SeqID_54587
ccttgtatttccaagtgaaaaaggacgagaaaaacaaaatttaacaaaagatttttgtaaattcgaacttaaaagttcactcatcaatagctgcaaaattcacgtaaataatgtatgttttttggtatttttgagattttagggcgattcttagtgggtggttttatcagaaatttttgggttgattcttacaattatgggtgcatttttcgttttattgcattttgctaataaattttgggcaaagcgccaaaaatagttttttttcaaaaaaaaaaatagattttttaggctttaaaaataaaaaattagaaaataggccctaacaactcgaaaagtagcgtaacaaccaccaaaaaaaaaaaattgtcgtgcgtttcagaccataggagttcaggaaaaaataggctaaaacctaaaatcttatctttaatttattaaacaattttactaattttttcatttttatcagctgttgagaatg

SEQ ID NO: 106721 - DNA, 379 bp, Heterodera glycines
  Promoter: Source sequence=SeqID_8866; Location=2091..2469; Strand=-; Gene=SeqID_69461
ttgctgatggtgatcgtcgtcatgtaatgtgcatcaaaagacgtaaatgctttttcaaatattttgcttggggacatttgcccttacaattttcccaggataattatcaacagtaaatgtttctacaaaaatttttaaaaactttagcgttttttttaaagtttatgatgaattactaattttttcaaaatttttccaaaaaaaaaatcccttttgttttttaaattaaattccagtgtttttcgggaggtgggaggttaaactggaagcaccgagggtgccttggaatgattttaggattcgaaaattgactccaattatcatttttttatttccaattttagtcagcaaaaaggcgagcattgaactgtccaaaatg

SEQ ID NO: 106722 - DNA, 851 bp, Heterodera glycines
  Promoter: Source sequence=SeqID_22372; Location=1..851; Strand=+; Gene=SeqID_53039
atctgagtctttcgtttttatttattttttgcaaatctcactttgaatattttttcagaaagggttctgaaacgcaccaaattttatttacatgttagtttaggcactctgatgctttttctatcaaaaagggagatgaataaaatttttaaaaatttttaattcctttttaaacaggccaaaaagtttaggcttaacttttttttcagaaactgatcagaagcgcaccaaactttgcagggatactgaaaggaagagaaataacctattttaaatattatctagtcagttcatttaaataatttttatccaaaaaatttttttttgggttttcggggcagtccccctgaaccgatgcgcccagatttatggggagaccgaatccttcgggaatagcttccctatagtctgtactttaattctgcgttggatttttgctccccataaatgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataaatgtttgagtaccccaaacggacacttgaaaaaatcgatttttttgtttcataaatatttttttcagaaagtcatg

SEQ ID NO: 106723 - DNA, 651 bp, Heterodera glycines
  Promoter: Source sequence=SeqID_5573; Location=3554..4204; Strand=-; Gene=SeqID_58529
atataaaattattaatcatctacaaaatgaaaaacgcggcttataaaaattttataaaaaatattcgaattattgtgttattaagcgtgctggtaattaattattcttttaaattaatctcataaagtttactattgctttggtcttactttatttacattgcatttttactatacgataatctaatagtaatcgcaaaaatgcaccggcagtgcttgcgagtaaaattaatttttctcaaaataaaaatgatttagacgagtaacaaaaaaagtcctcgctactttgttatattttttgaatgtatatttttctctacatttctaataaacgttttctattttttctttttaatcttggcatctatagttgacgccatgaaatctactactctcgatttcggaagttctcgttttaatatgtatttgtaataatttatttttacggattttgcatctaaattccaccataattttaaaatttaatttgtttatttttgccttaacattgttgaaaaggctttaattttcttaaattaaagtattttatatagatttattttcctttattttaattcttatattttaattagttttcatttttttactatatataaaaagtcctccatattcagttgaaattttttatatg

SEQ ID NO: 106724 - DNA, 303 bp, Heterodera glycines
  Promoter: Source sequence=SeqID_14026; Location=422..724; Strand=-; Gene=SeqID_78003
tttcgaccgccgactttcatcgcgtcaaaaaaccaatagaccctaaaagggtgaggttccgccaggtgcggttttcaacgcttcaaaaaaaccaatagaccctaaaagggtgaggttccgccaggtgcggttttcaacgcttcaaaaaaccaatagaccctaaaagggtgaggttccgccaggtgcggttttcaacgcgtcaaaaaaccaatagaccctaaaagggtgaggttccgctaggcgcggttttcatcgtccaatttcaacactcaactgaaaagcgatcgataaccaccgacaatg

SEQ ID NO: 106725 - DNA, 69 bp, Heterodera glycines
  Promoter: Source sequence=SeqID_40768; Location=105..173; Strand=+; Gene=SeqID_69012
tgtcggactggttgacctgctgatcaaccgtggtgagaagatgccctgttcatcttttgctgtcaaatg

SEQ ID NO: 106726 - DNA, 401 bp, Heterodera glycines
  Promoter: Source sequence=SeqID_13225; Location=1438..1838; Strand=-; Gene=SeqID_77053
tttttcgtgcgttggccaattttttaatgttttcggttgctttttgatttgttcctttctcttaacccactcaatcgctgcgctgatcaccgccgcctcgccttttctcggaattgctgccaattcgtccgccgattggccccaatcatcgccccctccccctcccccccccccaatcattttctggtgctgatccaactcaccgaatttcctccctttcttcccattccaatcgttctcctcctcctctcttcttcgtcctttccatcatttaattatcttcctaaaaatctttccttcttaaacaatgacgtcacttacaattttgaacagtcccattttttttaactatttgaaaatttccctccttccaagctcagtcttctgaccaaaacgaaatg

SEQ ID NO: 106727 - DNA, 921 bp, Heterodera glycines
  Promoter: Source sequence=SeqID_4971; Location=4335..5255; Strand=+; Gene=SeqID_56406
attgcaagaaccacattgacgaagcccactctcctgattgctttaaaaatattttttcaagctatttttttttctaaattatctgcaattgtccgtccgaaaatgtccaacttcgcctgttatactgcaagaatacccatttttttggccaaattatttacaaagcataatgctattgaattcttttattatttaaatttttagtaaaataattggccaaatgttttttgtcaccaaaagttagccaagataaataacttttatgtaggtagtacaataaacatttaaaattatgccacttttatacagttagttggggtcgaaaaccaaagggggatcattttgatttgcaacaaaagattattgcatatttaaaggtggttgattatgaattgtgcaatttatttttgtcatttgtgactttcaccaaaaaaacttatgtttttagtcaaaagggggtccgtcctttagtgtttaaaattttgacagtttcaaaagaattaaaaaatgaatgaatcaaaataaaatttagccttaagggagcatggctctagtgcacttagacatccaattggctttttggcatccaaccgatgacttccttcagtttctttggcataacttttttcttgggtcagtgcttggatcaaacgaagcttaaatcaataatttataaatacaagaaaagagagcaagaaccggtaataccaagaatgtaggtattgaccaagtaagaaagatgatttaaaaacaaggataattttgattgtacgtctaaagtgcactagagccgagagcgctttggactgatataatttattacaaaaacctaacgtttaagtgtttacccttcgtttgatatgtaatttctctaaataattaaaaacgcagtttttaagttttattttctaggtcacaatg

SEQ ID NO: 106728 - DNA, 125 bp, Heterodera glycines
  Promoter: Source sequence=SeqID_36175; Location=94..218; Strand=-; Gene=SeqID_65564
attcaaaaatttaaatattttaggttttacttaattttaggattattttcccgtgaaaatttcaatgtgggcttcttttgtcgaaaatatgttatacgataattgtaatttgtggatacaaaatg

SEQ ID NO: 106729 - DNA, 474 bp, Heterodera glycines
  Promoter: Source sequence=SeqID_11655; Location=1431..1904; Strand=-; Gene=SeqID_75115
tttacgagcaaaaataagttgaaaaaaatagtgtttaaagtaaaaatagttgttaaaaagtttcataagcgaaaatagttgaaaaaaagttgctaaaaagtcgctctaaatcgaagtgttttttgcgtttatctcaccatatgttatccgcaaaaaaaacatatgtgaaaacctaaaaatccgggccctgggtatgacacatcattatggggttggggactgttaaaatgagaattgaaatggtatggaaaggttacggtaaacaaaaatcgtactttatttctttattatttttctgttttttttaaatttggtgtaaattaaagtgccattaaatacaatcaaataatgtacaagcttcatctcggcgagacattaactaaaggagaaaaagaagttgatgcgtttttcgaaaaattgtcattaattttgggtgccaaaacgcggcttttgaaatatttgaacgcaaaaatg

SEQ ID NO: 106730 - DNA, 165 bp, Heterodera glycines
  misc_feature (48)..(49): n is a, c, g, or t
  Promoter: Source sequence=SeqID_23452; Location=1..165; Strand=+; Gene=SeqID_54159
tgcatagatgaaaaggaggggaccaagaacacttctcaatttcagtcnncatataaggagggaagtgaggggtgaaggtggatggaagaaaatgcaattaaatatatgtacggatggcgccgtgggggtgggaggacggcaaaagggcatccatcgccgcccatg

SEQ ID NO: 106731 - DNA, 213 bp, Heterodera glycines
  Promoter: Source sequence=SeqID_9478; Location=6217..6429; Strand=-; Gene=SeqID_46762
tgccttttttagggcgaccccgaaaagaggggacattcgaccgctttaactccgtctttaataattttccatgtcttgctcttgagtctcgacaatttttttactctcgaacgcaacatacacttaattttgtaaaattatgaatgtgttaaatgtcgtgtcatttagaaaattttgcataataataaaacaataattgccacaaaaacaatg

SEQ ID NO: 106732 - DNA, 823 bp, Heterodera glycines
  Promoter: Source sequence=SeqID_2890; Location=1..823; Strand=+; Gene= SeqID_82204
aaaaaagtgcaaaataggtgcgaaaataggtgttaaaaattggaaaaatccaatgtatttatgcataaaagttccaaaagtgactaatttttttataaatttcgcccgcacaattcaattggtcaagaaaataaataacaaattttattttttattttttttcatttcttaattgtgtatttgaaaatttttgggtcgattcatacgggtgtatttttctgaaatttttgtgatcgttttataggggatgtatttttcgtttttattgcacttttgctatgaaatttctggaaaatgccaaaataggtgctaccccccccccattttaggtgtttttaggtgctaaaaagttgctccaaatcaaaaattgttcggagaaaatgtgtttttcgtgcttctctcatcaagtaatacccgcaaaaaaataggtaaaaccctaaaaatccggtctctagtcattagtgcgtccataattgacttgcacccggacaatcggacaatttaaaatttgacactaaatgagaaaaaaaagattataaaaaatggaaaaacaaaaacaaagaacataagggcaaaacagcagatgcttttggaaatgtcaacgatttgggtgacttttgttgatagaaacacttgccaatgcttaattaaaagcctttcccatttccttgcgcaaataatttgcccgttttctcgcaaaacaattcctttccattaatttgaggaatgacaaatccatggacattacctaaccatccaacaaaatcccaattcaagcgcaaatccgcaatgataaattttcatttttataaattatccaatg

SEQ ID NO: 106733 - DNA, 98 bp, Heterodera glycines
  Promoter: Source sequence=SeqID_14321; Location=1001..1098; Strand=-; Gene=SeqID_78349
ggtttgttttatagccaaaaatagtaaatggattcaaacaattttacatttattcttagataaaacttcgaattctccacgaaaacttccagcgaatg

SEQ ID NO: 106734 - DNA, 144 bp, Heterodera glycines
  Promoter: Source sequence=SeqID_41049; Location=442..585; Strand=-; Gene=SeqID_69266
tatgtgacagctctgtaagaaacagctattctatctaagttttaatgataacacacttaaattcaccttattaattatttattgataaatctttaggcactcattgccacacaatgttccaatataaccaacaatggcaacatg

SEQ ID NO: 106735 - DNA, 214 bp, Heterodera glycines
  Promoter: Source sequence=SeqID_14902; Location=830..1043; Strand=-; Gene=SeqID_79065
ttattttttatgacaaaaaaattagaaaacaaagggtcccactttggttttaaacagtaaaagtatcgaatttgataattcaataataaaattgtcttaaaattcttatcttcagcgctcgctaaagcatgcgtttgattgctagaaagaagtgtgcgctaatgacgcctttttcaatcaaagaaagttccatgtgtcgatattccctaaaatg

SEQ ID NO: 106736 - DNA, 85 bp, Heterodera glycines
  Promoter: Source sequence=SeqID_18431; Location=1308..1392; Strand=+; Gene=SeqID_83028
ataatttttgttttgataattttgtctcatgtttataacatttaatattttaaattaatcaaatttgtttcttttttttagaatg

SEQ ID NO: 106737 - DNA, 265 bp, Heterodera glycines
  Promoter: Source sequence=SeqID_10805; Location=1363..1627; Strand=-; Gene=SeqID_74070
ttcttaaaattcaatctaattgcttttgctaaagtcaattcatccattaattttataacagttttatttatttatttatttccaaatttttggtttattatttattatttcaaatgatgaatcattggttttatatgaaactaaacattttccattttacattgaataaccacgaaaattattcatttttactaaaggcccttttatactttttgtattagattaaaaataagaaataaacaatttcacttttccaattcaaatg

SEQ ID NO: 106738 - DNA, 289 bp, Heterodera glycines
  Promoter: Source sequence=SeqID_2162; Location=3886..4174; Strand=+; Gene=SeqID_78188
tattctggtcaatttgtgcaaattcctccgattgcaataaaattttcgtattttggtcaatgaaatccaagcagcgaagagcaaaatccttaaaaaaggcaatttaaaatacattaaattcatttacaaaaaattcctcaaaattcagtgcaaaaactttactttttcgctgagaaaacgagcatggtcaatgacaaggaaaacattggacaattgaccaattagactgaagcagccaaattcaaatttaagccctttcttcggatgttcaaaaatttaggaattgatg

SEQ ID NO: 106739 - DNA, 369 bp, Heterodera glycines
  Promoter: Source sequence=SeqID_5376; Location=4531..4899; Strand=-; Gene=SeqID_57817
aataaattttcaagaaattttccttaagctgttcgtaaacaaaaatttcatttatccaataaaagtttcgtttttttttctaaaattgacataataatatctgtcatagacggggattgatttgtttgggatttttttaaaaatcaatcaaacaaataatccaattttcatatttcattcagaagagaaaactttatgctttttcttaagccataattttagatttttattttgaatttcgaattttcatttttttaacaaatttttatacatactaatattacaaatttttgctttttttacgcattcgtctttgttaaaaaaaataacttaaatttgctttattttttaataaatcattaaatgatg

SEQ ID NO: 106740 - DNA, 973 bp, Heterodera glycines
  Promoter: Source sequence=SeqID_1968; Location=2904..3876; Strand=-; Gene=SeqID_77095
tttttgagaaaatttgaaaaatacattcctaaaaaagcaattttttgcgtatttcttaaatttatttcaactgttgaaagcaaacaaacaaatcgaattcttaattaatgtcatgggaggatttcaaagttccctgttggaacttatttagctgaaagttttcaatttacaaaacaatttatcagaaaaaagacatgacccccgaagaacaccaccaaatgtattatttcttttataacaataatttctaaaggaaatcgaatagaataagctaaaaaagcatttttattctatgtaaactaagaatacattttctatacaatattcgttaaacgaaaaggtgggattacgcaattatttctttgatgatctaaaatctttaaaaaaattaatgtataagcatacaaaaattcgaatgagattcccaatagagaaattgtgaacaaaatttaaaatgtaaccaactattcttttcaatttactaacataatatgtaaataaaaatatatatatatatatataatcatttcgagaaatgttgcgtgaattttcggtaaaaaaatcaaataaaaatattaaatactaatttaaaaaatatgtgattataatagcgcttgttataattatttaaaattaaaatgcaaataattacgaaatgcttaaattgtctaatgaaaggaacgcatataaaattttaaaaaatgttcatctttttatcaaggaataaaaaatgaaattatattctcaattgttagaaatatataaataattttaatattgaatacaaagaataactcgtattgcctctaaacattattaaaatcagaaaaagctataccttaataatcttttatggaaaataaggaaccatatttaaaataaaataaaatttattaattaccaaatattattattaattttatatttcttgtaaaaatataaacataatttcttttttaaagattttcaaatg

SEQ ID NO: 106741 - DNA, 131 bp, Heterodera glycines
  Promoter: Source sequence=SeqID_3466; Location=814..944; Strand=+; Gene=SeqID_47624
ggtttgttctttattgcgctgttaatagacaattgtaaaaaatggattcaacacggctactcttaaaatactacttttgttaaacaaaaacaacttttgaaatttcagggcaatttctccagaacgacatg

SEQ ID NO: 106742 - DNA, 431 bp, Heterodera glycines
  Promoter: Source sequence=SeqID_17985; Location=1593..2023; Strand=-; Gene=SeqID_82553
tgcctattaaatgggggccatgatgccgacactattggatgttggtggacatcgacggccgcaccaatggcaaccaatggaatgctatgggacaattgtcatgtgagaacggggattccatcaaagatgacaagaccaaaacaccaaaaaaaacccaaaatatggataaaacgctaaaataccgacaaaaatttcattaccaaaaatcaagatggaaaaactaaatagataaaaagtaccaaaatatgagcaaaatatttcaaaaattgggttcaattaacaaaaataaagaaaccatcaaatttttgttaaaaattctttttaaacagaatttttaaatatgtttttatttgattttttaggccaaaataagtccaaaaaatgccatataaatccaaacgctctaatgacatttatcccttctcaaaatg

SEQ ID NO: 106743 - DNA, 591 bp, Heterodera glycines
  Promoter: Source sequence=SeqID_18326; Location=234..824; Strand=+; Gene=SeqID_47511
cgtttgtttttagagtgataattgtttaaaaacttgtaaatatatattaaatgggttagtgcggttgttcaacatcgacacaattcaataaccacaaacaatctgggatgtggggtccttttgttggtatttggaattggttgcaacaattagcgactcaggaaaatccccgtgtacaagttttcatgacatgacaaaatttgaaaaacaaaatagtctcccctttggaatttttggcggtggaccaaccgttttacaatgcttttacttctcttaaaatttagtgtcatttcgatgttctttgaactcgagcgcaaggacttggagtttgtcaaaggtgaaagctttgcgtatcactgaccgtgcattggtggtggtcgattgcgtgtcaggtttgtcatgaaatcgtatgctttttttttggttggcacaaaccaacaaattcgcggttgcatttctatatcaatttggcttttagtttcaatttctatttctacatccgctctttagggtgtttgtgtgcaaactgagacggtgttgcgtcaagcaattgctgagcgtatcaagccggtgttgttcatgaacaagatg

SEQ ID NO: 106744 - DNA, 179 bp, Heterodera glycines
  Promoter: Source sequence=SeqID_519; Location=487..665; Strand=+; Gene=SeqID_55096
aaatgaacgattttttgtttgtaaaatgattccttaactttcacagatacgtcgaccaaaatgccatcgcttttctccaacattttcgccaacttttcgccttttctcagattaatttggccataaatacgtccgatgaccgcactttggtgtcgtttttgcgcaacatttttccaatg

SEQ ID NO: 106745 - DNA, 486 bp, Heterodera glycines
  misc_feature (62)..(62): n is a, c, g, or t
  Promoter: Source sequence=SeqID_33346; Location=1..486; Strand=+; Gene=SeqID_63437
atcagtttaaacaataccgactttcgaaccttaaataaattttgcacatcaccagagtcccnccttagggttttaaaaaaattcgaaatctacgattttattaacatagcgctcattattcaaatatgaattcgaaaaagaatttaaaaaaagtaaataatttaaattttgtataaaattaaataaaattgtgtaaaaataaaatattgaaataaggaaatgaatattgaatttgcaaaaacaaaaaaaaatcaatcaaattttgttggcattaattttgtcattaaattaatacaatgaataaaaataatgctactttaaatcacaatgattcaattatttttatttgttatattaaaatttttcatttcattcgaaattattttttttacaataaaaaaatttaataaatcattttactttatataattttaattttttagataatttcgttgcaataattgtaatttcagagacataaaaatg

SEQ ID NO: 106746 - DNA, 1003 bp, Heterodera glycines
  Promoter: Source sequence=SeqID_13069; Location=864..1866; Strand=+; Gene=SeqID_76855
ttgctataaaaatgaatgaataaaaaattaaaaaccaaatattgggaatattttcttcaaaattaccaagcgaacatttattttcctgaacaattttttcaataaaatattaggtaaaagacaaatgtgtttctgattaattaccaaagaaaggtaatttaccaaaaatatttgatttatttccaactcgccgcacattattttaacagctttcacgccaccatatttttcgaagcaaaaactagaaaccaactcatatttttgcatgtattaaatataaatatttatttaaaaacattaattagcaaaatcatgggtcaatcaatacattcactttcctattggattttcttaaacccattgacacttggaaactgagtaaacccggtgatgaaaagatagtcaatgctttggcgcggagcttagaaggcagttccgtgcagaaatttacggtatttctctttacacgtgctgtctcttcttcattggcttattcgcttcgtgttatgacgaaaggccacggcaaatgggccaaggcgagaaattcgcggcgagttgggagttgggccacggcgagaaactcgcgccgagttgggccatggcgagaaactcgcggcgaattggccccgccgaagtgccctgacccccaaaacaacccctgcgttcactctatgtgctctctcattccctcccaaagccaatggccaacaaaacaacacagagtcaattgatttctttcattgctttcccaattccgtctttcatctgtgttcttcacttatactaaatttttgcttcttttcacattattttatcttttaaatttatcggttaaagatttttttttgattttgaattttcaatattacacaaaaaattgtttacaactgttgcaggaccaccaacttatttttttggccattggtgaaactgaacggcaatcgtggtttcatttgtgtaagaatttggaaattggcaaagtgttcgtttggaaaagaaaatg

SEQ ID NO: 106747 - DNA, 146 bp, Heterodera glycines
  Promoter: Source sequence=SeqID_43012; Location=1168..1313; Strand=-; Gene=SeqID_70788
agtgggtcgaactttggttgcaccgggagaaagcaaaaacgtaattttacagctaatgaatgcggggaaagcaccagttaaaatttatgggaattcacatttggctgacttagaaccaattcaaataaatgcgttaccaggtgatg

SEQ ID NO: 106748 - DNA, 863 bp, Heterodera glycines
  misc_feature (12)..(12): n is a, c, g, or t
  Promoter: Source sequence=SeqID_1698; Location=394..1256; Strand=-; Gene=SeqID_75378
tatcgtgatctntagggcattgaattatatgaaatttccatattttttttcctggactgttgaaagcctgaaacgcacgaaaaacatggttttaacctggtttgaagattctaggatgggttttcaatatccatatttgtctatttttggcaaatttaagtccatattttatgtccatattttggcattttccaaaaatttctatttgaacggccctcatcagctaatttggcccttttgactccaaagaccgaaaaattttcaaaaagatcataattagcaaaattttctcgaaaatattgaatgaatttaaattttcttaaaatttgataaatttagcgaaaattttacttttcagattgatttttcgctagcaatgaataaatttgagttttatagttgttgtttttttcttaaatttgatttttaatattatatattcagccatttttgaaagttttactttacattaagcgaattaaattaaattaaattaaattacatcctcaatttggaaaaatttatatccatatttttgccattttatgtccatatttagagattttcgcaattttatgtccatattttcgtggtttattgtcaattttttatggccagattttgggattttatatccatataattctacgccctagtgattttaaatatggattagggatgaaaatttttgtgttaaaaagcacggattttttgcctgaaccgtcgaatgtcctaaaacccttttatgaattttattaatccccgctttctgcattttaaccagccagcccagcttcttcatttggtgccgggttgttactcaaaaaattcattaagtttaaagaaagttatgacgaaaaatg

SEQ ID NO: 106749 - DNA, 72 bp, Heterodera glycines
  Promoter: Source sequence=SeqID_17150; Location=235..306; Strand=+; Gene=SeqID_81585
actaaattttggaaaacaaaccaaattataaaaattgttattgaaccgaagctgaatccatgacctgaaatg

SEQ ID NO: 106750 - DNA, 189 bp, Heterodera glycines
  Promoter: Source sequence=SeqID_36490; Location=628..816; Strand=-; Gene=SeqID_65785
caaatagtgcaggaaaatgggataaagtagttttaaaagtacctaaaaatttcaaattatgtagaataattggtaaagtaattttaaaagccaaagggaattttaggggttcaaattagagcccgacctggacatggacccaggcctggattttccctggatccagccccgccgcttctttcaaaaatg

SEQ ID NO: 106751 - DNA, 62 bp, Heterodera glycines
  Promoter: Source sequence=SeqID_1762; Location=2644..2705; Strand=-; Gene=SeqID_75764
gagaagccaaattgcaaatccttgaacttgaacccgatggacaaccattcactgtacatatg

SEQ ID NO: 106752 - DNA, 62 bp, Heterodera glycines
  Promoter: Source sequence=SeqID_30477; Location=1..62; Strand=+; Gene= SeqID_46215
acttgagctgcgtgaatagcgacagggaattgcctccccctgtagccgagagcgatgaaatg

SEQ ID NO: 106753 - DNA, 193 bp, Heterodera glycines
  Promoter: Source sequence=SeqID_4608; Location=1515..1707; Strand=-; Gene=SeqID_55068
tttctaagacagcccggacacttttcattcaatacgataattgcacggcttcggaaaatgggactactgtagtagaagtatacagtaagccgtatcttttttattcagtacggtatttaccggctcccggaaaatgggggccttatggagcatactgtaattagaagtatactgtaagccgtaattattaatg

SEQ ID NO: 106754 - DNA, 461 bp, Heterodera glycines
  Promoter: Source sequence=SeqID_40429; Location=1..461; Strand=+; Gene=SeqID_68770
ataaaatacatgcataatgcccaaatatggaaataaaacgcgaatttggaaaaatatgaaaaaagatggattacaaataattgacagccatattaatcactatttgtgtaaattcaatatatttttgttataataataaggtaagtttttggtctttttaataaattctttttttctataaataatccttttattgcgcacatcattaaattgagtaaatccaacactaatcaaatgcgagtgttgatattattattatttttatagaatcctactgagggttaaatttatttaaaaatgaaattttattctttatttttatttaaaattgtttcacaattttgtgtgttcgactatggtaaagaaggtacctcaataatcatttaaaaacacattaacattgttttattatttttctataaatatttataaatattcttttagtcttttgccaacaaatg

SEQ ID NO: 106755 - DNA, 1003 bp, Heterodera glycines
  Promoter: Source sequence=SeqID_18515; Location=823..1825; Strand=+; Gene=SeqID_83136
cacttgaccaccgagtcgcttgcttcttccccgtttaattcccttttctttttccttcttttttggaagaaagcccgaccaaaagtgcttgtcctccctttttagagcacttcccggacacggaccaaaacaaccctggtatcattcgaaagccaagagtttgtagatgtgcacaaacatattaaagttttgatttgaccctttttaaggtatgcaaaaagcgttcaaaaatgggacacccaaaaaaagtgcaaattttgactcgttttccgaacgcagttcgaacaattcttaaccgattgggatgccgatagtttttccttatagccagtccaaaaccctatcgaatgataccactcccgacccgtaacattcggtagaaagtcttaaattagtttttaagcttgaaactggggtatattattcttatatagggaattttctttggtcacctcccgcccgtgtgatctttaccaacttaggcccaccggcggaagcttaaaaatatgatactcatcttaaaactacagtatataggcggatagtcagcaacataaactcgaccttttgtgggattatgaacagattttgcgccaaaacaggcccactttttcatgtatttgtatccgctctacagatgatgattattttgatttttcttccaagtattttccatctagcacctatttttcagttatactattttattttatgatattatttttatagagaaatcttgttgatcatcattaaaaaagttaatggctctagcatgagttgaaatatcatgaattttttaaaatttcatcacttttatcgaatcactttttctgatcagttttggggtagggttaaaaaagccaaaaatttccaatagcaaatcgcctatgctctacatgatatcgatacattcccttgtaagcactcattagggatatgtgttaacgaattaatttaaattactttaaaaatttaaatataattttttagacaatccataatg

SEQ ID NO: 106756 - DNA, 728 bp, Heterodera glycines
  Promoter: Source sequence=SeqID_6103; Location=1295..2022; Strand=-; Gene=SeqID_60342
atctacatactatcctcctacaattattttacaattaactcgtttttgtttaagcttttctgctctctgtggaccaccttttctccggaagagcgagcacagattgaaagtgttgccggtccgttcctttcgtccgctgtccatttgtgccagagggactccccccgtgccgtggtcacctgtttcatggaggcgtttgttctttgctctccacccattaaattggagccgttcatgctcaggttgttgttcagttgccatttgtttggcatatcaaatgagacttcccattgtttagctatcttggctccacctttaactgttggcacgtcgcagtgacacaattagaacgattggccagggatattcgtttttcggttgccgacccaattctgctgaacacctcggagccggccagcgaaaaattggcgcgttccccatcaccctggactttatttccaattattagaacaaccaaattattatttttgttgcttttccaggaagtgctagactgtttggctaaactctaccgccaattggacgaattggaccagttcagtgcgttgtggaagaggcgttcattctttgacagaactgccaaatgctttgcgttgtttcagcaggtggttcgatcaattcatatatttcttggaattattgcttttcattgaccaatacgtatttgtttttctgcccagggtgaattcgttcgtgcgcgtgaaatg

SEQ ID NO: 106757 - DNA, 601 bp, Heterodera glycines
  Promoter: Source sequence=SeqID_33203; Location=116..716; Strand=-; Gene=SeqID_63337
gaaatggcatttttgaaatgattagaattccattccgagtgatctgaaagttttcggcgggattagttaacggaaaattgtttgggattaatataatggattctctaaagtgattaaagaaagagtgtctttcgaatgattaaaattgattaagtctgatctaaaagatttgaatgatctgaatctaatttcagacaaactgttagaattttgagtgatttgtggaattaaaactttttttattagaatgggtttccgagtgatcggaagcctttttcataaatgatcaattatatagaacatttcttggtgtaattaaacagaacaaattgataaaattttgagtgattgggggattaaaacttcttttttatttgaatggaataccgagcgataagaagcctttttcttaaatgatcaatttggaatggagttccgggggtgatcagagaaaattttttggggtaattaaacagaatttttggatttccggcaaccacagacactttgactgatcaatttttatttttaaattaggtgatcagtcaaaatttaaatcattgatctccctttcaaaggcgacgacgggcccgaaccgatg

SEQ ID NO: 106758 - DNA, 96 bp, Heterodera glycines
  Promoter: Source sequence=SeqID_26928; Location=311..406; Strand=-; Gene=SeqID_57664
tttgagcacgcagtcacttttcgtgtccctccccccgtcgctttttttcggaattttgcgcatttaatatttattttagtttttttgtgtgaaatg

SEQ ID NO: 106759 - DNA, 222 bp, Heterodera glycines
  Promoter: Source sequence=SeqID_28787; Location=1211..1432; Strand=-; Gene=SeqID_59366
tgcatcgagaatgagagctggcgagaggcatcgggagggtgtgaggtgtgcgggccaaacagaacggtcgccttttggcaacgccgcttcacagaaacaacagtcgacaagcaagtggtcgcagacaatcctgtggaggaatttgtcgattgggtagtcttccaactcccgctgaagtacgacacttatgtttattcgcactttggtggccgcttcgatatg

SEQ ID NO: 106760 - DNA, 280 bp, Heterodera glycines
  Promoter: Source sequence=SeqID_7145; Location=2360..2639; Strand=-; Gene=SeqID_63955
tgtgagttttttgggagggatattttgttaagaaaattgcctctctttttcccttcgccggcgaccccccccccccccctccacctcttttctgtcttttttcccttaaattaagaacaaaaaacacattttgtctaaaattcggtaaaaatttttttataaaatatcaagcatttatttgtcgtgatttaattgactataaagattcaattaactataaaacaaataattttccaaaaattattcatataaaacaaaaatcccttccagccttggcatg

SEQ ID NO: 106761 - DNA, 867 bp, Heterodera glycines
  misc_feature (7)..(7): n is a, c, g, or t
  Promoter: Source sequence=SeqID_40601; Location=1..867; Strand=+; Gene=SeqID_68875
ttattantccggtaattaaactattaacttgacataattcaacaaacacgctaatttaacattttaaatggggaaaatttttttaacatttttctcattagatttggagcacaattagtttaaggttttcatcgttaaaaaataaatcaaccaaaatttttaattcgtgcctctattgtttttcagcgggtctgatctgaaggcttgcaatgagaaaatgcacaaaagaatcgctgaaaggataattatgcattaaaatgtgaaacattttctcaattaatatgctggcgcgttttttaaatctgtcatcccccccccctcacaaaatatgtactgatttaactctttgctcttcgtttatcatttatctttatatgattaagaatatttaaagaaactttgtattattatttctctcaaaacttagcacccattttttgataaaatttagcaaatgtttatgtcagaaatcttcagaaatgaaaattttgtttcttttagtgacccaagatttaaaaaaattcaaacttttattattcggttaatttttgtgtgatggtcatttactccgtgatcaagaaaatgtcattctgtttaaaatgtcatgtcgaaaaaaacggcagcaaactttttcccctctctctgacaattttgccaccaaaaaattctcagactcatactcagtattaaaatgcttttttaaaggagtgattctgggcttttcattcataccattttctctttaattttgcttcacctgctggtcaaaacactttgttatgggtgagcttcgatttgggagcaaacaaaattgccccaggcaattaggggaggaatggaactccccatattttcatgcccaacatg

SEQ ID NO: 106762 - DNA, 274 bp, Heterodera glycines
  Promoter: Source sequence=SeqID_42331; Location=1..274; Strand=+; Gene=SeqID_70254
aaatagaccggaaaaattaaagtcgaatttttaatccattcaaactaaaagtgatttggtcgctatttatttatttgtattgatttcatattatattttattttttggcggcgatctcgtttttaattgttttgcgctttcttgaggacattttttaaattaatgttttgtcctcaatgtaagcggatttttcccttttgtggactttttctttattgacaataaacaaattaaaagcttccctgattatatattttttctttttataattatg

SEQ ID NO: 106763 - DNA, 519 bp, Heterodera glycines
  Promoter: Source sequence=SeqID_12506; Location=2807..3325; Strand=-; Gene=SeqID_76144
tttgatctcattgctcaccattttgctgctgctcctctgctacacagcggtataatctgttgcttaattaacaatcactgatttatacaaacaaattttatactggaaaatttgaaattaaaaattcggttgttttttaccaaaagttatgatttggttcacattttccgaccacaacttccatagtgacggaatttatggaagatacttaactcccaacgaacgtgacgcccttaactcattaagaattaatttaattggcatattttacagaaaggcaatattttaaattggcacacagttaattggaggcgcacttttcgacaaaaaatgccatttttagtaacatttttaagaatgtaaaagaacaaatttatcggtggtgccatctgtactctcataatatggcctggttaattcactttttaattggcttttcacttggaaaaattaggcaaattgaagtaatggaataattttattaattttgtattaataatttaatcgtttctcaaaatg

SEQ ID NO: 106764 - DNA, 280 bp, Heterodera glycines
  Promoter: Source sequence=SeqID_794; Location=1..280; Strand=+; Gene =SeqID_61383
caacaaattaaaatgaaaattagttaagaaatttcgtctttctttccccttctaaaggtttaatgaataattgctttttaattttcaaaaaaatttcatttaagtttttcgaaaaatgcatttttagttaaatattatttaaaaaaatttgtattttgtgaaaaaagaattattatttttatttcttcataatttcaataattttctgattaattaatttatgataaatgttttgtcagaatgttttgaaattttgcaggaaattacgtttggcataatg

SEQ ID NO: 106765 - DNA, 54 bp, Heterodera glycines
  Promoter: Source sequence=SeqID_27100; Location=1..54; Strand=+; Gene= SeqID_57808
agctatgacggcaagtaaggatgatcctgtgagacactattatcccaggaaatg

SEQ ID NO: 106766 - DNA, 1003 bp, Heterodera glycines
  Promoter: Source sequence=SeqID_6003; Location=2056..3058; Strand=-; Gene=SeqID_59982
tacgcgtcccatcacattttacgcgtcccaacgacagtttacgcgtcccatcatttacgcgcacaaaaatttttatctctttttccagtcgggacaccaattccgaaggattacccttttttcgaaccgtcaatcaaaactttataccttccgaatcgtataattgttcttgattgtatactttgattatcgaaatgtgcaaaagcaaccctaagcaaacttattgatgtcaacagtcagtaaacacaaaagaaattttcaaaagcctacgcctagtctaagccattgatcgagttgcctgtgtatgagttgacatgatactttggtttagtaacgaaatttttagttgaaaatttactaaatacacgacaaaaaaataggtttcctcttagttagggatggcacggaaggcaatctttcggaattgtggtcccgaaaaaattttttttatttaaaattcatagtttaagggttttcaagggtgctgattacgaatctgaacttggattggcccaaatccgaactcctgacccgagttcgaacaaaaattgaaaaaaaaatttcaagaatgcatttttttgggataaaaaactctaattcatgcaacaactattattttttgattaaaataatgcttcaaattgttaattggataaaaatgcgcggtttacgccaaaatttgatcgattttaacgtatacttttgaaaaaataattcaagtttttgttcgaattcgggtccggggttcggaattgggcaaatccgagttcatattcgtgattagcgtatttttaagcctagaaaaagtgccatacaaattaaaaaattttcgggaccacaattccgaaagattgccgcacggaattccgaaaatttgtggccggaatgccatccccgccatggacacaaaaaaatgtcatgggacgcgtaaactgttgttgggacgcgtaaaatgtgatgggacgcgtaaaaccgactagaaccaacaattatattttagatg

SEQ ID NO: 106767 - DNA, 91 bp, Heterodera glycines
  Promoter: Source sequence=SeqID_519; Location=4096..4186; Strand=+; Gene=SeqID_55097
ttttttcatatgaatttctaagaaaataaagcccatttacgaaactgaaaaagtgccgaaaactgtcttaataatttgctgcaacaaaatg

SEQ ID NO: 106768 - DNA, 254 bp, Heterodera glycines
  Promoter: Source sequence=SeqID_7570; Location=1967..2220; Strand=-; Gene=SeqID_65262
ggtgggcccatttcaccaacccatttcagcaaagtgttcagatatcgcccaataatttgtttctgctcagtgagaaattgtacattgaggagaatttggcaccaaaatacctcgcggcactgaagcaatttttgcgcaaagtgttggaattgttgtacgaagacgaccaacggcaaacggtgttcagaagggcaaacaaagcggcggacatcgaacggagagtgaacgcatttgtggaggtggaagtgcgaatg

SEQ ID NO: 106769 - DNA, 264 bp, Heterodera glycines
  Promoter: Source sequence=SeqID_38596; Location=688..951; Strand=-; Gene=SeqID_67367
gcgaccgggcactgctttatgtacagattgccccaaacacaggtgacccgtcggcgtggcctatttcccagcttcgatctgctcgactttggcctcgtccgggcgggcggtgggccggtgcgtccgcgcgcgttcagcgtgttcagctcgctggagcgtggcgtggaaattgagtcggtttatgtggagggccagagccgtggcgtgtacctgcagttcgagtcacggccgcccatttcggtccgaagcgacgcccgaggaatg

SEQ ID NO: 106770 - DNA, 574 bp, Heterodera glycines
  Promoter: Source sequence=SeqID_8358; Location=767..1340; Strand=-; Gene=SeqID_67798
tgccgcgctctttcaggcgtgggtggcgcagcagaaagctgtagttcaggtagcgtccgtcgcggtaccaatggacgcgcggctgcggtcggccgatggcattgcatttgaagcgaatggtgtcgccgagataagcgaactgatcagagggggtgggtgattggagaatgatcagtggagaaaaacgctgccattcaccattcccacctgatgggtacgcacgttttgtttgaagcgcggcggaccgtctgaaaatgtgtcaaaaacccatcattaatcaagcaaaagttaattattccggtccaaattctggttttgcagttcattttttgccatttttttgtcaaattcgcctttttattttagtccttcttccgtccgctgctaatttccctttctttcatagttttattacactcaaacgcacaattcacataaaaagaatgtttggcaattcgtttttcatttgtcatatttttattttgctccccccacaaactcacatcttgcggcaaagtgttcaccgatattccccgacaaagcacttctgctgggaattgtgaagaaaaggatg

SEQ ID NO: 106771 - DNA, 201 bp, Heterodera glycines
  Promoter: Source sequence=SeqID_21407; Location=620..820; Strand=-; Gene=SeqID_52017
ttttcggcgaaaagctgaaagaatgcgcaattattggtgagaaataaattattattaatttcgtaaaaattcttttttaaatttaaatccaaatttattaatttccttagctttttactaactcagaaaaagtacatttgttttctaaatgccaatttaaatgagtaaaatcatttttttattttcattttactaattatg

SEQ ID NO: 106772 - DNA, 1003 bp, Heterodera glycines
  Promoter: Source sequence=SeqID_912; Location=5264..6266; Strand=+; Gene=SeqID_63845
attaaaagaaagtgaaaaataaataaataaataattgtcgaaaatataaataaatgagcaagcatattgaaaatgaacaaaaaatgagcggagatctgtggattatgggcagagtttgaaatcaacgaaatggcggaacaatctcgtttaagagaaagcattagctcctgccacagagcattgagtggccatgaatcacgtgaaccataaatgaatggatggctaatacattaagaatagctaaaaatatgatgatggacagagataagttggataacggtggcaaaaagtatcaattataagtgaaatttgacaattataaattaaaaatatgtttaaaaaaaataatttgtctatctttattagtagaaagtgtaaggattaattctttttgttttttgagcaccttatttggatggttataagtcggacgagaatcaaccgaagaagtatttgggagatgattcaatagtcctaattctgctctttcgaatgagcatttatttgttcaaaactattaaaatttcagagactagttaagttttttgtaacagtaacgaaatgagaggacaaaaaacaaatacagaaaatgtttaaaaaatatgaaacatttaattttaattttgtttggtatttattaattgcaaataatgattgtatataaattgaataaataataaatattaaatggaaaaggccagcggtgtgagtaaaaattagcattgaagggacattcattcaccttaccttccttcacatttgcgcaccaaaaaaaaaattaaaaggcggccacaacaacggtcaaaggagaattatggatggaaatttgaatatgcatttgtgtgtgaataggagagagagaatgaaaaaatggtgttattatacagtatattatatataagaaagtgggaaacataataattttaatttaaatataaaataataacaaagaaaatattttaattactatatatattttgagttggattcattgcttttcatg

SEQ ID NO: 106773 - DNA, 1003 bp, Heterodera glycines
  Promoter: Source sequence=SeqID_20665; Location=723..1725; Strand=-; Gene=SeqID_51224
gggttttaatttcgcctaaattacctagtaagttttttggaaaatttttctaaaaaatcgcttaaaaaaatttttccaaaaattacgccgtggcgcgactgtgacggttcaaatttggcggaggagtgccggaagcacagctcgacacaggcgaaacagcgcaagtcgccgatgggaacgacggcgccgaatggacgcaaaacaatgccaaacaaactgacgaacaacaacggcacttcttttattggaatgctctctctctttcttttcttctctcctctcctattctctctctctctctatttctttctttctctctctctctctctttcttttcttctctcctctcctattctctctctctctctttcttttcttctctcctctcctattctctctctctctctctttctttctttctctctctctctctttcttttcttctctcctctcctattctctctctctctctatttctttctttctctctctccctcactttcgctgcgtttgttttgccttttcttttgttcattttttcaaagttatgtgtggtgtgatatgtttcttttcctttctgctgagtctgttgcggcgtttggaatttaatgcaaaacgctttttcaattttttccagaatttttttgaatctatgaataatttgatgatttaattttatgtacaatatgtacctgtatatgggtttcatttgcctataatcgttttgtgaagaatcaacaaaatttagtgaagagagagagagaggcgagaaaccggttgtacgcattttcattcgtccggtaataaatgcgcaaaaagaagaagaagagacccatcccttcaattttttatcacattttgttggaacgagcaaaatatgagcagggcaaaaattgaaatatttttaaatttagttttggcagatgaggggaccaataacaaaaaccattacgcttaattgattaattagtgtttggtgctcagattggctaacatcagcatg

SEQ ID NO: 106774 - DNA, 828 bp, Heterodera glycines
  Promoter: Source sequence=SeqID_31656; Location=1280..2107; Strand=-; Gene=SeqID_61972
tagagtcatcgacattttgtagcaataaaataatttttgaaaatggattgagagagaacatattcttgccgatattaaataacaaaattgtaaaacttgccttgatgattcagttttgtcatttagttagaattttttattaaaattatgtttccatatgtcaagtgtttaatgagactgatgaatgagtaatactattttgtttaaatttttgacattttattaaattgaaaaaatgtcaaaaagtggctgagaaattatgaaaattttaattaactttaattataattaactttatattaattttttttcagtgttttaggagaattcctccctggaagattatatttacattaaaatagaaccaaaaatagtttcatttattcttactacctaatcgtttataaaaaatataaaatattatttgactttttatgtatattagagtgttaaattgcttatttattacttatttttatgatttttcatacattaattatttaacaattattataattttaatacaattaattttatgtgtttaaagagttacgaggttttttttattcacttttcttttatatttcaaaatttttaaatgtttcacatgaactttcaagataaaaaaaaagaaacattaattcacattaattattagatcagataaataaatacctgtttatccaaaataaagcaacatttgcttcactcaaaataattttaaacaaatgtggtaaattcaggcaaatttttttttaattaaaatttattttaataataatttaataaaagaaaatttttttttataaaaataattggtgcgaaatg

SEQ ID NO: 106775 - DNA, 90 bp, Heterodera glycines
  Promoter: Source sequence=SeqID_8775; Location=1089..1178; Strand=+; Gene=SeqID_69190
tcctgctgtacaattaaaattgttcccgtcagttttttattttttgtataatttttttaaatgactaaatgttgtgcccttttcaggatg

SEQ ID NO: 106776 - DNA, 62 bp, Heterodera glycines
  Promoter: Source sequence=SeqID_6286; Location=3620..3681; Strand=+; Gene=SeqID_61010
aaaatttcatgaaaattttaaattaaaattatttttatgtgcataattacagtgttccaatg

SEQ ID NO: 106777 - DNA, 439 bp, Heterodera glycines
  Promoter: Source sequence=SeqID_36909; Location=1219..1657; Strand=-; Gene=SeqID_66108
gaaaacggattaaaaatgagaattttaattcccattgtccgtgatgacgcaaaaaacatgcagcgaatggctagggtcttaggaaaatcaaggtaaaacattttataagaacgaaaattattcgaaaatttaagtcatcaatgtgtggctcattttttacacataaattcaaattattcactatccaacagttaattctttcgttccaattattaaaacatttattttcttgattttttttggacaatttctttattaccaatgaaacgattgtctagagaatttagaaatacagtagttaaggtgtttccctccagcccgcttagaaaaaaaaaattaaaaattactagggtaatacataagtagggttgcgattttaatgaagaaaactcgaaatagtttttcatgaaaataagcaaattttaaattttctcgcatg

SEQ ID NO: 106778 - DNA, 71 bp, Heterodera glycines
  Promoter: Source sequence=SeqID_43470; Location=874..944; Strand=-; Gene=SeqID_71123
atgaaaattaaataaattaaggatttctttcgttggttgtgccttcgccaaaaaagtgtgaagggaaaatg

SEQ ID NO: 106779 - DNA, 381 bp, Heterodera glycines
  Promoter: Source sequence=SeqID_3984; Location=903..1283; Strand=-; Gene=SeqID_52697
tttttttcttcagttgtgcctttgttgcgaatgttgagagcggatttgtgaagcgaccgttagaagtaaaaaattttggtatttaaaaaaatctaaaattacacaaaaaaggtgaaagatgctcatatttttgagcaaaagccaacatttgtccgacacgacagaaatataatcaggtaggcccgacataaataaatactgaaaagtacaaatttgtcactgaaaatttattaaataaatgatgtttttaaacatttattcgtttttttttttgtctttttacatcgaaattcattttttcaatgtttattttttgaagttttcggtgtgaatcctcaaaaataaaatgaattttggtgcaacttagaattgaacgagatg

SEQ ID NO: 106780 - DNA, 261 bp, Heterodera glycines
  Promoter: Source sequence=SeqID_29034; Location=287..547; Strand=-; Gene=SeqID_59605
agcgcaatgtaataagattagtttgtcgacacaatgcttaaaattttgatagaaacaaaaggattgtactttttggcaggcttcccagaggaaatgaaataacttttctttttttagtgttttttatttgaaacaaatcgccaatgtctgaatctcttttaaatgcttgcacttgattccattaacagtccgttaaattgacattttttataaaaaatttcctattttgtacatacacatacctatttttcagaaataatg

SEQ ID NO: 106781 - DNA, 1003 bp, Heterodera glycines
  Promoter: Source sequence=SeqID_8; Location=11271..12273; Strand=+; Gene=SeqID_61204
actataaatttgcaaaattcatgaaaaatggttaagtttcaagaaagttatgacaaaaatgtttaaaaaaacttaattttttaggcttctcagttcaaaactgttttgaagcttaacgaattgcatagaaagcacttagggctaccgaaaaatatcaagattttaaaatttggttgcttttgtgcaaaattatgattaattttctgccaaaaattttcttccaagtcatttttcgtcagtctgcattttcctagattgttttgttcaggaaatctagacccaatggtcagattaaaaaaaaaacttcaggcataggtccggttttagcaggaaaaaccttgatttcagggatagaaattttagaatttgtagtaactagtttaatggtatgcagttagctgaaatttttggactgtcatcggactaacatttgcagaccgacttttgaggactgacatttgcggaccgacatttgcagaccgacttttgaggactgacatttgcggaccgacatttgcagaccgacttttgaggactgacatttgcggaccgacatttgcaggccgacctttgaggaccgacttttgcggaccgacatttgcagaccaacttttgagaaccgacaatggaccgacaatttacatatgctgactgaaaattacccaatttccgctaaaaattacatttttttttgctatattgaatttgcatatatacttcctttttgttaattgctaaaaatcctaaattatatttacgtgaaaagcattcatacgtatgtaaatatatgcttaatatttttaataatgccacataaatgactgagaactgcccaatttccactataaattatcaaaattattattgcagttgatttattcataaattcgaataataattcacatgtacatgagcacaaaatatgcatataaaaggcggttgtcaattaatgaaaaccttacaaaatattttaaaaatttccttttaggaggtattctcaatg

SEQ ID NO: 106782 - DNA, 470 bp, Heterodera glycines
  Promoter: Source sequence=SeqID_39563; Location=486..955; Strand=-; Gene=SeqID_68106
gcagtgattggcatttggggaggggttgttgcaccaacaacaaagcttaatttgacaatgctaatatgaaaatgaatcgaaattacaatttttgttgaagaagattcagcagagccctcgagcgaattcatacttgtaaaaaaatcagtgaatttttaatttttaatgcaagctttattaatgagaagcaattaattttaaattttataggtaataaaaaaattaaaaggaaaatttctttgatcttttccgcattcatttgtttttctctttttgcaaatttattgttgaaatgcgttaaacgcttaaacgcccgatttattttttgctttagctcatcgcgcttttatccaaagttttgccgactatttttacgataaattttaatttgggttttttaagcagtttttttttggttgttcctttttacatttcgatgctctgttaattttagtctgaaactcggaatg

SEQ ID NO: 106783 - DNA, 73 bp, Heterodera glycines
  Promoter: Source sequence=SeqID_23040; Location=1636..1708; Strand=-; Gene=SeqID_53745
ttttcaatgtttacctataaaatttttttttaaaactattgtattttttccacatttgtaggagttggagatg

SEQ ID NO: 106784 - DNA, 754 bp, Heterodera glycines
  Promoter: Source sequence=SeqID_16746; Location=1..754; Strand=+; Gene=SeqID_81155
gcttcattttttgcccctgtcttctgttcaaactcaaacttcaatttgcactttccatttttttgaaatcgtactgattttttgacaattttcgttttctaacggatttccgtcataaataatcgtaggtgaacaaataaatgaggaatttgacatttcaaattgaggtacagactgatctctttctaaattcaacaattcattttatttgttagttaataaatttgctatttcgaaagcttttgattttaggatatgtgttaggtcttttaaaaaacgcccatttgccgattgaatttttttgtttgggattaaattaaaaatttaaaaaaaattcctaagtttttaaaaaaatttgtcaacaaagaaagaaaaataatgacagaaaaactaataaattcgaaaatttttaaaattttcggttatcgagtcgagaaaatgttttttaatattttattttagttacattaaattgaaaatttattatgcaaaataaatttttaattagaaataggagtaactttattaaataatccattattattattattattattagactcagaaaatttctcgtgtccaaaattctcagcaattggcatttcagaaaagctttgctcattccaaggtgttatgacattatcataaaagaacaaaaaataatgatgacaggctgaaaaattaatctaagaaataaggacaatccttaaaagtaaggacaaaaatacagacaaatcatagaaaaggacaaatg

SEQ ID NO: 106785 - DNA, 286 bp, Heterodera glycines
  Promoter: Source sequence=SeqID_19067; Location=1131..1416; Strand=-; Gene=SeqID_83812
tatttactctttttatatgccatggtatattatttatcaacctcctcagaatggggtagataattggagactggtagactaatggagactaagagattatttttcggctgatttatttagtagaaaatttttgaaatttttttgaacatgtcgccaaaaaatcatatttattgcatttttgttaaagaacttctgaaaattgacgccaaaaatggcaaaaatgttaattttttgcttccggtatgcataaaaatgggaatttttaatgaaaagttcagaaaatatg

SEQ ID NO: 106786 - DNA, 267 bp, Heterodera glycines
  Promoter: Source sequence=SeqID_32623; Location=989..1255; Strand=-; Gene=SeqID_62925
tctgaaattaaattaaactaataaattacttgaataaatttattaaacttcgtatatgcttttaactagaaaatgtggcaatgaattatttacaaatttatcgataaaattaagaaaaattttaagcataaaaatataaaactaaatccaaagcaatatacgaaaacatcgaaaaggttatattaatataattttgatttgtgatattaaaaaaacatacttctagtttaagtaaatggattcaatgcatcaaaaaatttaaaaatg

SEQ ID NO: 106787 - DNA, 478 bp, Heterodera glycines
  Promoter: Source sequence=SeqID_26049; Location=1..478; Strand=+; Gene=SeqID_56797
caaaagcctcatttggcaagcaaaaaagcctcattttgggttaaaaagcctcattttcacaaatttattcaaaacacatttaaaatgttcaaatgtgatattttctattgtccatgatcaattgcaattttttcttagaactaagcattttatgaaattctgagcatgaaaaatcgacgttgatttttgcggcgctttttccaattttttggggaacaggggggtccggcggtgccgataagcaccgccgggaaaatttttgtaatttttaatgtgatttgttaacagaatttgcccacaaaaatggcttaattttgcaattttaagcaaaaattttaagaaaataaaggatttttgggtccggcggtgccgacaggcgccgccggggaaaaaagtgagaattttgactatatttttggactttttgtgcttattgtgactatttttaggattttaaaaataatccttaacaaaaatg

SEQ ID NO: 106788 - DNA, 1003 bp, Heterodera glycines
  Promoter: Source sequence=SeqID_4205; Location=5547..6549; Strand=-; Gene=SeqID_53592
tcccgatgccgtgtctcaacgtaatttcgggtcccactcttttaatattctccaaattttcaaacaaaaattgcttaagctgccgcccaatttttaaaaaataaccacaaaagctccactaactctcaaaaatgtctcccacaacaaataaggtttccccatctccaagaaattcttgaaattgcccgagaatggctaaaactgtcacaaaattattccaaaaattcccacaaaactctaatttgtaaggaaaatttcccgttaatcccccccaaaaatgcccctccccattcacatatggtgtttgtgtagtcccccttcacccccccccccctagtgtccgctgaatgtccccttaaaaatcgtcaaccgaaatggcgctgacaattccatccaatttgtgcccccgtccgtccgttcgtccgtttttgtgcccccccacccccaatctctcccacgaccgcccccccgccaccaccgaaagtcattcattcgtcgtccaattccccccattcattcatttttcattttcattcattcactaactcattcattcatttgctgaaaccgcaaaaatggcaaaaagcaatggcaaaatgccaaaaagaaagtgccagaattcatttgggatgccaaatttacatcaaacggcggcggcatcaaaaccaaaattggtgaccaaatttaagccggattgacttgattttaacaattttaatcaatcgactatcattttaatcaatccgaaaatgctaaatctgtttaaatttagcactaatttcttggcaaaatgccaaacaacaataatgactcaaccgtcatcattctcttctgctactccataattctgcaaattactgtcatctgctgttgatcaatgatcaatccaacaattccaatgccatcatcatcacctttatttcgccgctgtttttgtttttcaattatttttttgtccgccgcccttttggcactgtgccgttcgacaacgacggcacaaatg

SEQ ID NO: 106789 - DNA, 443 bp, Heterodera glycines
  Promoter: Source sequence=SeqID_14678; Location=1328..1770; Strand=-; Gene=SeqID_78786
tttgtgcgcttttaatcctggaaagtgatttttttccgcagatttcacacatgtaaagaacttaacaatatttttttattttttttaatttcaattttacatcggtgtatgagtctcaatgtgcgtatgtaaattgcctttcatattgaagcttttttggcatatgaagcatacaaaaggttttgctttactttccattgtaaaagtgaggttgcttagataggaatatttgaaaattaatttagaatattttatttactttggaatatgggttcgatttaaaattatttaactttgaatttggaaacaaatgtgtgtggatttaatggaggttgtaataaaatgaatgatgtcgggtattcattttgtgaaagtttaattctttatccgccattacttttatatataaactgccaaaacgccgatgccggatcagtcccatg

SEQ ID NO: 106790 - DNA, 106 bp, Heterodera glycines
  Promoter: Source sequence=SeqID_30936; Location=1683..1788; Strand=-; Gene=SeqID_61307
gcacagagagaaaaagcgaacgagaaacaaaggccaaatggacgacgaagggagaaagagacgaaacagccaaagaaacatccataaaagaacggcgaaaagaatg

SEQ ID NO: 106791 - DNA, 84 bp, Heterodera glycines
  Promoter: Source sequence=SeqID_10855; Location=1..84; Strand=+; Gene= SeqID_74133
tcccccccccctttccccgtatatcaaggccttgctataaaattgcctcctcatgcgcttctaaatcattcactttcgcaaatg

SEQ ID NO: 106792 - DNA, 328 bp, Heterodera glycines
  misc_feature (46)..(46): n is a, c, g, or t
  misc_feature (65)..(65): n is a, c, g, or t
  misc_feature (106)..(106): n is a, c, g, or t
  misc_feature (121)..(121): n is a, c, g, or t
  misc_feature (200)..(200): n is a, c, g, or t
  misc_feature (260)..(260): n is a, c, g, or t
  Promoter: Source sequence=SeqID_22034; Location=1..328; Strand=+; Gene=SeqID_52671
aattcagcagcaatgacgatgtgggaggaatattccgagcgagatntgattaattttgcatattntatgctcgccgggtccggatttcaggcaaatttgtgcattntaatgaaaaaaatanttaacttattaaaaaacattcaccaattttttcgggttaaaggtacgtctttttgaaaagttatgggcaaaaaaatatnttcttgttgattgtatgaaaagaaaaacttttaaaagattgatagttgaacgaaaaaaangaaatttaattttgaatttttcttaaaatttttcttaacaaattattttttaaaaaatttagaaaatg

SEQ ID NO: 106793 - DNA, 308 bp, Heterodera glycines
  Promoter: Source sequence=SeqID_38843; Location=1..308; Strand=+; Gene=SeqID_67562
ttatatcgattttaatgcgctaggttcgatgaaactttttaaaatataagcctaaactttttggcctgtttaaaaaggaattaaaaatttttaaaaattttattcatctcccttttgatagaaaaagcatcagagtgccttgattaacctgtaaataaagttttgtgtgtttcagagcactttctgaaaaaatacttatgaattaattttgcaaaaaataaataattaatgaaaaagtcagaatttcgaaaaattttaaaaacaacaatcgttggcattttttcaggttaagttagtcctttacaatg

SEQ ID NO: 106794 - DNA, 79 bp, Heterodera glycines
  Promoter: Source sequence=SeqID_17490; Location=1949..2027; Strand=-; Gene=SeqID_81995
ttagtagtaattggttctgcttgctgcgcgagtgaatttttcaaaattttgtgtaccgtccccttttttggcacaaatg

SEQ ID NO: 106795 - DNA, 368 bp, Heterodera glycines
  Promoter: Source sequence=SeqID_28067; Location=232..599; Strand=-; Gene=SeqID_58723
ttaagaaaatgaatgtaattatgctcaaaaagggagaatattgcgaaggcaagaagcggcggcgcaagcggcggccgcggaaaaagcgaagggaccgctgacgacgcggccaccgaaggaagcggaggcgaaaagggtaattaatgaacaaacgaacagaccgacgaacggagcggacattgtgccagtttagaagatcagcgaattggcacggaaagcgaacgcttcgaaattggcggtggcgggcgcaacggaacagccaaaggcgggctcatcatcggcagaaaaggcgagaaaagcatgccaattggacgacaaagcgatttggccaaatttagccgatgctgcgagagaaagcgcgcgacatg

SEQ ID NO: 106796 - DNA, 107 bp, Heterodera glycines
  Promoter: Source sequence=SeqID_31108; Location=170..276; Strand=+; Gene=SeqID_61487
tgttcgggatattggcatgttaatgcctaaacacctcaaatcctttttttatataactattgactaaatttttaaaaaatcgggatgtgaacataaaaatagccatg

SEQ ID NO: 106797 - DNA, 144 bp, Heterodera glycines
  Promoter: Source sequence=SeqID_40702; Location=1..144; Strand=+; Gene=SeqID_68958
aaaccaatttttggtgttcctaatttacccgcgagtcaaacatccgaatcaattaaatagcttctgagataataaggtttatcataaaatttcatttaaaaataaacactcaattatcggtacgaacgatactttccaaacatg

SEQ ID NO: 106798 - DNA, 531 bp, Heterodera glycines
  Promoter: Source sequence=SeqID_12690; Location=1463..1993; Strand=-; Gene=SeqID_76371
ttcaggtgggaagggagaggaaaaaaatttttgatggagaggggggggggggggagagtaatgcccaggggcatcattttcgaatgtttcaattcaaattaattgaacaatttgacaaatggggggaagggaaaaggctattggccatttcattcatttgccattcctcttttctgatctttttcccttttcctccttcagatcgctgcttcgactggtaattttgccctctgtgagcttttgctccgtgccggtgccaatcccttcctctgcgtccctttgcccttttcgtcccttcccttcggcccttcccaaatttgtccctccgcctttgccatcgccgcctcacgcggtgatcaaaaattggtcggcctttttctcactttttgttcggttttgcgccaacaatgggacaatactaaaggttaaactgaaacaattcggctcatattttccgtggcttttcctcaaggccaaaatgcgttgtgccgttcctccgacgctttttcccctcagccgccctttcaaatg

SEQ ID NO: 106799 - DNA, 250 bp, Heterodera glycines
  Promoter: Source sequence=SeqID_5879; Location=1..250; Strand=+; Gene= SeqID_59527
ccgccacttccctaccgccatgtccctaccgccaattccctaccagccatttccctaccggccacttccctaccagccatttccctaccgccatttccctactaaggcatttgggccatttccctaccaaaattttttttgaaattttttggcaaaatttcaaaaatagaaagggtattttcaacattttgatgtttctcgtgaattataagacaataagttttttgtttaagttatagattagaaaatg

SEQ ID NO: 106800 - DNA, 529 bp, Heterodera glycines
  Promoter: Source sequence=SeqID_23112; Location=1..529; Strand=+; Gene=SeqID_53818
caaaccaaaatgaaatggtcttaaaatattcctttctggacttgactgggaagtcttgatatcgaagctgttttctgcggctaaaaacggttataccaaaccccagatttttgaatccggttttcagaaaaaatgccttggtggtgaaaacaatatttcacatttcactccataactttgtgagttcggcacggatcgagaccgggataagaccattggaaagagcagctcgagctctacaagaaggtatggaaagaaaaaatagttatttctgggactttttcagaaatcagaattaattctccaatgtggcccaaattttaggcccccagccacagccccttgcttctcccagttttaagtcttggatttgtcaaataaattcaagacttcaaattaataatcaaaaattctcttaaaatttttttgaacccaattcaaaaaaggaaaaaaatttgcagtcaaaaaattattcgaatttctccaattttgtttccataatttccgaaagttattcggtatcataatg

SEQ ID NO: 106801 - DNA, 496 bp, Heterodera glycines
  Promoter: Source sequence=SeqID_3910; Location=4524..5019; Strand=+; Gene=SeqID_52394
tttgggggccattgttgggagaagcatagttttgttatttggggtaattagtgagcaattagctgattagcattgaacaaaaaccgccgtcgtcacattggcactttgaacttggtttggcccgtttcgtctcgccagtaacagtagcagcagcagaaggaatggccgttttttttctctcctttccgtttgctttatctcttctgcgttgtctgccttttcctcttcactctctatctctatctctcaccttctctctctctctctcctttttattttctctatgccttgcgttgcgttcgtcctttcgcaatgattcggtcgcttttcgtcctcgcccgaggggttttgcgtagaactgtctcgcttttctgcttccacttctaacgtgcacacttttgtctttgcttctctgttctcgctttttctctcctgtggcaacactctctgcgttctctctctttcacttctctgtttagaatagggcagagaaatg

SEQ ID NO: 106802 - DNA, 405 bp, Heterodera glycines
  misc_feature (31)..(31): n is a, c, g, or t
  misc_feature (55)..(57): n is a, c, g, or t
  Promoter: Source sequence=SeqID_5296; Location=1..405; Strand=+; Gene= SeqID_57591
attagaactcgtaaaaaaaccaattttgctnttgctattcaagatgatattaatnnntcaagtgtagaaagaacaaaattccaatcattaaattataattctttttttcctttactagtttttttaaataaaattatgagccgaggtcaacaacaattagccataataatacacacacaattcatttaattaaaaatttcttataaaatgtccaaagtttcttttttgaatgatatattcgcaatgaatttcttaaatttatgcagtaacaattttatttaaaaaataaataaataaattttcatattttattatgatttttttccggtctcatttctcaacccttccgaccttaatggccaaccacccatcgtgcaagtgttaaaaaattctttttcagagatg

SEQ ID NO: 106803 - DNA, 87 bp, Heterodera glycines
  Promoter: Source sequence=SeqID_9805; Location=154..240; Strand=-; Gene=SeqID_72758
tacccagtgcttatgagggaaatagtccagaggagccctcttacgcgtccgtaattaggccccgcagggcttggaagggaagggatg

SEQ ID NO: 106804 - DNA, 1003 bp, Heterodera glycines
  Promoter: Source sequence=SeqID_3239; Location=970..1972; Strand=+; Gene=SeqID_83843
gcccagctaatatcaatgaaatcagagtagttttcgagtccgaaaatttaccatcggaaataagacaaaaaaaaattggtctttttcgagtcgatgcttgagatagagactttttcaaaatatttcttgtacacccaaaaagaattaaacaagcaatttaaggttttgtttagcaaagtctcggcctcgggtctcgagaataaaaccgaaaaacccgagaccaaaaaaaaaattcagggagtgattactgttcataatatgtacaattttaaacatttatttaaaatagcatttttaaattataatattatataaagtcaataccaatccataattctaagcagtatgataattacgtaatttgcatttaatgcgcttcattacaacatctcaattgccactctctccgatgccaattttgcctctctccccaggtttgatgccgatttgtgtcggcattgcgtcatctcatttcatgccagttttgtctcccccttcccgattttcatgctaattttgtctctctcccatgtttcatgccaattttctttctctctgcctctctctttctctctctctctctcctctctctctctctctccgatgccaattttgcctctctccccacgtttgatgccgatttgggtcgatgccgatttgcgtcatctcatttcatgccagttttttctccccttcccgattttcatgctaattttggaaacgaatttgacaattggaaacaaaacgccaagcaatgacaaaatgcaaaaggatttgatgattgatagcaaagcgcttcaaagcaaagtcaaaacgaaaaagaatttgacaagtggaaacaaattgccaaacatttgactaatgatggcaaagtgccaagatcaggtaaaatatcaaacaacaacaaaaccgaaacaaatttgacgaatgatggcaaaacgccaaacgatgacaaaatgcaggatttgacaagtgatggcaaaatgccaaaatcagtaaaatg

SEQ ID NO: 106805 - DNA, 444 bp, Heterodera glycines
  Promoter: Source sequence=SeqID_9337; Location=5353..5796; Strand=-; Gene=SeqID_71046
attgaatttcaaaaagtatggtcaaaattgttgagtctatattttttttgcaagtttttggtcacaacttttgtaaatttttgctaattttttaaaaattataaaaatagtagagaatatatatatatatatttttttgaatttagctacattctaataccaagatgaataaatttgattaagtttaagctaagttatgcttattattttgcaaataaaattgaaataacaattaaatttaattattattaacactgatatttttgtcacttaattcaccagcaatgcgcaccaatgcccaaaaatggaagggttccaaaagcggaattctgaaaattttctggaaaagcggtccgtactcacatggatttacatttttattttttcgaatttttaattcgacttttgttttaagacttctcgacacaatttccagctcaaatg

SEQ ID NO: 106806 - DNA, 57 bp, Heterodera glycines
  Promoter: Source sequence=SeqID_12348; Location=1723..1779; Strand=-; Gene=SeqID_75944
ggttataattaaaaaatcgtttttttttaattttatttaatttttagaaatcgaatg

SEQ ID NO: 106807 - DNA, 91 bp, Heterodera glycines
  Promoter: Source sequence=SeqID_4752; Location=1..91; Strand=+; Gene =SeqID_55608
aaatgcttttcctctcttttccgtccctcgtcctccgccaaattcgcccttctttctgtgctgcttttcctttctgctgatgttagccatg

SEQ ID NO: 106808 - DNA, 194 bp, Heterodera glycines
  Promoter: Source sequence=SeqID_23302; Location=1..194; Strand=+; Gene=SeqID_54008
gggccctttgcaatgtatgtgatctctgcataatcctttcacatattctgaccctgaaaggcgcccggggcatataaaaaattaatgcatagaattgcaaaaattacgcgcctaaataatttcggtgatgcataaatgcatcaatttaaagcaagaaatccttcgaatggatctgcataacttttctaaaaatg

SEQ ID NO: 106809 - DNA, 360 bp, Heterodera glycines
  Promoter: Source sequence=SeqID_5768; Location=1..360; Strand=+; Gene= SeqID_59160
ttcggcgcggccagttcgacgcggccacttcgggcgcccctatataaaatgactttttcggcgccgaaaaaattttcaaaatctggagcaaaccatatcaaaagcaaaaaatttcctgctgaaaactacctacacactaattttgagaaaaagtaaaaaaaaaaatgttgcattgttgtttacaatcgaatacctggtcagtttggaacttttaagtccaatccaatataaatattcgaaatttgaatccggggttctgagttaggcaaacctatggtcagattgtaatcagcaccctcgaaacccccgattggtgattttgaaccaaaatataaaagttaattagggaccacaattatg

SEQ ID NO: 106810 - DNA, 278 bp, Heterodera glycines
  Promoter: Source sequence=SeqID_1189; Location=1..278; Strand=+; Gene= SeqID_69543
caattttgggctccaagtacaaataagtttattatttatttagtaatcagaacgccaaaactttgcaaaacttaaaatttattggggattttcccttgtaaaaatggaagagccgatctcgagttaaaaacttaagtttcacaaaataaacttggaatcgttaaagggggttaaaatatgggcctatgcaaaatttcaagaaaatttcaactgcagaaaaattttttcaactgggtgaatatttcaataactttccgacacttttacagttaaaaatg

SEQ ID NO: 106811 - DNA, 702 bp, Heterodera glycines
  Promoter: Source sequence=SeqID_2485; Location=276..977; Strand=+; Gene=SeqID_79993
attaacgccaaaaaaatccctccccccccccccccaccttttcaattccttcatcttattcaatggaattaacttgtaaacgcaacacaaacaatacgattgttataaaattacaaattgcaaaattatgtgcaaggaactaatgggaaatgagcaaaagtcaaaaacaaaactatcaaagtaaaacggtaaacaaaaacaaacccaatattttacgcactctgttaattttgagaatgaaattagtttttttaggaagactaatttattcactgtttacagttgaaaaaatgaaaatttcataatacatatttcacgattcactttttaattttgattttttcatagtattgtaaataaggaatcatttgcttatttaaaattcaactctttttttttctttaacgtttcgtttatttgtgaatttgcttttttcaaatttagcgtgacttaagataaaagaaaatgtcacatggttcgcaattaatcgcatcatccatcatttttatattactaatttcgctaatgaaatgatgcaaaggaaccatttacatttgtagcaataaataatgaatctaatcagctaatcgcttctgattttcactgcttttttcaataaaaaattccgcgttttatacagaatattttgcatttgttaataattttgttaattgtcatcaattattattattattcattatg

SEQ ID NO: 106812 - DNA, 1003 bp, Heterodera glycines
  Promoter: Source sequence=SeqID_8887; Location=3066..4068; Strand=-; Gene=SeqID_69535
cgtaccaattctagaaattttaattagcccatcaaattagtttttaatacatacgttcaacttcctcgttatgcggaaattggtgaaccaacaaacaaaaataattgtaaagtggttcaccaacaggcacaaaggcaagagcgaaaaaacattaaatatccgtgtgttggtctgcgttttgaaaaaagtgagtgtgaagttgaggcaggcgttgtaatttgcggtaaaccgcctggcaaaagtggaaaagacagcccacccttgtggcatttgggaaaacctgagtgggactgattgaacaactgcttggaacatcttaaaaattttggcactgatcactaatttaaaaaaatctaaaacaaacattaaggtattattttctgattttgatttaagtatgccataaacacaggggacggccaccttatcgatcagtacagaaattgtgtagacttgggtaaaatgagctggggagcacttaatattataaaaattaaactattcgaatttttcgggttaagtctctttgaaggttccatcaactgtggcatggtgtccatatagttacaaaatgtttctagcaaccggagaagccaactcgaacaaactctgcccatcgacaacgttgtcacgaataagtgcatctcgaaggtgtcccgtaacttctattcacgcgcctccgtttccctcttataaattctcccccgtaactcataaattattcttgaaaaatttctaagttagcaattttttttttttaaattttctcggggggaaacgatgcgggggggaactgattcgggggggaaacggcgggggggaaacgagccgccccgctccctttgaaaggtttaaaatgcaaggtgaaattttttggggattttcccttgtaaaaatagaagagccgatctcgggttaaaaactagacagctaaaaaataaactgtgattcgatagaaggggacaaaatataatgtcctcaaaattattggaagccacacatg

SEQ ID NO: 106813 - DNA, 545 bp, Heterodera glycines
  Promoter: Source sequence=SeqID_28417; Location=1051..1595; Strand=+; Gene=SeqID_59038
aattaaatatcattttcgatcaaaaaatttttgaattttttagaatttataaaattgcaaatatgttctaaaataaaatttgtatataaaattttctttagtttaattaattaattagaaatttcttattaaaaataacaattaaataacattattttttaattttaaattttgtctaaattaaaaatatattttttaaatttaatagcttaagaggcgcttatcacaaacaaaaaaagaatatattaaaataaaattaaaattcccataatttctcataactgatatgaaattaaatacaattaatttaattttatttattttaaaaaatctgcaaaatataaattaacaattaaaagaaaatccctctttcagaacattgatcagctgcagaaggtcagcaatcgctttgcttttgctttcgttttacgctttttcgcttttgcttgtatatatatattttttttgcgggcatttcaaaaatatttaacttcggacggcacattctcttaaatttgaattttttttccaaatttggcataatg

SEQ ID NO: 106814 - DNA, 167 bp, Heterodera glycines
  Promoter: Source sequence=SeqID_22383; Location=1..167; Strand=+; Gene=SeqID_45714
ttcttttcatatcgaattacaatttacttttttatttacattgtttttttaaagagtcgattacggtatcccctttggtaattactgtatttttcgattatccaattttccaggcgggtgacgaccttcgccaggatgctgttgtgctgcagttggtccgcgcgatg

SEQ ID NO: 106815 - DNA, 176 bp, Heterodera glycines
  Promoter: Source sequence=SeqID_44856; Location=1058..1233; Strand=-; Gene=SeqID_72269
tcatttttagttcgtatgcgacgagaaaaataggaaaaaatagcaaaattaaagtcgaaaaaatcttttggaagtgccaaaaaacacttcaaataattcataaagaatatttttgaaaaaatctaaataaacaaacaaaaatatatagatattcactctctttttcaccaacaatg

SEQ ID NO: 106816 - DNA, 332 bp, Heterodera glycines
  misc_feature (42)..(43): n is a, c, g, or t
  misc_feature (47)..(47): n is a, c, g, or t
  misc_feature (71)..(71): n is a, c, g, or t
  misc_feature (177)..(177): n is a, c, g, or t
  Promoter: Source sequence=SeqID_35948; Location=953..1284; Strand=+; Gene=SeqID_46454
ttgtttgacttttttccccattttaaggttttttgttcgctnngganctccaacacttccgaaaaccttcngtcggtcagtgctaatggcataagcaattagtccaacaattgcccactgcgggacaaagagcgacagtccgtttttatgtcttttggtgttcgacccccgccggcntttcggatggtatcccaaattcattcaaatcggaaagtgtgaaaggagttatagccaaaaacggactgtctctcagttggccatcgctcagttgtcccttccgttaattgtcccgtaacttttgcaatttttcaaaaggaatgtggcaaaagatg

SEQ ID NO: 106817 - DNA, 355 bp, Heterodera glycines
  Promoter: Source sequence=SeqID_30488; Location=1..355; Strand=+; Gene=SeqID_60893
acagttcgatgaccgatatattagctttaataatatattgtgctgaattcacatgttatgctttgatttggccgatcaattatttctgtcacggacaaacattagggtgattgttaaatttaattaatcaattaaattttaattgctttcttcatttagaatcgaaaggaacagacgtttattgatttcactgactgttattatgtcaatcggtctcatctgcttcattggagtaataatattattattttaattatgattatgtttaaaaccctaatttaataataaacttattcacaattactgtacattacagttcccgtttaagacttctgtgttctttcatggcataatg

SEQ ID NO: 106818 - DNA, 235 bp, Heterodera glycines
  Promoter: Source sequence=SeqID_41884; Location=662..896; Strand=-; Gene=SeqID_69922
aaggaattaaaaaatttttaaaatatttattcatctcccttttgatagaaaaagcatcagagagccttatttaacttttaattaacatttggtgcgtttcagagcactttctgaaaaaatacttatgaattaattttgcaaaaaataaataagtaatgaaaaagtcagaatttcgaaaaattttaaaaacaacaagcgttggcattttttcaggttaagttagtcctttacaatg

SEQ ID NO: 106819 - DNA, 60 bp, Heterodera glycines
  Promoter: Source sequence=SeqID_338; Location=1353..1412; Strand=-; Gene=SeqID_83076
aaaattaagaatttgttcaacccaataaaccgcgtatacgccgagaaggaggacgcaatg

SEQ ID NO: 106820 - DNA, 573 bp, Heterodera glycines
  Promoter: Source sequence=SeqID_3427; Location=3686..4258; Strand=-; Gene=SeqID_47615
tcggccaaaaccttgggcccagggtaaggtcagaaccatcaggtgctaccagttagagttgtgccggtcccacggatcccctcttgtccatcccgggccgtaaccctcgcgctgagtactccctgggctggagaagggggacgagatcgatggatagggaattgaataggagatattgctgataagtcgcgactgagatctcttgggaaggaaatcccgagcttataagggggccctcgggagagatccaaggggcggtcccttcccgctattggctgaacccttttacgccttacaatacaaaaaagacattaccagtgtaaatttttgaattaccgcgcaaataattacgccaattacgctatttggcgttatgagcaattttgtctgggtaggtgacggttcggtgccagccgatgttttgggctacaacttttttcattgttgaccaaattcaacattgttgatatcattcgagagtttacatgtttagaagctttttctaacattttttcattgtgttattgtgtttattcttttttagacaaaaatatttattggcctcccaaaatg

SEQ ID NO: 106821 - DNA, 225 bp, Heterodera glycines
  Promoter: Source sequence=SeqID_4084; Location=3741..3965; Strand=+; Gene=SeqID_53117
ggtgggcaacagcagaagcagaaatggcaaaattgaaaagagtgtaaaaaacaattaaaaaaaaacaaaattattggctttatttttaaaacccgggcaaaattttatattccggaaaattgataccattttaaaccccaagaaaataagcgcgcattctaaaatccagaaaaagggttctgatttaaaacgagggaaagcccaaagaaagatatagaactgatg

SEQ ID NO: 106822 - DNA, 166 bp, Heterodera glycines
  Promoter: Source sequence=SeqID_2929; Location=1785..1950; Strand=-; Gene=SeqID_82373
ggtggttgcggagaataaactggaagaatttttaaaattaccatcattttttcgcatgcttttttataataaatattaaatgttcatgttgtttttaaagtgaaggttttgacccaaatatttaatcaattttaatttattatttttggtagaattccagaaaatg

SEQ ID NO: 106823 - DNA, 358 bp, Heterodera glycines
  Promoter: Source sequence=SeqID_40125; Location=1..358; Strand=+; Gene=SeqID_68551
aatatcaaaaattaaatggatcggagtcatttttggacgcccccattcttaggcgcaagagaaactaagaaacaatcaaattttgggttgataaaatctctaaatagtgattgaaattgtccaaaaaaaaagttttatttagcgttttatgtgacatggacataattaaattatttgtatatttttttaagatggcccaaaacagacgaaatttttaaccaacgcatatggcaaaatcgaatggaatttctttaaacacatccataacgacaaagtgatccatgatatacattcacattacaatgcacaggaaaagatcactattctagtcgaaaaggcaccagataagcgaattatg

SEQ ID NO: 106824 - DNA, 1003 bp, Heterodera glycines
  Promoter: Source sequence=SeqID_1312; Location=1188..2190; Strand=-; Gene=SeqID_72326
gcctttttggggagcatttatcaaaaatatgggaaaatagggtccggcggtgccgataggcgccactgggaaaatttttaaatttgggcgtgcttttttaagcgaatgctgaaaattttcaaaaatttaatgccaattttagtgcctatttcgcaatttttgggcatttttcaggatttccggaaaaatccttaacaaaaaagcattaaatcaacttatttactatcagaaatttgttaacaacaattttgtttttacccatttttctacctatttcagcatttacgtacctattacacagaaactttaaaaagaaaaaaaagaagagggaaaggatttagattaaagaaacaacaaatagatagggctggcaaaaatatgtacaaaaagtggtcaaaataagtacataaaatgtaaaaaaaaatcgggatccaaatggttaggtataaaaataagtacctaggtaataggtagaaaaactcccaaataggtaagaataggtattatgaaagtcatcgtattgaccccaatccaagtggaaaataatttttttcgtgcttatctgtgcctattcaatgcgcaaaaaaaattttttggaaaaacgtacagcaaaaaaaaccttttattatattttttaattggaataaaatttttgaaaataatgctttttaacgccaaatgctgatttttttggcaaaatgatagatttcaaatttttatctggcagcctggttatagcacagccaattttgtgcaggaatgggggactgggtcgttttggcgcccacgttttggcgccgacgatttggcgcccatgttttggcgcgaagccaaaaattaaaaaaggtaaaaatttaatcaaaaattttacaaaaaaaagtgaaaaacttttaccttccaatgggtttttcaaattttcaaaaaattcacaaccccctagaattttttctcaaccttcccgattttaactgtgttttatgggtgtagattagagaacaacatg

SEQ ID NO: 106825 - DNA, 349 bp, Heterodera glycines
  Promoter: Source sequence=SeqID_20091; Location=1129..1477; Strand=-; Gene=SeqID_84876
tttcgttaataacactgatttttactcttttaaaatggcctttaaatttaattggcctaaaatgtcacttgcttaatcatttacttatgttcaaacataatcttttaatttgtcggaattgaatgaataagccataaaattcactcggaaaccaatgagtaatattcaaaagcatttttttgtcgctcccggcaaatggcaacggtctgagcaatggcggacaaatttggagctatttataagcgaaaaggtgcagaaatgggcatttcttttgttgcatttaaaaattcatttaaaacatttttatgtatgattaaaaattaatatttcagccaaactcttccaaatg

SEQ ID NO: 106826 - DNA, 485 bp, Heterodera glycines
  Promoter: Source sequence=SeqID_11297; Location=2254..2738; Strand=-; Gene=SeqID_74671
taatagaaaataaattaacacaaacattatttttatttatcaaatttaaaatattgatttcatttcaatatagaaatatccaacaaaaatccttctttcacttttctttaaaattttttccaaaaatataaactaaccagcataacagattctaaacatgaaaaagtctttaaaataacagtaaagacaaaaacttttgtcaataggcattcaaaagcttcatacaaacaattacaaaaaggtttatcacaatcaaaccgttgtgttttcctttctagatagcatatgcgccatgttttgtcgaaaattttgataaattggcgcattttatgaacgacccagaacgatttagaaaatagacaggagaataaaattattattaaaatattacatttttaattcacctattaaatattataatttttacccaatcagataatttataaaaaaaaagaaataattttgcagcctttcgataaataatg

SEQ ID NO: 106827 - DNA, 1003 bp, Heterodera glycines
  Promoter: Source sequence=SeqID_16911; Location=196..1198; Strand=+; Gene=SeqID_81340
tttgtacctcttttatcacttttgcacctcttctatcactgttgtacctcttctaatcacagttgtacctcttctcatcactgttctacctcttctgatcagatttgtaccccttctaataatgttgtacctcttctaatcacagttgtacctcttctcatcactgttctacctcttctgatcactgttgtacctcttctaatcactgttgtaccacttctaatacacttgtacctcttctaatcacttttgtacctcttttatcacttttgcgcctcttctatcactgttgtacctcttctaatcacagttgtacctcttctcatcactgttctacctcttctgatcagatttgtaccccttctaataatcttgtacctcttctaatcagatttgtacctcttcctaaaaaacgggcgcgaagcgcccgtctgaggccgcgaagcggccgaaaaggcccaactaaatttaaaaacgggtgcgaagcgcccgtctgagctcaacaaatttaaaaaacgggcgcgaagcgcccgtcagagcaaaacaacatttgaaaaacgggcgcgaagcgcccgtctgaggccgcgaagcggccttaatagcccaacaaatttagaaacgggcgcgaagcgcccgtataagcccaacaaaatttaaaaaacgggcgcgaagcgctcgttcgagcccgcgaagcggcctaaaagtcccagataattttttaaaaattccaaatctccacaaccagagctaaaaaaaccgtagttgtacctcttctgatcacaattgtaccttcccacccgtggtagcaacatttttgcgtagacctgacatggatctgcggatcagcactccaaaaaatctgctgcagtatttggtcaaccaatacaacaggcagcaagcacggcaaaaccccaatgcccaacagaaaactgttgatgacattggcagtgttgttcggctttccgaacacaacgtaaattctctccaatattggaagaaaatg

SEQ ID NO: 106828 - DNA, 705 bp, Heterodera glycines
  Promoter: Source sequence=SeqID_28483; Location=358..1062; Strand=-; Gene=SeqID_59097
ttgaaagttttaataaaaacttattttttattcatttgaagcgttacacaaatttgtgacgcaattgacagagggcaaaaggaatttgagaaattcggtcgaagcggcgcattaaaggtgagaagcatttattagacgtagcatcgagtgagaggtgatatttaattgtttacaaaaagataataattgaaataataaataaaagtgccatagaattttcgaaaaaatagaaggcagaaaaaaaaagatttgataacacaatgttgagcgatttatgtttgggatattttcaaaattttcattttaattctatttttataatagaatactggagatttgggtccggcagtgccggtaatttttctccaaaaatggacaatccattaaaaaaaagaataaatgcacctccggtaaggcttttttcagactttagattttaaaaatgattttacctttcgctgcagttgcatgagagtactctttgtactctccttttcatttcgagcgggcattctgtgctataagtgccagaaaaaataataataaatgcaaaaaagcctttattattattattatttaacatattgaaatgccaaggttttcgtgttgatcagcgacggccatggccacgaattatggccaaaaactttggagaccgggaaaaacttacgccagcaaaaattgcaaaaattcgctgtttcaatg

SEQ ID NO: 106829 - DNA, 505 bp, Heterodera glycines
  Promoter: Source sequence=SeqID_30631; Location=998..1502; Strand=-; Gene=SeqID_61036
ttaaaccagggcttccatcgaaaatttttcaaaatcagaacatcaagtccaaaaaaatagattttagggttaaaaataagaacatttcgcaaaattgcttcaaatcagttatttttacaatttattcgattaaaaatatattaaatattatattttcacctcccattattgattttaacaattttggggaggaaataagcaaagcgtatatttcagtgcattcgggatcaaaaaaatgagattttaacaatttttttgcggcgagtttttccaaaaaacttttggtgaatgggcaataggcgccgccggaaaatgttgtaatttagttttgatttattaacagattttcacaaaaaaattaaatttttgcaattaaaaccaagtgacgacttttttttttgttttttaaaacgctttttgcggcgcgcttcttccaaaaattttgggaaacagggggggggggggggggaacgattagccttctttgtgtttttgccgagtaatg

SEQ ID NO: 106830 - DNA, 409 bp, Heterodera glycines
  Promoter: Source sequence=SeqID_2018; Location=3904..4312; Strand=-; Gene=SeqID_77348
aaaaaacagttattttgtttttttattttcattttatcattttaatattgaaaaaagttttgagattttgctcattttcaaaaatgtctcaattttaaagcaactcaatgtgccgaaaatttttcattcattttattttgtaaaattaaaaaattaattcttacttactacaaaacacaaaaacaatcctttttaataattattcgactcaatgaaaatatgcaataccaatagatatatggattagcatattgattttaaatgtgtaagattaatatatttttataagaacacatgagaatatgcattattttattatattcatttatttgtatattcaaatatattactttgtctatagcttttaatttttgattttttaagtttgtgccaataaaattttaccatg

SEQ ID NO: 106831 - DNA, 69 bp, Heterodera glycines
  Promoter: Source sequence=SeqID_6397; Location=700..768; Strand=-; Gene=SeqID_61397
atgtcttttaccaattaattagatggttcttcgctgcatcaaaacaatgccaaatttatcgatgaaatg

SEQ ID NO: 106832 - DNA, 51 bp, Heterodera glycines
  Promoter: Source sequence=SeqID_17824; Location=1130..1180; Strand=-; Gene=SeqID_82354
ttgaaaaagtgtcggaatggcgaaaaattgaaggaaaacactgagaagatg

SEQ ID NO: 106833 - DNA, 1003 bp, Heterodera glycines
  Promoter: Source sequence=SeqID_3545; Location=1512..2514; Strand=+; Gene=SeqID_50806
atttcgaacaatttcgaaatccggacccaaattcgaacaaaaaatctaaaatttaatttttcgaatttcgtctaaaaatggtttaatgatcttttattgcatgagtggatagctttcagtttgtttccatgtgtttaaatcgtttttagatgaaaaagataaattggataattaaatttttgattttttgttcgagtatgggtccggatttcggaattgttcgaaataaacgtcatattcatgatcagcgaccccgaaaactccagaaaaaaaattaaaaattattttatgtggcgtaaagtgaaaaagtaccgattttcctggacaaaattttagaatttattatttcaagtgaccgatattttttcaagttttcaaaaaatgattaaatatatttaaaaacaaattattattgtaaattagatatttttagatgttcccaagcaattaattgaatttttcaaacatttttttgatttttaaaatgagtttaaaaaaatccaggtccaggcctggatccaggtctcgaagagcctggattttcctggatttttgtccaggaaatccaggtccaggtccaacatggaatccaggtccaggtccaggcttttttcaaaataccgagctctaattgccacttctccatttttacacctattttggattttttataacttaaaaataatatcataatatccctagtcatatgtttagcatcaattacaaaactatttttgtgggcctaaaatcctaaataattcattctgttctaacttttattgctgatcaaaaaaaaacttatccaacttgatcagatgatccacttcctcatagtgaaacactcctattatggatgaattgagtataaaagagttgcgtaagatgagttgggtctactccatacatacgccaaacaccttcattattgcctttaattttgcaatagtttaggataatttaatttgcttttttctcttccatatattcacaaactcccaaaatg

SEQ ID NO: 106834 - DNA, 125 bp, Heterodera glycines
  Promoter: Source sequence=SeqID_7411; Location=266..390; Strand=-; Gene=SeqID_64746
tctgctggaaattcaaattatatacataagtttttatttttcctttcctttttcctttccacatggccgaaatgactcccccccttaaacaaatataattagtgtattttaattatcacttaatg

SEQ ID NO: 106835 - DNA, 260 bp, Heterodera glycines
  Promoter: Source sequence=SeqID_4507; Location=544..803; Strand=+; Gene=SeqID_54710
tttcctccccccttttccccttttcttatcgctctcctcccccaatcgtttgcctttccttttgcttccccccaatcacttctttcactttccgtttttggttgcttcgttggcttaccttttttgccttcccatttttcccctttttggtggtgaattattttctcaatttttcgccttctctttgagcaattgccaattgtcccttccttttcgaccgttttttctatttccgtcgcttttcctcccctcccaaaatg

SEQ ID NO: 106836 - DNA, 720 bp, Heterodera glycines
  Promoter: Source sequence=SeqID_10666; Location=1..720; Strand=+; Gene=SeqID_73912
ctaattatccataaatggcataataatgcccttccccaccattttttgttggcgagaatttgaggcggagaatttctcggcttttgctactaggctcttagtaggtttttttgaaatttatcaggtattactttcacagggctcatttttttttgcaaccccatatgaataaaaaaattttagttttaaaaattttcctttttcgaaaacgttataaaatatttaataatcatttaaatgaccaaaattatgttttttggttaagttttacgtgttttgcgccctaaaaatccttaataaaaaatttttaaatgccttttttcatgccttttttgggattttcgtgccttttcatgccttttttcaattttttggtgcctattataagtgcctttttttgcgagctctcattatggcagataatttgcaaatgaaagatttaaaacaataaaaaataataaaatacctaattacgacgttgactcttcgataagacgactcatttcatataaatttttttggaaaattttttgttaaaaatcttagtgaaaaattgattgcattgctcagaattacgcgacaatttaatgttggaaaagatttattatgagaaaataaataataaaataaatattaatatttaaaagcaaataaaacactaaacatattcatttactgcaatatctttaaattttataaatattctaaatactaaacatg

SEQ ID NO: 106837 - DNA, 503 bp, Heterodera glycines
  Promoter: Source sequence=SeqID_5018; Location=1205..1707; Strand=+; Gene=SeqID_56591
tggtgaaagtgaattaattgaattggagaaatggccgatgaagcagttcggattttgagtgaaaattgtcgctttgataaatgtgtagccccgtggtggtcgaaggacaaaaagtgcaaaatttgctaaatttttgactaaatccactcataacttttctcagacgcaaccaaattgcacaatcttggtatcatacgatagcccttgaattgcgctattagcctgccaaatttcaaaaaattatattaagtttttcaaaagttatgacaattttttcattttttggctagaacttttgaaaaacttaataaataagcctaagcctaaaccaagcctagcctaacctaacgataaaaaactgttcatacaacaaattttatttcctctttttttgcaaaaattgacaaaaaaatgggcaaaaaacgaaatttaataataatattattttaatataatatcaatcaaaaatattattccaacttttagacaaaggctaaaatatg

SEQ ID NO: 106838 - DNA, 66 bp, Heterodera glycines
  Promoter: Source sequence=SeqID_42199; Location=1167..1232; Strand=-; Gene=SeqID_70150
aggcattttgttattttcgtacacaaatatgttggaatcgttggtgtataaattgtattcaaaatg

SEQ ID NO: 106839 - DNA, 241 bp, Heterodera glycines
  Promoter: Source sequence=SeqID_24320; Location=312..552; Strand=+; Gene=SeqID_55045
aaattatataaggagaaggaatttaaaatttcgaaaaagaaaaaatttaaaatcggtgatatcgttcgtattaccaaggaaaagggaaaattttcaaagggatacctcccaaactttaccgaagaattgtttaaaatcgttgttgccaattcgacgacacccgattcatacaggatcgaagatttggaaggaaatttaataaaaggcatattttataaccaggaattagtgaaaacagatg

SEQ ID NO: 106840 - DNA, 579 bp, Heterodera glycines
  Promoter: Source sequence=SeqID_232; Location=4774..5352; Strand=-; Gene=SeqID_78830
tttttaaatctatttaaattaaataataaatttttgaattttgtgcataaataaaatgatgagatgagagaaaaagcatgcttatataggcatggatcattgtgaaatcggtagcaaccaaccatgacctgatgagcagcgcaccgccacccatgaagcacaagacgacagggcacctaaagcgttccgtgaaattagatatgtctagtgcactacctcaagacctaaaaggcaaattaacaaaattgctgccaggataaacggagctctttaagttgagaaaccgccctggttaacagcaaatttgaaaatgtaaaaataaccaaatagagtgtcagtgagctcttataaagccatccaaatattggtaagctcctcccatcaatcgatgatccccgggaatatcaatatgacgccaggtgtttgcaaggtcatgttgatcaatacttttagaagccaattcaaaattttcccttgggaattggtgtactgtaataataatttatagcccttgcttgacgcctacacccaactctaataatcattcattcattcattgtctatttcactgaaaaaatg

SEQ ID NO: 106841 - DNA, 493 bp, Heterodera glycines
  Promoter: Source sequence=SeqID_22848; Location=1..493; Strand=+; Gene=SeqID_53553
tttaaaaagggttcaaaaaaattgcccaaatatgaaggaaaacgaaaaaaagcgaaatacaccggggttatttgggctaaaaccttcactaaatcaaaaattttcaatacaagaatgctatttttgagtttcttcttttatagcatatgcaccaaaaatatttaaacccagccttggggattaatctttaaaaaaggcgcctaaatatgcacaaaaggcaaaaaaaaaaactgttttctacctaaataaaccggtttttctgttttcaatttagactaaatatatttaattatgcaaaactttaaaaatgaaaaaagttcagaccacgctaaaaagttttcatgcttatttcaatgcaatagggcgaaaaaaggcatcggcctaaaaaatggagccccaatgacatataataaatcaattttagccaacatcaattttccaaattcatttccatttaacctttctcattcatttttttaattttcgtcaaatg

SEQ ID NO: 106842 - DNA, 495 bp, Heterodera glycines
  Promoter: Source sequence=SeqID_25778; Location=1076..1570; Strand=-; Gene=SeqID_56517
tttcagtacattctacgtcttttacaacgtattctgtaccatctgaaattggataatatagaagaaccacttatatggaaaattttagatatttcgagcaaatactttcaatatgaaattaggcttcataattgttcaataatttcatttaatacttttagttagagtgccactgcaacgggaattgtgggcaaagccgggacagggaccttttcgggttgaaaatccgggaatttttggctgggaaagccgggaaaaaaccgggactagttccggtcccggtcaaaaccgggaccttggtactcagttgtactcagttgtccgctaccaggtaccggtcccgtggcactctacttttaatttatatttctctgtcctttagcagcagcttttcgattttctttggttgccaatggttaccaatgaatgaattgaaaggggctaaagcaaaagcaaagtgattactctttatattatttatttttttgcttaatg

SEQ ID NO: 106843 - DNA, 208 bp, Heterodera glycines
  Promoter: Source sequence=SeqID_1034; Location=717..924; Strand=+; Gene=SeqID_66569
aagccgagtcggctcatcaaaattcgtcaaaagccgggtcggctcagcaaaaattcgacaaaagccgggttggctcgtcaatttcgtaaaaaaaaacaggcaaaagaactgcttattcttctaaagccgggtcggctcgacaaaattcaacaaaagccgggtcggctcgacaagttcttcaaaagccggttggctaaacaaattgatg

SEQ ID NO: 106844 - DNA, 75 bp, Heterodera glycines
  Promoter: Source sequence=SeqID_11673; Location=1..75; Strand=+; Gene= SeqID_75140
aaaccaatgcccaaattgtgatggtaattgcaattttttcaatactgtacaaaaatttttttaaaattttagatg

SEQ ID NO: 106845 - DNA, 427 bp, Heterodera glycines
  Promoter: Source sequence=SeqID_27516; Location=1097..1523; Strand=-; Gene=SeqID_58210
tttcatttcatcccctgtggcgacgatccacccaattacacgacgaaaagtgcgcctcgcccgcgtttttcgggcggacggtcaaagccaaaaaaaagagattgagcaaatccgaaaatccaaagcaccgaaggaaaacgattttgcgagattgaagttttttgaatgacttttcaaaataaacatttgaaatcgtatttcaatagttaatttaatcatttgttttgttttactaagattaaataaatgattacatccggtcttataacaaaaacagcaattttctttttctccgcgtcttttctcggtgcaaatggtaatttgaaattatttaaaaaataatttattcgaatattttccatttactgtgagcaaaggttataataagcatttttagctctgaactgttacatttgtgctgagaatg

SEQ ID NO: 106846 - DNA, 291 bp, Heterodera glycines
  Promoter: Source sequence=SeqID_20300; Location=1462..1752; Strand=-; Gene=SeqID_50807
tctttaagcaacgggaaaattcaatttttaaataattttcaattttttattatgtaaaaaataaataaatttaattattatgattattttaatagaaaattataatcgaattttttttaaatgtttacggaagtcagaagagtatttttttgttttgtagtttgtttaataagaaattatttttttgtgtcagttttaattcatgtataaataaataaatgatcatcaataataaaaaataatattaattttaattttatttaaaaaaaatcggaaaatattttaagaatg

SEQ ID NO: 106847 - DNA, 167 bp, Heterodera glycines
  Promoter: Source sequence=SeqID_2929; Location=2864..3030; Strand=-; Gene=SeqID_82374
gtcctaatttggaaaaatgtttcgaagaagtggagagtcacacaaacgaaaataaaaaatttgggataaaagagcacgtgacaactttctattttaaatgcccagaaaacgaagatcccgaaaaaatgtttaaaaaaatcctgaaaaaattaatgggggatgcaatg

SEQ ID NO: 106848 - DNA, 171 bp, Heterodera glycines
  Promoter: Source sequence=SeqID_26939; Location=963..1133; Strand=-; Gene=SeqID_57675
aggggttcggaggcaatttcggaaatttaaaaaaaatcggcactatcgcactgctgtgcaaaccaatttctaagttccattaagtctgtccttgatgcccatcttcttcgcatcggcagacgccaggcagttcggccagaccttcagcatttgctattggaagccaaaatg

SEQ ID NO: 106849 - DNA, 485 bp, Heterodera glycines
  Promoter: Source sequence=SeqID_11309; Location=1770..2254; Strand=-; Gene=SeqID_74689
tttttcctttgtaataataatttttcaataacacctaaaaaacggttgcctatttttgaactgccaattatgaaagtaaatcgtattgtatcattgtctgtcaactcaagaaaaacatactttttaggaattttatgcgtatttaagcttttctaagaattttttttagtagtctgttttattggtttttagaattgcaaatctgcagataacaaagatcctaattgatttatttacgaaacgatttgcctgtaaatttctttaaattataaaatttacacgtgaactgtgagacgagaagaaaaattaattagagaaatatggaaaaagaagctgaaataggtaacacaaagagataaaaaaattaatttgatagagttgattcatttttattcttaattttgttttaaattttcaattaatcatttttttatatttcgcatgtgaattggatctggtcattaaatggatggagtgtattaatg

SEQ ID NO: 106850 - DNA, 247 bp, Heterodera glycines
  Promoter: Source sequence=SeqID_23902; Location=1..247; Strand=+; Gene=SeqID_54594
aaaaaattcaattttttggttattgttcgagtttgggttagtgcttagaaattggtcaaaatagatgtcagattcgtgatcagcgacatctaaaaccccgtagaataaatttttatgattttctatcacaatttttttttgaaaaacaaaagggccccccctctttactttttgaaaaattcaaaatctgccattctacgatagtgcccaaatttttctgattaatccaatggattcagaaataatg

SEQ ID NO: 106851 - DNA, 350 bp, Heterodera glycines
  misc_feature (12)..(12): n is a, c, g, or t
  misc_feature (148)..(148): n is a, c, g, or t
  Promoter: Source sequence=SeqID_34496; Location=1..350; Strand=+; Gene=SeqID_64270
gtcatttcgctntaattaataaaaatgtacaaaacaattctctaaatgggcttaattttgccgggacttaagtcccgctctgcttcaatttaaattaagtattcatagactatatataatttaaaataatgaaactccctttttttgngcagtttaattaaagtatgtttaaatgaggtgtgtgtacttattctaatgttatacagtatacgtatctcccgtcgaacattttctttgttggccttgaaaaagttcgctcaaccgttaaacaaaccttggatgaacagagtacaaaaaatgcagaagtggcggaagcatttgcgctgctcaaaaaacaccgcactcaaatg

SEQ ID NO: 106852 - DNA, 1003 bp, Heterodera glycines
  Promoter: Source sequence=SeqID_8972; Location=1442..2444; Strand=+; Gene=SeqID_69870
agagtcgtcaaagtcgagctgttcaggccgaacttctcgcggctgtacgtggtcaatttgggcagtgccgaccccccggggcggctcaattggaaccgaagggtttttgtagaagcggaaaacgatacgggcaattaccacgcttttgtgtatgctgctgtggacaaaaatgagcgaattctcctgggatttgcgccatttgtgaaaattgagaatggcaatgagtcaaacgcaccgcaggcaaaaaaaacaaaaaaaaacggatgaaaaaaaattataaaataaaataaatttcagttctccgaatatcaattatcccttcctgtgaatttgaatcccttctttaaacgcaatatttggtttctttccatggacatttaccagtttgaggaggtatggcaaaagaaaataaaatgtgtaaatttttaattgaattaatcagaaatattatttagacaatttattcgatcgagacaaaaaatgagtcaaaatcaccgatatcaaatagtggtaattattagagaaccggaaatttaagtttacgggtcccgctgcatgattgggactcaaaattttagcgggaggtatcccgtagtctcgcattaaaatgtgcgagaacccgcggggtttgcgggatttttggaatttcgaaaaattaagataaatttaagaaaaactcaaaaaactaaatcaaattgcggatcccgctgcgggattggactaaaatttttgcgggaagggttcccttgggattaatcccgcaaaatcccgtgcggtttcttataagttcaatgaaggtgatggtactgatgatgtaactgcaagctgttcaatttgtttggaggaattaacgaacggccaacaaattattaaattacacgcagaaaaaggcgaaaattacttggttaatttggcattgaatttaaaattcatttcaaatcattttagcatttatttcacgaaaattgtatcaaaaattggtgaggaacgaaacagaaaaatg

SEQ ID NO: 106853 - DNA, 104 bp, Heterodera glycines
  Promoter: Source sequence=SeqID_15680; Location=4010..4113; Strand=-; Gene=SeqID_79989
cgggaatggctttttagttggaattcaagagggaaaggcaaaatggtcgttaattgctttaacattgcaaatttttagtttcaaaggcattttgccgttcaatg

SEQ ID NO: 106854 - DNA, 234 bp, Heterodera glycines
  Promoter: Source sequence=SeqID_20091; Location=452..685; Strand=-; Gene=SeqID_84877
agtttggtaaaacggaggacaatttcaattttaaattaaagaccgcgttaattagggggttgatccactaattaattaattcactaattgacttattcgctcttttgctgaacagccgccccagcagaagcagcctcaagaaaagccggggccgcaacaggacgacacggagacggaggaggacagcaaagaagacaagcggaagccgataaagtgtcaggaggagaggaaatg

SEQ ID NO: 106855 - DNA, 94 bp, Heterodera glycines; identical to SEQ ID NO: 97954
  Promoter: Source sequence=SeqID_41815; Location=809..902; Strand=+; Gene=SeqID_69852

SEQ ID NO: 106856 - DNA, 1003 bp, Heterodera glycines
  Promoter: Source sequence=SeqID_19838; Location=412..1414; Strand=+; Gene=SeqID_84592
cttccaaatagcattgaaattttttctctaaatttccttataatatttaaataaataaatattttcccgcgattttttttgtatattttatttttgccaaaaaattcttcacttttttttttgcccaactcatcatgagatgatacaccacatcccgaacaaaacttgtacattttttgttgtgcatgtatgtatgtgttttgttgttttcttgctgctgccaatcatccacatggttaccacccatttggccacaaccatctgcccaaaccccgaaattcccccgaggggattttcgctttcggcggcaaaccattcctttggcaaaagccccccaccctccttccatttagtccccaaaaatcgggaagaagatgaagccttggctgggggggggagtggagaagtcgaaaaaggccccacgggtttgccgatgggatgaataattcagtgtccccatcccttggcccctcaacaagtacttcaaaatgtttatatgctttgcacagttgaggagcgtataatatgtcactgtaatttgaactaatatttttttgatataattaattaggctttttgaatgttaattaatgttggaaatatttaaataaatatttttaagtttttatttaaatattaagttaaatagtttaatttttcaacattaaattaggcttttttaagtatgtaaataaagtataaaatatttttgagttttcaaaattcattaaataattttatttttcaacattattatgcttttccaatattaattaatgctatgaataatcaaataaatatttttgaattttcattaaatattcgttatttgatccttaaaaattaaaggataatctataagtaaatttacaatatttttaataaaattttattctggtaaaaattaaatttttatcaatataattaatagtaaaattttttaaataaataaaaattcttaaattgaaaaaatattccattttaaattatagcacatgacatg

SEQ ID NO: 106857 - DNA, 868 bp, Heterodera glycines
  Promoter: Source sequence=SeqID_10558; Location=1259..2126; Strand=-; Gene=SeqID_73793
tttttgtgtgcctttatatacaggtttcaagagtaattaatcccaaatctcttgggttgacaatggcaattcatccgatttttccatgcagcaaaaataattttatatataaatgaaataatgaaatttgggtgggcagcagaaaccggtcgatgtaaagcgcacactgatcagtcagatgatcagtcaaggcatattataggggagggaccaaccaaccccgccgatgcctccgactattgaatccccaacaattttaaaggcacgaattccgtcgattttttggcatcctttggcataagtattgtttggtcttgctaagggtttcttctcagattaattaatttggcaattatgctctgttccccctagttttcgccaatttttcgtccacctaatgatttgtcccaacgaatcggagttggacactgccaatggcgagcagtacaaaaattcagcggaaatgaatggccacgattttatgccctcgggcaatgcctaaacggagggaaaagccgacaaaagacaacagcagcaaagaaaactgtacaaagcggacgaaaacccaccatttctgcagacctttttgtttggctttcaggtaaaacaaatgcaagcattgattgatcagtccaataaatcaatgtgcatatcacaatcatttcataccgtaccccaccataccctaaccaatgaaagttgttaatttccgctttaccaagtgatggtgtccctgtccatgctcgtctccatcccgtttttaatccccaaaattcccgccttttttctccgatgactcgaagaaggcgcaacactttaataaaataaaaataatttaattgttgttcagatacaaggcactctaatg

SEQ ID NO: 106858 - DNA, 62 bp, Heterodera glycines
  Promoter: Source sequence=SeqID_20504; Location=1195..1256; Strand=-; Gene=SeqID_51042
gggaaattttcaaaattttccccatttttcagaattttttgaaatcaatacacttaactatg

SEQ ID NO: 106859 - DNA, 224 bp, Heterodera glycines
  Promoter: Source sequence=SeqID_6397; Location=3216..3439; Strand=-; Gene=SeqID_61398
ataatcatttattttttgtttactaaaataaatatgcaaattatttaatgaaagaaattcgctcaaaaatattatcactcttttccaccaaaaaatgatgacattatttgagtaatattttcataaaatatgtaataaaaaataattttttatttgcttgaaaaaatataaaaatattttaaagaattatattctcctaaatgaatgaaattagatcaaaaatg

SEQ ID NO: 106860 - DNA, 142 bp, Heterodera glycines
  Promoter: Source sequence=SeqID_6032; Location=2678..2819; Strand=-; Gene=SeqID_60075
ttttgggggagagaggggaggaaaatgccaaaaggggagagaggaaaaagtcaagaagaagcagctaaaggggataaaagggagaggaaaagcaggaggcaaaaaatagacatacagacaaaacacacaaaatgccgaaatg

SEQ ID NO: 106861 - DNA, 59 bp, Heterodera glycines
  Promoter: Source sequence=SeqID_2811; Location=2063..2121; Strand=-; Gene=SeqID_81739
ttttaataaacctaaaacaaagaagacataaattatcaattaaaaaaatttagattatg

SEQ ID NO: 106862 - DNA, 844 bp, Heterodera glycines
  Promoter: Source sequence=SeqID_24892; Location=900..1743; Strand=-; Gene=SeqID_55639
tccgtgccatccctggtccgtggtattttagccgtccaaataactaagaggaaacctatttttttgtccgctatgcagtaatcttttttaataaaatttcgttgttaaacataaagtatcatgacaattcatacacaggcaattcgaaaaattactgaatataatgcagtttacgcgtccaatcgacttttacgcgtccaatcaatgaccatcctcagtttcttaagccaaaacttttttcttacttggtcaatccatacatccttggtatcaattgaaagcttaaagtctcgggaatttataaatacaagaaaagagcaaatatttgcattacgaaaaatttcaatgaaaaaaacctgaaattcatcatttttcgcgtatattcaacaataactttttatctgttgcctttatcccagaatttttctatataaaaaaatctgtggactttagctctcgattgatacaaataatataagttttgagcaagaaagaaaaaaagttatgacttaagaaaccgaggatagtcattgattggacgcgtaaactgcattagaaccaaaatttcttcctccataaaattccaaaaaattaatatttaacaaaaaagagatgatattatggtcagcgaggaatatttgcagataaacagcagccagcagaacatgttccttccgtcggtgtttccgttccgaattcggcgccccccgcaaaaacgtcggcactgagtctgaccaatggcgccggaattgtccaatccgccaatgtccttccgtcctcccttctcaaaagggacgcggcaccgaccgtttccgccggtgttcgtcgtgccatgtccacgatg

SEQ ID NO: 106863 - DNA, 383 bp, Heterodera glycines
  Promoter: Source sequence=SeqID_1484; Location=1460..1842; Strand=-; Gene=SeqID_73831
tccggcactgaaattcatatttactggcataatcttaagtgttatccaaactaagggactttattgatcagttggtatttgtcttttcagcggaagtaatagtctggtcattgtctaaatgatcagcaggaaattccgatcattcccaatttgttgatcaagtaaaaatagtctgatcatggccatttgcccgatcattaaatccttccctcgccgtaattgggacagtttttccccttccctctctcttacacttggagcactgctgtttcatttcgtcattctccacacaaatttccctttcctcgtcgcatttgatctcgcacaaatccaacaccggcacccattgagcatccgaaaaaggactcccacctttgaaaatg

SEQ ID NO: 106864 - DNA, 508 bp, Heterodera glycines
  Promoter: Source sequence=SeqID_20041; Location=1033..1540; Strand=-; Gene=SeqID_84815
cgaaatgacggaaaacgaacggacaaatgttcatttcatttcatttgagaatggaccgagtgggcgggctggaaaggctgacaagcatgaacaaaataaaatgtccgatttcaaacggttggcccatccattctgatgatgttcagtgcatagaaggctgatgagactcattctctgctcgctctttaagaaaacgctttgggcaatggcaaaaggaaaggacaaatcatccgaaccctcgggggacagagtgacccattggcaacgcgtaacccgcgacaaaacaccttacccaagacaattgcatttgtcgtgccatttattcaaaatggacaaatgatcaactcactttcccactttttttccacttttagtctccttatcctcgaaaattcctttctggactaaactctgccccttctccaaacaacagccggaacagcagcagtcttcccccgtcgcagaagacacaattccgccccagcaacaaaaagaaggtgccgcaatg

SEQ ID NO: 106865 - DNA, 255 bp, Heterodera glycines
  Promoter: Source sequence=SeqID_28078; Location=1..255; Strand=+; Gene=SeqID_58736
tttttacagcttaactaggccctattaagcttatttccagataatcccgcatgaattctcatttttaaattttttatagatttttaaatatttggattttttttggcttaccaaaacttcatcgaacctggttctttctattctctttcaaatcgccccaaattttttttacagcttaactaggccctattaagcttatttccagaaaatctcgcatgaattctcatttttaaattttttatagatttttaaatg

SEQ ID NO: 106866 - DNA, 77 bp, Heterodera glycines
  misc_feature (12)..(12): n is a, c, g, or t
  Promoter: Source sequence=SeqID_8383; Location=1..77; Strand=+; Gene =SeqID_67875
ggattgtccttntaaaattaaattgtaaataaatttcgtaactttccctgccaaatttcagggactcgacacgcatg

SEQ ID NO: 106867 - DNA, 229 bp, Heterodera glycines
  Promoter: Source sequence=SeqID_4567; Location=5744..5972; Strand=+; Gene=SeqID_54919
ttttcgaggaatattttttgtgtgttaagatgaaaatgagaaggaaaagtgtgggggtactgtatgtgacgtgacggagagggcggggggtgtcacgtgggaataggccactcccactcaactgagagcacgcagggacctccagacgggaggatttcgaaatccatccacagtatgccctcctatgccacgccccttatcattcacttccctgtcagtcatttagatg

SEQ ID NO: 106868 - DNA, 214 bp, Heterodera glycines
  misc_feature (105)..(105): n is a, c, g, or t
  Promoter: Source sequence=SeqID_39651; Location=1079..1292; Strand=-; Gene=SeqID_68162
tttttttgtcttttgaaataaatgtgaaaaaatatacgaaaattattttcggttttaattatgctgtacaatgcttttaagccccgccgtgcggcggctcccctnttgtgcactattttagtttttaaaattggttccggactttttggctttttgaaataaattgtgaaaaatatacgaaaattattttagcttttaattatgcagtacaatg

SEQ ID NO: 106869 - DNA, 346 bp, Heterodera glycines
  Promoter: Source sequence=SeqID_41095; Location=703..1048; Strand=-; Gene=SeqID_69291
taagtagtgcctcccgacaccggggagcaagaatattgctatcttgcctaggcgggattctgacttagaggcgttcagtcataatccctcagatggtagcttcgcaccattggtctatcgaccaagcacatgaaccaaatgtctgaacctgcggttcctctcgtactaagcaggattactatcatagcaacaggtctttagtagggtaaaactaacctgtctcacgacggtctaaacccagctcacgttctccgcctgcaaatgccccattcgccactgaacagaaggacagcaaaccccagtctggaggctagcagcccaacgtacagcaacaaacgggtgaatg

SEQ ID NO: 106870 - DNA, 80 bp, Heterodera glycines
  Promoter: Source sequence=SeqID_20677; Location=148..227; Strand=+; Gene=SeqID_51238
ggtagcgatgcttctgtcgtgactgattttttaaaataatttccctttttcattttcagaacacggaagagccgcaaatg

SEQ ID NO: 106871 - DNA, 410 bp, Heterodera glycines
  Promoter: Source sequence=SeqID_2643; Location=1..410; Strand=+; Gene= SeqID_80863
tggttcggttttatacttttttgggagctggtgtcttcctttttgaattttccaatataatctgtatattttttcatcataattaaaatgaatataaacattttttcgttaattcttatgttcagataattttttagtttttatattatctttttaaaaataattaagtcatttatttaatgaatagaaattaaaaagattttactaattatattattttaagcggagaactgttttaacaagtaaaaataaaaattttaattttcattcaaagatcttaaattttccgggagagtgttactacaaaataaagtatgacataaccataaaataaatttaacgaaaaatctttggctaaactatttaagaattttcaatttttttttattaggaatttgtgcatacatatg

SEQ ID NO: 106872 - DNA, 53 bp, Heterodera glycines
  Promoter: Source sequence=SeqID_30732; Location=515..567; Strand=-; Gene=SeqID_61136
atcaaaaaattgttgctttttttgaaatattaagcgaaattttttggaaaatg

SEQ ID NO: 106873 - DNA, 844 bp, Heterodera glycines
  Promoter: Source sequence=SeqID_9826; Location=1..844; Strand=+; Gene= SeqID_72839
cataaatggacatttgttataacttaataaagcttgacaaatggtctatctccatttcttgcacactaaataaaatttaatctttatccacacagatgccctcgaatgcatgaaaataaggaatattataagctgtcaccggataaaaaatgattcaaaatgttgcaagaaaagaattttcaactccccaaatttactgttcaatttcgaaataatgaactgtgtacttttactaagatgtgtttatttgaaaaaggttggcctatcaaaaggctctctgaataaaggctcacagaattcagctccaattattttgccgatattagaattttgtacggttaaaataaagattaaaataatgtattagcatttggttttcaaatataaaaagaaaacataaatgacatttgttataacttaataaagcttgacaaaaggtctatctccatttcttgcacactaaataaaatttaatctttatccacccagatgccctcgaatgcatgaaaataaggaatattataagctgtcaccggataaaaaatgattcaaaatgttgcaagaaaagaattttcaactccccaaatttactgttcaatttcgaaataatgaactgtgtacttctactaagatgtgttggcgctagtgtaaaagttggcctttttgaaaattttttaaaaaagtcatgaaaatacatttccgggggttttcggggccgctgatcacgaatatgacattcatttcgaccaatttcgaaccccggacccggattcgaacaaaaagtcgaaaatcgtaaattttcactttttataaatgataattttttaaatccttttagcaaatg

SEQ ID NO: 106874 - DNA, 506 bp, Heterodera glycines
  Promoter: Source sequence=SeqID_36920; Location=1..506; Strand=+; Gene=SeqID_66114
gggtgggcaatggcgattctcatcgagcaaatcgaaacttgaaacgaaactgcataaaattatcaaaacgaaactcggaacccaaaaaggcctgaaattctcgaaactttcgaacgctcgaacacatttttattattattttttttaattttggaattaatttattttgatttctttttattccattaaaaaatatcaaaaatttgatttttaatatcggatttaaattagggtaggagccagaaagaaggggcgggggaggagggggcgaatcgcgctcaaaccggggaacggggatgaaatattctatcttataaaagaaatattttattataaattttactcctctttatattttcatttactaattaattgtgatgcgccattttatttttattttttttgcattaaaaattttcaaataaaaatcttttcattgaattaagctgtcgattggagctgtaagtgttcagcttcgcttcgaattctttctcgatcgcaaaatg

SEQ ID NO: 106875 - DNA, 193 bp, Heterodera glycines
  Promoter: Source sequence=SeqID_12141; Location=2349..2541; Strand=+; Gene=SeqID_75714
attattaaaatagccatgctttcgacaaacgccaaaaattgcgttgttccattaagcccaatcgtacgatgggcgacagcagcaacaaaattcgatggctgttgacccgagtaattaggcgctcattaattggccaattagcttgttcattagtattaaatgctcagtcaattaagatgaatatgtgataatg

SEQ ID NO: 106876 - DNA, 453 bp, Heterodera glycines
  Promoter: Source sequence=SeqID_14524; Location=1..453; Strand=+; Gene=SeqID_78576
taacgcccattttgatgttttttgactaacgctccatcactaacctgctgcacaatttaaccattcatctttaagggcaccaccgatttagtttagataaattttcagcttttgtccatggcctataaactaataataactatgtataaacgataaaattggaatatatgaatattccaaaagtcaccaatcgtacaaaattgagctcgatagcataactttttactgaacaaaaaattaaaaaaaaaattccagtggactgaaatttttttctaaaacctatgtatgacaaatactcactaaaattagcaagtaaattaggttagattctgttcagggaaggtttgaaaaaattcaaattgaaaaatgttcattttggcaacttgttttctgctgtgcatttggaattttgttttctaaaagcgattgtttgtctatttcagtggggtaatg

SEQ ID NO: 106877 - DNA, 896 bp, Heterodera glycines
  Promoter: Source sequence=SeqID_19573; Location=1181..2076; Strand=+; Gene=SeqID_84313
ttgttatagtatccgctaccatacccgtagcccgccgattgctgtggggctcttatgtgaatgtgcacccgaacccgctgctgatggtgtcgatggtggtattgctgttgaaaatgggtggtcagcttctttcagaaataattctcgatgtttacttgtccgttttcatatccgccatatccgtaccgttttggccgcgaatgatttgccaaagaaacgactgatggggccaaataatgagacggaactgcaacaattgaggagcaaaggacaaagaggaagagaaaagtgaaaagaaaattcattggcaatttttgagaattattttgggaaaattgcggacgattcattctttttataggcacacaaagtcaagtggaggacgaacgtcagcaacaaaattaaaaggggccaataaggccgaaaaggaaacatttgacgaacagaggcacaattgttgtgtttttgagtaactcttcacatgcgatgacaaatttatttttattttgaaatatttttaattataataaatttaatttttaattctaaacttaagagttatgaataaaaatacctaatgtcttaaaatacggtcaaggtcagacggtaggggtcaactccgtgtggccaactccgtctcagcaatgttcaaaaagctataacttttttctttgttggccaaacttcacaatcatggtatcattcgaaagccctagatgtttagaagatatttataagctatttctcagtgattaatcagctctcaaaaaagttgtcagttgaaaaccgcaaaaaaggcagaattttcgaagttttttatttctatctttttttatagttcgaaattttctgtaatttttagtaggctaatagagcctgtgaagagctttcgaatg

SEQ ID NO: 106878 - DNA, 107 bp, Heterodera glycines
  Promoter: Source sequence=SeqID_4586; Location=2651..2757; Strand=-; Gene=SeqID_54992
ttaagatttcaaaccaatttggattttttttaatggagaataatcgtctgcaaaaaacaattaacaaattaacaccaattaagcgtctaaaaatcggcgaaacaatg

SEQ ID NO: 106879 - DNA, 1003 bp, Heterodera glycines
  Promoter: Source sequence=SeqID_25626; Location=144..1146; Strand=-; Gene=SeqID_56378
atgattatataaatccattttattaattgcttttattctcattgatttaataaaacggcaaactactcaaatttatataaatgatgaatttgtaaattttctctttatttgttcccaatttttgtgcaatttttctttcaatttttgtccattcttttctcgagtatttctttcccattttcttaatttattttttattttatgaaatttttccacaatttctctcttttgtctgtcatttaaaatctgattcttttgatcacaaatttgtccaacattttctctcaattgtttcaatcccctaaggtatattaaatgagagcaagccccgccccctcaattaaattggcatttggcgttttgacttaatatgaaaaaaagaagagaaaaagaaaagaaatagcatatacaaagaaaaaagggaagaccagacagttgcttacttatgtgtgatgaaagcgtaggagcgggagggaataagaagtgagagataggaaaaataagagagagtgcgagggatgagaggaggagacaaagggaagaacgagaaaagaagggagagtgggggggggtggatgagagagagagaatggggaaagagaacggagaagggagaaagagtgagagagagagagaggagtgggtgagagggaagagaaaaggcgagataatgggagaaaagagagaatcaaaagagttgagatgataaaaaaaagcagagagagtcggtaggggtcaactccgtctcagcaatgttcaaaaagctataacttttttctttgttggccaaacttcacaatcatggtatcgttcgaaagccctagatgtttagaagatatttataagctatttctcagtgattaatcagctctcaaaaaaattgtcagtttaaaaccgcaaaaaaggcagaattttcaaagttttttatttctatcttttttatagttcgaaattttctgtaatttttagtaggctaatagagcctgtgaagagctttcgaatg

SEQ ID NO: 106880 - DNA, 687 bp, Heterodera glycines
  Promoter: Source sequence=SeqID_21179; Location=733..1419; Strand=+; Gene=SeqID_51766
atttaaattgtaaatgtttgcgatttaacacgctaattatagcacttttgataaaatatgatttggagcaatttttggaaaaatcccagaaaaatgaaaaatttagcatgtagccaaaataaaaaatagaaaattacatttccaaaaattcggctaatccatgttagcatgcactgactaccatccgcgatgttgggaatgggccgaggaaggcgaatgccgcaacaatgcatggatgtcggagaattgtaaacaaagctgtggcacatgtgtcagccaatatgaactcaaacaggtactgtattatttactacgtgttttaccgtaaaaattaccgtaatgttgtatacaccaaattttaatcggttcaatttttaccctccatttttcacaaattctctttagaaattgttggaaaatttcttatgaaaatttaataaaataaataattggtaaggtatcaaaacttcacattttctttaagctcaagacaactacaaaaaataagcttcaaaataaaaatttcgaaaaaaatcaatttgtttgtctttgatttaaaatttgataacccattaaaaaatagaaaaatagaatgaagctaaaccaaaatggcgcaaattaaatcgaaattaaaaaaaaaatcaaaaaattttaaaaataatccctgttttctttttttttaagatg

SEQ ID NO: 106881 - DNA, 127 bp, Heterodera glycines
  Promoter: Source sequence=SeqID_18528; Location=1716..1842; Strand=-; Gene=SeqID_83154
tgtcagctccaacgtttggtgcaccaaattcaaaatcaccgcggccgaaggcaatggccaattgccggctacactcgcccaagtgttctacaaaacttccgttttgcacctccaacctcggcaaatg

SEQ ID NO: 106882 - DNA, 763 bp, Heterodera glycines
  Promoter: Source sequence=SeqID_5132; Location=1253..2015; Strand=-; Gene=SeqID_57028
tttttccagaaaacctttattataatggcctccatcagttaaattggcctttttgaatttccgaaaaggttattttttaacaaaatttttcgaaaatattgattaaatttgaactttgataaaattggttaatttacgccaaaaataagctaaaatgcgaaaatttcgcttttcgggttggtttttcgctaaaagtgagcaaattttagcggcacatattttgcgattttatatccatatttttccgagccctagttattaaatgtaaattggattgattaacaaaagtattaaaatgatagtaattattaaacatttcactcatataattagcatttttatgcaaaaaaaaaaccaaaaatatttttcgtattttgagactgacatttatcccgataaattcattcaatacaatttcactaataaaaaaggataaaagtctttaaaaaggccctaaacttcaaattttcccttccgaaataattattttattttggcgccagaaaaatttttgtgcatttataaatcatttttaacagcagatgtttagcaaaatgatcaatgttgtacaattttttggggctattaaaaccagggctcggatctgtccttatttataagatttgtccttatttggagggtccaaatcttacaaaataaaaatgtccttatttgtaagatttgtcctcatttcgggctattgttcttattttgttcttatttcttaaatatattcaaaattttgaaattttatagcagaatg

SEQ ID NO: 106883 - DNA, 1003 bp, Heterodera glycines
  Promoter: Source sequence=SeqID_22493; Location=1568..2570; Strand=-; Gene=SeqID_53164
tatttttaacgaattatccattccacttttaactatttctattctgctggactatataattctttacaactgtaagaattgatgaaataaaagattaagggctttatatttaatttttcaattttcaagtaaagatattttaattgggtcattaaggatgaaaacagcgtaattgaatattatttattttatttaacactcatcaacaaaaaatgaaaattatattgccaaaatgctaaagaaaaagaagtctgaaaaaagaatatgaattcaaatttggcactttccgttctaatgtattgttttcaattttcgtttaattttgtttataatttttttttactttgctcaaaattgaataaagcacaataacttttccaacttttcaaattttcttatttttattttaaaataattcctttattaaatttcaatttattcaatttgagtgtgcacttttctgttttttgactcagcacgctttcttttagcttataattatggatagaattttttaattttatctgtttagcttttattacccgagtgatcattcaaaaagtcaattaaatttaattaaaacgaccaaactaatgatggcgtctgagcccaataatgagaagcaaacaaatttaattgatgaaaatttctattggccaaattaacattagaaattggccaaatgataaatagttcagctaaacaaattttgttcaaattttttggttttccgtcaactcgaaacaaaagtttagtttagtcaactgtcaagtgcataaaaattttttaacataaattttaaataattttaatcgatataaattggcataattgaatgtctggctaaaaagaaagttcagctaaacaaattttttgttcaaattttaacaaactttggttctcctaagcgcaacaaaatttttgtttaaaagcgattaacttttttgaaattccacaataaaaacatcaattaataaattgaataaaaattaattaatcaatg

SEQ ID NO: 106884 - DNA, 237 bp, Heterodera glycines
  Promoter: Source sequence=SeqID_19081; Location=1659..1895; Strand=-; Gene=SeqID_83825
tgtttttgacaaaaaatcaaataatttgggattcactaatttcgtttcgtttgcggtaagtgccaattcaaacaaatattttaatttgacattcgtggaccagccaatattgaagttcatttatttatttgcctggtgtaaagaaatcataacaaaataaattaatttctaaaacataaccaattgaccacgcataaacaaaaattaaattagatgatttaaattaaggaattgatg

SEQ ID NO: 106885 - DNA, 274 bp, Heterodera glycines
  Promoter: Source sequence=SeqID_37646; Location=1182..1455; Strand=-; Gene=SeqID_66664
ttggttaagcttttcgtaatttatttgctctaaaaactactaaaataaagtaagcataaatctcagtcaatttgaaaaacttttttaataaaaatttttaaggtatatgtcggttatacgggcacagaatctgactctgtcaataccgcctttttgccggtcgataaatgtatagccattaaaatttacaaaaacgaaaaatatcccaaaaaaggttatgaaaatgcaattaaaattttgaatcgactaaaggtggatgaaatgaacagacatg

SEQ ID NO: 106886 - DNA, 417 bp, Heterodera glycines
  misc_feature (9)..(9): n is a, c, g, or t
  misc_feature (30)..(30): n is a, c, g, or t
  Promoter: Source sequence=SeqID_14697; Location=1..417; Strand=+; Gene=SeqID_78812
ttttaattntaaaattattgaaatcccacnccaaaatcttaaaaatttgtacattttaacaatgaaagaggctttaaaaaacgccgagtttggcacgttatgtggcaaaattttttgtttttatcggaataattgccgaaaaaatgctcaacattcaacctcctataaaattttctaggtttttattaggaaaaaaacttcgtttcgcattttttaaaaatctgacattgcaatgttttttcaagggggaatcgattatgtttgaaagtagcaaaatcttcaaaatttggtgcattttagcaattggaataggttttagaaatgttatttctcttaattaggtatacactattttttaaaattcctcccccattctctcaaggcctcgagttttgctgtacggagcagttctacatg

SEQ ID NO: 106887 - DNA, 354 bp, Heterodera glycines
  Promoter: Source sequence=SeqID_14432; Location=1..354; Strand=+; Gene=SeqID_78472
ccccccccccccccccccccttgtcccacaaaatttttggaaaaagcgcgccacaaaaaaagcgtttttaaagcagaaaaaagtcgtcgtaaatgaagaaaatgataagtgaaaacaaaaaaatgttggaaaaaatccattccggtgaaaaatacaagccatttgaataaatattaaccattttgcattgcatataataaaaattttaaatgtccttgaatttcatgaattttccccactatgtccttgcaaatcggcatacccgtccttggaaacggagcatggacgatggcaaccctggttttaatgctttggatgatcatttgttttgtttcagaatatccaaattaaatg

SEQ ID NO: 106888 - DNA, 149 bp, Heterodera glycines
  Promoter: Source sequence=SeqID_10404; Location=2395..2543; Strand=+; Gene=SeqID_46865
aagggttcttctgcttaccactcattaattgttatctcattgataaattgttttgtttgaaaacctttttcataaataatcgtcgattacgattgaatgcttctcatttattgattgtttttaccgctcattccttttttcaaagcatg

SEQ ID NO: 106889 - DNA, 119 bp, Heterodera glycines
  Promoter: Source sequence=SeqID_2735; Location=3820..3938; Strand=+; Gene=SeqID_81348
tttgtttaatagttaagagattattattattattatttctgtaaagctttattgtgtatatataatattttttaaacatggataatataagataaaccgttttgcaaaaaaaaaaaatg

SEQ ID NO: 106890 - DNA, 381 bp, Heterodera glycines
  misc_feature (52)..(52): n is a, c, g, or t
  misc_feature (64)..(64): n is a, c, g, or t
  Promoter: Source sequence=SeqID_4926; Location=1..381; Strand=+; Gene= SeqID_56228
ctacccatcggacgattacattcagccaaatgccatttaccgtaacaactgnagatcgacaagnaattgaccgacatcccctggtctccttcgtcaaatggattctatacaatttgccaaaacaatacgacaccattgcatacattttggaggacgatttgacatggttttggttttccgagaattattcatggaagggctaaatccgtcaatgatcaaaaacggcaacagattactcgaaatgaaagtaataaaaatatttttaataatatttatttttataattttttggtaaaaagtcggaagaaattaaatccaaatatatcattccgagattcttggaatttggttcctggtccattagcctcactggtcccaatg

SEQ ID NO: 106891 - DNA, 87 bp, Heterodera glycines
  Promoter: Source sequence=SeqID_10880; Location=329..415; Strand=-; Gene=SeqID_74162
gctaaagattttcggctttttgctttaaggtacgacggatgtgtcggaaagacgcgcaacattttcgaggggctcaaacaatgcatg

SEQ ID NO: 106892 - DNA, 951 bp, Heterodera glycines
  Promoter: Source sequence=SeqID_63; Location=1724..2674; Strand=-; Gene=SeqID_59394
ttagtggggtccggctggcacttttgccgtaatggaccgaccgctaatggactggtccattagtggggcccgggctggcacttttgccgtaatggaccgaccgctaatggactggttcattagtggggccctggctggcactttgccgttaatggaccgaccgctaatggactggtccattagtggggtccggttggtacttttgccgttaatggactggtccattaatggagtccggtctggctaatggacagacagaccggtatgtccattagtctggtctaattaattgacctgtcgattagtctccggtctggctaatggagaggcccgttcaacgtcggcactttgtgccagttaataaccctctcaattagcagctcaatttttaatttcttccataattttcccttaatggaactgacggtatttcataaaagcaccccccccccccccacctgacccagacagagtcaattagctggctttttttaggtgatggatgaggggctttataagcgccagtttttatgaccataagtaatgatgatgaagcatcgctcgaaatcctttcccccaccctctcgtaaggcacgctcgaaaaggagtttgtccgaaagcggtaggccgggtaccgcttccaacatttgtatgtggcaggacccggcctaccgcttttttgccagattacacgatttgaaaggcggacggcgtttagttagcacgccaaacccggccatctttcaaagagcgcctcccctaagtatgtttgtttttttttttttgaaagtctactgtcgaattttttttgttatttaaacttttttagactttttcccagactttttccattttggcatttttttagcaataaacatgtccgcaaaccgagagcagctgactgaaaatttaaaaaaaatcatcgcactccacaaactccagcaagacatg

SEQ ID NO: 106893 - DNA, 150 bp, Heterodera glycines
  Promoter: Source sequence=SeqID_34855; Location=928..1077; Strand=+; Gene=SeqID_64556
aatgatcttatttattttgaaacaatgttgttctttgaaataatttttgttaagtgataaatattttttttttagttactcaaaataattttgtttgaattcaattaaatactttaaattgaaaatttttgtaaatatatttttagaatg

SEQ ID NO: 106894 - DNA, 902 bp, Heterodera glycines
  Promoter: Source sequence=SeqID_20722; Location=2237..3138; Strand=-; Gene=SeqID_51284
agtatgctaaatgagttattgtttgggaggtggggtctttttgggagtttctttaagtgcaatcgcatcggaagaatgaacggagattgtgatcaatgactactgaccacggtcatcggacgggtgggctaagcaaagagagagacgaaattaagcaattaattaggcggcgcttattaaaatttaatttttaatttaggcttcagaaagttcgaagtattcgggccaaataatttgggatgaaacagatgtttgtttttcctgtaaaatgaagtcaaaactgattaaacagaattgaaattcggtggaagaatggaaaaaagatcttatcaaagaaaaagaattcgaatcggaggataaaacaacgaacggagaaaaagagggggagagagaggaggaggaggagggaggggatggcataagtaaaacgaacgaactcagagggaaaagggcgggcaaatattgagataaatcacttaattaatgcaagcagaggaattggggcattcgcaattagaaaagggcgatgccgggcattgcgcaaaaaatgaaattgatgagcgaagaacgaacgaaacgaacggcggaagggcaaagggaggaaaagggggggggagaaaggaaggcaccgggggaacgaaggaagggaaagaaggggagagatggcacggcacgggaggggggagaccatccattgaatgaatgccgtggcagggcgaaagggaattgccatttcgaaaccaaaaggatggagcgcaaaatattttttcgtaataattcaaagttggaaggagatgtacagtctgtgaaagtccctttctcctacggaattggccaagcggaggagtggggaaggagggggggggaaagcaggtcgggagccatttcaaagagcatttatg

SEQ ID NO: 106895 - DNA, 73 bp, Heterodera glycines
  Promoter: Source sequence=SeqID_30881; Location=1521..1593; Strand=-; Gene=SeqID_61264
ccaaaaggcacacgacattggaacactggccaagtctgaagaagtcaaatcgatttcggtgccaccagcgatg

SEQ ID NO: 106896 - DNA, 57 bp, Heterodera glycines
  Promoter: Source sequence=SeqID_4369; Location=924..980; Strand=-; Gene=SeqID_54194
ggtgcattcattttgtatttcttaacaaatttttccatatttaggcatttgccaatg

SEQ ID NO: 106897 - DNA, 122 bp, Heterodera glycines
  misc_feature (90)..(90): n is a, c, g, or t
  Promoter: Source sequence=SeqID_30184; Location=1011..1132; Strand=-; Gene=SeqID_60621
aaaaaataaattttgatcttttgttcaaaaagtattaagatttcattgaaacgagaagatatttcggtatttttagcgttgttattgtcncagcgttcgtcgcattttcaaattcggcaatg

SEQ ID NO: 106898 - DNA, 425 bp, Heterodera glycines
  Promoter: Source sequence=SeqID_42443; Location=345..769; Strand=-; Gene=SeqID_70336
tttttccattaccgcaagagctgcggaaattgtgaattaattctcagaaaaatggctatctctttttaggacaattttctatctcgtaaccccgatgctaatccgttccgcagagcctcttcaaaattttttccattaccgcaagagctgcggaaattgtgaattaattctcagaaaaatggccatctctttttaggacaattttctatctcgtaaccccgatgctaatacgttccgcagagcctcttcaaaattttttccattaccgcaagagctgcggaaattgtgaattaattctcagaaaaatggctatctctttttaggacaattctctatatcgaagcgagaatagtaatcggttgagtagcccctccacccgtccatttcagtcccacaaactctctcttttttcagctcttcaaatg

SEQ ID NO: 106899 - DNA, 182 bp, Heterodera glycines
  Promoter: Source sequence=SeqID_5673; Location=986..1167; Strand=+; Gene=SeqID_58874
atcgtgttggtttatgggactgcatttactcagtttattaaactcattatttatgagcaaatatatttttgtcactaatttgtctaacttacctattttgagttttttccccatatatctatatttttttctgtggtcttttattcatttaaatttcgtcggacttatttgttaggaaaatg

SEQ ID NO: 106900 - DNA, 697 bp, Heterodera glycines
  Promoter: Source sequence=SeqID_27212; Location=1..697; Strand=+; Gene=SeqID_57900
ataaatatatgaatttggctgagtttcctaatgcattcattaatgacaatcgtccaattatgccattacaaaagcaactcttatttaaaccaaaaacatttgttaaaaatttaaatttttaattaatttattacaaaataatattgaagtacgaccaaaatgtaataattcatgatttacaaaaaaaacttataatattatttattaaattttcatttgtattatttttaaaattttttatatttttataattatttttcaattattaaagtgactctgaggttgtagacattacatcgctttcattctatcatttttagtttattgtttaaattttttgttttaaaaaagaaaatacatatgttggtcatgaaaaagacttaattttttatcttttttggattatatttttattaaactttttatcattaaatgattaacatagtgtaataataataataatattaattaaatcattgcttactaattctgtgtgaatttcaatattttatatatttataattgttgtgaatttcttataaaatttaaatttttttaattaaattattacaaaataattgcgaacataaaatttattttattttcaaaaattaaatacggcctttattccttgatgaattgaaacaaaaaggcgcgaactgagaaaaaaagcatatttctattctatcattacatg

SEQ ID NO: 106901 - DNA, 145 bp, Heterodera glycines
  Promoter: Source sequence=SeqID_1913; Location=1..145; Strand=+; Gene= SeqID_76754
tatcttttgactaatctaaagatataaaaaagcataacaattaaattaagtttttcaatatttacacatcaaaattttagatacaaaaaattggcgtcctattctcgtttaaaacaaaaaagttttttaaatttttttatagatg

SEQ ID NO: 106902 - DNA, 505 bp, Heterodera glycines
  Promoter: Source sequence=SeqID_3271; Location=3107..3611; Strand=-; Gene=SeqID_84002
acataaaaaacatattgaaaatcttttcaggcgtttttagcaaaattaaaatttttaaaatataataaattcacagctaacaatttcactaggttctacttcaaattttagcacccagaaaaaatggaaccgttggttgaattgattcaacatttcggttgtcgttatgcgcttttcggggcctataactcggctagggttacagattgaccctcctttttataattaaaagaaaataaaaattacataaaagagtttataattatgcaatttgaagagggagggcgggcatacaaatgaaaagttgaagacaatttaggaaaatatgaagaaagagaagaattgtttcatatttctaatattttaaaaatttgagcggattatgtacatattttcccaaatatttttaaacttgtcaggatcagtcagctgggggcaagcttttcgaaaatttaataaagaaaaagtaagaaggtttaattacccaagtttgagattaaatatg

SEQ ID NO: 106903 - DNA, 96 bp, Heterodera glycines
  Promoter: Source sequence=SeqID_16432; Location=1..96; Strand=+; Gene= SeqID_80842
gaaattgccaattatttcatttaggacaaggcaaagcgacaacgggagactcagcagatagaaccgggaaatcagaattgggaattcctcgccatg

SEQ ID NO: 106904 - DNA, 377 bp, Heterodera glycines
  Promoter: Source sequence=SeqID_13475; Location=1..377; Strand=+; Gene=SeqID_77366
tggtcctttggcggctaacaatgaaagaaaaacgacaccgcctcccccccccccaatttgacaatgtccgtccgtcgtggtcattccgctggctgatgcttttcctccgctgctgctcctttgacattatttaaattctcgtcactttctgtttagtcgccttccggcgtttctcgagaaagttaactttttggctggcgctgtaagattcgaccaaattgaacttgtttttggaattttatcattcgatgatccaaaatttgctgggggttttaaattggcaagcccaacaatttcagtcgcgatttaaaataaaattcagaaatagtcctactgtacaatttacccttccctccctccctcaaatgccaaaaatg

SEQ ID NO: 106905 - DNA, 103 bp, Heterodera glycines
  Promoter: Source sequence=SeqID_921; Location=2666..2768; Strand=-; Gene=SeqID_64065
tctaaatgagatacgctaatttagataatagatgaatagtttatgaatgcatgatcctatgaaagcacatggcatgaatgaataaatagatgaggcaagcatg

SEQ ID NO: 106906 - DNA, 775 bp, Heterodera glycines
  Promoter: Source sequence=SeqID_41791; Location=1..775; Strand=+; Gene=SeqID_69838
cagtaaaataaatgaaaatagttcactgtagaaatcggtcactgtagaaatgttacagcaccttaagatgtacaaatgaactttatttttggaaaattttttaaaataaattcttattgttagcctttttatgcaataaataattaatttccaagtttacgtcgacactcaaaagatgctcacggcaaaagaattaatttttagctccttgaatatgtcgtgaaacatttattttccaaaagttaaatataaatttagccaatgcttcatgagtccttgcaaataaaacacttaattaattacctgttcctctgagacttaatttctttttagtttggttttaaaagcgcttataaaaggttagattattgaaaaattggctgaaaatttttggaaaatttttgattacagctctgaatttgccatttctgtcactatttttgctatttgcccaaattttaggcctttattctggtaattttcgcctcaaaaaatctaacaaatatttaattctgatataattacaatttacttttactagtttttctattgtattttttttaaatataaaattttaaaaagttaaaaaaattgaaaattacggattatggattacgggaaattacggtgtccttggacccccgtaattagggttacggatttctgtaattgcaaatccagttacttgcagccctgatttaaacccttaattacctataattaaagtgtccttttttgccagaacaacccgttgtgcaaccttcaagcagcgatg

SEQ ID NO: 106907 - DNA, 117 bp, Heterodera glycines
  Promoter: Source sequence=SeqID_19335; Location=715..831; Strand=-; Gene=SeqID_84074
accgcgataaaaacattcgaatcaattaaatagcttctgagataataaggtttatcataaaatttcatttaaaaataaaccctcaattattggtatgaacgatactttccaaacatg

SEQ ID NO: 106908 - DNA, 358 bp, Heterodera glycines
  Promoter: Source sequence=SeqID_41476; Location=734..1091; Strand=-; Gene=SeqID_69582
caaactttgcctcaataagtcaaaaaaatcacgaaccaaaagtcgcaaaacctcaaaaaagtcataaaaatccgaaaaagtgtaaaaaaagtcaaaaaaagtctcaaaaaatgcatgttagaagtagggatcggatttttagtggcaaaaatcccaaaataattaactaaatagtggcaaaaatagtggcgaaaagttccaaataattacttttaataaaaaacttttaagctctgatggggttttgaacaagcccaatttcgagaaagaattactcgattgagtaaatttcggcataaatttgaagagaaaaaaaggattttcgatgagagacctattttgattttggcagcaaatg

SEQ ID NO: 106909 - DNA, 380 bp, Heterodera glycines
  Promoter: Source sequence=SeqID_655; Location=7541..7920; Strand=-; Gene=SeqID_58301
agagtgtcaaaggtgatttcaaaaaatgtgcactttttacaaaacatgtgctcaacaaagagtgccggcccgctcatccaagacgcctccgatgaacagctgttgtgtctcgtggaaatttgtgtcaacattttgaagggccgtgtccctttgcgagccaaacagctaaagcgtttacgaacaaacgcacagtcacttcgtcgactagcgcgcacacgcagcgcacggtctgccaaaacggtgttgttacagcacggtgatggcctcccggccatcgctgggctgatggccagcatagtgctcccgctaattgggaatgtcattgaaaattataaatagtaatagttcatttttatttgctctttttttttgaaataatg

SEQ ID NO: 106910 - DNA, 364 bp, Heterodera glycines
  Promoter: Source sequence=SeqID_9676; Location=853..1216; Strand=+; Gene=SeqID_72297
agtacacacaatttattttcttcaatatatattttttaaataaatttataaattatggaaatttaaaatttttgatgctttcgatttttcaacaattaattaattccgtttgatggggggggggtgaggtatgagaaaaagacagttggcgagagagcgcatgaaataagagaacagtcagtttgagagcgacgagaggcagaagaagttgctccctcctctcgtttatgagataattaataacaaattatccaatctaattaagttaattgttaaacatatttaaaagcatttcccctcttcacagggccaaacgctgtcgcgccgtgaactgttcgatttgattggcgaaagcaagaacatg

SEQ ID NO: 106911 - DNA, 567 bp, Heterodera glycines
  misc_feature (61)..(61): n is a, c, g, or t
  misc_feature (97)..(97): n is a, c, g, or t
  Promoter: Source sequence=SeqID_26529; Location=1..567; Strand=+; Gene=SeqID_57265
gctgcacagctgcttaactaagctgtgtgcatttagcctccagaccgccaaactcaattgncaaaatacaatgcggcattgatgaattttcttggcngatgatgattgaatttgccgcctggccaaccaaatcctcggcctcagcaaatcactcctccgccactcaacagcgaccaacaaacggtctttgatgctgttgttaaggctattcagtcggacccaagggattcgactgtcccccgccgtttcttcatatacggcgatggaggcacaggaaagacattcctgtttggccaaattattaggcgcttgcgaaaggccccatacacctacaaagtgcttgctacggcatccactgggtgtgcagccattttgctgccatatgggaaaacagcccattccacgtttcgtctgggtagagaagtgtcattagacaaactcccaagcattccgctggagagcttctttgcccgtcggattcgtgaggcccaactcatcatcattgatgagatcaccatgcttcacaacacggtgattgaggtcatcgaccgagtgtgcaaagagatg

SEQ ID NO: 106912 - DNA, 1003 bp, Heterodera glycines
  misc_feature (3)..(3): n is a, c, g, or t
  misc_feature (44)..(44): n is a, c, g, or t
  Promoter: Source sequence=SeqID_20564; Location=67..1069; Strand=+; Gene=SeqID_51116
gcntaagttctatttgtcgaaatatttttcaatggcacgacttnttcacagttagcaaaaaataatttaattaaatcggctggaaaactattggttatagaaagtgatttcgatcacttattactcaaattcatagctaaattttggtacattaaaataaaatatgtttttttaaatcattaaaaaatgaatgagtcaagcatattgaccatatttatttataatttatttattttaacttaaaaattttagtatgaatattaagtattttgaccaattttagtaatcaatttttaaaagaatttgttttttaatctttaacaattttgccataccgtactttagctggctgcccatttgcctgtgcctttttgctattaattaattaattaattaattaattaaaggtaaacatatccaagggatctgcccttccttcactttctcggacattttcagcagaacaaactttagtctttttttctctccgttggtcatttggtctttgtgtcccactgcttaatagtctttttttctctccgttggtcatttggtctttgtgtcccactgcttaatgagtcatccattaatagcgtttgatctttgtcccactgcttaatgagtcatccatcaatggtcgaccgttgtaattagctaattaattaaggaacagaacattgcgacccaatgtttacaattttttgtttattttcactcccaaacatttttctgagcatccgaatgcaataaacacaatatttcgttgcataaattgtgctgaaacttctctatgatattcacaaatgcatttagcatcaattagctaattcatttatttatatcaaattttatttatttatttttaattaaatttaatttattgcaaaaaaatagttgtaatattttaaaatatacggccttttcttggcgaatttagctatttgttgtttaagtaacaattttaaaaagtttgccctattttttaattgccaaattcgacatg

SEQ ID NO: 106913 - DNA, 318 bp, Heterodera glycines
  Promoter: Source sequence=SeqID_8780; Location=1..318; Strand=+; Gene= SeqID_69201
atcgctcatttccacgaattaaatggcaatgcgacgaattgcgcgagaaattaggccaattagagggatcatttgccctgcgggtatagtgtgatgggcacggggtatggtaaagtgatgtcaattgggctcaaagaggcgaatttcttcaattaattggatggaccgaatgaccaaaacggcaaattgagggccaaacgaaatggcttttcagctgtgaagcggacaaattcctccaaaaagaagaaaaaaggcccaaaaaatattttaggataatattccgtttttataaaataaaatatttttattcagcagatg

SEQ ID NO: 106914 - DNA, 72 bp, Heterodera glycines
  Promoter: Source sequence=SeqID_9621; Location=987..1058; Strand=-; Gene=SeqID_72105
ggtttggggataaagtatttttcaatatttcattcccttttttgaatattattatatattatagctaaaatg

SEQ ID NO: 106915 - DNA, 516 bp, Heterodera glycines
  Promoter: Source sequence=SeqID_2969; Location=1..516; Strand=+; Gene= SeqID_82561
aatggctaaaatgaaaaccttagaagtcaaattccaaaatgttcaattttttaattttaaagaaagtcaatttgggaggcatatgattagaggaatttttcttgtgaaaaaatgtttgacaataataaaaaattcagttttttaaaatttttaacactatataggctcggtcttctttggcaaaatcaacgtccaaggttggctatagatatgtccagcggtacctgggagaaaaattcggaatttttaagtttttaaagaaaagtttaacattttacccacccatttattaatcaaattcccaaactcattagcatagatttgtcacaattgtttttaattgttttttagataaccgcaacaaaaattgatgaaccttttcgtgatttgttgttttacatgtatttcaaccaaaaattgttgcacattttgaacgaaaatggccaacttcaaagatatttggccaaaatttcggatcattccaacaaaaatggtgataaaatggaacaaaaaatg

SEQ ID NO: 106916 - DNA, 332 bp, Heterodera glycines
  Promoter: Source sequence=SeqID_40713; Location=1..332; Strand=+; Gene=SeqID_68966
tgctagatattttcacttttttgtcggtaacgccggacacagcttataaaattttaaatttttaacgaaaaaatattcaaaaatctgattttttacaaatctgatatgtagcagtttccataaaaattgaaaattcctggcgtccatcggtgccatcatttgtttttccattccaatttattggaaaatttttttataaaaaacaacgccattcgggtttttacaggaacttcttcaacaacggtccgttgtctacaggtcaaccgaacaatatgttggcatttattacccttgtttgttaattcccttttagtaacactgtgcacgcaatg

SEQ ID NO: 106917 - DNA, 94 bp, Heterodera glycines; identical to SEQ ID NO: 97954
  Promoter: Source sequence=SeqID_24264; Location=283..376; Strand=+; Gene=SeqID_54979

SEQ ID NO: 106918 - DNA, 1003 bp, Heterodera glycines
  Promoter: Source sequence=SeqID_3740; Location=307..1309; Strand=-; Gene=SeqID_51696
aagaattacctgcaacatctgctggcagcaaggtgataatttcaaattcaattcaaaagtggtgatcgtttaattacattttaaaaatatgttcagtcgaaggcgcgaaacaaaaagaaatttcaggttcatttttgtattaatgtataaacgtagaacaaacaattagtattttaattcgtagtaaattattttttttttttaaaaagttttaattgattattaattttaataaataaaattgaatttagcgccaagcttcgttctcggcgccatcatcacccaataaacattgggtttgcaaaaatacttataatacacagtaaactaaatttattaggttgacggatcctctgaagcatcctcggtttgtttaaaacaaaattattaataatttaaatgaaataaataaatttttaattcaatgactcttaattaaagtaaatatttaaaaaattgataattagtcggagacgtttcaaacgccatcggcacaacaaagtccacaattaaaatcaccagctgccaaactatcaccatatcatgtgaaaaccaattctggcaatgcggtattttttaattgattgccaaattcttttattccaattaatcaaaaatgttgagaggaagcacttattcaataaaagttaaattttttctagttaaattaaattaatttttattaatgaagaaaaagatcttttattaatttttacaaaatgagatttaaaaattgtgaaatcttttttcctttttcttttttaaaattaataagttttacgaaaaattcgtattttataaaatgtattgttgtaattatattttttttttgaaaatattaataatgcgatttatgcacttaagaaatcaatttttaacaaattaataccagattttaaaagactgataaagcaaatattataaaattatttaaataaaaattattattttttttaaatattaattaattaagtcttcttcaccacgtcgcttatcactgatg

SEQ ID NO: 106919 - DNA, 66 bp, Heterodera glycines
  Promoter: Source sequence=SeqID_41071; Location=153..218; Strand=+; Gene=SeqID_69276
ggttttgaacgatttcttatttttcaatttctgatttctttttagaatccgaatgctctccgaatg

SEQ ID NO: 106920 - DNA, 101 bp, Heterodera glycines
  Promoter: Source sequence=SeqID_40136; Location=64..164; Strand=+; Gene=SeqID_68560
ggtcaggctttttttaaaatactgagctctaattattatgaataaaatttaaatgtatttagaagagggatgagaagccttgggataataaaaaaagtatg

SEQ ID NO: 106921 - DNA, 807 bp, Heterodera glycines
  misc_feature (317)..(317): n is a, c, g, or t
  Promoter: Source sequence=SeqID_18112; Location=1..807; Strand=+; Gene=SeqID_82694
aatagcatttccccatgagattgagaaaaagcaattcccctaaagaagcattaacggatcatttgaggaaacaaatgatccatttggtcgataattggggttgtagaaggcagaatcggtagttcagctggtagaacactcttccggaaggccaacagaaacggcggttcaaattcccccccccccgacagtttttccctcaaaggcttttctcagctcattactttattcacgaaaaataaaaacaaccatttaaaaccttttggtgaaaataataaatgtatattgacttcatttattagcattaataatcattntttataatcatttcccccccccctccctattaatttctcaattacagtttcattttttttcgtttgaattcattctccccccccccccttccttcgtctcccatttcatttgttcgaccttttctcctcccctcccattggctctctttcgtcccaccaaaaagggaccgccccttctccataacgtcggcgatgcaatgagaaggggcggggggagcgaaggtgaaaaaaagcgggagaaggaggagagaatggtagtcaaaggaaaagccaatggaaaagccaaaggaaaagcaaagccaaaggaatgggcggaggagggccaatgaaaggcgagacgaatcgcacggcacaaacagtgcacgcgcaacaaacaaaacgcgcaaatggccccattttaaaccaaataaattccaattttccctaatttttgatgtatttaaaataacgaaatccaacaacaattaagcaattagtactccaattaatg

SEQ ID NO: 106922 - DNA, 171 bp, Heterodera glycines
  Promoter: Source sequence=SeqID_14669; Location=1072..1242; Strand=-; Gene=SeqID_78771
tttttcattcattcgtcgcatttcccaattttctgattttggactttaaaattatattttcttttctctgtcaaataaatattatttttgtttgtcctttggacacaacaactggcgacgcccgattgaaaatatggcaccaaaagatgagcttaaagctctttggaaatg

SEQ ID NO: 106923 - DNA, 300 bp, Heterodera glycines
  Promoter: Source sequence=SeqID_17150; Location=602..901; Strand=-; Gene=SeqID_81586
tctgcattttattttgaaaattaaattattaaagcgatttcctttagtcaatttgttcattttatttgcgcgttgtaattgacaatttataattttggtcggactttctgaattggcgcacagacaaattgctaagatggatcagttttttctcatttttttgtttagattgatggcttttcattttgtctatgaaagaaaggtggaataaccagttcaaacatttgtttataattttgttttatttcacagataatttgttaaacattcaggcaaggtcgaaaatattgttttattatg

SEQ ID NO: 106924 - DNA, 524 bp, Heterodera glycines
  Promoter: Source sequence=SeqID_37164; Location=92..615; Strand=+; Gene=SeqID_66311
ttgccaatattcgcacaatgaaatggccaaagtccgctgaccgattaatttacccacaaatccttctccatctcctcattcattaaggtgcgtctgcacatgtcccacaaccatcaggacttcaccagtcagccgatggacatgctcagttttgagatgcaactccaatggggtcttttgatggagcagtgttttcccgagcattccaaagtgaacactgtccattaaatgctaccaaattgaatatctcacttttctttcattagcgtttcggcccctccgccgcaaattcgcagtttcgcaatttggaagagttacagaaatatgtggacatggaggtcgaattgacaagacaatccgtcacaccactcgcacttgtccatttagcactcctacacatgcattgaatgtggcgaagtgttgacgggctatcagctggtcacccacttggaggatgtccaccgtcaagagtgtgtgccatttgcgtgtggccaatgcggttaccaggcgagcaagcacaaatg

SEQ ID NO: 106925 - DNA, 72 bp, Heterodera glycines
  misc_feature (53)..(53): n is a, c, g, or t
  Promoter: Source sequence=SeqID_1160; Location=1020..1091; Strand=-; Gene=SeqID_69068
ctccatttggctgcgtttgcgtacggatgtccgctgcggtcccccgaactgtntgtggacgtcttccgaatg

SEQ ID NO: 106926 - DNA, 518 bp, Heterodera glycines
  Promoter: Source sequence=SeqID_16928; Location=1390..1907; Strand=-; Gene=SeqID_81358
cgcttcattcccaactaaactgaacaatttggtatttattaaaagattttgaaaaggagaatctttttctaagggcaaatgctaagcaattcgatatatatgaaaaaagttgtgtatctcaaatttttatcacgttataactcaggccattgacaactgattccaatcaaaatgctaaaattattcatttttcaattgattctaaatgtctagagtgattttacatttacaaccaaaattattagaatttgcgaatttctattttttaatgtgctagggacattaaaatagtggcacgatgacatttcgcctactattcattttgcctactgacatttcgcctaccaaaccaaaaacattcatttcgcctattggaaatacataatgccaaagagaaaataaaaagagagaatatacaatatctataatgtttttgcatcaaataaatcattcatttcatttttatgtcatttcaaattttcttcaaaaacagaaatttcagattctaataagaaatg

SEQ ID NO: 106927 - DNA, 399 bp, Heterodera glycines
  Promoter: Source sequence=SeqID_2056; Location=3153..3551; Strand=-; Gene=SeqID_77560
atgtatttaagtattttttatatttcattttgtatttcaaaatgtatattttatttattttattcttaataaaatatgtagcatgttttaatagtcctattctttaccctgaacgttcaactaatgtaggaatgacagacatttattataaaattgcttcttttgatcattcgtatttaaataaaatgaatcaaagtcaactattctcaatgattgatgaaattattgataaatttcaactttgtaatattgaagagacaaagtcattgtcaagatgggtttattgcgtattattagttttattatggatagctgttgtaatgacaggcatttttttctattttaattctttaatcagaaatttgtgtaaaattatgcgaatatgtagagaagaaaatg

SEQ ID NO: 106928 - DNA, 93 bp, Heterodera glycines
  Promoter: Source sequence=SeqID_21211; Location=790..882; Strand=-; Gene=SeqID_51803
tatactaaacggtacttccgggttttgctacccgctccccccttgaaaaattttaaaattcatattttgaggttttcaaagtcactgatcatg

SEQ ID NO: 106929 - DNA, 646 bp, Heterodera glycines
  Promoter: Source sequence=SeqID_603; Location=1565..2210; Strand=+; Gene=SeqID_57367
tttggtgaggaaaaattcaacgggagaatggacaattggggggggggggggggcttgagcgcggaaaaggtaaaataagtcggaaaagtgggggggggggattacagcacaattcgcggttaattgccacgcagggggacggacgaaagggtgccaattagtgagctcatttgcgcaaaagccatctccacaatggcaaacaatgcttcatcaaagtttattttgcattggcttcattttttggttttaaatcactttttcactgattccattcacaaaatcattattttatttaactgcccttttctgttttattttttcccctttttcatttcgacatttttgccactttttcactcgttaatttcttttcgttgctaggcaaaaattgtgccattttcatttccatttatcgttgaatacaattgttcttttcaatgcgctttgcttctgattaatgcccgtgtttggactcgttttgttctcgtcgttaacaaaagtgcttttgccactttttccctgtttttctgtgtccgttgccgcttttcctctcatttttaaatcagtgacttcgtcccattgttcgttctgctgctgcttttggcaatgattggcctttgattcttccgatttccctcccaaaatg

SEQ ID NO: 106930 - DNA, 55 bp, Heterodera glycines
  Promoter: Source sequence=SeqID_27355; Location=1..55; Strand=+; Gene= SeqID_58051
ctgtcagaaccacttgcgaaaaatgtgacacgtgagttttgacggactaagaatg

SEQ ID NO: 106931 - DNA, 639 bp, Heterodera glycines
  Promoter: Source sequence=SeqID_3359; Location=1..639; Strand=+; Gene= SeqID_84354
ttttttttagcaaattttatgatcgttgatgttattgtttagctttttactttccctgcccacaatttgtcgtgagaaaacatgaaaaaatgggcagcgaaaataaaaaatgttatgatcgttccgcgctcattgcgcaacccacggaacacaacagagaattgttgcaatatttaagctaaaatgcgctctctccagactcctttcatttaaaaaatttttatttttcattaactttataattaatttgaaatactttaaataaatttaaattatactaatgtatgacaatctcgaccaattttgtaatattgtcgtcaaaaaaattgtaaattctgcaatttatttattaattttttttacaaatgttcgttaaaggaacctttggttgtcaaatcgttctgaacattcaaatccaattatatctgtatttccaaattctcccaattaatggtaaaaagtaaaaaaatcctaaatcacagtattagcaaatggcgagcaaccggctgaaacgcgtgccggcttctcccaccgagtcagctcaagctgatgaacctcccaatcaaggccgaatcattagcgaattaaaaaataaagatgaaaagaatagcaacaacttaatcaattttcagaaaaatg

SEQ ID NO: 106932 - DNA, 355 bp, Heterodera glycines
  misc_feature (46)..(46): n is a, c, g, or t
  misc_feature (68)..(68): n is a, c, g, or t
  Promoter: Source sequence=SeqID_19932; Location=1..355; Strand=+; Gene=SeqID_84692
catggagcacgactcgtgttacattgacacttggaagtgctggccnaatgtgagggaaactttggccncacaaggttggcagggaataaactaacagtaaaaaaacattcatttatactatttgcattcttgggtgtcaaaattctatttaataaaatacgaattttaagacccataaatattaaacttgcaatggttcatttttacagacatcaaaacttcaacaggatttcgcagttttaatatcttggcaagtgtaatagccgacctattgttagaatttgattgaattaagtgttccgacagaagtttttacgtcaacacgacacatttgaatttgttgggtggccgaatg

SEQ ID NO: 106933 - DNA, 91 bp, Heterodera glycines
  Promoter: Source sequence=SeqID_24591; Location=2432..2522; Strand=+; Gene=SeqID_55329
attattaaaattatatttttaactgaaggcacaacgacagtgaaaattccgcaccgttatggagcagtgtcggggatgagtggccaaaatg

SEQ ID NO: 106934 - DNA, 499 bp, Heterodera glycines
  Promoter: Source sequence=SeqID_10305; Location=1..499; Strand=+; Gene=SeqID_73470
ccagaaaatttttagaaaattttgtgcaatttgttaatagattttgtatgaaaatagccaattttataaattaaaataaaagcaatttttttagttttacatacttctttgtaagaaaactatatttgaatttctaagattttcgcccttcaaaaaagaaaaaaacatcttagaattaaggaaaaatggcatctgaataaaagttaaataaattttaaatttgtccgtaggcaataccttttttgaaaaataataatgcggtaaaaaaacaaattgaaagtacgctataaactgtggccgtaagcgtaaatcatggtcaaaataacaaatattttttcctgttcagaattttataaaaagttcatatgaacattgaagaaataagcattgagtacttttcgccttttttttagtcttggaatgaataatatgcattaaaataaaagtcgctaattgcaaataaagttgatgcctattttccagagattattaaattatg

SEQ ID NO: 106935 - DNA, 388 bp, Heterodera glycines
  Promoter: Source sequence=SeqID_19670; Location=804..1191; Strand=-; Gene=SeqID_84403
ttgttgatcattacacttttctgaaacaaaataattgcgttataaaatcgtattttgattttggaaaagaaatggaagcaaattgcgtgttgtagcctgagggcttaattcgcaacattatttttggtggtttttggttacctaagctttatgtaattggcacagcggaatgttctttatggttttctatcaatgaccgggcaaaaccatcggaagaaaatgtgtcagtaaatttttaaaagaaaaactaaattttgaagctctgttttacaaaaaaaaatatttcgccaaaattggaaaagaatatgtaattgcgtaaattcaaatttatgtttgatttaatgtcgagcaaattcttaaattctttttttttcagtttactagtatg

SEQ ID NO: 106936 - DNA, 1003 bp, Heterodera glycines
  Promoter: Source sequence=SeqID_69; Location=6794..7796; Strand=+; Gene=SeqID_61208
gtaatttaacaattaaaaaattacctatgattaatatttgagtaaaaaaacggattaattagctagtaatttaaatgtttaattggacttaaattgatttaattaaaagttttttggtaacatattttgcaataaaagttgaaaattcggtaatttccttgtagtcctatgttaatctttattaaaacatttaaaaaataattttacggtttttaatctattaaagtttttgtttcttgtataattatattaaaatgcttttattttacttattttttaaatttatttttttaaataaaagataataaatttgtttgcgttattgttgtaccatatttattaattaacaagaaaattaattttatttaattatcataaatttataatttgtataattttatgtaacgagctaaaaactatgtgcttatttgccaattattatttttttcatctctataatcaatgcacttgcgttaataatgatgatgaatatgttaagtaattgtcgagaaatttattaatttttttattgttattgttaaattatctaaaatttatgaaatgaatgacaaacttggtttaatctttaaaaagtggatcatgttgattatagttaagtattaaaaaaaaaaaagtaaatttaaacaaatttggttcttaaattcatatttgaattttttcaatatttttgaatgcttttttttgaattaaatgtcaaaaatgaataataaatctttcttaacatgtacacttttgctaaaaaaaaaaaaaaatgtttattacttattattattagcaaagttcccaaaataaatcagctttttttaattttttttttttttgctgtttaattttgaaattatgattgtttaaaaaattttcgtcttacgtgttgtgttaaaacataattatttaaaaatctggtatgaacaaagttttggatttcatagttttttttaataaatttttcttgaaagtttaattttttttttcattaaagatg

SEQ ID NO: 106937 - DNA, 525 bp, Heterodera glycines
  Promoter: Source sequence=SeqID_13356; Location=1..525; Strand=+; Gene=SeqID_77221
gggagggggagggggagaagcattcccttcccttcccttcccccgggggaggggcgatcccggaagaaccccgagaacaaacttatccctctccagctgctcttgagtaccactttttttctcttaaagcatatcattatccaacggacagagcgcacaactgttgtcggaagcggacgaaaggcgggggggagaaaaagcatccgaaggatgggccgagagaaccatctgtgatgcgttagtggggcagtgattgttggttggtggccagccatttggccaacttaaaatgcgatgtgccaaaatcatttcccgcctatgacgaagaaaaaaagggggcgggaaggggcgggggatggtcgaaaagccaacaaataacgccattttacaacctccagatggccggacattttcgtaattttcctacaaatagcgacgattttacgtgttaaagcatacttaaaatttaacagcacttaaaaataactgacatttgttttattattcttctgctgctgcgtgatg

SEQ ID NO: 106938 - DNA, 224 bp, Heterodera glycines
  Promoter: Source sequence=SeqID_5610; Location=283..506; Strand=+; Gene=SeqID_58648
ccttgaaacttattttcattaattttttaaatataaaaagaaaatttattaaaatcatatgaaatctgtcacctaaactacataagtaccaaaatatcttggacttttaaaaagctacaatcggcaatacccaaaactattaaaatcacatagaaacataaaatcttttaaatacaaattccctacattttttccaattgcgtttcagcgtaatcataaatatg

SEQ ID NO: 106939 - DNA, 69 bp, Heterodera glycines
  Promoter: Source sequence=SeqID_19397; Location=1..69; Strand=+; Gene= SeqID_84122
cctcttcagattttccccgacccaaaggcatttcggcccgtgcgctttttggacgaacgcggaaagatg

SEQ ID NO: 106940 - DNA, 115 bp, Heterodera glycines
  Promoter: Source sequence=SeqID_127; Location=6738..6852; Strand=-; Gene=SeqID_73478
ctcttcgccctaatttaatcttttgttaaccaccctctcaatcactatataagcagaaaaatttaaaataaatatacacatactatccaaatatacattacttaaaataaacatg

SEQ ID NO: 106941 - DNA, 258 bp, Heterodera glycines
  Promoter: Source sequence=SeqID_13999; Location=1342..1599; Strand=-; Gene=SeqID_77968
ggtagagagacgaaaatttgaaaaaatgcgtaattttttcccgtcattttttcccccacagtcacatttctcgtcgagaatggtgccaacatcaatctgcagactggtgatggggcaacagcactgatgtacgcgtgttacacgggaaatgtagggaaaaatttccattggcgaaatgttttccgacatttttccatttgaattcaggtggacattgtgcgcttgttgctgtcacatggtgcaaatgtcgagcaaatg

SEQ ID NO: 106942 - DNA, 514 bp, Heterodera glycines
  Promoter: Source sequence=SeqID_7199; Location=1492..2005; Strand=-; Gene=SeqID_64118
atagatatttcaacttatttttaaataacattacggtaatgtaaattaaattaataaaaaaaaaagacaaaaattaaaacatatgacctaaatcacagattatctaacgaatttcaaattaaataaatttcataattaataattcaatccatttgtaaattaaaataactcatttaacaatgaattagtaaaactcaattttttgttctaagaatacaaaattaatatatttttaattctaacaagaaggaatttattgtctgttatgaggaaaaacaaatttaaaaataaattattactctaaaatatgattctgatttagagcagcaaacccccagagtaccaattgaaggtttaaattataaattaaaaataaatttttgaaaagttcatatatatttgataaatgattgttttcttaaaatttaggtgaattaaaaaaataaaagtcgaaattttttcgtaaattaaaaatcttcatttcttcttattttttgttctacgtcaaaccatg

SEQ ID NO: 106943 - DNA, 93 bp, Heterodera glycines
  Promoter: Source sequence=SeqID_10015; Location=1225..1317; Strand=+; Gene=SeqID_73067
aaagattggtgttccgtctttgctaaatatccgattttgctgaataataattggtccgacactttttactacgaaatttcagtcaaaaatatg

SEQ ID NO: 106944 - DNA, 86 bp, Heterodera glycines
  Promoter: Source sequence=SeqID_16288; Location=1137..1222; Strand=-; Gene=SeqID_80677
ttttaactatttcacatattgtatatcatacgtatttgttggatttgcatttatcacgatgatcttaatttttttaatcccaaatg

SEQ ID NO: 106945 - DNA, 417 bp, Heterodera glycines
  Promoter: Source sequence=SeqID_5548; Location=3078..3494; Strand=-; Gene=SeqID_58411
ttggcactgaaaaaatattttgaattatttcgtttgaacctagtggtgcttagaggcatcgcatggaatgtatttaaaatgcgatttagtttagtttttcgaaaattcattctataagcgataaaacagacacttgtactaatgtaatcgccaaaatttttttatgaatttaaacataaaccaaaaaaaagtcggggttctgagaaaattcccgacaaatttgtctggtgtggctggagaagtcttaaaaaggctgaggagaaacacaatcgaaaggaaattttgataaaaagccgaaaagggagaaatgtttctaataatatccataatcagcaatgcatttaattagtaaaaataaatttatattttgtataaaaaagtaaataaataataaatctcatagcgaattaaaaaatg

SEQ ID NO: 106946 - DNA, 92 bp, Heterodera glycines
  misc_feature (12)..(12): n is a, c, g, or t
  misc_feature (66)..(66): n is a, c, g, or t
  Promoter: Source sequence=SeqID_2193; Location=1..92; Strand=+; Gene =SeqID_78408
gatgacaaatcncaaacaaaaaagagaagtacgtgaaaagcgtgaagaaaggacagcgtgaaaagnccggacaaaagacgacgaaaacgatg

SEQ ID NO: 106947 - DNA, 810 bp, Heterodera glycines
  misc_feature (24)..(24): n is a, c, g, or t
  Promoter: Source sequence=SeqID_26630; Location=904..1713; Strand=-; Gene=SeqID_57383
aaaaaaatcaaagcattaaaattnatcgatgtgaaaaaactgaaaaaattcttaaaaaaaaaattttcgagaaataaagtatttttcaaaaataattgccttcctgatatgatttatgaggtaattataaataacagtttctttttaattaaacgacccatttggccagtgaacactcgggctgagactaatggtcattaaatttttgggttctatgattatattttttaatttgatccccgcatccctctcacattttgagtttttaatgtttctggtcagatcagaaaatcttaattgcattttgggtcagaggcagtgccgaaaagcgccgcaaattaattatggcacaacccaaaaaatgtgcaaatgccgctgtaatcaatcagttagacattgatcactctcaagggcatcaaggatgtgtaatgccgatgcccaaataattacggaaattcaggagttcagaagcttacaaaaatggaaatttaaaattctctctagttggcaccattaaggaaatgccaacttaattgttgttgattcgctcgctgctgcaaacaaaggaatgagtgatttctggcatatgtggaatgcttttccaaccattagtcccctgggaggccccatttttctgacgtcacaccatcatttgtccacaaggaagccaatgacgatgccacccgcccctcccatggggcgataatggggcggtgagttcaaaggccaaaaccgaacgattaagcggctggcagcagagagagaaataggtcaagcagcagcatcagcagctgtcattaaaatgtaatg

SEQ ID NO: 106948 - DNA, 603 bp, Heterodera glycines
  Promoter: Source sequence=SeqID_38446; Location=1..603; Strand=+; Gene=SeqID_67256
atttggggcgttaataattgttgaatctaagagagaaccccccccgtaaaattgttaattttttatatttgcaaaaaaaaactaccgtacatcatgagagcaatttgtgtacaatttttgaacagacgcaaacaaaagcacagaaacaaagccggagaaggcattaagcgacgaaatcagctaaaaaaaaataatatttaaaattattagaaaaaaattctttttaatttaaattctattaagataaaatttatttattttattttttattgctattgaccaatttcactccacgacaaattaagaaagtagttttttatattcttcgatacgttgaagaaaatatgaaaaaaaatttggaggggggtgggggggtgggagaaaaaatttaacgcacccgcccccgattctgaccattttccatgtcccggttggcaacacggattcgaccatgtccaagtcgggcagcagcatcaatgcctggaccgagccgtgctgtccgacagtgcgcagcgcacggccaacaatttgggcaatgttttcctcgggcgtcgccggccccgcgaaaatggtctccacggagaggcaaaacagcggcaaatg

SEQ ID NO: 106949 - DNA, 1003 bp, Heterodera glycines
  Promoter: Source sequence=SeqID_11; Location=202..1204; Strand=+; Gene=SeqID_69056
tactctgctattctagcccattaaatgccatcaccctttaaagatacttcgcaagaaaagcttaaataacaaaaaattcgaatctgttatacaattccatgctgtgtagttttctataaagcaaatattcatccactcttaattactctcctattctagccaattaaatgccatcaccatttaaagatacttcgcaagaaaagcttaaataacaaaaaattcgaatctgttatacaattccatgctgtgtaattttctataaaacaaatattcatccactcttaattactcacctattctagcccattaaatgccatcaccctttaaagatacttcgcaagaaaagcttaaataccaaaaattcgaatctgttatacaattctatgctgtgtaattttctataaaatttctagcccattaaatgccatcaccctttaaagatacttcgcaagaaaagcttaaataacaaaaattcgaatctgttatacaattccatgctgtgtagttttctataaagcagaagtagaatatattcatacataaattatcgattttttgccaatcaagtcaatcgatctgattggcaaaccagaagatgtgggttttgtccaaaagcctattgctacatgcgggtgccgtgcctcacacgctgactccgccccctttatcatgatgcaatcaactgactccgcccccttagcataacgcaatcaactgtctccacctcatgacgtcattaactgacccccccccctatctcatgacgtcatcaactgactccgcccccttattatgacgcaatcaactgactccgccccctttagcatgacgtaatcaactgactccgccccctttatggtgacgcaatcaattgaccccgccctttgctatgtttattattttttaatgattttttgagcactctatatcaaatcgctctgtaaggtcctggctataaaagtgcctccccttgtgcttctaaatcattcaacttttgcaaatg

SEQ ID NO: 106950 - DNA, 1003 bp, Heterodera glycines
  Promoter: Source sequence=SeqID_2285; Location=1023..2025; Strand=+; Gene=SeqID_78885
ttttaaaccaaaccacattaatagcttataaggggtgggaccggtgagtcgggggtcgttctagcgtcaaaaatacgaaatcgcatacatcatggctaatactagagttgagcgggaccggaatttttggcaaaaccgggaaaacccgggaatttcccggtcccaatcaaaactggtcaaaaccgggacttggtactcagttgtccgtcttcaggtcccggtcccgcttaactctagctaatactatagatggtaggggcccttttaggaagaaaaaattttttttttaaatcgtgaaaacatgtttatgggggttttctgggccggataacccgaacccaacattcattttgactaatttcgaattccggacccgaatttgaacaaaaaatctagaattcaaaattttcaaaattctcacttttgttcctaaattgaccataacaagctaaatttagtctaaacccatcgaaacatcaaaaatggtcattctgtacaggtatgaacataaaagtgaattttgaaaatttgaatgtttatctttttagaaaaaaaataattttcttccgaaaagggggacattgcatctatagtattacgcacatgactgtatgccacaaatcttgtattttttgggatttctggcgtaatgatgacaagttctgcttttgaaagtcaggtttctgcggtcagacgctaactgcatgaacctgtcaaaaatgacaggttttttccggtcggggtcgttttcgcgtgagggccattttcgcgcaccccccccccctaataaatgaaaaattttctcaaaaattcgactccaaattcttttacatacttgatatgaaatattttagcctaattcacacaaaatttgaagcgaatttaattcttaatggaatcgcccgttgaaaaaaagaaaaaaatttcctccgccgacaattgcttaatttcttctgccacagttagtgaaaatcagcagcaatcgccgggttcatttacgatg

SEQ ID NO: 106951 - DNA, 202 bp, Heterodera glycines
  Promoter: Source sequence=SeqID_15577; Location=1681..1882; Strand=+; Gene=SeqID_79866
ttttgccaaaggcggcggaacgagtttagcagaaagggaggacagaacacagtataaaagcggcactccgaagcctgacaaatgcagaaacattcacctctcaaaccaaatattttattttttttatatttttaaaattaatttccgcggattttttaacataaaaaccctttcactttcaaataaaagctcgtgaaaaatg

SEQ ID NO: 106952 - DNA, 284 bp, Heterodera glycines
  Promoter: Source sequence=SeqID_2845; Location=1255..1538; Strand=+; Gene=SeqID_81907
ggtgagcaataaaaaggggggatttgtttttatacatatccaaatttgagatttgcgcttaattaaggccattgtctccgccaccggcagaagatacgggacaaagcatcacaaattggccgtcttctgctgacaaatgagtgatggacaaaagaacaaaaaacacaatgatgagctgcagaagaaatgaattaattaaaaatgacctaattcatcagtgatcaaatgcattttatgaagaaaaacctctcaatttcggtaaataaatcagatgcataaaaatg

SEQ ID NO: 106953 - DNA, 64 bp, Heterodera glycines
  Promoter: Source sequence=SeqID_603; Location=4449..4512; Strand=-; Gene=SeqID_46002
aagtttgcttggtggggatgaattggaagttctgatccacccactgggtgtcttgcccgttatg

SEQ ID NO: 106954 - DNA, 196 bp, Heterodera glycines
  Promoter: Source sequence=SeqID_9401; Location=3522..3717; Strand=-; Gene=SeqID_71283
ttgcacagaaattttttttaaagattttgtgaaaattttgcaaaattcggatacaaataataataatttatcagttgtttgcttctatcttaatccgatcactttatatgagtctgttttgaatcattttatccattgttccacatttatcagccagtatcaacgcgcattatttggctaatctcacaaaaacatg

SEQ ID NO: 106955 - DNA, 780 bp, Heterodera glycines
  misc_feature (11)..(11): n is a, c, g, or t
  Promoter: Source sequence=SeqID_24903; Location=1..780; Strand=+; Gene=SeqID_55651
atagcttaaantagattaaaaaaattacagaaacaaataaattttatagctaataagtaatttttaaaagttagttgtgcattaaaaataacaataataaaaaaaatatctttctaaaatacaattgaacattttaaaaccccattaatttattttaaataagattaaaacataaacctttagtccaattttataacatcaaatttaaaaaaaagaaaccaaaaaatctaggagattacaaaaataatttaaaacctaaaaaaatatttttaatttatcgaaataaaaataaaaattaaatttgtatgtcaaaattattgcacagaaataagttacctgacagattataacctaaaatatatactttaaaatttaattcaagaaggacacgtaaagaattactataagtattataaaagatgaatgaacatttagaaaaacaatacattatttttaaattaataattttattaaaacgaaaggaaaaatatttataagaaattactacggcgaccgtcagactgaacaaaaatctgaaatggtagacatgattataaataaaaatatataactttaaaaccattaatccaataaatatacgtgcaaacaaataaaaattggataattaaaatacaatcaacataagttaaaggaaatttgaatttaaaaaatagaaaaataattgcgagaggaaataataaatttattaaataatttattataaaacagaattaaaatattttgaaaaggatctttttcttaagataatagttaattatg

SEQ ID NO: 106956 - DNA, 399 bp, Heterodera glycines
  Promoter: Source sequence=SeqID_102; Location=1..399; Strand=+; Gene =SeqID_68300
cattatgacacttggacattttgacgggcagcgaaaagcgcgtgctcaactgattgattagtgagcagaattccgcaagaaaataattgtaaaaggaaaaagtgatcagaaaattacttaagtgatcaatcgatcagaggtgaaaatgctgcggtaaacgattgattgccttacgccaatttgtacgcttcggttggtcaaaagtcctgcaaattgcctaattaaattaggcggcggttgcgcactctttcccaattctgcccaaatttttgcactttcatcaaattcccaaatgttagtaaaatttcctcaaaatgcacttctttccatttttgctgctgttttgaccctctcacaaaatgctcctccaccgatcggtccctttttgattgactcatg

SEQ ID NO: 106957 - DNA, 652 bp, Heterodera glycines
  Promoter: Source sequence=SeqID_9466; Location=1..652; Strand=+; Gene= SeqID_71522
gatgaatgggattgatgaaattttgagttgctagacacactaaataaacttaatatggggaccggcaaattggacaccggaaaattggacaccaagcggaaaaatggacaccgccggaattttggacactaaaggaaaattggacactaagatttcctttttaaaaaaaatcaagaattaggtgaaaataaatttgagtagaatttgatcaatgtgccacaaaatgcaccaaaaatgggtgacgattgatcaatgggccaaaaaatccaccagaaatgagtaataaaacttatttctttatgaatgatatgattttttcttctcctgaagttacaaaaataataacaaattaatttccatattatttacgcttataaacaacatatggcagattaagataaagatcttttaggccaaaccaaaatttttgtttagtaatttattttgtttattttcatttttatttacaacagtgtccaattttctggtgtccatttttccattggtgtccaattttgtggtgtccaatttaccgggagccaataattattgcggggaattatatggataaataaattttatggagttttaaaaaactgaatttcttattcacttcgtaatttcagaatgacttgaaattttgcaggaaatg

SEQ ID NO: 106958 - DNA, 83 bp, Heterodera glycines
  Promoter: Source sequence=SeqID_16553; Location=1..83; Strand=+; Gene= SeqID_47378
atttttcactttaattttcaagtatgtattttaaaggcaattttgataagaaaaatgaatattacgggcgctatcaaaaaatg

SEQ ID NO: 106959 - DNA, 107 bp, Heterodera glycines
  Promoter: Source sequence=SeqID_2660; Location=6390..6496; Strand=-; Gene=SeqID_80939
ggttaaaaatgttggaaaactgttcagtgcccgcaactattgttttggagtatctataataatatattttatactgtaattaaataaatatgttacagtgtgagatg

SEQ ID NO: 106960 - DNA, 224 bp, Heterodera glycines
  Promoter: Source sequence=SeqID_10256; Location=1..224; Strand=+; Gene=SeqID_73413
actcacgttctcgctcccactctcgctcgcgcagtcgtacgcgctctcgttcccgcagtagctcgtcccgctccgcttcatagaccgcgcgctgacgaaagtcccggatatgcgaacagacgcacggtcgggcgggcggacagactacctgtcgtatgaacgaccaaacggccggatggaatgaggaggaatgacgggatggatttgattggatgcgtcagatg

SEQ ID NO: 106961 - DNA, 60 bp, Heterodera glycines
  Promoter: Source sequence=SeqID_14244; Location=1..60; Strand=+; Gene= SeqID_78260
tgctatttttgtttcacacaacttgtgaatccaacctttcatcctgtcattgcggcaatg

SEQ ID NO: 106962 - DNA, 88 bp, Heterodera glycines
  Promoter: Source sequence=SeqID_28089; Location=352..439; Strand=+; Gene=SeqID_46086
tgtttttccccttttcaaaaaaggggataaatttaattctgaaaattataggcctatttctataacctgctcactttgcagggttatg

SEQ ID NO: 106963 - DNA, 169 bp, Heterodera glycines
  Promoter: Source sequence=SeqID_21441; Location=737..905; Strand=+; Gene=SeqID_52050
gttcacaatttaattaattgtaatattgttttttaaatatttgaaaaaagattatttcctcattttttaaaataattcaattttatcaatttaaattcattttcgattattttatctaaaaaattttgcgttttaaaaaaataatttactgacagattgtttacatatg

SEQ ID NO: 106964 - DNA, 782 bp, Heterodera glycines
  Promoter: Source sequence=SeqID_14557; Location=2055..2836; Strand=+; Gene=SeqID_78624
tgtaatttggacaatttgcgtcgtcacatttcaccgacacttcttactgatcttgatcaattgaattcaatcaactccggttatctgtgccccgatggaattgctgacgatgggccaaatgcaactgctggccaagctttggccaaatggctgcacactccgacaaaaaatggccaaccgaagcgattgtatcgcatcgctattatgcatccaaaaagtcttttcgacctctttatatacctaccaaaataaaagtgagagatttgaaaacggatgaacggatgggggggagattaaaatgatttgttggccaaaataatggccataacgcattaatttatgcgtatataaagagagagtaatggggaagggtgttttgctgattttgttcaatacatacataatttacacggcttccttatttttgtaaatgcatatatttttttcctggattctccgtatcctaattcaaaattgattgagctgataccgtccgtatatctctaattatccccccggatgattattgttcaacctccttagatagggaggggggggggggctaattagagataataggtaaagtgaattagagtgaaaaaacaatatttttacaaatctccgtctgttttattctgtttcaaaattgttttttgttctttttgctttatcatttttcctaattgtctctgttttaagttaacaacagattttttgccttttgtgacaaaaaaaaaaacaatcgaaaaagggaaaagtgtgctaattgagccaccaaaatg

SEQ ID NO: 106965 - DNA, 99 bp, Heterodera glycines
  Promoter: Source sequence=SeqID_5931; Location=1..99; Strand=+; Gene =SeqID_59714
aggggtttcagaataaaatgcaaagcagtttcattataatttcaattaaaataattttttccaaataacattgaaaattttagaaacgggcgtcctatg

SEQ ID NO: 106966 - DNA, 528 bp, Heterodera glycines
  Promoter: Source sequence=SeqID_20691; Location=804..1331; Strand=-; Gene=SeqID_51248
taattaacgaaaaaagctaaaaataattaaaaacaatattgctccccgaccttcggggagaggaaaatcgcggttccccgataaaatttgttggtaaaaaatcgaaaaaaataaaagaatattttaaaaaagccttagagactcatttaaagactctctcatccgtttggaagcaacgaagaggttcatcatttatcgcatcgaatccaacccaaatttaaaaagcaattaataattaggcaaaaatttttgatttaattcctaaaatttaaaattttcggcgcccataaagaggcaaaaggaagggacagagttcgtcataataaatgtgcaaatggttgttgctgactgactgaactgaccacgtccgtccgtccgtccttcgctctgatcgattttggcggaagaattttcactgatttatttttgcgcacagatcgacggaggacaaatgaaaagagaacgggaagagaagagagcgaggggaagaaagaacaacgagtgatcaggagagagtcattaaacatg

SEQ ID NO: 106967 - DNA, 1000 bp, Heterodera glycines
  Promoter: Source sequence=SeqID_5703; Location=1663..2662; Strand=+; Gene=SeqID_58974
tttttttgtaaaaatataatgaattatttttataaaaatatttttcgcaatgaattttgtaattattaattttatagcatggcttaatttttcttcaatcaatattaaccacatttaatcattatttcattaatttgacaacatttttataataattcaattattaaattttccttttatcagcgaattgggtagtaattaatatcagataactataattatggaggtttttaaggtaactatcacaaatatcacattttcgttctcatctgatgtattaattcactaatttttttagcacatattttggggattttttggaaattttatttttattttttacgaaagtagcttttttgcactcaaattcttggcaagatatccaaaaatgttcaaaaattttcttttttttctttttgcactttttgaccgttttaatggcttttttaatttttaaggcaaaatttgaattttatcaatgaaaacagaaaaataaataaatatttgaagcgagaaaaatatttacgtcacaaagaattgaaatgtttttgattagaatcgtactagcgaaacggataaaaaacgtgattttttcgataaattcacttattttttcgacagttttttttcaatttttcggcacatatcgttggcctttttgagctttttagggtcgggggtcgttttcgcgtgggtcgttttcttggtgggtaagactctttttttggagtctgaaagcggatgcggatctggcccgtattctagaaaagtaccattgtttttcgttcgtttctgaccattaagcaaacccctaaaatctatccctagtaatgatataaaaaataattagcttacctatatgtattggaatttgattttgaaacaaacgaagcttttgaaatagcaggctaatagaaaattatatattgattctattcggttttttcctcgaacagattttttcaattttgcatttatataaaaagttctatcaaaaatg

SEQ ID NO: 106968 - DNA, 312 bp, Heterodera glycines
  Promoter: Source sequence=SeqID_17421; Location=565..876; Strand=+; Gene=SeqID_81903
gtaaacttggcaaaacccggcatggcctcaaatgacggtttttccaggcaaaatcgcatcccctgagaaaaatatttaataaacaaattacttagaagaaataagaaaaaaaaattcaaaattatttttgaaaaaaaagaaaatagggtaacttctcattttttaacaaaatgaaatgagttagaaaagaaaattcaaaaaattgaaaaatttgtgttttttgaccgacagaggcataaaaaagcatcagtgatgagtcagcgacatcattttttggcattggcacagcccaaaaaaacgacgacaaaaatg

SEQ ID NO: 106969 - DNA, 172 bp, Heterodera glycines
  Promoter: Source sequence=SeqID_6386; Location=2535..2706; Strand=-; Gene=SeqID_61339
tgtaatcagctgtatgtcgtcctcgttctgatcaataaagaatttgtctggccatgagtccgtctgatcagtgaatgataattgattgaatgatttgaacccatgaaaaataaataaataaaaattttaacacaaattctaatatttgaagaaatatatttagagcaaaatg

SEQ ID NO: 106970 - DNA, 121 bp, Heterodera glycines
  Promoter: Source sequence=SeqID_4052; Location=360..480; Strand=+; Gene=SeqID_52972
ggtaggactactgtatggttcttgataatttttaaatctagcaaaatcactattatatttttaccagggaaattaaaaaacatttaaaatagtttttatagaacacaaaaggaacaatatg

SEQ ID NO: 106971 - DNA, 1003 bp, Heterodera glycines
  Promoter: Source sequence=SeqID_16783; Location=1388..2390; Strand=-; Gene=SeqID_81200
gaacaaaggcatgaaataaacttttaggcgtaaagtttagtttctttgaccataacttttttattacttggtcaatccctacattcttggtatcaaacgaaataataaaaaagttatggccaaagaaactggacaatggacgcctaaaagttcattggacgcctaaagttcactagagccaaccttccacccaacccccccccctcccccaggtctccaattgcttcgtccgccctcttccagctggtcccctgatctgatcgcattcgtctttctcctcttctttatcattatcatcttcatattttttgttcacttttttggaacgagtgaggagtttaacccatcgaccaaacgaaggattggcgcaccgaataaaaagatgtacccatacgcactaaagaaattgtaggagtatatgcaatacaaatgccaaataacaaaattcgattttcatttgagattttttacatgcaaatacatttatgtaaaaaagctgatcgatccagcagttgggaaatggtggtgaaaatttggcaatgattgtagattattggttccataaaaaaaagaaaaagcccgattttaacgattttgcccttcaaatttgagatgacgacgagcttgttttgcatgaaaataattgaccggtgctcataaccaatcacttggaaattttttgccaaattagacactcatggtatcattcgatagcccaaagtattctttattacaagaaggctgaataaagtgcaaaattgagctttttcattttttatggactacatagtattcatttttaatcatatatttatgttatcgatttctgaacaatttagcctgtattagtatcaaatatacttttatgaattttgtaaatatgcattacaatttaaagctgtttcaatgcaaaaactttttattttttaattaacaatgcacatgatgttttaaggtcaataatttcgctttctttgtttgagcttactatttccgcataatg

SEQ ID NO: 106972 - DNA, 123 bp, Heterodera glycines
  Promoter: Source sequence=SeqID_45283; Location=566..688; Strand=+; Gene=SeqID_72610
ggatgaaggagagaaggaagcggaggagaaaaaagagtaaaattaaaaaaattaaatattgaataaaaaatacatataagaaaaattcattcaaatttttgccaaaattattgtagcaaaatg

SEQ ID NO: 106973 - DNA, 303 bp, Heterodera glycines
  Promoter: Source sequence=SeqID_12987; Location=1..303; Strand=+; Gene=SeqID_76750
caatcggatcgaaaatcacagatcagcccaactatcggtcggcacggatcaaaatggcacaactgtatttggaggtgaagcatgataagcacaagttcgccttgtgctacaggttgatcggcagatttccgtgtgctgcagagcgtaaaactcaatcattttttcactgaagggaccttttggagcaggacccgagcccgcagacattcgaactgtcggcgatattttcctatttttgattagcccccattatcggctttaagtcttggtgacgcctacatgagcatacaggagccagaaatg

SEQ ID NO: 106974 - DNA, 1003 bp, Heterodera glycines
  Promoter: Source sequence=SeqID_19098; Location=398..1400; Strand=+; Gene=SeqID_83841
ttttaaccgaaaccgttcgaccgaccctcttgtccggtctctaataaaaactatgattttcttgattaggaattagaaaatactttgaattgtttaagtattcatttgaattgagaaaaaattcataaaatcgcgctgtcgataaaaattgatgcatttttgtattgcgttaaattcacgagttaattcttttatcatttttgataatttccgtgtcaaatctaattactattctcataaatgacagctttgctcatatgtacatattgcttctcactggtgaaattattattgaaattgttccattaatttgtttagcctttctattgtaaaaaagtcaactgaatttgagatttaattatctaaattaataataaaagttgccttcataaggcacaatttgacaatgaaaagaatgatcttaaaagaaaagaaaaaaacagaaaagagaataaaaggcaatcgagaatagagaaaataaagagaaaaaccgcaagggaaaatttaaatctctcaatgaaaatatttctgatcaaatttttaaaaacaattaaattatctagaagttaaatttttgtttagctttattttgttttgctggagataataaatggaaattaggtgatatttaaatattttgttttaatggtttttgaagcggcataaatagaacatttagagaatgaatttacatattttctgaaccagaatattttttagaattttatttaattatttcaaaactacctttccgataatttttgaaattcaaataattttatattttatttaaatctgtttttggtcaaactcataaattaaagttagttcgaaaaatctgtatttactgctgttcaaacaaaaattttaatgaattcaatttaatttcaataaaatgacgcaaatcccaattattttcttgatgagtttatggtttaattaactttagtcaattaattagtaaattcattttttaaagcttaaatatttaatatttaagatg

SEQ ID NO: 106975 - DNA, 191 bp, Heterodera glycines
  Promoter: Source sequence=SeqID_32645; Location=1..191; Strand=+; Gene=SeqID_62938
ctgaattatttgctttgtatttgttaactaagcattttcctggaaaccctcagcaactaaagatcgttaatcccccgcatgtctgctccacatttcttgaggctgcccgattaagaggtcttattgatgatagtgatgtttggatccgaacgatgacagaggggtccgcctcactcggtccggcacaaatg

SEQ ID NO: 106976 - DNA, 71 bp, Heterodera glycines
  Promoter: Source sequence=SeqID_26071; Location=1..71; Strand=+; Gene= SeqID_56817
ttggtcaaacgccagaatgcaagtaattcactgatgactcctcccaagtggtgcgcatctcgtcaaaaatg

SEQ ID NO: 106977 - DNA, 167 bp, Heterodera glycines
  Promoter: Source sequence=SeqID_22708; Location=623..789; Strand=+; Gene=SeqID_53396
ccgaaaatgcgagggacggatagaaaaaagggagaaaagcatatttcaaaccaataaataacctacctaaaaatgcatcttatgaaaattgttttgttttttgggtgtaaacctgggtcagcttctcgcgaattgccttcagctccttggcactcgaatagacaatg

SEQ ID NO: 106978 - DNA, 96 bp, Heterodera glycines
  Promoter: Source sequence=SeqID_6690; Location=50..145; Strand=+; Gene=SeqID_62506
ggtaatgataatttttttaattaattttaattttaatttaatcaatttttcgattaatttaaaatttcttatttgatttctcaggctgctgtgatg

SEQ ID NO: 106979 - DNA, 129 bp, Heterodera glycines
  Promoter: Source sequence=SeqID_3893; Location=4331..4459; Strand=-; Gene=SeqID_52317
ttcatgcctattcttttaattgtcaattcacccgtttctacgtattgcatccgttcccctaggttgttgtagccaattaaacacttcagtttagctccgttattttcatattttcttttgttaataatg

SEQ ID NO: 106980 - DNA, 287 bp, Heterodera glycines
  Promoter: Source sequence=SeqID_30958; Location=1086..1372; Strand=-; Gene=SeqID_61319
tttcttgtgaaaatttccaaaaaatggccaaaatataggactaaaaacccaaaaatggcgaaatatggatttattcccgaaaacccccaaaatatggatttatatggactaaaaaccttcaccaaatcaaaaaattttaacgcagaaatgctatttttaagcccctttcttcatagcatatgcgcagaaaaaatatgttaatccatataatttacaaccctactaattaaagattaattttaaaattagtttcacgacgcgaaccacaaaaagggcatgtttgtatg

SEQ ID NO: 106981 - DNA, 1003 bp, Heterodera glycines
  Promoter: Source sequence=SeqID_16345; Location=743..1745; Strand=+; Gene=SeqID_80732
tgaaccccaaaaaacataccaattttctcgctggtatttcccgaagctaggtgtggcctttatttgctattctttcattttgttaatttatgaattatgattaaattctataaatttgaataaaaatggtaaaattttggtgataagtacatatatttctgaaggttttttcaatcaatccgagtcttgtacaacaactatttcgaaaactgccctcgtagaaaacgatgctgaccgttaagtgtcgggaaagacgtcttaaactttcaaaaacccaacatttttgatgctaccaacaggaccttttataactaaaattgataaaaattgtcaaaagtttttatgtatacatatatttttgtttttcgaaatgtttttgatcagctaatggccattttccaatggtccgaaaagtctcaaatggcggtccataaagcccctgtaccgtaaaaactgagcttttcttataaacaaagaaaattctgacttagcctcgaaatttaattcagattttacccggttcaaaatccaaagaaaatcggcaatattgaatttacagtttgtattttatttattgtgttaatcttttttaacctttcacgttcgcgtacaaacctttataattgttttgttcggaatctgtataccctggagttgaatgacatttaggaaaaacaaaaataacattaatgtttaaaactccaatataaaaatttggtattcagattttaatttcagttttcctatgaaaacctctgtttgtttttatagcttaaatgttgttcttaaaagttattcaaaaaacaaaattttgaagcctcgtatcttttttctaactcatcaaattgcttagcatttgcttagaaaatgcttcgcctcatcaaaggctttcgaatgatattgtccaatttgattggcaaaaagatcaaaaaaataatttccgaaattagtatttttttaattttttggacaaaaataaataaaaatattcatgtgcacaatg

SEQ ID NO: 106982 - DNA, 620 bp, Heterodera glycines
  Promoter: Source sequence=SeqID_10905; Location=687..1306; Strand=-; Gene=SeqID_74184
attcctgcaatgctttgtactgcaattgatcgcctcttttgcgtcatattcccttatttgtaaccaaattttttaattaattaatataaataaattaaaatttcattcaaattttattaaattcaattaagacaataagaattaatttagcgtttcgctaaaatgcattttattgtttttttaaaaatattttaataaatttgaccattcaatttattattttttgtactcagattatttattgaggattccatttttcggcataaatattaataacaaaaagtaataaattaatccattaaaatttaattaagggccaattagcattcattcgaaaaaatataatttttgtgatgattattgttactattctagtcaatgttttcactggtttatttctgtacagagacaaaattggtaattaatttattttactaataaatgtaaaaatattgatttttaattaccctaattaggcaaacgttcaaccacaacaacatcatgcactcattggaaagttttcaagtcactttcgctggtaatttttgggcacattggcggctttctatgtcttcggcatttttgtgatgccaattttaatgcaaaattcactaattatg

SEQ ID NO: 106983 - DNA, 99 bp, Heterodera glycines
  Promoter: Source sequence=SeqID_32817; Location=1..99; Strand=+; Gene= SeqID_63053
agaatttacgaatatttaatttaaataattcttataatttttgagaataataaaatgtaaaaagtgggcaatagtaatgcataaatataatgacaaatg

SEQ ID NO: 106984 - DNA, 51 bp, Heterodera glycines
  Promoter: Source sequence=SeqID_29957; Location=685..735; Strand=+; Gene=SeqID_60427
acgtatggagcaccccaaaagcatggctcgtgaggcagctgccccgtaatg

SEQ ID NO: 106985 - DNA, 769 bp, Heterodera glycines
  Promoter: Source sequence=SeqID_8916; Location=4308..5076; Strand=-; Gene=SeqID_69632
ttttttgaaaaaaaattttaattttaaagaaaaaaaatgttttagaaggttttcagggtcgctgatcacgaatataacatccatttcgataaatttcgaaccccaaacttttctaataaattatactcttcaaaaatttagtaaaacctaaaatcctgacccggttaatgacgaatatccagtgttaattggaattttggatctgattcaattttaaaaaaaactatttaatcatttcagatccataattaattaatcgatcgatcagtcattctcactcatggaaaattgtaaaaaaagttttccatagttttatttaataaaacaaatcatgatgggattttaaaactaaaaactctcttaattttcaattgttggcattgaacgaactgatcagttttgcattttcatgtattatgttgatcattttatttattgctgatcagttcctatgtctgttgagtctgtttgatcaccaccatttttccgctgattcactctgctccaaataaaacaatcttccgaaacagatgcactcatctacacgctgacccggctgcctgccgagctgctgatcggctccatctttggcatcctcgttggtctcctcctccgcgcgtttccgcgtgccgacgcgtcctccgcacactttgttcgcaccctgctgatcagcgcatttgcgctcgcagcacactttggcgcgcagactattggctgcgcactgttcggaccgatcacggcactgttcgccacggcggtggccaaaatg

SEQ ID NO: 106986 - DNA, 379 bp, Heterodera glycines
  Promoter: Source sequence=SeqID_17521; Location=1854..2232; Strand=-; Gene=SeqID_82027
ttgggccccagcatgtttttggactataactttttcactgtgaaccaaatctaacaatcttagtatcatttgagagctcttcagatgctttaatagcctgcaaaattccaaaaaattttgtcaattttgaacaaatttatggccaaaaaagttggaaaatttggctttttgaattcttctgaccataacttttttgaactttaacgaaatgtttcgcaattttgcaggctaatagaggacacttagggctttcgaatgataccaagaatgttggatttggttgacaaagaaaaaagttatagcggaaaacccgctggggtccaaacgtgccgggcccaactgagccggtccgctcgcatttccatttaaattaaaaatg

SEQ ID NO: 106987 - DNA, 827 bp, Heterodera glycines
  Promoter: Source sequence=SeqID_16231; Location=1341..2167; Strand=-; Gene=SeqID_80608
ttttttctttctctgtttaccttttcgcctttgaattcattcaaaaaatattgccaattgaaaaaattgtacaaaaagttacttcttttttgttgttcaaatctctttcccaggcggggtttaacaaaatttgataaggaaaaatgatggcacttgaaaagaaaaaaaagaataataaaatggatatttacggaaaagcaaaaaatgaccaaaaaaaacacagccctaagaatgaaaaaatttctgaaaatacactataataaaattgaaaaaaatttattaaaaattcatcccgtaaaaaattttttcttgaccaagatttggttaacttaaaatatccatattacaaaaatttttaaatatttgaattaatttcgtttattttgcgttttttgatatccccccgtaatagagccaccctccccctctaagggaagtcctcggggctctctctgtctgttttactaaatttaaatcgttttatgagagttccattgaaataaactttaaaaatttggttagtgccaacgccatccctttttttcccaaaatttctcaaaaaatacttggttaatgccaatgccatccatcactttcttttttcccaaatttcaccgggactcatttgagcatcagtaaaatgaatcccacgaggagtgggggggggctatgtttgttgagattgagggtcaaataaataataataaaacgcatccaagcagtcagaggtcacattttcagcacagaacacagcaaagcacgaccaccaccactcaaccggagagcaaagaacgcggaggcgaagggataactgaccgcccggaatg

SEQ ID NO: 106988 - DNA, 136 bp, Heterodera glycines
  Promoter: Source sequence=SeqID_19301; Location=701..836; Strand=-; Gene=SeqID_84043
aattctttatgttgtatatgtaataactaagttaaactcgtaaaaccctttttttcttaatttaattgcgttagaattgccaaatatttaaattcttttaaaatttacccctgagattaaatcgtcactagaaatg

SEQ ID NO: 106989 - DNA, 205 bp, Heterodera glycines
  Promoter: Source sequence=SeqID_26215; Location=1351..1555; Strand=-; Gene=SeqID_56967
caagaacgacaaaaaccttaaaaaatgcaaaaatctatccatttaagccaacacttcaaacaaagtgtaaaatatttttacctcgttttaaagcctttgagtcagtagaacaaaaatcatttgattacgttccttttaatatttattcgtcataattgacatttatatttgggtttttgtgtgcaacaaattattttcagaaatg

SEQ ID NO: 106990 - DNA, 122 bp, Heterodera glycines
  Promoter: Source sequence=SeqID_6959; Location=3025..3146; Strand=-; Gene=SeqID_63403
atattcctcaattatgttgttattatatatttgtcatattattattattgttattattttctcagttatttaaaattaattacatttatttttaaaaatataagaattttcttttcaggatg

SEQ ID NO: 106991 - DNA, 1003 bp, Heterodera glycines
  Promoter: Source sequence=SeqID_12726; Location=303..1305; Strand=-; Gene=SeqID_76425
gccaatcatcacaagtaaaattttaaactttcaaattttaatttttattttttgaaattaattaaattatttgaaacaacgaatagtttttcaaatataagcgcttggagcatcaagaaatgatgaacattcatgcaatcttttttaattttaaacaaatttaatattttattttttaattaattaaaattatttggtacatcgaatagtttttcaaatataagtgctattttattcttaagtgctggatcatcaagaaatgatgaactttccatacaatttttttaaattgaattttacaaatttcaaaatttatttttttttaaattaattaaatttatttgaaatattttttaaatataagtgctatttaatttgaagggtggagcatcaagaaatgatggacaatccatacaatttcctgatgaatcaacgctacctggttaaattttcttaattatcataaaaattaaatttaatcattatgggacaattaaattcactgtcaattttcataatttgagaattaggtgtgtattaaaataaattgttttttagaccaattatatggggttgcatcagcttttagtcagggcatatcatcgttcgtgaattggttgttagaatccaatagtaattttttttaattcaaaatattttaaaataaacattttaaaataaaaataaattttattttgattggaacataatttcaaatttttcctgtagtaatctatttttgagagtgctgggtcatttcgcgaaactacaaagatttaggaattttgattaaaaacgcaaaaatggaccatggggttcttctctatttttttaaattttaattcagttttgtatttgtgaaatgacccatttttgctttttttcacgaaattagctagaacttaatccttaatactaaagattattcaaattcaaaaaacatataatatacccgcattagatagtgttggaacaattatatttacatctttttcagctaatg

SEQ ID NO: 106992 - DNA, 327 bp, Heterodera glycines
  Promoter: Source sequence=SeqID_14948; Location=1..327; Strand=+; Gene=SeqID_79111
tggaagaaacattttgaatgggggaaagaataaaagagaaagaaaaaatggaaatagtgaaaatttattggcaaatgaaaggacaaaacccaaaataaggaagagaaaaattcaaaaatattgaaattaatcgactgaacattttcaaatggaagaaacaatttggagatgaattaaatgaggattaaaagattaaggagataaaatttccttccgttgttcgattttattctttacgaaaataaatggttttcttttttatacattttggtcatattttattactttatattagggttgctccccgacccatccggttgcaaaatg

SEQ ID NO: 106993 - DNA, 1003 bp, Heterodera glycines
  Promoter: Source sequence=SeqID_6315; Location=919..1921; Strand=-; Gene=SeqID_61121
gaaaatggcgcattaattaagcttttctcaattaaaatttcaattctttccttaaaataacgaaaaaatgcaaaacggaaattgtttaaaaaaaacaaaaaaataaaataataataattaagcgagaaaaaacacgttttgtacggaaaacttagaaagggaatgggtgaatgagtgagtgatcggtgataatgatcagcccaaagtgatcgggtcggataatggcatggattggggtggcaccaaaatatacccattcacccatcaatcattcattccctttcccatcaatcattccatccgaccatttattaattgcccaaataaccacaaaattttgcacttttttgtcggcaattaattttatttaattcgcttctttttgtgcgatgtctgacagaataaattttatggcttttgtttgcttatttgttgtttatttgttctgtcgtcggtgtccctttgtaatggttgcgctttttttaatggtgtaaaaaattgtgcgcgacttttaagaggaaaaaaaggggggaaaagaaaatggaaaaaggggcaattgaaaccgggaaaagaagaaattaaacatggacaagccacagaagagaaacaatggaaatgcgaaggaaagtgcgaatttatttaactcactttataattataagttatttaatattttaaatgttattttattaaaaagcgaataaattaaaatcaaaagaaacacaaaaaaacaattgggaaagtgtaaacaaaaataaaattcaaaaaagcaaggattaaactcattatttcttcggtttgcatcaaagcctgaaaaatctcgaattccttcaaatgttcgatattttgctaatcgcaattttatgtaaaagcaaaaagcaaacagaattttaaacatttaaatgttacatttgtttttttattggacgaagaaaggctaatttaagtgacatgaaaaaaaatgtataataatttttaaaaaagcaaaatatttcagaaaatg

SEQ ID NO: 106994 - DNA, 328 bp, Heterodera glycines
  Promoter: Source sequence=SeqID_9386; Location=2711..3038; Strand=-; Gene=SeqID_71214
atatttcaaaatataggtttcaacagtgaaagtgccatttttgtacaaatgttgctcgtaagtaaaaaattacttaaaaaaatgcataagaaaaattcttcggcgacgagctccgaactcaacttttcgaaaattggaaaaaaatttcaataaattttcttagaaatagaaaaaatttacaaattttgtcctttgtctgctggacacattaaaatgtttgttggccacgtatttacgcgtttttcaaactcaattctcattcattttcatatgcattttgacccctgtttttgagcacaggttcactgtgttcatggtgatcagtatg

SEQ ID NO: 106995 - DNA, 1003 bp, Heterodera glycines
  Promoter: Source sequence=SeqID_18859; Location=606..1608; Strand=-; Gene=SeqID_83560
gaatcactttatgacacaaaatatttaatgtgaccttagtatcataaatcaaaaacggacagctgcacgagataaaaaaaaagtaaacttttcatagataaataagaaaatacccattgctcctattcagcatctatatacctattgaatataacattctaatcataacaaattttaattacttaacctaatactctattagaataactaggtgtgtaaaaaaactgcaaaaaaaatatatttatatattctatttgtttttattgtgatgcttttcaacaaaggaaaaaaaagataaagcagaataataatataatttttaaagttatttttaatatttaaacaaagaattaaggtttaaatccttttaattttagccatcccagaattgatcaaaaatatggagtatagcattcaatagtcacgctatacgcacctgaggcagaggcaactgctcaaaatttgaatatataaatcttaataagaattataaattttttgcctaatttatatttcgagttaagtctataaaagggaatgttaaagcgtttagaaggtttaagtatttcaaagggattcagatctgttcggccataaattattttatgagccatgaacagatcagacagctttcgcctgctttcaagtgtcggcaattgaaggtattctaatctttgttggtatggaatgggtggaaggctgcatttgaaaagaactcttttggtgaaatatttttgacattttttcaatttttttaatgttttttagaagagatggattccaaacctcaggagcatattccaataacggtctaacataagttttgtacaaaataatccaaatcctagaagactttgatttaataacccgaaataaagaacgcatacgtaaatatgcattctttattatttgtgtgacatgattggaaaattgcaatttattatcaatatttatgcctaaatccctaattgtatccacaacattgctgctcctcctcgacatg

SEQ ID NO: 106996 - DNA, 200 bp, Heterodera glycines
  Promoter: Source sequence=SeqID_26392; Location=1..200; Strand=+; Gene=SeqID_57123
taacattgctttaaaaaatattccttaatgaacgatcaacaaaaacaaattttccaatgtataaaatcaaacttagaacatccttcagaaaattgtaaaagctgtttttatatcgacggaccaggaggaactgggaaatcttttgttcaaaatgctttatttcattagcacgtggtttttcaaaaaaagtaactaatatg

SEQ ID NO: 106997 - DNA, 456 bp, Heterodera glycines
  Promoter: Source sequence=SeqID_11477; Location=3617..4072; Strand=+; Gene=SeqID_74880
cataaaacaatttttttttgtttgcattaaaatttcggttgataggtcattttttaaatccgccaaaaatgtcacacgtataaattcataagttgtctcagtttcaaccaaattaatattccttggtatcatccaatagcactaggtgttctctattcaaatataaatttatgtagaaagaaaaaagttattatcataaaagtaaaaaaaaattgggtcagaatgttttgtccataccttttttgaaattcaataaagtttttaatattaaatattaatagagcatttcttagagctatcgaaattccattaaagtttgaattctgactgtagattttttgtacttttatggccataattttttataattgaaaaaaaatttcgaaccgcttggcggatttatgaaacaacccaagacgaaaattttgcattaaaaattatcaactgatttatatg

SEQ ID NO: 106998 - DNA, 218 bp, Heterodera glycines
  Promoter: Source sequence=SeqID_11534; Location=1167..1384; Strand=+; Gene=SeqID_74966
aaaatttcacactttgtcaaatgatacagtttttttttgttcttgttgtttttatttgttgaagggagaatttgaaaggctttgcagttcaatataattatctccaaatcaagaaatatgagataaaaaaatttagaaattttagtgtttaatgggaaaaaaatctttaaaaattcaaaaagaatttgagcattcaaaacattacattcataactatg

SEQ ID NO: 106999 - DNA, 328 bp, Heterodera glycines
  Promoter: Source sequence=SeqID_37723; Location=1..328; Strand=+; Gene=SeqID_66726
gtagttggacatttacggtgctttggctgccaattatggtaaaaaaacttattagtggaatatcgtactgagtgttttgtaaatccgcataaatacagtagttggacatttacggtgctttggctgccaattatggtaaaaaacttattagtggaatatcgtactgagtgttttgtaaatccgcataaatacagtagttgggcatttacggcgctttggctgccaattatggtaaaaaaaattattagtggaatatcgtactgagtgttttgtaaatccgcataaatacagtagttggacatttacggtgctttggctgccaattatg

SEQ ID NO: 107000 - DNA, 79 bp, Heterodera glycines
  Promoter: Source sequence=SeqID_5165; Location=721..799; Strand=-; Gene=SeqID_57125
tcgttacggctgcgaaccaacatatttaagaacgaacaggaggaagaagaaggaacagttgtgttcatccccaaaaatg

SEQ ID NO: 107001 - DNA, 454 bp, Heterodera glycines
  Promoter: Source sequence=SeqID_16450; Location=2502..2955; Strand=-; Gene=SeqID_47367
tgcaggtcaacatgggcattggggcgcagtgcgtggcacaatgtccgcgtcgatggtgcgcgagtgtgtgtgttctatgctgtacggcactgttctgaacctcgcggagaaattcctattgtaattattatttttttaaattttcatgtcaacttattttattttgcttttagcgattttccatttgcacagctaattccgcaagaatttgtgccctatttgcgctcgccatccattcgacttcgctcacgacttgaatcagtcattgcagacagagaccaacttgctgtgacggtttgtttttcattttctactaaatggttgaatttttaaaaatagatttaatcccttcggttcctctttgaactgccaatttggaagtggcgattcccttttgctttaggttcaaattgaatggtccggtgataattccttgcgccatcagccggcaatg

SEQ ID NO: 107002 - DNA, 275 bp, Heterodera glycines
  Promoter: Source sequence=SeqID_1275; Location=642..916; Strand=-; Gene=SeqID_71247
cttttacatttgcaatgttagctgtggcgcacatttactcaatcttgtcgttcagaagagtattagggttgaaaaaatcgctaatttgctcaaacagtgtcgaaaagtggtgtcgcattttaaacattctaacaaagcattggggatgctgcagaacattcagtcaattcttgaccttcctgaacattcacttttacaagtttttctaaaaactttttgcatctaatatttatgtttaggaaatccctgtgcgttggaattcggcgttggcaatg

SEQ ID NO: 107003 - DNA, 331 bp, Heterodera glycines
  Promoter: Source sequence=SeqID_24164; Location=746..1076; Strand=-; Gene=SeqID_54877
tggctgccaattggcattactgaactaatagtaaatgagaagcgaatgttatacttttctccaaaaaaccaattaaagctatcagtagtgtcatcaatttttgcatccgacggtcggacactaataaaagacacgtcacatttttggcatttagcggagagaagtactaacaaacacatcaatcacaatattattttaccatttagttgttttgaaaataaaataattcattcttatacaatagtgctctaatattttttaaataattatatttttagttattcaaaaaatattaaatcctatcactttcaacatccaaacaccacaaatg

SEQ ID NO: 107004 - DNA, 400 bp, Heterodera glycines
  Promoter: Source sequence=SeqID_7721; Location=3702..4101; Strand=+; Gene=SeqID_65729
aaatgaattcatttgacattcgttttcatttaccgaatttatttattttttataaattatttatttggtataaagcgaagatgttcaaaagttgctgcttttcaaattaattatggtcaagtttctgtcgctttccacaaaatgtgcaatttgcagcccatcggcgcattgatcgggcggatggaagcggcggtgaccaccctccgccccccgaggggaaattgtggggctggcgaccaatcgtcggctttgcattggatccggtcgcctttcgctgttcatctcccaccaccgaattggcggttccttcagcagacttttcacttttggcttgcattggcttttgctctttgcctttcgtattttcccttcatttttcgcttttcccaacttcaaaatg

SEQ ID NO: 107005 - DNA, 80 bp, Heterodera glycines
  Promoter: Source sequence=SeqID_5828; Location=1..80; Strand=+; Gene =SeqID_59357
aatttcattacttttgcggtgagtgctaattgtgcatatttccttaattgacataattatatgcaattaaggaattgatg

SEQ ID NO: 107006 - DNA, 448 bp, Heterodera glycines
  Promoter: Source sequence=SeqID_24421; Location=1936..2383; Strand=-; Gene=SeqID_55153
tttcaagacaacaaatcttttaaactttttttataggcatcttcgaacagaaaattttttgtttttagagcgattatttgaaaatactttcaaaaaaaatttatataaacttttttaaaaaaagaaaattttttcaaattttctttttaaaaaatttcttaatattttttcttgaaaaattctgctttgaaatttttaagaaacggcgacattttttcacggcgagattttgggcggcgagcttttggagtgctcccccttcgataattaggctaattatcaatcatttctttgttttttaactctttttttcattatcgtattagagcagaccaattctaatttataattttttgagaatccaagaattaaatgggtgcgacgaaacctggtatgtatcatgtttacatacagtaaactcatatctcataccaaaattacacagatg

SEQ ID NO: 107007 - DNA, 329 bp, Heterodera glycines
  Promoter: Source sequence=SeqID_2555; Location=2632..2960; Strand=-; Gene=SeqID_80397
tccctgaccccctattcaagcacgaaaaaacacacccacacatacacacccgccacacacacacacatacactcatacactacaaaatatgtacgcccgcaatcgctcgccaacgttcaaccaactaggcttacaccgcgtcttagaattatgttaatttatttaaaaaatttcaactatggcaaatttttcggtgtcatcaatcatcatcatcatcactattcgtcggcccactcggccaactccacaaatgagccctccgtgctgttggacgacggcgaaccccacgtgccgaagccggaacagctgggctccgtcgcgcgtccatg

SEQ ID NO: 107008 - DNA, 71 bp, Heterodera glycines
  Promoter: Source sequence=SeqID_570; Location=1961..2031; Strand=-; Gene=SeqID_56339
cctatatgtaattttcatttattatttttatttaaaaattaatgcacattttttttgaatagattaccatg

SEQ ID NO: 107009 - DNA, 243 bp, Heterodera glycines
  Promoter: Source sequence=SeqID_36036; Location=1..243; Strand=+; Gene=SeqID_65480
ccccgctccccgctccccctcccctatttccactcacccctcttccccactgctcccacccttgtgtctgctaacataccatttttaagctgaacaacgcagttttgtgttcctttttggaaaagtattgtcaacgcgccgtgccagaccagtcaactcttcgaaaaaattatttggtccaacttttttctgaggttccaaaattgttcaaaaaattttttcaattttgatttttagacaatg

SEQ ID NO: 107010 - DNA, 222 bp, Heterodera glycines
  Promoter: Source sequence=SeqID_3034; Location=3512..3733; Strand=-; Gene=SeqID_47507
ggaatgccacttaagggaggcactggtaaagcgaagggaagaaaaggaattgataccgtattggagaagggaggcctaccaaaacagtttggcagtggtggaagaatgggtataaaaagaagaagaaaacatgcaccaagtcaccatacaataattggccgaacaatcagcaaaccagcaagaaaacgtgttcgatccgacgcatttggactttactaaatg

SEQ ID NO: 107011 - DNA, 258 bp, Heterodera glycines
  Promoter: Source sequence=SeqID_9267; Location=1253..1510; Strand=-; Gene=SeqID_70804
ggtggggggtcactttggcgcgggacattttggcgccgccagtttaaaagggtcataattttttacattttgatataattcaatatgtttaagtgttctctattagcatattccgttccaaaaaagatgtatgatatgcggcgccaaaatggccagaaaaggtcactttttgagatttttggccacaaactttcgtgtgtgtcccagatagatttttagaaaaatttttaaaataattttatttagaaatcaattatg

SEQ ID NO: 107012 - DNA, 205 bp, Heterodera glycines
  Promoter: Source sequence=SeqID_14085; Location=1355..1559; Strand=-; Gene=SeqID_78059
ttgtcgaatcacaaaagcatcccggagggcgtgccaggcgtgccgcttggccaaatgcgtaagggtaagcggaaaagcggaaaggccaaagaaaagcgaagcggacaaaaggagaaagggaaaagcaatgggcaatcaatcgggcacaatttaaccttagcatcaccggatttaaagtgccattttttacattcagaacggaatg

SEQ ID NO: 107013 - DNA, 83 bp, Heterodera glycines
  Promoter: Source sequence=SeqID_4350; Location=1644..1726; Strand=-; Gene=SeqID_54144
tcggcagcttaaaaggaacggtgcgaagtgcgtttccctctccccccccccccgttgactttgaagtgaaaagcgacggaatg

SEQ ID NO: 107014 - DNA, 529 bp, Heterodera glycines
  Promoter: Source sequence=SeqID_9699; Location=1574..2102; Strand=-; Gene=SeqID_72394
gaatattaatagccatatctttccaacggaatggcaaaaagtggaggagatgagcatacaaaagattttgatctagcgatttgcttggggagaagggtcgggacaagggggagggggactgaaaacttttagggacaaagaaaatgtacgacggttattgtggacaatggaagtgatcggaatgtgagtatgggaaggggtgggttgggcttattcggctatagccacgggcatttgccatcatttttcatatttgttctgtgctctttttctatgcattttataatttttccaattgctttagtccaactgatcacctttttctgtcatgagcatcattcaacctgtcgccacccaccccaccaatttgacctggatggtgctcgagggctgcgtgtgtccccggccggatgcggttggcatccggccggtggactacacaaagccagttgagtgcatccacgtgtcacacgtgggtgatttttctgcgcacctgatgagcaaaccctgcgacaaccccgacaacatg

SEQ ID NO: 107015 - DNA, 548 bp, Heterodera glycines
  Promoter: Source sequence=SeqID_24342; Location=1..548; Strand=+; Gene=SeqID_55061
tctgcagcccttccagtataggtagaggcctggaattttttttgaaaattagaaaacacttcaacttaaaatcctaccagcaagaattttccgctccctgtcctttaaaaaaagttacgggccttcaaacgcaagcaaaagtgagaaattagccgccgggactcagttggccaccggagcaaaaaacctatagttttcccagatgcgcctcaaaaagttgtaagacccttccactactttcagggcgctcccggccttcggccgggagccttaatttttttaatgagtccccctttttctctatatatatataaactagggtagccagttggctttaaagtagaaaaaatacttctggaaccacaatataatcggtattgacataagcgcttcgcgcaaaggacttcgttgctagttcttgcgcggacatgaggccagtttattaaccgtcattagcggttggacaattatttctcctaaatataaattgtccaacccccagggtccaccacgcggaggagcacggtggaaaactggcaaaaaccatg

SEQ ID NO: 107016 - DNA, 67 bp, Heterodera glycines
  Promoter: Source sequence=SeqID_8190; Location=680..746; Strand=-; Gene=SeqID_67260
cgtaagttttattttattttattttaattgttgaatttaattaatttaattaaaggttggggccatg

SEQ ID NO: 107017 - DNA, 199 bp, Heterodera glycines
  Promoter: Source sequence=SeqID_36208; Location=927..1125; Strand=-; Gene=SeqID_65585
aaaactattttcaactatttttgcttgtgaataaaaatttatgaaaaatgcaataaaaacgaaaaatacacccctaaatttgaaatatttagcaactatttacccatttttagcaactctttttggggttttttagaaactaaaaacaaaatacctattttggcagttttagcaactataaatatacgccctgctgatg

SEQ ID NO: 107018 - DNA, 185 bp, Heterodera glycines
  Promoter: Source sequence=SeqID_11012; Location=1..185; Strand=+; Gene=SeqID_74330
tgaaacaatcggcggacggtcccggcgggaaacggttgttcgttgtgattgaggactgcagtctcgaagtggccaaagtgtgtaatttttgttgcccgggggggggggtgttatagctgtttttgtctaaaaaataattcttttaatagtaatttgtgggtaaaatccatgcatatgataaaatg

SEQ ID NO: 107019 - DNA, 686 bp, Heterodera glycines
  Promoter: Source sequence=SeqID_618; Location=8416..9101; Strand=+; Gene=SeqID_57575
atttttgaacaaatttgcatttaattatttattaatttaaatttcatttcatttctctattttattattcatccatatctttcatcctttgcttttgcgatcactttataagtcgttggagacaagaagaaaataagcgatagggaatttcacagtttaataaaaagcggaaaatgtccgtgagcggaaaaaagggggaaagatggaaaaattaaaaatctgttctcattcgcttaactttttaatccgttcaacatcttctctctccgattaaaaattatttattaatttcgaattttcgcaccgtaataaatatttgtcaccgggacattgtttgaaggttacggtaggggaaaatttggtactaaaaatcgtttcaccgggaaacgggaattggtccaccggggacttttgaaaacaaaatctgtcaaggggttggcccaccggaaattaaaagtgattggcaaactctaatttgttccaccaaacaaaggctgattgattgattcattgtttgattcttctactgtcattggacgaactgacaaaagagaacagcggacgaagagcggacttcgacacgtggcgacccattggccattgcgaaccgaattgtcaaaggtggacagattcaaatttttgttaaaatttgaaaaagctagttggctagcaaaaattttaaaatg

SEQ ID NO: 107020 - DNA, 444 bp, Heterodera glycines
  Promoter: Source sequence=SeqID_41906; Location=723..1166; Strand=-; Gene=SeqID_69941
aaaattttctcacttgtattgcaaattttataacttgttgcaattgcgatcaatttgttgtggaaaagaaaaataaatcgattttatggcatttacagttgacaagattcccggttctaatctatttttaaacgcgttctaatacaaaaagctgcaattaataaaaataaaacctatttaacatcagttttgccgataaaaatccaataaagacagaaggaaatttgtaataaaatcgagcatatatgaaaatttcagaactttctatacgagtatgtaatattcaatttaacgagctgatcttcactttgtttagttaaattcttgacctttttaaagggtggttgtatacatgtagaaaatggaacaatcgaatgttgattactgcagaaaagatagaccgtattacgaaaaataatgaaaaataaagccaacctttaaatg

SEQ ID NO: 107021 - DNA, 899 bp, Heterodera glycines
  Promoter: Source sequence=SeqID_3426; Location=3580..4478; Strand=-; Gene=SeqID_84641
atttttgttgagaccggtgagacccgtttgtagttatggacacctactccaattccattcctccgacccccgagggcattcgttcgtaaatggtcagaccgccccttccccaccagggacgggcgaagctcggctcggcactcgaagccgaaggcgaagcccaatttttttcgaagcacgaagttcgaagcccaaaaaccgtgaagtttcgaagctttcgaagctcgaagtttttcaattttttaatccaaaaaatttatccagatagtaaaattcaattaaatttcgaatttaaatccataaagaggcaaattctgttgaagaaaaaggagttctttcaacgtttctcctgctaaatcttttctcaaatctgtcacaattgagaaattttaaaatatttaatatatttgctttgtggtggcattttcaagctaaaaatgtaaaatgtgttaaaaatcatttaaaaagagatatgcaatatgtagaatataaaataggtaatattgaagaaatatttaatttataaaattcataaacattatcaccattactcacattaagatcaataattaggggagtatttttacttcgaaaactcaatctttaggggtgcatttttcccgaaacttcgagcattttcacgaagcacgaagctcgaagtttcgcccgtccctgttccccacacggacggttttaaatttattcccggggctgtgtaatgtcttggctgtgtttttggtcgctgtgttttggtgtgcattgtttttgattggtgtctctcaaaactatcagttggatattattcaattttacatcattttttacttttttcaaaatggtcatttttcacaattaatgttttttaaatgtaaaccaagaaaaattctctaaagctgatg

SEQ ID NO: 107022 - DNA, 346 bp, Heterodera glycines
  Promoter: Source sequence=SeqID_723; Location=851..1196; Strand=-; Gene=SeqID_46155
attagcaataattgccttagtgaatgctttaaacgagagaggattttaaatggaagtattaaaccgattcccttcagataacgggccgaactctcatgaagagacatttttgaaattggtcaaacgccatttgacttcggcatttccctccataacttttgtgtcgctattttcctcttttctttcatatattttgttaatttttacgggtccattcatttgttgattaaattttcaactttttttttgtttgttttattatgcatttgtttttttcaaattttttttactgattccatttcctttaccattttatatacttttttccaaagttttcttcaaaatg

SEQ ID NO: 107023 - DNA, 72 bp, Heterodera glycines
  Promoter: Source sequence=SeqID_30195; Location=1..72; Strand=+; Gene= SeqID_60630
aaaatggaatttatttcaatttccatccaatttttaattgttgcttcgcttttatgcgttcccgcaattatg

SEQ ID NO: 107024 - DNA, 91 bp, Heterodera glycines
  Promoter: Source sequence=SeqID_13600; Location=1823..1913; Strand=+; Gene=SeqID_77501
taatgattgacctggaattttaattgggtgctgcaaaaactttaaaccctattttaaataagaaaaaatgaatataattttttagaaaatg

SEQ ID NO: 107025 - DNA, 867 bp, Heterodera glycines
  Promoter: Source sequence=SeqID_3778; Location=1..867; Strand=+; Gene= SeqID_51842
aatttaaaattttatagaatatataaaaaaatttataatattttaagtagtgacccgtgtacttttgtcgccccttttggcgctaaattcaaatttgaattttcgcgtcgatactcggtgggtggagggacgcttgctggggaggaggggagggggcgcgctttggggtgtggggcggtgccgtagggtgtaagacctatgttattttaattaaattttattttaaattaaattttaattattattttaaattaaataattcccaaataattatttcccatcagtgggggggggcgcactcattgagggaagagatgaactttattatatgaaatgtgaaaaataaataaaaatgaaaatgataaaacaaagggatcagcaatgagggcaatcactgcggcacttctgcttccaatactcaacaatttgcctcatccttttgtcacggtcgcttcgacgggacgaagtggtggacgaagaagcggaagaggaggaggacaccgagctgaaggcagtgtccggtatgttgtcaaacagaattgctctggcggacgcgatctgttcggccgagaggcgcttgtaggcagtgcgcacacattctctaggaatgcgccgtgaagacgaagggacctaattggggaaatgtttatttcacatttataggtaaaagtgggtttaggctaccgtttgcaaaacatcgcacaacggcagaggcaccggggcatcatcgagcggaaaaggcattgcgaatggtgggaagacgggcagtggtggcatgcgcatttgcaaagtgctgatcgcctgttggacggcagctgaaagcatcggcgatggttgttgctggtgctgtgttgccgggacgcaatg

SEQ ID NO: 107026 - DNA, 233 bp, Heterodera glycines
  Promoter: Source sequence=SeqID_2147; Location=1215..1447; Strand=-; Gene=SeqID_78076
ttctgagttattttctgaaacccgaccccaaaaaagttataaatcgaaaatttttgaaaaattccgaatttatcaaaaatatcggaattcagtgccatccctggtgtgttccaacatttttggcaaatcactgattgttgttttccaatcaaattgtttagcattttctccgtgcgaatgccatttcttccgttagttacgaaattcattttcctgttcatgcgccgtcaatg

SEQ ID NO: 107027 - DNA, 231 bp, Heterodera glycines
  Promoter: Source sequence=SeqID_37175; Location=1..231; Strand=+; Gene=SeqID_66320
agtcaatctggaaattgaaagaagcagttactaaaaacaaccttttgattgaaactgtaaacagaataagagctgatccctcaacagtgacgaatgaagtacaaaaagattaatttaaatgtttaaattaattatttaaacattcctatttttactcttcttttttacaacattttctatatattttttgtttttcttatgtagttctttcccgagagtgtgttatatatg

SEQ ID NO: 107028 - DNA, 451 bp, Heterodera glycines
  Promoter: Source sequence=SeqID_43736; Location=676..1126; Strand=-; Gene=SeqID_71342
ttgtatgagaaaaatttaactaaaattgaaagattaactaaaattatatgggaaaaaaatataaattaacaaagttcaatagattcgactgtttcaactttagaaaagcattatagggaatttactctaaaattgaccgggaaaataaaactactaaaatgatagagttagaatttgcggttgaaaaacattattttaggggaaaaaatcataatctcaaaaaattgacactcaaactcaaaacagggatttttaagaaatctaattctttctctgctttttctttttttcataataatttctctcagtttggcgtattatctcttcttttaatagaaaaacagaatttactctatgcatgaataccccaattagttacctgtaaaattactagataaataggtattcaaattatttaactaattttcagatcaatttattaagaacaatg

SEQ ID NO: 107029 - DNA, 420 bp, Heterodera glycines
  Promoter: Source sequence=SeqID_15555; Location=170..589; Strand=+; Gene=SeqID_79839
tttgagaaattaattaacccgttttctttaaaaaaataataatttaatcgctgaggaatgattaggaaaattggttcacaaaagcataaagatagccgctaaaaatgaagaaaagatttcgacgatgatgtcaattttgttttggttccacttaattacctagctgtgaaaaatttttagggctaacggcaaaaaaaaatttactccaaaatttggattgaatttttatggcataatgttttttgccaaattttaaattttcatactgttaaagctgtacaaagagacaaaagattttgccaatttctcttatgtatgtctttccctcaccaaaaaaggcatttttcatttcatctaattgattgttgttttggagtgtttcttcgctttcgtgtcttcaaatattttttgttaaaaatg

SEQ ID NO: 107030 - DNA, 261 bp, Heterodera glycines
  Promoter: Source sequence=SeqID_42049; Location=621..881; Strand=-; Gene=SeqID_70047
attcggccgaccaaataagcaaacaaacattcccaaaatccttcctttcttctcattgtcatgaattgtgtattatgatgatgatgatgaatgggttcgttgtgttgatcggtcgcgttgagaatggatccgtccgatcggtcgccgtttcgcgccttttctccgttttgtcatttcctaagcaaacgatttgcccggggtgcgtaatgaagtgaacgaattttgcacaaacaaaaattgaaattggaaaggagaagaatg

SEQ ID NO: 107031 - DNA, 908 bp, Heterodera glycines
  Promoter: Source sequence=SeqID_7721; Location=2435..3342; Strand=+; Gene=SeqID_65730
atgacggctaaccagcaaattgcccagcggagaaagacgggaaatcggaaaaattaaaacattggcaataatcgactgactaatgataatattgcaaaatatataatatttgaaatttattttcattcttttaattaatgttgctttgataatattttttaattttctctctgaaaatggactgtcaatcattctcctgcattttcaaaaaagcccaccgaccgacccatcgcccttttcaaatcagcagatgagccacctcacctgtcaaccattcgttaattagtgtcccatttaattaatttccccccccccccccataaaatttgtccgattttaaaatgccaattttatattctgccctttttcgtctgttcctccctttggttgtcccttctcttttttgggtcgctttggcttcgatggaatgcagcgaaagtgtgctcagagtgagcgatttaaccaaagccaaagaaagaggtacaattcggcattttgggcttgccttccatttcaaaaaacggcgattgtttaattttgaatttcgcctctccccctttaccgtaccctctcccatgtacagtacccttccgtttgctgaacctttccctcgcttctttggatgtgaatatgcgccccttttgcgactctgagggccattcggccgtccgattgcccggctttttgctcattttgtccggtattctttcgcccttccctttttctttttccaatgccttcgttttcggccaaattgtcctttcgcgccctttgcctccactgaatgcgtcgtcccttcgtttgtctctcactttggagcaaaactccgtttgggtgggccgaatttgtgacaaagggcgaagtcaaagtgcctttttgtccgacgatttttggtgaatttcgaaatg

SEQ ID NO: 107032 - DNA, 435 bp, Heterodera glycines
  Promoter: Source sequence=SeqID_446; Location=1..435; Strand=+; Gene =SeqID_52986
gggtcggtttagtctggcccgtttagtctggccgttttagtcagagggtcggtttagtctggccgttttagtcagggggtcgttttattctggttagctgtttttacccacaaattaattactttttataaatttcttttgtttgtcaatcatatacataaacataacttgaaaatgtctgtttagctacaaatcaaatggaaaactccaatcaggaaataaagacaaagcgaaacaagcagaagctggaacatgagggttcactttatgttcttcaccaactcagtgacgatggacttcggaagtactggcgatgcgagtttttcgggcctaacgacaaatgcaaaggtgtatgcaaaaataaaataaagactatttttcaaatttagggcgcattcacactgatattcatggtaatgtcctcaaaagttcatg

SEQ ID NO: 107033 - DNA, 752 bp, Heterodera glycines
  Promoter: Source sequence=SeqID_5244; Location=2402..3153; Strand=-; Gene=SeqID_57425
ttcaaaatctattggccgttgtccgtcgctctttcattttgaacgtcttttgtgaccacgagtcgctgcagtgtgaattttggtgaaaaataaattttcgatttttgttcgaatttgggtccgggttcgaaatgggtcgaaacggatgccggattcgtgatcagtggccccaaaaaccccaggagagatgttttaagcgattttaaattttttttattttttttgaaaaataggggggacaaaccaaagtattaccaaaatgtttaggtcgtttcttaggggtgtattttttgattttattgcatttttgtttaggaatttcctaaaaatgtcgaaatagtaaattttcactatcgagaccgaaaatttcccgagactcgagaccaattttttatggctctaattttttgactcattttacgaacaaaatctgtgcacaaaaataaaaaaggcttcttcgtgatcgtttcgtccatctttcaccattaaaaatttcaatttttatccatattggaagcaagaaaatgacacatttttgccattttggggtcaattctcagaagttgtttaacagaaatgcaatagaaataatttttttttgacgcgatgacatttttggcgacatgttcaaaaaaatttcaaaaattttccactaaataaatcagctgaaaaataatctcccagtctccattaatctgccggcctccaattatctacccccttctgaggaggttgaaaaataatataccatg

SEQ ID NO: 107034 - DNA, 54 bp, Heterodera glycines
  Promoter: Source sequence=SeqID_24664; Location=1059..1112; Strand=-; Gene=SeqID_55402
tctttggatttggtaattttattacttttgcggtgagtgataattgaatttatg

SEQ ID NO: 107035 - DNA, 565 bp, Heterodera glycines
  Promoter: Source sequence=SeqID_29721; Location=608..1172; Strand=-; Gene=SeqID_60189
ccggtccgtctcttatgcgcatgtccgactgcttaatcgtcgggttattttcacgtgcaatttgttgtcgcaattggtccgctcgttgctgcttctcatgaatttggcgatccaattgctgcaatttttattccatttatttgttttgtcaaaaaatatccataaaattgattttaggacaatgaatattcattaattccatttattatacacagcggcccaattttgggctctcagtgcaaataggtttattatttatttagtaatcagaacgccaaaactttgcaaaacttaaaattttttggggattttcccttgtaaaaatataagagccgatctcgagttaaaaactagacagctaaaaaattaactgtgattcgatagaggaggtcaaaatatgggcatatgcaaaatttgaagaaattttaaaagctagaaattttttttgaaagggacgaacatttaactcattttccagaaattttaatattcatttcaataatgccaaatcaaccaaagccattttggtcttctatgcagaagcaagacgaaagcgaaaggaatg

SEQ ID NO: 107036 - DNA, 78 bp, Heterodera glycines
  Promoter: Source sequence=SeqID_6272; Location=2430..2507; Strand=+; Gene=SeqID_60976
agctgggtatagatgagtttggcatttatgagttggtttataccccggttattattttttaccacggtttgaaaaatg

SEQ ID NO: 107037 - DNA, 285 bp, Heterodera glycines
  Promoter: Source sequence=SeqID_19685; Location=322..606; Strand=-; Gene=SeqID_84425
tggcgagagggcaataaacaagacattcacataagcacattttgttttttttatcactttttggctccgaaaattaagtccttcaagtcgaaaagacggacgaaatctcttggcaaataattgaaaaaaatcaggtctatttttgttgacgtaaacgctaccgattgtgcgcccgattgaactgttcctcttatacttgtcgcctttgcacttaattgtaattggtaaaattcacaatcaaccgggtttccaattaccttaatgtcctcccgagctttccaaatg

SEQ ID NO: 107038 - DNA, 731 bp, Heterodera glycines
  Promoter: Source sequence=SeqID_7114; Location=631..1361; Strand=+; Gene=SeqID_63880
aatgactctgtgcttaattaaatgataaatttggcatttaaacggatggataaaatttgaaaaaaaagtttttttaatcgacaaaatcttttacatgaagctgtaaaaataataagtgcaatttgcgcttgacttcgtttgttcgtttgcttgtcttttgaaaagttcggtcattattttgtttttaaattaaaaacatttttgaatacaaagacgaactccggttaattcaactgtttcgtgcaaattataaaatttcagtgatcttatgaaaagatggccattgattgggccgattggtcagcccggggctgcgacgaggggacccattttgggtgtccccgagcccaacagaccccagaccagggcattgtcaagtgactattcgaaaaatttagatagtttccctctctattggaatagtttaatgagtgtaaattaaattcaacgaaatcccctgctgatttaactgattatgagtcactttccctcccccctccccctccctttccatttgtctcatccgtcgtcgattttttggaccattttactgacaatccttcaaatatttgtgactgttaataaaataatccaaaatttactacaataaaataacggataataaaatgcgttcttttcgccgtttctttgaatttctcatcgttttaaacttttggtcgcacttttcgtatgcgaaagaggtaataaatgcagacaatcagttaacaatg

SEQ ID NO: 107039 - DNA, 289 bp, Heterodera glycines
  Promoter: Source sequence=SeqID_22608; Location=543..831; Strand=+; Gene=SeqID_53275
acctgatctctttcaatgtgaagaaattcctctgtatttctctcaatgctaaataaaaattgtgaatttgagtagtgtaattgagaagggatgggtgggaagaatgtcattcggaactgtcacacgggactcagttctgagtgcccatcttcctccacttttttcaattctgtcttgtcaaaatgggcggggcttagccctttgacaagtgtatataaacagttggtattcatccattcatgtcatttcatttgaaaatttaaaattctgttaaatggctatcaatatg

SEQ ID NO: 107040 - DNA, 1003 bp, Heterodera glycines
  Promoter: Source sequence=SeqID_14797; Location=358..1360; Strand=+; Gene=SeqID_78947
tctgtcttacttaaaaatttttccaacccctaacaattttttctctcgaaaattttaccgatttcatgtttaaattagttcatcagaaagagtgaacttcttcttcttaggtcaacattcaattttgcttatattcaaaatttgaatatgaaaaagtttttcatattaacaaaaagatttaaaaaggtacatttgaattttggatcatttattgtattaaaaaaacagtacaaaaacctctaatggccgatcattttttcactgatcgtttcgtcactgagaaataatttttaaattattagtctcagtgacgaaatgataggtaaccatttaaatgccaaatagaaaaacgaaatgcaaaaactttgtaaatatttaaacagaggacaacgatcgacggaggcgaaaaagggaaaaaattttaatgtaaaaaagctaaacaaataaattattttcctaaactttcatataaaactaaaatgcggcactctttcccatataaaaaccaatcaaaaaagtcaattttcataataataataataataataataaatttaaaaataaaacatttaataaatttttagacattattttctaattctcaaattttcgttttttcattcgcattcgggttatccatcttgaaaatggaaaactttatttttcaaaaaggctaggggtaccatcggcattattagctgaaacccaaaaaccgagaaatttgtcgactaaaaacaatagattctcggaccacccttgagccaatttcttttttaagaacttttgtttattatttttaataattttcatggatcaaaggccttaatgacaaaaaaaaaataaatctaaaaaccaagtcctacccataagttagttattcaaaaaaaaaccaaaagccgaaccgtaagccccctaatcttaataattaaaaacaaaaaattccaattttacccttaatttcaacatttttagttttcccataaacgaagaaattttcataatg

SEQ ID NO: 107041 - DNA, 469 bp, Heterodera glycines
  Promoter: Source sequence=SeqID_7702; Location=154..622; Strand=+; Gene=SeqID_65675
gatgagagagagagaagaggaaagaaataaagcgatggagagaaaagagagaggaagagcaaaaagagcaaacaaaaagaagagagagacagagggaggagagagagagaagagagttacaggcctgtaaccagaaaaaaacggtagctgcacccgaaggcctttttaaattgggatccggcggttccattaggcacggcctgggaagtagaaaagttagggcctaatttgttagaaaattaagtgaatattaaaaaattactcatttttctgaaaaattttagttttcattttagatgtggttacgggcctgctgacgattttaatttgtccatttatatatttgaggggggggggggggggggggagaaacattaaaaataaaaaaattatacatatttgtcctttttagtctacatttattcaacaatttaaaaaatgggttcattcggagcctgtggtcgacatg

SEQ ID NO: 107042 - DNA, 156 bp, Heterodera glycines; identical to SEQ ID NO: 102245
  Promoter: Source sequence=SeqID_25648; Location=468..623; Strand=-; Gene=SeqID_56399

SEQ ID NO: 107043 - DNA, 275 bp, Heterodera glycines
  misc_feature (59)..(60): n is a, c, g, or t
  Promoter: Source sequence=SeqID_18558; Location=1438..1712; Strand=-; Gene=SeqID_83185
agtgatcccaaaaggagattatgcacccaatctttcatccaaaaatcaatacaattcanncgaaagttaaccaaatcaaagacacggagacattaatttcggcgctcaaatcaacacattccgatgtcttcagcccagaattaggtcactgcaccaaattcaaggccaatctcattctgaaaaacggtgctaagcctatctactgcaaggcaagaccagttccacatggcgctttgaacgacgtaaatgccgaaatcgatcgtctactgaaaatg

SEQ ID NO: 107044 - DNA, 575 bp, Heterodera glycines
  Promoter: Source sequence=SeqID_26961; Location=1..575; Strand=+; Gene=SeqID_57699
ttccactttttaatgagtcttttttggcatttagtgcctaattgaaatagcacaaaatgcacagaattgatgggcaaagagggaggagcaaattaattaattttttgaaaatgtatattttgagtaaattaatttctatttgagggcgaaacgtgcatcacgcagctgagatctgtctgccggtcgattaccattaccgcgctgtcccatcccgtgaaagtcaattttgtggatcaattgtacgcggataagttgtaataaaatgtaaacatttaattttataatttcataatttcttttggcattgtcggaattgccaattcaatcgaaagatttggcggaccgttcccgagtttggatgtgtttggtctcgaccgtgacgatccaaattatgtaagtttaacacctgtcgtgcagctgtgcagctatctaaactgatttaaaaattttcggcaagtatgccgcaatttttgtgtgccataattcacctcccccaaccatcatccattttgcagggtttttgtattaacgaatttcgttgttaatggtacatattttaggcgaaccgcgtgatg

SEQ ID NO: 107045 - DNA, 288 bp, Heterodera glycines
  Promoter: Source sequence=SeqID_37490; Location=1..288; Strand=+; Gene=SeqID_66552
cctcccccccttccccctccctcttccctccccgtccatttgccctctccccttttttctctcatttttcgtttttttttctttcccgccaaactaaaaacttttcacttggtgtggttaatctttccgctgaattttgggcgttgtgcagcagaacaaatctttggcctgctgcgctcgctccgctgataaatattctccgaccgtcggacacgcaacctttaaaattgttttttgtcctttttatcaaattttcttccttcggtgctttttcactgtgtgcaaatg

SEQ ID NO: 107046 - DNA, 509 bp, Heterodera glycines
  Promoter: Source sequence=SeqID_5644; Location=1447..1955; Strand=-; Gene=SeqID_58752
tggcacaaccgcagcagcaacagcaaatgatgatggagcaaaatgtatgggggaggggggggggaaatagcggatcaacgggggggggggggggtaaaatctagcaggatttagacggacgaatcccacatgaactagtccttttgtatgttttccgacaaaaaatgttgtaaatttaatcaaattaaacatattttgtaatttaaaaaaattatcatttttgaaaggttacgaacacaaaaaaatttattgtgattttttgtcaaacttagaaaaacaataaaattttcttgaattttgtatggagatatggaattttaagggctatctaatgatacaaagaatgtttgatttggcgccgaaaaacagtacgagtcggggcaatacgcacgcgttggggtttttaccgatttcgaccctttgagtccggtccccaaattgtcaacaaagaaaaaggaggatttccgcaattctaggtacagtatcaaagaaattactcggcacagatg

SEQ ID NO: 107047 - DNA, 141 bp, Heterodera glycines
  Promoter: Source sequence=SeqID_2324; Location=32..172; Strand=+; Gene=SeqID_79126
ggtatgccagaaaaatggctatctctttttgggacaaatttttagcgaacaaatgctcgcgagcaagagccgcggagcggtaagcaactgccagttaattttcagagaatttccaaagttctcggttatgccagaaaaatg

SEQ ID NO: 107048 - DNA, 59 bp, Heterodera glycines
  Promoter: Source sequence=SeqID_28820; Location=1..59; Strand=+; Gene= SeqID_59391
atttccctcattcatcgcggtggtcatcaaaaaagcctaccacccggtaaacaaaaatg

SEQ ID NO: 107049 - DNA, 624 bp, Heterodera glycines
  Promoter: Source sequence=SeqID_18129; Location=117..740; Strand=-; Gene=SeqID_82711
tcgcaatagttggtttcttaaccttagattagttttgagacaaaaaagaaaaggaaagaaatgagaaattgaaaaattgaaaaatgcagataagagaaaaagggaaaggtaaatcggcgaatcagcctttttaaatttcaaaacataaggccatacaattaattatttattcaaaatttctctgcatttcattttattcccaaataaatctacttatatatccgcccttccaatgtttgcagttacagaaattactaaatttttaattcatatttttttaattactgactttgaaaaacaactgcttaatttatctcttatcattgaaataaatcaaattaagattcaataaaaaattttaatgcatttgtcagtttgttcattattgctaaaaaggcttccttctacacgcttggccactacgcttgctaatgttagggcaaaaaatgtgaagcagccgtcgactgagcggataaatgcaatttctctggatgatttcccgtggggaagaaattaaaacgctttattctttagtaatttagaattgcttatcctgattttcttcgctccgaagtttttgatcgtagagacccgttgtttgaacaactcgtccaagcagacatg

SEQ ID NO: 107050 - DNA, 234 bp, Heterodera glycines
  Promoter: Source sequence=SeqID_44809; Location=160..393; Strand=+; Gene=SeqID_72222
gcaggccaacgtacagcaacaaacgggtgaatgcagaccagatacgccagctctgtccgtttccacctcatcggtttcacgtcctctttaactctctcttcaaagtgctttgcaactttccctcacggtacttgttcgctatcggactcgtggccgtatttagtcttagatgaagtttaccacctgatttgggctgcgatcccaaacaacccgactccaagacacgtaaagatg

SEQ ID NO: 107051 - DNA, 726 bp, Heterodera glycines
  Promoter: Source sequence=SeqID_14689; Location=903..1628; Strand=+; Gene=SeqID_78801
ttcctgtataattattcacggaagcggagggtctattaaaaataaataaataatttacactaaataattgatttaaatttttttaaattaactaacaatcagtatttcgagcaaatttttgtttttgtgaaattaaaaattgctttaagaatttttttaggtcacatttttgctagaagagctgatcgagaataaccaatgttgttgtcagcaaatttccggcatcttcatttattgagaattttcaatcgaattgtccgattgtctcctcactgtgtctgtcagacgacggaattattctccgaacggtttatttcaacttcctttcttttgcgtatgttcattactcattttgtttaattctaattctgtttttacattcattctttcactgttccaaaacttttgttcagcggatgcttttgcaccaaaaaaagtcgtaagttcctttcccatggcttctacatgttggaactgtcccaagttagttaatgctgtcgctttcactacatttttcattctctcagctgttcctttcgaaattttgtcacccgtcgttcatgtcgtcgatgtgattattcgcggacggaagaagaaataaacaaaaacaaaacaatatggccatgttcagagtgaatccctaatatcattagtaaattcctaattgcctattattgacaggtgcaattccattaattacattgacagaaaaacgtgccacaaatg

SEQ ID NO: 107052 - DNA, 65 bp, Heterodera glycines
  Promoter: Source sequence=SeqID_925; Location=1677..1741; Strand=-; Gene=SeqID_64150
ggtatatttctcatttaccaaaaaaaaaaaaaaatttttttaagcgtgaatcattgttcgaaatg

SEQ ID NO: 107053 - DNA, 1003 bp, Heterodera glycines
  Promoter: Source sequence=SeqID_4304; Location=3823..4825; Strand=+; Gene=SeqID_53967
tttcaaagaaaaaaattgttggaattttaaaaattgtaatttacaaactgaacaattataaattttattattttttgaaacaaatcaagtagcaaagataagccagatttaaggccatattcggattctactgctctaaacttttcagaagaataatttagaagtcggttttgttttatcaggtttcattaatcaataaaatacaatcctgtcgatacataagaatattaaataccacacattctccatcgcttttttctctttctttgttattctctctttctctcggtctcttttcttccctttcgcacgctcccttcctcaactataatcccggatgtctacagtaattcaagaaattgattttattaagaataatttaacaaaaaattggaaaatagccgggaatatacttaaacgatcaaataatcttgaaatctttgcaaataaactttttaaaggtgtgaaaactttctacataacaacatttagtgcacctggaatcgaaaacttatatttttcattcttagaaatgctcaaaaaaattcaaaaattacccggtcttattatgggtgaatataggaaacaggccttagctatgcggaaactagaaattggcatcaaagaaacagatatatttaaatgtcaagaagcagagaatatatcggacctttgtttttcaaagataaatgaattcgaaaaacaagtgcaaaattatcggtttaacatgagaatgttatacaataaaattagaataacagcagtaaagcatttgtttaaacccgaaaaagaaatattttttagtccttttagaatagaaagaaatagagaaatattttattctatatctaaatatatttaataaaaattcaatcttacaaaatcaaataattgcgactaattaaattatagctcgcatagttttgtgtaatatttgagcgctactcgtgcaaaaaaaaaggggttaagcgcgctgcgaagggcacaacactctcccacaatg

SEQ ID NO: 107054 - DNA, 1003 bp, Heterodera glycines
  Promoter: Source sequence=SeqID_13462; Location=1233..2235; Strand=-; Gene=SeqID_77353
aacaaattggacagctttatattattgggagctttgaccatttgctggatttatgaaattttaaaattaatttatccgacaatttatttgatgatgctttctgtttggtaccgatgacaagtggcaaaagaattaaaattaatgagaacaataaccatattaaatgccggcatcccgatgacgtagctcgaagttttgttaagttttgagttgcgatgagaaaatgaaagagatgagattttgttttcggggagggcccagtcgggtaatgggacggccaactcttcaaaaaatgaggcgaaaatcttttcagcgctactgagcttagataagaatcaataaaatagtaaaaaattgatttaaaatataaaaattatatttgctgaatttttccatttaatgatatttattatacccaatttccaaagaaaaaatggtttttttggcattcaacaaaaaagataaattattaagaaagttgatactcgggctttttgatattcaattaacttattgttcttcaaaaataataaatcttaatatgttttgaatagatttttaactaattaaagaaagtcgtaaaatttatgaaaatttttcgaaatttgaaaaatttctagttctctaaacaaaagttattaaacattaagaatttaaaaatctttggtggagaaaatgattaagctgtgtccatttggaagtgaatctatttcattttacttttttcgtttaaaatgtttgtgaattttgatattcatgcattatgatttattatcgtaaaaaattgatttaataatatattaaataatttcttcatataatgtataaacattttttaaaaattattttattgctagaatatttcgctgtaaaaatgaatttatggcatttaatatttataataatttttcttacttataatattgaaaccggcaaaatcctaccaaattttgatgaaatatttggtgacgaatgggacacaaatgaaagagaagcagaaatg

SEQ ID NO: 107055 - DNA, 733 bp, Heterodera glycines
  Promoter: Source sequence=SeqID_27928; Location=1..733; Strand=+; Gene=SeqID_58592
tcagagatttgttatttgtattcgaaattggcaaaacgtttcctttctttgtgctgcttgacgccaatgataaggtaagaaatatttataaaaattaaaaatttattcaattttaatttcaatccaaagattgccctgtgcagtaatattgcgatgccattgtattcactgttcaaaaatttctactcagtccaacaaaattgtgacatcgtttgtaatccttctggggtgcttaccataaatatctttgcaaatacatattacaatgaagatccagtgtaagtataaatggtatcggataggcggaagcattttgctttaataaagcaatcaatttaattttttgtattttctaaaaaatttggttcttaaaacattttttaaaccattcttcccggataaaattataaaatcgtttgactgaaatccctgttctttttggccaaaattagtttttatctccatccgttttattaagagtgaagaaaaaaccactaaaacttcattttataaaattgaaacaaaattaccaaatttatcaatttatgaacattttttaaattaatttattttcaatattttttcaacagcgcctatcggcaggtgggtgaggctaatcctcccatcttaggactttatttaaaatattttggtgcattataagtcaaactatttgaaaaacccaaatataaaattataaataaatgaaataacatttaattgcagtgccatg

SEQ ID NO: 107056 - DNA, 120 bp, Heterodera glycines
  Promoter: Source sequence=SeqID_549; Location=6454..6573; Strand=-; Gene=SeqID_55921
aaattaacgacaaaagaggaggacaaagtaacgccaaaagatgagggcaaagtgacgacaaaagaaattggtgatggtcaaaatttagaagacattcaatcagtaagaggtggaaaaatg

SEQ ID NO: 107057 - DNA, 592 bp, Heterodera glycines
  Promoter: Source sequence=SeqID_44155; Location=148..739; Strand=+; Gene=SeqID_71682
agtaatgacctttgagcgcggaaaaacaaatttttaaatgtcatattcgtactcagcgactccaaaaaccctaaattagatccgttttccgggtttttatgtgctttttagacttttggacatttcgtgttttttactcatggacatttcgaggcttggacatttcgtggcttggacatttcgttggtcagcggtttttactaattatgttataaaattcgaattaaatttctttttttcccacatcattgggacccttgattctttataattttttaaaatccacatcaagacaccgttaataaaaagctgcaacacgaaaaccgtaaaaaggtcagatttttgcattttttttataacttttttacatgacggtatttctttttgattgtggaaagccaattgagcttacctacctatttattttccgagtgtccattatcccatccccctttcttcagctgtacccgagtatataaagccgactaaatccaccttccagtcatattcttcatcccatccgcatttatttgataatttttttctgtcacttcttttttctaattctgtttgatttacagctaaaaaaatg

SEQ ID NO: 107058 - DNA, 395 bp, Heterodera glycines
  Promoter: Source sequence=SeqID_15596; Location=500..894; Strand=+; Gene=SeqID_79887
atgggcgccccagcgaattggcacgcgcgcaaccgggtgaccgcgtgttgctgcaacgactgaacgtcacgcaaaacaagggcgcggccgtcacttcgcacgacaacacctttttattttcctgctccttcggacaattttccgtgttgcagatattggcgcacaccggaaatggtaataaaatgcccgggggtgggggggggaaaggggttaatttgtttgacaaaatgcagtggcaactttaaagaaaatttagaatggacaccgacgagtgctcgagtgttggggggccgcgttttggccatcaccgccgcgcaacaggaaggtcggttgggcggcggccatacccactttttcgggcgttcatttcaaaaaaaaaaaaaaatccaggaatg

SEQ ID NO: 107059 - DNA, 258 bp, Heterodera glycines
  Promoter: Source sequence=SeqID_16572; Location=1..258; Strand=+; Gene=SeqID_80980
taaaaattccattaaaaatgcaacaaaatcgtgaaaatatattcgtggatgagagaatcagaatcttacctagcatatgaattcctacgtattatcatcgtgccctgcatgtgagctacgcaggaattctgattctctgacccaagaaatagaaaagtcactgctctgaattgttaagggagcagatgcacattttatataaattttattacctaccataataaaaaatttattttagattacttagtttgcgaaatg

SEQ ID NO: 107060 - DNA, 838 bp, Heterodera glycines
  Promoter: Source sequence=SeqID_10286; Location=668..1505; Strand=-; Gene=SeqID_73453
gtttgtcccggattttgttattattataaagttatgaattttctacaaaattttatgaatgggaaacaaaaaatgataaattttggctttattagttcttaagtttttctatttgaatctgacgcttgtacaagaactcgtacgaaaatgttccccgtacgaaaacggcggtacgaaccaaatttacacttttcgtcggtcgacatatttgaaaattcaattttcgacaaaaaaactatttttgaaacgcacgaaaatcaagtttttttggttgttgttaaggtacttttcgagttattagtgcctattttctaggcttttatttttagcgcctaaaaagcctaaaaatttttgaaagagcctatttttgcctattttggcgttttgccaaattattaacaaaaatgcaataaaaacgaaaaaacacctctaagaagcgattttttgggaattttaaaaatacacccctaagaatcgaccaaaaaatttctgaaaataaacctcctaagaaatgaaaatttttcttaataaccgtctttaaatttttttttttggacaagtttttgaatttaaaaaatgatgtaactcaatactgagttgtagggctgcaaaaaatatgtacaaatcaacgcgattatcccatccaagctgttgcgacacattctcttgccggttgaaatcaatttaaatttaatgagttgtcaactttatatttatttaaatattgctttcaagcgaatttttcttcaaaattcgtttattttgcatgaaattaaaaaatgattttaattttcattaaaattattattttttttctattttgtagatgttagcaatg

SEQ ID NO: 107061 - DNA, 142 bp, Heterodera glycines
  misc_feature (46)..(46): n is a, c, g, or t
  Promoter: Source sequence=SeqID_43331; Location=1095..1236; Strand=-; Gene=SeqID_71034
gtcattattttaaaaaaactaatgtaattaattcccgtatgcacanaatagaataaattgaaaaaacgaaccaaaaattagagaccaaacaaatcaaatcaaatttaaaaaagacatttttcaaaatatttggtcgcaaatg

SEQ ID NO: 107062 - DNA, 348 bp, Heterodera glycines
  misc_feature (334)..(334): n is a, c, g, or t
  Promoter: Source sequence=SeqID_41183; Location=1086..1433; Strand=-; Gene=SeqID_69370
cttttcaaatttcaatgcaaaacttcaaccataatttttttttattttaaataattctttttccgtcattgaatattatgagaaaaaaatcatttattttttcatatttattcatatgcaaggcccattaaattcccgaaaaattcattttattattcatttaaaattagacttttatttatttttcctgttttgtattaccaaagattaccctaatttattttttccgattcttgtagacatataactgtccattaagtatctccttcacaaatataaatatgccgcggcaatcacgaagacatacaattcataattatcagtgaatcaattntaattaagaaaatg

SEQ ID NO: 107063 - DNA, 375 bp, Heterodera glycines
  misc_feature (39)..(39): n is a, c, g, or t
  Promoter: Source sequence=SeqID_14259; Location=1..375; Strand=+; Gene=SeqID_78276
tgtgtcatttttggtcaattttactttcgcttaaatatnttggcaaaacgatgccaatgccaaccaaagaacaatttaatgcaaaaaaaaaacaatttattcatttttcaaaaaagaggagccaattcgctctgtgttctcccaattcggcaccatcaaagaaattcgtctgtttgcttcacaaaactttggtttcgttgtgttcgcggacaaatcgtcggccgcgcgggcgatttttgagatgaatgggagggaattggacttgggagtggtagcggggaaatgcacagttcgggtgaagtggggaagacaaccgcagcagcaaaacggaagcggaagcggaggggggacaggcggaagggcgggagacgcatg

SEQ ID NO: 107064 - DNA, 79 bp, Heterodera glycines
  Promoter: Source sequence=SeqID_12321; Location=2071..2149; Strand=-; Gene=SeqID_75918
cggatcaatgggaagacgacggaaattgggacgacaatttgaccagtgtccaatttactttgtggggtggtagaaaatg

SEQ ID NO: 107065 - DNA, 233 bp, Heterodera glycines
  Promoter: Source sequence=SeqID_32513; Location=50..282; Strand=+; Gene=SeqID_62819
cctaaaaattcgaaaattataaaaaaaaaattagattatttatgctttttttgaaaaatagaatttttaattcaaaattttcttaaaatgaaaattttcattataattttttttccatttgtgctcaatttttgagggcaaaataaattttttattttggaaaaataacaattttacagcaaaaaaatatatatataaaaattcaaaatttttccagtggcacttatcacatg

SEQ ID NO: 107066 - DNA, 57 bp, Heterodera glycines
  Promoter: Source sequence=SeqID_42221; Location=780..836; Strand=-; Gene=SeqID_46700
tttttatgttcgtacgccgtcaatgccaatggtgccattcgaattggtgaacgaatg

SEQ ID NO: 107067 - DNA, 191 bp, Heterodera glycines
  Promoter: Source sequence=SeqID_45122; Location=1..191; Strand=+; Gene=SeqID_72493
tgctgttaatgcttaatgttcattattctgtatcaaactatacaaaaaaattttagaccaaaaaaaagcgaaaaaatttcaaaagagtacgcttttagactagcgccaaattttctttaaaaaatttttctcgcatttaaaaaaatatatctatttgaatttttttttttcttattttaggagtgaaaatg

SEQ ID NO: 107068 - DNA, 1003 bp, Heterodera glycines
  Promoter: Source sequence=SeqID_2450; Location=1248..2250; Strand=+; Gene=SeqID_79790
atatccacctctttttggctctaagttcagtttaggcatccaatcaatgagaccatctttagtttctttgcccataatttttatggtattcaattgattgtgcttctcatgcgactaccaatagaaaaaaataaacatgcaaaaatgtaaaaacataaaatctgtgcctaatttcttttttaaatttaaatattagtacgtaaattaatttgtgctctttttggcgcgaaatttaaatgaaataaaataaaacataattcgattgcgttgcctttcctttcatttttctttcattttcgttttcttaattattacgcttttctttttttattcgaatcaaaaacaattgtgtatgcttttgcctttgcttcattcatcgttctctccccccccccctttttttcggatcgatgcaccgaaattccatcgaattgctaaaacaaacattttgtttattttttttgatttgaacatcattcgctttctcttcctttcacagtcatttctctgttccctttcccatctttattttgccttaaattttacccttcgaaatgcaaataaaaaatgttgcccctttccattccccttcctttccaatctctttggctgtaatggctttgttatgtatttcatccattgaccttttccaccatttcattctttgccgtgtagccattagtcttttattacaagagcattcactccctccctaccttttgctgtttatttgcagattttataaaaaaacaagagctactgcattttacgcgtaatcaatgaccatcatcagttttttaggccataatctttccatacctggtcaaagcataagtaggacttcattcagctgaaaccactaggcatttaccaagtaagaaaacctaaggaaactcaggatgatcatttgttggacgcgtaaacagcagtagagccaaaataaaaatgtttcttacctaattcatagagatcatcatttattttcatatttacagtaaaaatg

SEQ ID NO: 107069 - DNA, 126 bp, Heterodera glycines
  Promoter: Source sequence=SeqID_15831; Location=1593..1718; Strand=-; Gene=SeqID_80155
ggtgggatatactttaaaaaacaaattcttctttttttaattttttctattaatttcttacaactttcaaagaaaattttaaaaaaatttgagaaaattggaaataaaattttttagttgttaatg

SEQ ID NO: 107070 - DNA, 101 bp, Heterodera glycines
  Promoter: Source sequence=SeqID_42399; Location=1388..1488; Strand=-; Gene=SeqID_70297
cgtcagccgcagagcaaattgaattgattgagacggagactattccgcaaaatttggagtcatttgaagtagcgtcagctacacagaaaggattgatcatg

SEQ ID NO: 107071 - DNA, 1003 bp, Heterodera glycines
  Promoter: Source sequence=SeqID_29067; Location=89..1091; Strand=+; Gene=SeqID_59630
tagttaaaatcataaagcaaaaaattattttttttaattttattccaaatttaaaaatcaataaaccgcttttttgaggcgtgctttttccaaaaaaactttttgggaagagggggcaggccgtcgcggcaggtgccgccgggaaaatttgattaaaatttgttgacagattttcactaaaaaatgatcaaattttgtgatttttatcatttttctaatgagaaatgagttttggggcgccgctgagaacagtttttcatcaaattaccaaattttgcgattttgggccattttctaagaaaaaataggagttttgggggcgcggcggtgccgataggcgccgccggggaaaaaattggaaattttgatcatttataaacaggttttcactgaaaattaatttccaataatgaacaattaaacaacggggatattttatttatacttgtagttaacaattaaattttttttaaacaaataaaaaatattaaaagtaatcatttgtaaataaatctcaataaaaattttgaaattttttcagctatgcctattcaaaaatattcttttggatgaatttcacatgaatttattttggtgacataaaaacatataaaaatatttatgatttctatttccgctttattttaagttttggagggtaatcatcacaagtaaaagcagtgtaaagcaaaaaataaaaaaataaattaccccatttaattacttcattcattcatttgcttggaggaagccacgccatatgtttttgtatataatataatttacatataatatatgcgcatatgtggatatattctagcaatcttttataaaaataaataaaaatatccatattattattattataacatgtaaaaacccacaaaaataatgcataaaaaaagccataaatttattattattatattcaacacattgcttctttttcattcatttttcttatttagtctctcaaatcaaaccaaacaaaaacaaaaaaatg

SEQ ID NO: 107072 - DNA, 158 bp, Heterodera glycines
  Promoter: Source sequence=SeqID_4491; Location=1185..1342; Strand=-; Gene=SeqID_54657
gaaagagaggagaaaggaggataaaggggggggggggtgaaacggatgactttctctttgccatgactttggctgctgctgatggtgagaactgagaacagcagcacacatcatccgcagcagcagatgacaataaacacagcttaactaaacatatg

SEQ ID NO: 107073 - DNA, 1003 bp, Heterodera glycines
  Promoter: Source sequence=SeqID_13264; Location=2953..3955; Strand=-; Gene=SeqID_47118
acatacctgagcaaagaatttcaatttttttttgcagaataagctatggtcaggtaaaaaattaagaaaagggaaaacgcatagaaattaaatgcgaaaaagcacaattgttttccatgctttggtgtaaggtaatagtccagagagatgaaaatttgattaaatagtcatagtagactcataagtattgggagaatcaccgccggttaccgctaacgaaggcatttccccccccccctcgtccgtccatcccaattccctccccccccccccaaaatccttttcattcctccgatgaattgccccccccccctcaatccttccacattttccatccctttttcctctttgacgctttcttctgaggcgaatcaaacggagaagagaaagccactttcgccgtttgtatatggtcaaatcaaagcaaaagcctccgatcaaattcctcgtaaaatattcgcttttccctttttctttcctttccctcgcttttcccttttattggcttttcccccatttttccttaagcatgcgcctctctttgtccagttggcctttcccccacagaagagaaaggcattgtcttcgccttggccttccttccgtccgatcgcttttccctctcttttttctctcatttgtcattgccatctccgccgatcagtccattcgtaagttttttttgatgtgccaatgtctttcctctttgaatagccctggggggtttgctttttgatttgtgttctccgccgccttttccatcgccagtgacggcggtttggcggaccgtcatcttaatcatcattatcttgacgaagaagaggagacactcttgcgggtgaccttcacctgaattgcttttcacaaagcaaattctatgggtcgaacggaaaacactgaaaacaaagcattataattggggggaggggtaattaacttaattaatggagcaaaaacaaaaggtaaaaatgaaatgccaaaataatccaattgattgattatg

SEQ ID NO: 107074 - DNA, 300 bp, Heterodera glycines
  misc_feature (13)..(14): n is a, c, g, or t
  misc_feature (22)..(22): n is a, c, g, or t
  Promoter: Source sequence=SeqID_10567; Location=1..300; Strand=+; Gene=SeqID_73805
ttacatatttatnnataatttntaatatattttttgtttatttgcttttaaaatatttccattcttctattatttttaaatttatcacagtaaaacgatgactctcataatgcgtcaactgttcgcctccttgttcttccttttgcttctcattttgctcatcactttttccgatgctcaattatttggcggatggggtcataataaaatttagaattatacctaattaattacaatatttttaacaatttacaaataatataaataaaatttaaataacaaatatttattgtcaggatg

SEQ ID NO: 107075 - DNA, 1003 bp, Heterodera glycines
  Promoter: Source sequence=SeqID_13007; Location=579..1581; Strand=+; Gene=SeqID_76778
aattttgttttccaaattagctcgtcatccaaaaaccgtttttgttaaattctgtcttttatcggttcgttcgattttatttccctttttccgttagtccttccagttcatttttaaatgacctgctgtcccaacttgattggtaatttgggaaattctgggattaatccggcaaacccacccggcaataaattgggccccaatctcgaaatcggtgctagcgcgtttgttaaaaactgccaatgggtttgaaaacaaaaaacaggctatgttttttgcaatggtaatgcatatataataataaacatttaaaattttaaagtctttaaaatgaaatttaaccaaaattaatttatatttcgatagccctaataattctctatttatatttaaaattttagaaaatttcattgagtttcaaaaaagttctgaacaaaaaatgctgacttaagattttttgcaattttgtgaccataacttttttttatacttaagttaaaaatataagaaaattatattctgaaagagaacaattaaagctattgaatgataccacgaaatattaatttggttgaatttgagccaagctattaatttaattattttacccattttttgttttcaaacccattggcagtttttaacaaacgcgccagcacggttgtatccagaaaattccctgaattttcattttttaacgcattaatccgttgctgataaacagtgctgtcaaaaatatgcaaatgcatattttttttcctggattctgcgtagtctaattagtaggaaaaacactttctttttggtatttgcgtatgaaagtcgggacttttatttgcatattttgggttttttctgcatatttcatgcatattttgccactttttgtacatattttcagattttgcatattttgccatttttcgacaaatatttccgatttaaatatcctcttaggaaaaaaaaatttgattatgcctaaaattaaatccaaatcggaatg

SEQ ID NO: 107076 - DNA, 156 bp, Heterodera glycines
  Promoter: Source sequence=SeqID_21877; Location=1..156; Strand=+; Gene=SeqID_52516
atcattgctgatgagcgtggcaaccgtcagagttttgggtagagtaaaaaattagagtccgttggttatttatctaagtcattaattttagtcattgtgagtctgtttcggaaccgatcacaattggaaactgttgcaacgaaatgcacagctatg

SEQ ID NO: 107077 - DNA, 109 bp, Heterodera glycines
  Promoter: Source sequence=SeqID_23924; Location=1..109; Strand=+; Gene=SeqID_54615
catgggcgacattgacgcgaagaagttggctgatctgtacaccaagaagtcccaccacaacaacttttcggtgatattcctcacccaaaacctgtttgacaaggcgatg

SEQ ID NO: 107078 - DNA, 228 bp, Heterodera glycines
  Promoter: Source sequence=SeqID_44470; Location=1..228; Strand=+; Gene=SeqID_71955
gtatatgcagcgagcaataaaatattttattgactattatgcgctaaatgatataactcagctgtacgctctcctaaaatccgaaatagactctaaaccgtccaactattatccaaatcctttgcaatcagttccttgtgtacaccttgtgaacgaagagtacgaaaatcagcctgttgttgtagaaggaacacttgatctgataggcgatctgttcttttcaacatg

SEQ ID NO: 107079 - DNA, 1003 bp, Heterodera glycines
  Promoter: Source sequence=SeqID_16089; Location=557..1559; Strand=+; Gene=SeqID_80444
ctatcaccattcctcccctctctgttctctttcaccattcattcatttatttgtcattttccttttgcttgaccttaatcaatattatttgtgtgccttgtccttttatttggaataaacatttgtttattctctacggactcatcggcataacagaaattaatggagaaagtgaaaaacaaaaaattaaattatttatttcatttaaattatttattcatgtgcatatttggcttagtggctaaaccttctgcctttcattatttgtcgcatgggttcgattcctcactgggatataaaattttcaaattttttgtgggctttcaaatgataccaatcattagtcgaaatgagaaaaaaatgctacaaaaaatgctattacacttctggtcatacttttcttggtaaataattattaaggaaagtgtttgttagcagcaagtcgccataaacatatgaccagggttcccagatgtgaggctttagcctcattttgtggttttttggaggtcaatgaggtgaaattttcaaaatgaggctttgaggctttttgtgggtttttgagaaattttgaggttttgtgttttttttgttaaattttccaaaaaccacaaaattaggaattttttattgaaaatctgctaaaaatatggtcaaaattctcaattttttcccctttttggacaaaatttgttaacaaatcacattaaaaattacaaaattttcccgacggcgcctatcggcaccgccggcccccctttgttccccaaaagttttttggaaaaagcatcgcaaaaaaatcaacttcggtttttcatgcttagaattttacaaaatgctcaaattgatcatggacaatcagaaatataacatttgaacattttaagcctgcccggcaatagcaaaataaaaagagaaaagattatgcgaaattggcaaaaaaccaaaaattaattaaaatattttaaagtttctaaaataaaaatgtttcattttagtaatg

SEQ ID NO: 107080 - DNA, 1003 bp, Heterodera glycines
  Promoter: Source sequence=SeqID_6713; Location=488..1490; Strand=+; Gene=SeqID_62601
ctaggatagacacaaagagagggagagagcggcgagacagtgagaaaaaagagatttggacacagaaacagaaagagagacaatgacaaaatgagagataaagggggagagacagggaaggagctagagaaagaggggagagaggcaatcagcaaattaggcaaattgtatttggccactgtttttgtgccaaaatgaactcccacgcattggaatggcgtgtgtgcattcatggaaacaaccaattaagagaatgaataacttgatttctgagaaaatattatcacaccgtaccatgggaaaaagcgtttgtatgaactaattaattttcgtttaatttatttgtgtctgatgaatgacgtttcgccaaattaaaaaaaaaagttgacattttgcgttagccactatttaataattggctcaatgaatgccgtagtgattgatcactgtcttagtgattaggtaaatttcttgtacgaattatcctttttagtaaaaatttttgttgtactaattgccctttttacatgttgccactgacccagatgaacatgaaacggaatcttgcaaaatcttggcaaatgttaaacaaaagatcggtactttacctagcaggtctggattgtaacttatttcagttacggaaatctaatccgtaattacggcgatttcatcaatcacggcaatacataatccgtcattatggggaacaaaaaacgcgttaatttccgtaatccgtaatcggctcgataaataatccaaaatctcagttacggatcaaaattacggaaaaatcactaaaatccgtaagtcgtagtccgtaattatgggatcaaacacgctgttgtttccgtaatccgtaactacgtcctaactgttgcataggcaatgtcccggcccaaacccaccacaccttgagcgtgttcatcatcatcatgttgttgttgctgttggcattgtactgctccacatcgtggatgatccgcctaggcggtgaacgatg

SEQ ID NO: 107081 - DNA, 117 bp, Heterodera glycines
  Promoter: Source sequence=SeqID_25235; Location=296..412; Strand=+; Gene=SeqID_45917
agtgagttggcattttggggaatgtcccctcaaattgattgctttcatcagttgagcatgtccgatgagcaaattgaggagaacgtggcggtcattgttgacactctgtgcaaaatg

SEQ ID NO: 107082 - DNA, 794 bp, Heterodera glycines
  Promoter: Source sequence=SeqID_3674; Location=1772..2565; Strand=+; Gene=SeqID_51408
tttttctcattaaattttgccaccttttatttaaggcttttaatttttcaaaatttggctctattttttggataatttcctttgttttattgaatatccgcatgcattctccgggattattttgatcatattcgaatttgttttcctcaatttttgttttgatcgtttctatttccctttttaatacgcgattaaggaggggtattttgctacgaagcgtaccggacatagtttgtattttaaaattttaaaataattaactaagtatccttttatggttatttagtggataatcagaaaaatgagaattttaattaggtatttatcacaagttaataaatattattataattttaatgatcacagaattaacaattgttacgaaatttaaaaaaaatatatataatcacagaatttttttgtttttgttaattatttgctccttttttttgtaaatttctttcagtatattctctgtatgtttcgggcgaagtttcgttaatttgtatttcggtttgtgtttttaaattttataagttcagtcagtgtagtgcttttcgccacttgtttctttttcgtgttggctttggtcgtcggagtaattgaattaggagtcgctctgtccacttaattatttaaattagtgatgggtttgctgtagggtttattatgacttttaattatgtttggctttttatggtgtcctttttcggttttttgattgggtttggtgatccgtgtgtgtgtgtgtgttttttttttaaattgggtttgtcaacccttgattttgtatg

SEQ ID NO: 107083 - DNA, 652 bp, Heterodera glycines
  Promoter: Source sequence=SeqID_4988; Location=817..1468; Strand=-; Gene=SeqID_56457
tcctcagggcccggatttctagttttttccttttcagataatattttagagatatatacggcaagaaaaattaattttctccgtccaaagttaaattagagcgcgttactataaacatcataaaacagctgattttgtaggtttgatcacaaaaaactgtttcggatttaagcaaatatgtatttccgcaatttggaaaaatgaaatattaatttaaattttaaaaaagcgaacaaaatgcatttctctaagtttgttttttcaagtagctccaatttgctttatcttcttaataagatttctaatttttaagcacagcatattcctttcttcttcttttttttatttgaatcaaaaatctaagtttaatttaattattttctttattattattattttatttgtaaatttatttttagagaaagcacactgattatgaaatttccagaattagaaaaatagtgagttggatgaacgtggtttttggcaattttgagagatttccaaatagcataaatgacgtgcgaaaaacgaatgttttaaaatcaatttcccatcaatccagcaatttattcatccatccgccacattataatattttatttcaaaaaaaaagtaatgaataataaaaaaatgtttaaagcagtcaatg

SEQ ID NO: 107084 - DNA, 166 bp, Heterodera glycines
  Promoter: Source sequence=SeqID_41498; Location=682..847; Strand=-; Gene=SeqID_69596
tttcgcttctgtcctttggtctgttccgtcgttcattcgtccattttccttttccctccgtttggttttttcctccccccccctccacttgtaatttcgtcaattccgttaaacttagaattattcagtggtctcgctttccccatacttttgcccgtccaaaatg

SEQ ID NO: 107085 - DNA, 51 bp, Heterodera glycines
  Promoter: Source sequence=SeqID_12442; Location=1911..1961; Strand=-; Gene=SeqID_76069
ggtggtttatttaaaagtttgcattcattttaatacctaatttaagaaatg

SEQ ID NO: 107086 - DNA, 559 bp, Heterodera glycines
  Promoter: Source sequence=SeqID_27062; Location=1..559; Strand=+; Gene=SeqID_57785
aaaatttttcccgacggcgcctatcggcaccgccggacccccttctttcccaaaagttttttggaaaaaacgtatcgaaaaagtgatgtatttactacattaaaaaaaaattttaattcccggtttcaaaactggtacccaacccggtacccggcttttcaatacccggtaatacccgggcccggtttttgcccaaatacccgggcccatgtaactctagcaaatataatggatctttttttgaaaattatttaatcccaagcaatttgttgttcttgtaacacccggctaataaaaattggcgggctaattgaaaaatattttgccttatttcgataattagtgccagattgggttctgtttttaaacttcccttgaggggagggcgggggtaattatagggtggtgcactaattacagaaatattgttttattttactattttagaaatctgcgcggcacttgtgccactcttttggccatcggctcagccgttgactttctctttttgctctcattttcggtcccttttgccctttcgttggttggccagaacatg

SEQ ID NO: 107087 - DNA, 461 bp, Heterodera glycines
  Promoter: Source sequence=SeqID_13552; Location=1..461; Strand=+; Gene=SeqID_77455
ccccccccccacctcggccaattgtatgtcgtacgggaatactgctggtagaccccttacacacttgtggtcataatcagggctcccaactaaaaattagcattttaccaacaataaacagcaattggggtcaaagagcagcttataccccttgaaaacggcaaaatgttgataaatcagcagagttgagagccctttgaccataatgaattacgttgcaaaaaaacaaatttcagaaataagcacatttgaaagttaaaattagaaatgagaagtaaactaatctctcttatttcagagaagtgattcctttcaaatctcacaatcaaggcaattataacttttatcaaatttatttttttatttttggctaacaattgttttatttattaaagaattttttgtagtatttaaagcaatgtgccaaactttggttaaaaatttttctcagtgacgaaatg

SEQ ID NO: 107088 - DNA, 337 bp, Heterodera glycines
  Promoter: Source sequence=SeqID_39739; Location=1..337; Strand=+; Gene=SeqID_68240
tattcttattgcgtttttatttctttttgtaagtatttcaccaaaatttttaaaatttgccaaatttttagttgaataaaacattaataataaaatattatggaatcttttcttattacagattttatttttgtagtgacgtcacattttgtcttacaacaataaaaatgtcagacaatcaaatggaagcggaaaaaaagatgaaaagacaaatgtaaattaaaaatatccaaatttagccaaaatagactttgtttttaaattaagttcaatttgcaatgataattgtcttaaagtgttcgaatttctctcgccttttaaacttggcattgaaatg

SEQ ID NO: 107089 - DNA, 1003 bp, Heterodera glycines
  Promoter: Source sequence=SeqID_10804; Location=3262..4264; Strand=+; Gene=SeqID_74068
ttgagagctgattaatcactgagaaataccttataaatatcttctaaacatctagggctttcgaatgataccatgattgtgaagtttggccaacaaagaaaaaagttatagctttttgaacattgctgagacggagttggccagacggagttgacccctaccgtcgaatgataccaaatttgtccgggttgggcacttataaaaaggagtaccctttttctctgtttctcaaatcttgaactggttcaaatatctgtttaaatttttttttcaaagtgttagaaaaagcccagaacacaacaatcatagttttattgaaaaagggtttaattagaatagagtttaaaaatttattactttgatcagtgcagtaatattctccttaattctataacaaatccttttttttaatttgatagataaatatttaaataaattcatttaaaaaaaataatatttttaaacatcgacggtgttttccacaaaacgaatgaatcatcatttttattttgttaatagctttacaatttttaatttgcttttcccaactgattgacaattagcacaaaatggatgaaacttttcaattttatgcaaaaggccgttgattttatttactgtgaaaaggcaaaacgaaaaatacctgttaatttatttaatgagtttttgggtcttttaattaattgacaagagattaaatgaaaaaaaacaaattaattttttatttaaaaaacaaaatattccaaccattcttaaacaataatgtctgcttcatcgacattttttctgcttttttccttttggtgccaactctaaacggttaattcattaataactagtgttgctctcggggtttttttttgggtcttggtctcgaatctcgggaaaattttcgttcttagcagcagcactgtttctgcaaaaataaatgaatttgagaaagaattgttgtatattatcaatttagtttttattttgtacatttcagcgcttagatgctatg

SEQ ID NO: 107090 - DNA, 75 bp, Heterodera glycines
  Promoter: Source sequence=SeqID_23781; Location=359..433; Strand=+; Gene=SeqID_54484
ataaatttttaaaatgaaaaaaaaattgaattgccaaggttcaaaccaaccccgtgttggaggcttttggcaatg

SEQ ID NO: 107091 - DNA, 118 bp, Heterodera glycines
  Promoter: Source sequence=SeqID_26815; Location=517..634; Strand=-; Gene=SeqID_57564
ttttccacttccgtttctttccttttcgcgtcaattttcatctttccctttagcgatcgtccagcgtctacagcagcagtgagcaggacccttcgtgtgatggacaagggggtaaatg

SEQ ID NO: 107092 - DNA, 858 bp, Heterodera glycines
  Promoter: Source sequence=SeqID_4433; Location=1..858; Strand=+; Gene= SeqID_54422
taaggttagggtggtcatatccattgaagcaccatcaattacaacaacgcaagcagtaaaaattgagctcacttagaatccgcgtaaaattgagccaaaggttaaagtggaaactccaaagtccttctccaaaggcattcaatttaaaagagtaagaaatgaacaacaaatttacaaaattatgggaattaggaaaggcacaatcctgtctactacaattccatttataagtacaactcaagcaccaaaaattacaaagccaaccacagtaagttcagtaacggtaccaaccaaatcaagtcaaaaaattatgaccacagtggccacgacctcgacaatttcaccaataaaaactgtgactaacaaacaaacagatttattaaccaacctaattggcgcagaattgaacaaaacgcttatcagtaagccaacgtcgcttacaaacagcacggcaaaaaatgatcataatatttctgtcaattctataaatacttttccgaaaaaggaaaaggagggaaatttgacaaatacttttaaaaaggaattaattgaggtgcaaaaaacattgatgaatgtctcaagtgaaataaaaaacagtggcaatgaaaagccagctcctataaatgaggaaatggattttgaggacactgaaaattctggtgacaccgaggaaattcaaaatggggaatatttcttagaaaatgaaataaatgagataaacccaggacctagaaggggtctacgatattgagcaattcaatttttttgaaattgacagaaagaaaaggactacaatggttaccactgacgagcagatgggttaaaaatgtagagaaaagcaaaacacgcagtaaaatg

SEQ ID NO: 107093 - DNA, 87 bp, Heterodera glycines
  misc_feature (5)..(5): n is a, c, g, or t
  Promoter: Source sequence=SeqID_28100; Location=1284..1370; Strand=-; Gene=SeqID_58751
ttttntgggcatttcaattaaatatttattttaatttaattaaaaattggaagaattaattaattcattaattaattactcaaaatg

SEQ ID NO: 107094 - DNA, 808 bp, Heterodera glycines
  misc_feature (117)..(117): n is a, c, g, or t
  Promoter: Source sequence=SeqID_36767; Location=493..1300; Strand=-; Gene=SeqID_66009
gaaggtttttataaacaaacaaattttaaatttactaataaaaattgtaaattttttttattagaaatgtgtaaaattttcaaaaatcaaaatttcgccaaaaacaacgggagatgnaatttttaaaatttttctgttttcgggataaattttaaaaaaattccattttaagcatatttattaattagatatgcataaataattaattaatcatttcgtaaataaaggctaatataatagaaaataaatttgtcaatatttattgtttcatacgtaaaaacttttaataaaataaaattataaacttttttcataggtcagccaatgggtgtcaatttatgctaaaaacaacacggatgaaaaagcaaaagcacaattaatcaacgttaaacaacacatatttaatggagaaaaagtaaggcgctcagcgaattggttttgtaattgatatgttttctttatgttataataaaaaaaaatacatttataaatatttattaagaataaaaaagaaataaaaatcaaaatttccagtaaaaatttgttaattttgggtttccatttttctataaatccaacgtattccatttcttttttttaaatgtgtgtaaactctggagatagttgttactatcaattaaaattaatggcacctaattgccagttggacttgtccgatccgccagcaaaaaactcatcaaaaaagttgacttctttaaataaacaaaagtcgacgacttcaagagaaaaaacggacgaaaagacgaagaaaattgaagaaggcttaaagaaagttggaaaaaaaatg

SEQ ID NO: 107095 - DNA, 232 bp, Heterodera glycines
  misc_feature (28)..(28): n is a, c, g, or t
  misc_feature (88)..(88): n is a, c, g, or t
  Promoter: Source sequence=SeqID_871; Location=2904..3135; Strand=-; Gene=SeqID_62992
acaaatttaatgaggagataaaagttancaggggcgggtggaggcgaggagtgcgtacctcgcacacttctggtgggtcctcccccgntcagaggcaagcaatcaattgttagttgacgattattgtacgtaactcgcgggtcatccactggtcactgcccaacaaatgccatcatccatttggttaaatatttgtacaattactattttatgcttcagaatccaaattatg

SEQ ID NO: 107096 - DNA, 854 bp, Heterodera glycines
  Promoter: Source sequence=SeqID_2716; Location=1772..2625; Strand=-; Gene=SeqID_81225
aaattaatcgttaagttcgagctttgttaagagtgctaatttgtctggaatgggctcttcattccgtaattcaaatttcgcgccattcaaaatgagcatcatactgtactgctgctgtgcaagtgcagagaaaggcgcataaataccgacaaattccctcacaaaagcacttccccccattcattctgtttctgtttccaccacctgccttcgttcaagtagaaatgcgcgaaaatcttcgtcttatcgccccttttaaatcttcgaatccctattttcgcatttttatatatttcttaccaaaatgcaattaaaaatgcacccataaataccgacctcttgaaagcttttcgaaaatttggaaaaaagtatcaaaatttctttaaaatttttggagaaaaaacaaataaaaatttctttttaatattgacataaaatgtaaaaacaaatcgaaaatggaattttctataagaaaaactttttagtatttattcaaaaataaattaaatgcttttgtaattataaatgctgaatatgctatttacatcgcttataatttattttcattgaaaaaagtcaatttatatccctttttaccattttcgccccatttcaatttatgtaaaaattgtcattgcttttttaagcattttaaaagcccaattttttatttgaaaatgtttttccttcgggcttttatcatcattgccgccacatccacctttttttggtaaaaaccgaaaaagggggggggggctgtaaacaaatgttatggaaaaatttttactccagaaaattttttgcttttaagtttttgcgcggccaattcaaccgttgcaggcaccacaaccatg

SEQ ID NO: 107097 - DNA, 215 bp, Heterodera glycines
  Promoter: Source sequence=SeqID_31689; Location=466..680; Strand=-; Gene=SeqID_61997
tttcgtcccgcgtcgtttcgtcccgcgtcgtttcgtcccgcgtcgtttcgtcctgcgtcgtttcgtcccgcgtcgtttcgccccccaagccaaaattagtcgtttcgtccccaaatttctttttatttataaaatatttagtttttaaagtgttaccactaaaattttttccgagtttagttaacacagcataaatttacgaatttagacgtatg

SEQ ID NO: 107098 - DNA, 859 bp, Heterodera glycines
  Promoter: Source sequence=SeqID_23147; Location=626..1484; Strand=-; Gene=SeqID_53852
atgtatgggttttacattaatcaaatgaattttctaattaataaatattattattatgaaaagtttgttaaaaaatattaaattgtgggcaaaaggccacaaaaatttgcacttcccggcagaaggggaagcagactctcccggcagaaggggggagtcttttaagcaaagcgaatttctgtccaaaagacagaaattcactgaatgtccaaagggacaaattaaaggaggaaattcctctcctttactgaagggacaatttgaaaggaggaaaatgcttctcctttccttttgtaagccttttctttgacccaacgggggtcaatggcttaatgatctgtatgaaagggctcctgagcgtcccttttacagatagagaaaagactaagactctttcttaatctttattcaaatattcacaattacaatttaatgcaaatgcttggacagaaaactgtccggctgacttaatcaaaaattgatcagagtcaagaaaatggagaatgggccgggcttttataccctcacaatcgatgggggcggggccaggcacgtgaagaaatgtgcacaagcaaagggaaaaaattccctcaaaaatgatgactcatagcgaaaatatggagaaaagaaaagatgagtcataattaaaggagcgagcgaagggagaaaattgatcgacgaaaaggatcaaaaataaaagaaatttcaaagaaatttgtgtcgctttggcgacataaatttattacttaattgattttaaaaagtaatcgctaaaagacatgaaaatgtcaaatgtctgatttgatggttttttgactaacgaacattgctcacttcgtcatcgcttttaatgaaaatg

SEQ ID NO: 107099 - DNA, 162 bp, Heterodera glycines
  misc_feature (29)..(29): n is a, c, g, or t
  misc_feature (150)..(150): n is a, c, g, or t
  Promoter: Source sequence=SeqID_33795; Location=763..924; Strand=-; Gene=SeqID_63744
cctagtggggggagcgcttgctcgttttntatgatgtgtaacttttctctcattgtgcaggcaacgcttggcggcacaattgacgtgccaagcatatccaccaacaacgatggcaaaacacgggtgcacataccggccggcacgtcttcncatgcgcaaatg

SEQ ID NO: 107100 - DNA, 1003 bp, Heterodera glycines
  misc_feature (33)..(33): n is a, c, g, or t
  misc_feature (79)..(79): n is a, c, g, or t
  misc_feature (133)..(133): n is a, c, g, or t
  Promoter: Source sequence=SeqID_41641; Location=764..1766; Strand=-; Gene=SeqID_69723
aatttaagcttttttctataataaattaatcanaatttaattattaataaaattatcaatgtcaaaacctctttatgcngaaaataattagaatctttatcgcccatatttaatatatttttttattttactntaattaataaaacaaattttgaaataaaacataacggttaagattatcagaagaaatatcttttaagaaaacagaaaaattacaagaaataaatttaaagcactcaatttatttaaccaggtaattgaatactataaaaaatgcatatttgaattaattaaacatagtctcattgcataattaatggctaatagtataaattataatatgtacgaaaaatgcaccaaatgacgaaatatagaataaacaaaaaatgcttaaatgtggcatgtaattagataatgaggactaaaaattctacgctctataattataactgccatcttatataataaagttgagtgtctgttgtgtgtgtccagtgtttgaatttgtgtggcgttttgtaattgttttgcgttaaaaatgtatttgaaaaatgaaatgtttggttttgctttttttcatttttgttttgtcagtttttgcaaaaagcacagttaaaataaatttctctttttttcgtttttaatgacaaaatagtttttgtatgtttattaatgataatgaaatcgcaattaatgctttctattgcatttcttaagagaaaaagtttttgtttttgttattatcaaaaagcgtttggaaatgaatgctcttaacacttttgtaaagaaaaagaaaatgtttttgtaaatgaattcctttttattgaattaaaattgatttgattagttatgaataaatttatgttagtattatttgtttttgattatggcaagctcaatggaaatgttattgtgtttgatattgcattgaaaaagttttgattcgagaatttgttttgaactttgaaatggaaattttgtttgtttgtaattaaagcggatg

SEQ ID NO: 107101 - DNA, 95 bp, Heterodera glycines
  Promoter: Source sequence=SeqID_18873; Location=1..95; Strand=+; Gene= SeqID_83577
cagcagatgtgacctcgttcgtacgacactatggtgaagacctgcaagtgtacctgtcgaccattgcgacggctaaagcgcttgagcagccgatg

SEQ ID NO: 107102 - DNA, 231 bp, Heterodera glycines
  Promoter: Source sequence=SeqID_26403; Location=1455..1685; Strand=-; Gene=SeqID_57135
gtatttttccgaaatttttggagtcgattcttagggatgtatttttcgtttttattgcatttttattaataaatttcaggcaaaacgccaaaatagtttaaaatagttttttttttgaatttttagggtttaggatcaaaaaataaaaaccttgaaaataggttctaaaaacttcgaaaagtagcttaacaaccacaaaaaaacatgtttttcgtgcttttcaggtcaatg

SEQ ID NO: 107103 - DNA, 251 bp, Heterodera glycines
  Promoter: Source sequence=SeqID_32108; Location=266..516; Strand=-; Gene=SeqID_62430
tttttctggaatatctattaaatttaaaaattatttgaaaaataaaatggccacggcgcaccgcacttcgtttcatgttcgagagcgtttgttgcatagaaaatttctcaaaaaaatagatagccatttttctggaatgtttattgaccagccctagttgaaatttataaattcgacaaaaataatgggtatatgatgtattttcctttcttgtataataaatgacacaaaatttcagaaaaaaaaatatg

SEQ ID NO: 107104 - DNA, 178 bp, Heterodera glycines
  Promoter: Source sequence=SeqID_26082; Location=416..593; Strand=-; Gene=SeqID_56830
ttcccgacgattggtcccccatcggtcgtcaattgctcgacattggggccggtgacggcgcagtgacggcgaaattcgcctcatttttcgcttccatttgtgttgttgaagcatccaaagttttcattcccagagggatcgggttgcttaagccccccccccttttgtacaggtgatg

SEQ ID NO: 107105 - DNA, 190 bp, Heterodera glycines
  Promoter: Source sequence=SeqID_1305; Location=1209..1398; Strand=-; Gene=SeqID_72163
aagttgccgagaatcgtgttcattttggaactgtgaatgcaaacttccgactgcgagttgcatattctacagagtacacgctgtgcctgagtcgaaaattatatacgaattaatttcgtgtccaacgtgggagtatcgaatcaatgcgaaacttaaagccgaatccggaggaaactttaagggtgaaatg

SEQ ID NO: 107106 - DNA, 81 bp, Heterodera glycines
  Promoter: Source sequence=SeqID_20538; Location=2679..2759; Strand=-; Gene=SeqID_51077
attcagttgcctagtggtattggagtcttgggctataaaataccgcctccttcacaatctgtggcggacgaatgcgaaatg

SEQ ID NO: 107107 - DNA, 1003 bp, Heterodera glycines
  Promoter: Source sequence=SeqID_1000; Location=6350..7352; Strand=+; Gene=SeqID_65726
aaaaaatttttaaaatcaaaaattcttgtcaagaaaataaataaattatggagatgaattttgagacaaatttttcatttagtagcggtacattttcaaaaatcttatggtcgattcttaggggttgtatttttctgaaattttttgagtcgcttcttaggtgtatatttttcgttttatttcattttggttaataaattttgagcattttttattttttagatttttaggcactacaaaataaaaaacttagaaaatatgcaccaatagctcgaaaagtagcttaacaaccactagaaaaaaaaacttgtttttcttgcatttcaggttacaggtagctcaggaaaaaaaacaaagcaaaaacctaaaaaccgtatcccttactctttacatgcacttttttgtcgtgctgacgcgtttcttaaaatccgccatccatgcgcgcttctcaaatcagccaatgggttcgtgaaacaaaaaatgtgtaacccataaaaattaataactttgtttaaatttaaccaaatatatttcttggtagcattcattagctctatgtgttctctattataatattcaaacttataatttttcaaatagtataaaaaaagatcggatataaaaataattttggctcaattgcattttaaagattttaaaattttaaatgtttataaattataattataaatgcatgaccattgcaaaaaatatagcatgttcaatgctttataaatttttttatacttaagcaaaaaaatttttaaaattatattctgaaagaaaacaattaaagctattgaaaataccacgaattattaatttggttaaatttgagccaagctatgaatttatatacatatattacccatttttattttcaaacccattggcggatttaataaacgcaccagcaccctttttgctggtcttttctgccaaaaaacaactgttcagtcagccgtattgtttaccgtaatttttgcacagtcaacgcaacatg

SEQ ID NO: 107108 - DNA, 198 bp, Heterodera glycines
  Promoter: Source sequence=SeqID_287; Location=2564..2761; Strand=-; Gene=SeqID_81327
aatcattttgtccccccaaaaatgcttaatacacaatcatttaccaataaagatatttgtttcaaactaccgtttggcctaatcatttcgggcccctcctcatcggggaaaactgagtttttgttaaaatttattgcggactcggaccaattaatcacaccaaagcccgtctcaatgctctattgttttggtgaaatg

SEQ ID NO: 107109 - DNA, 385 bp, Heterodera glycines
  misc_feature (16)..(16): n is a, c, g, or t
  misc_feature (61)..(61): n is a, c, g, or t
  misc_feature (74)..(74): n is a, c, g, or t
  Promoter: Source sequence=SeqID_40015; Location=665..1049; Strand=-; Gene=SeqID_68451
ttgctctaataaggcnccggggggattattttcaacctcctcagaaagggggacataatgngagacagggcctntaatggagacggggggattattttcgacagatttttaatgactagggccgcgacttttagtaatgaaaaatctcggaataggtaggtaagttaataaaatactgaaaaaatagtgacattacgccaaaattttaattattttggcgaggagccttaaagtctgatttgtgtggcctcaaaatcgaaaattcaatgctgacatgcttttttgagctcctttatcaaaataaaagcaaaaaagttttttcactaaaatcacggctctattactgacgtaacattttagcacatttgttttcattttagcaatg

SEQ ID NO: 107110 - DNA, 370 bp, Heterodera glycines
  Promoter: Source sequence=SeqID_11403; Location=257..626; Strand=-; Gene=SeqID_74796
gctttaaaagagggacgagagagtgcgtgagagggggagaaagataaattctttgcaaatttgggatttcctttttaaaaaactaattaaagaatttaaaacattatacagtgcctaaattcctttaaaaagcgtgggggaaaaagccggcaagaattctcaaaattttgaacccatcgcaaatttttctacgaaaaaataaaattcttgccattttttcagcgcccgactgtaaggctttagtgttcagccgtgaaaaaatagaagcattggacaacacatttgacgacgaattacaagtaaagaaaaaagggacatggatcatttggcgagattaaactcaatttcccaaacaattttagaactcatg

SEQ ID NO: 107111 - DNA, 349 bp, Heterodera glycines
  Promoter: Source sequence=SeqID_3674; Location=2919..3267; Strand=+; Gene=SeqID_51409
gccggtcgggggaacgtagggggtcgggaccgatcggagagcgatgagtcgtgccggttttcgtccaggcaaatagaccaagttgggcacaattttaataagagtatgtttattgtgtcgacctcaaacttgggtaattaaaccgtcccaatcgggacggtgagggaaacgaaaaatgggggacaaacatgataatgtgaacgggaaaaagggggcacaaaaacggtgacagtaaataaatcacaaatggaaaaatgtggcaaaatcaaaaggggtcagaacggcgaaacggcgatgggaaaatgaagggcattcgggcaacggctggtccaaaaggggccacacaatg

SEQ ID NO: 107112 - DNA, 386 bp, Heterodera glycines
  Promoter: Source sequence=SeqID_12442; Location=320..705; Strand=-; Gene=SeqID_76070
aatttcgcatttttttgaaatttatcacccagtgtttctataactaatctgccatcgactttccattctttttgttaacttacttacaaatttgccatacttttctttttttttaatttaacttagaatttcacaacatttgaattatcttgccttattttatcattttttctcctttattgctttaatctcttttcttttcatttttacatactttctatgcaattgtttaattaatattttaatgattgtgaataaaaatattttatattgaaggaatggtgggcaaagcaaacttttctctcttttaattaagtttaatagtcttttatttattaattttttgattattttaacctttaaatttggttttttggcgctttatg

SEQ ID NO: 107113 - DNA, 484 bp, Heterodera glycines
  Promoter: Source sequence=SeqID_8714; Location=1280..1763; Strand=-; Gene=SeqID_68926
aatttgaagatgacccatcattatacgacaatcgcttgattatttgaatttcatatttatatttgataaattgccgttggtttaactcatttttttattgttttacgcctgctaattgaattaagaaactaattggcggggggggggggagaggaggggtgaagtttttcttggacaatttatttgatgttttagtggaagaagtgtctgtcggatgagtaaaaaagttgccgttaacaatattttgtttgacaaaaattcccccaaaatcggcagagtttgccaattttcaattcttttcactccaaacgaacgatcaaagccaatgtttgtgttccaaatgctttcctcggcttcttctgttgtgaagtgcttttcctccattctcattcatttgcttaagtgccgccattcattggcccaattctctttcgctaaacaattaaaaatctttccattaattatgccaatttccctcagaatg

SEQ ID NO: 107114 - DNA, 57 bp, Heterodera glycines
  Promoter: Source sequence=SeqID_16736; Location=1134..1190; Strand=-; Gene=SeqID_81134
ttcaatggtggcgccgatacattggcattttctcaccttttggcggcaggcaaaatg

SEQ ID NO: 107115 - DNA, 110 bp, Heterodera glycines; identical to SEQ ID NO: 98226
  Promoter: Source sequence=SeqID_30521; Location=173..282; Strand=-; Gene=SeqID_60932

SEQ ID NO: 107116 - DNA, 877 bp, Heterodera glycines
  Promoter: Source sequence=SeqID_12798; Location=1180..2056; Strand=-; Gene=SeqID_76530
tagtgtccgtaataatttgcagagcagggtccttagattcaagtcgttttggggtactttcgggttttgtgtcaacaaaatttttctctttgttaaattgattttaaattaaaaagtcgtttccatgggttttcggggtcgtagaacccgaatatgatgtccgtttcgacccatttcgaactccgaacccggattcgaacaattatcaaaattcaattttttttttcattttttctcctaaaaattattatcatcgcaagaaatcatatttatattgccgttgtcgttctgcatgcccactttgtttgttctcgcattgataacgcaaaaaaatgacctgcaactcttgaccaaataaatgagggaaaagggtgtgggcgtaggtaggaagcaatttgctgataaggaaattagtcggcaatgaagtgggaaagcatttttgaaagaaaaaaaattgaattttgataattgttcgaatccgggttcggagttcgaaatgggtcgaaacggacatcatattcgggttcaattgcgagcgttcttcaaattttcaaaatttcttcaattcgttaaatttaagcattaaatatggtatgaaataaatttagaaaaaaaaattcaaaataaaactaatattaattttgaagaaatgagtagtagaaaaatgaaatttcccatttctggacttatttttctcataataaacggccttaaccaaaacaaacaaaaattgtaacacaaaaaattctatttttgagtttcttttacatatagcaaaaatgcagaaaaatgcaaataacgctcgagacatcaattggaaaacatcagttggaaatgccacctattttgttttgtcatttatagattaatttaaatg

SEQ ID NO: 107117 - DNA, 215 bp, Heterodera glycines
  Promoter: Source sequence=SeqID_4450; Location=443..657; Strand=+; Gene=SeqID_54491
accgttgttcgctaaaaaccacattgatttttgggtggacggcggtgccgttaggcgacgtcgagaaaattttttggttttagcaatttgatcgggaccaggagaggatcccgggtccggaatttaatttattttacatttcttaaaatatggtcattatatattttttcttcttaaattgataattttttttatttttagcctcttggaaaatg

SEQ ID NO: 107118 - DNA, 289 bp, Heterodera glycines
  Promoter: Source sequence=SeqID_11274; Location=3265..3553; Strand=-; Gene=SeqID_74644
ttatgctgggagattcgattcccactttgtcttgtctgaactaacgaagaaggaaatcgcgacggaactgatgatggcagatttgaaaatttatcagataaaggcgggacgagtgatttttcgtgacttttggatgctcagtcagaataaattggcggaccttccaaaaacgttgggattaaacattacggaaaaattgtattttccccacaaatacaataagaatgagaactttgggaggagattgcccaacctgccacctttggaagactattgcccggacaatatg

SEQ ID NO: 107119 - DNA, 500 bp, Heterodera glycines
  Promoter: Source sequence=SeqID_23499; Location=377..876; Strand=-; Gene=SeqID_54192
aatgatgaacacgttggaaattaacaaaacattgacaagaaacaacgtgactcgccactactatcttggttgttttgcagcagatcaaatacccgccggtgtaattgtcaaatttcctcactgtatggtggttaatcttgaccccagcacatcacatggttctcattgggtgggcatatattgcgcttctcctttgcatttggagtattatgactcattggggttctggccaccgcccagtgtttacattgtggatcatttgtcacgctacaaacaaattcaatataattctcttccccttcagtctgtcaactcaagtgcgtgtggtcgacatgtcattttctttttgtattgtcgatgtgttggaatgacctttgaaaaaattgtcagctttttgcactttggaaagatgcaaccggataagctcgtaaacaactttgtaaaaagcataattttcaaagaatataaataatgtaaaaacgtcaaatttaaaaaaaatg

SEQ ID NO: 107120 - DNA, 456 bp, Heterodera glycines
  Promoter: Source sequence=SeqID_13176; Location=1..456; Strand=+; Gene=SeqID_77005
atgccttttttggcgtttttttccgaaaaattccattaaaaaggcaataaattcgggaaaatgcacctctaagaaatgacccgaaattttttttagaaaccctaagaattgaaacattttctcaaaaattgatcgtcaaaatgaatttatttttttttcttgataaaaaattttaggtttaaaaattttccttattcgaaaaaaatttataaaatatttattaatcatttaaataaccaaaagtaagttttttaattaagttttatggttttggctccatgaaaatcataaataaaaaattttaattgccttttttcatgcctttttgggacttttgtacctttttcatgcctttttctttgcaatattttggtgcctattatatgcctttttcgcgatttttggtgcctttttttatcgttctctataaataaaatacaaatgattattcagatg

SEQ ID NO: 107121 - DNA, 108 bp, Heterodera glycines
  Promoter: Source sequence=SeqID_3819; Location=870..977; Strand=-; Gene=SeqID_52005
ttagttgttttccctcttttcatccgctgccgcttacatccctctaattaggctaaatggggctaagtgactgactccgactgtctctttgtttttgtccctccaatg

SEQ ID NO: 107122 - DNA, 170 bp, Heterodera glycines
  misc_feature (50)..(50): n is a, c, g, or t
  Promoter: Source sequence=SeqID_40158; Location=1..170; Strand=+; Gene=SeqID_68579
ctgaccaatttggccatatatcagttgctgtatgcattcttaccaatttntggggtattttaaattaattttaattttaaatttttcaaatttcttaaggcccccaattcgagcttggcaagttggttttatttctggcattctgttaaacgctgctgcgggatcaaatg

SEQ ID NO: 107123 - DNA, 51 bp, Heterodera glycines
  Promoter: Source sequence=SeqID_14967; Location=185..235; Strand=+; Gene=SeqID_79124
ggttgttgttccctctgctgttttgggcttcacccccttcgtcaggtgatg

SEQ ID NO: 107124 - DNA, 73 bp, Heterodera glycines
  Promoter: Source sequence=SeqID_1995; Location=935..1007; Strand=-; Gene=SeqID_77252
tccccttttttctccatcatttttaccattttcccctttctaaagtaatttcgtcgcgtgttatctgcaaatg

SEQ ID NO: 107125 - DNA, 56 bp, Heterodera glycines
  misc_feature (19)..(19): n is a, c, g, or t
  Promoter: Source sequence=SeqID_12841; Location=1372..1427; Strand=-; Gene=SeqID_76568
ctgcacgaccaaacaccgnaattttggccttcattctgcgcaccattggcccaatg

SEQ ID NO: 107126 - DNA, 114 bp, Heterodera glycines
  Promoter: Source sequence=SeqID_13484; Location=2013..2126; Strand=+; Gene=SeqID_77374
cgttcatatatttcactattatatttttcctgtctctatttcttaacccatccaaaacttaatgtccccaaccaaacatcctgcaaggttaataaacaaaaattttcagacatg

SEQ ID NO: 107127 - DNA, 135 bp, Heterodera glycines
  Promoter: Source sequence=SeqID_243; Location=1143..1277; Strand=-; Gene=SeqID_79586
tcgtttattacatgttgatggcgcttaagttttgtttccatgttttaaaccgattttatgaatcaaaatgctaaatttctaactttcggctttttgttcgaattcgggtccggggtcggaattggcagaaaaatg

SEQ ID NO: 107128 - DNA, 305 bp, Heterodera glycines
  Promoter: Source sequence=SeqID_24500; Location=1499..1803; Strand=-; Gene=SeqID_55231
caaatgatcaacaaaaaagagaaacaattaaaatttgaaacaattaaagaaaagttgaaggaaaaaggaaaattacaaaacaaagataggacaaaaattgtgtggaaaattggaaaattattaggcacatgactacatctaatacagaaatggaaaaatgaattaaatttaaataaaaacaaaatgaaaaagattattacgaggacaaaaagaaagaatttgttcaacgatttgacgaacttaagtgtttatatggccaaggcaaacagaaagaatttcagaaggaattgggcatttctgcaatg

SEQ ID NO: 107129 - DNA, 445 bp, Heterodera glycines
  Promoter: Source sequence=SeqID_8472; Location=3988..4432; Strand=-; Gene=SeqID_68192
aaaaaattgttcgaattcgggttcgggatgcgaaataggtcaaaatggatgttcggcacacatccgaccaatttctgtcctaaacaggcactcacgcgaaaacgtctttataaaaatgttgaagacagacgtggcacttaaaagtgggaaaaagggagacaaatactgcgcaacattaaatcaatctcaccaataaaatatcaaaatgtccaacaaaacaggaaacatattattttttaaccaaatcacgtgcatttcatttgattttcgttgttagcaaatgaagaataagcttctcccagcacttccttccgcttgtttcgtttttaaatgctgcaataaaattaattattaatgtattctttttcaaataattcattcattttaattcattaaaaatatatatatatttgttatgcgttttattgaagaatttaaattaatg

SEQ ID NO: 107130 - DNA, 932 bp, Heterodera glycines
  Promoter: Source sequence=SeqID_6475; Location=1649..2580; Strand=-; Gene=SeqID_61728
aaagagaaaaattaatcatagacatataaaataagtgagcgaaacacgtaaaaaaacatagaacatatattagtgcaacaaagcggacgtgtgtaaaacatgaagtaatattgttaaactaataaaaataaagtacattggaaagcagaaaaacacgtaaaaataggacaaccaaacacgtaaaagaagtcagaaaaacacaaataaacatagaaatataatataattgttatgcatactcatgaaaacaaggaaaaagagaaaaaatatatgtgagcgaataaaaacaaaacacgtgaacatagatataccgcgtgctggcgcgtttcttaaaaactgccacccatgcgcgtttcttaaaactgccagcgcgtttcttaaaactgccagcgcgtttcttaaaactgccacccatgcgcgtttcttaaaactgccagcgcgtttcttaaaactgccaaaaaagatactaacatattatttcctattttttaatttaaatataaataaataatttatgatttcgtgctaatcgataatataaattaaattttttgtttaagttaatacgtaacagacgtgactttcatatgttagctaaaattatggaaaattgtttgccagccttaaattatagccaactacaaaatatttgccaacattaattatatatttataaaattgaaaacgtatatacaaccattataaaaaatatattaacaattttttaagaaattctgaagaagagatattttcaagtgaaagcactgaaaacagcatttctagccaagaaactcaagggggtttaatttacttaaaaggaaatataaaatataactaataaataaatattaaattttaaaaccaaaataaattttaaaatcaaaatattaaaaattaatgaactcataatagttcaacatgttgctaccatg

SEQ ID NO: 107131 - DNA, 399 bp, Heterodera glycines
  Promoter: Source sequence=SeqID_5878; Location=3363..3761; Strand=-; Gene=SeqID_59525
atttcagtgagtttggccaatggtggtgttgattggtgactgctatgtattttttttaaataattttatttaaaaaaatgttatggcatggcaccttccgcccacatatttccctttaaattttgccctttttctcccctttccgaacacgttgtccttggtgataagtcgaattctgaattcaacgacttcatccgttgtgatgctctaaatgtcatttcatttgcatatttttagatacgccacgtgccgtccttgcaccatcattttcgcgagtcgtaaagagtaattaatttgcatattagtcatttacagggttcattttctgaatagttataaatgcattcagaatctgttagaaatccttgtgactccaccaacactttttggcctcggatg

SEQ ID NO: 107132 - DNA, 138 bp, Heterodera glycines
  Promoter: Source sequence=SeqID_13142; Location=1591..1728; Strand=-; Gene=SeqID_76947
cgggcggaagtcgggtaggaggggtccaacagtccgggtgttcgcaactcacagattatttccccactcccgggaaattgacccgttggaccttgaaaaaaatcgaaaatttaatgtattataaaaatgtttaggatg

SEQ ID NO: 107133 - DNA, 1003 bp, Heterodera glycines
  Promoter: Source sequence=SeqID_5278; Location=3066..4068; Strand=+; Gene=SeqID_57540
acctataacaatataatttaaataatattacaattaataattaattacaaaaataaaagttcgtgctcatcctttaattttctacgtatccttacatcttttacctacttacccttttttgcttttgcttttcctctttgctcactatttaatccaatttcaccacttaattttaatataaatccctcaattttaaaaatataaaaaaaaactccaataaacttaattaaatcataaaatttttataaaaactttacttcataaaatttaaaaaaaactttcctttattcatatatccatattttacccaatcaatcaataaaaactataaatatgaagcgtgcctccaaagcccaatcttcatctccctcccccaaaaaatctcaaaccaataaatgcattcgtaaaattgaccaatttacttccaaaagtcttaaacatcattttatccgttccaaatctaaatttgttattgatcaaattgaaaaatgtgcagatccacaggctgaattccgttcatgcgtgcacaaggcggtcgaggaggctattcaagacgcacagaacacacttggcgctgcaaataaggtaggtgtcataatttcttcggaacttttagaccagggagacatcatcctaccaattacgccaattacgtcaaacgtcgtggacgccgttttcaaccagttttgtaaagtggagcaaagcaaaagcaaatacgtcaatttttacggggccccatttgttataaccgtcactgtcctgaacactgatggtctaccccgtcgacgaacgaccaaaggaagtgcccctccaatcttctcttcccaatcacacatcttcaaaattaacaacaatgacaactattgccttttttatgccctggaactgatgcgctactattctctctacaaaagagggattatcacggaaaaccgatggagatggatgaacaataaccaaactactgttcttcgtcaaaaagtactacttttactccgcgatg

SEQ ID NO: 107134 - DNA, 119 bp, Heterodera glycines
  Promoter: Source sequence=SeqID_24676; Location=776..894; Strand=-; Gene=SeqID_55413
aaaataaataaaattattaatttacactgattaatttttttgagccttttccaagaataaaaaaaaattattttttatttttggtttttatagggaacattaattgttcactttagatg

SEQ ID NO: 107135 - DNA, 560 bp, Heterodera glycines
  Promoter: Source sequence=SeqID_345; Location=8626..9185; Strand=+; Gene=SeqID_83393
aacagtgggaaaaagagagagagagatatgaattcagcacaaatagatgtgctactaaggagaatgcgtgttacaagtgggaagttcatcggcgtttacgcatcaaacaaaataccaattgtacttgagagacagaaacgactgcggcgctacccccactgcatggtcgtaaacacagacagggagggaacacgcggagaacattgggtagcgtgctatgtgccctgtgcgaagcgaattgaatactttgacagcctaggtgcggcaccaaatccagatttgtctgcttatctcaaccattttcaacatgtgcaggtcaacacgcatcaaattcagttcccctcatctgatgcttgtggccacttttgtgtctatttcttggccagccgatgttccggcaccccgttttgcaatgtaattgaaacgctgcgcaaaacacgtgggatggcagactggttggtcaaatggtatgtacgtacactggcgcgccatgtataaaaggccgaccaaaagtggggagggtgccacattgtttctttcattgtgagaacagaaggatg

SEQ ID NO: 107136 - DNA, 86 bp, Heterodera glycines
  Promoter: Source sequence=SeqID_11100; Location=2016..2101; Strand=-; Gene=SeqID_74430
agtgagtgagtgccctggcttttgaccaaccccaaaaagggtgtgcgttcggcacaaaaagaccggcattttgtcatgaaatcatg

SEQ ID NO: 107137 - DNA, 604 bp, Heterodera glycines
  Promoter: Source sequence=SeqID_10608; Location=1618..2221; Strand=+; Gene=SeqID_73842
atattcaattcctaactttacaaaacatttagcacgaaaatggtttgtgcaaaatgtgccaaaaaagtggaacacatcgatgagctttgttactgcatggaagcggcaaataaatgccaccaccgtaattggtaaaaagacaatgaataaaaaaattgttttatttttggcttaattcacttaattgtttcggattgatttcggacttttcatgcaaaaatttaaatgagtaaaatgaaatattaagaaatatatccataaacagttttttttaaaatatgttatcgtttcaaagatttattgtgaatttgtctctattattttagctgttcgagccgcaacaatcgtgctctgacctactactgattttgattggatgagaagaaaaaagcgattttaggcccccttcaaattgaattttcatacaactaaatttgtaaaacaattttttggttttatttttgggttttttaaaatttaaaaattcaaaaaaaaacaattttgaatacaaggttaaaattgccttttattcataatttttataatttattatatttatattatgatttcacttctaaaataagaaaaaaaatcgacaaaaatg

SEQ ID NO: 107138 - DNA, 88 bp, Heterodera glycines
  Promoter: Source sequence=SeqID_8795; Location=983..1070; Strand=-; Gene=SeqID_69251
atgcagtcaacaccgattgggaaatagcagcagcagcagtagaagcaaaatcagttcatcgagaaaaagcattacaaatgccagcatg

SEQ ID NO: 107139 - DNA, 317 bp, Heterodera glycines
  misc_feature (30)..(30): n is a, c, g, or t
  misc_feature (73)..(73): n is a, c, g, or t
  misc_feature (93)..(93): n is a, c, g, or t
  misc_feature (100)..(100): n is a, c, g, or t
  misc_feature (147)..(147): n is a, c, g, or t
  Promoter: Source sequence=SeqID_37329; Location=1..317; Strand=+; Gene=SeqID_66425
attgggacttcggatacactaaaggatgcnttcataaggtttttatcgttggggtacgaatgaaaatatcaanaatttagcttgactgctgtnggtgtangctcaaaatttcgcgcaaaaaatttactctagctatcaaaaaattcnatggggcccacacttcggaacgcatctctgaaatcctaaaagctcttctcgaaagttggaatgtaaaagaatgccattgtttgtgaccgatttcggcagcaaatttagttaaggttagtttattgaacattttatttcaaatacattttttggaggcattggatttaatg

SEQ ID NO: 107140 - DNA, 177 bp, Heterodera glycines
  Promoter: Source sequence=SeqID_41742; Location=1..177; Strand=+; Gene=SeqID_69809
cgtccgtttccctttcagctcacttccctcgccaccacctccgactcgggccttttgacgcgttcgccgtcctccgcctccaccatttccggcattcagcagcagcaaaataatgccatcagtgcacaacgaacggaagaaacggaacgacgagcggcggcacatgaaagggaaatg

SEQ ID NO: 107141 - DNA, 358 bp, Heterodera glycines
  Promoter: Source sequence=SeqID_6305; Location=2191..2548; Strand=+; Gene=SeqID_61081
ggtatgttttttgtttttttgctgattgtgagattattatttctcgttgatttttttaaaactaggggtggaatcttttttcggtatttttttgtcgccggatttccacgcaccctagcaatttttatgccaaagtttctagcaaaagatttgcaatttttattttgtttttcaaaaattaatttcccggctgcgcgtatgctaccggaagtcagcattccgacactttttctgacttgaggaaccacccttgtcatacaaccactctccctggtcatacacataaatgccaattttgaaacttaaaatttatttaaaaaaacaatttcattcaaaatttttaggctgatgacgaatg

SEQ ID NO: 107142 - DNA, 450 bp, Heterodera glycines
  Promoter: Source sequence=SeqID_3152; Location=2053..2502; Strand=-; Gene=SeqID_83440
atcagtgatcagaaaagtcgagattgaatgagaaaagaaaatcaatcattgagaattatccgatcagattttagatgcgacaacacccttatttttgatcgatgcttttatccagttaaccatcaatcagtttgacaagtatttatgataaaaaccccgttccaatgacaaataattgtcaacaaaattttaacggcggtctgttaaaatcctccggccgctaatggtggtccgctttctatatcccactaacggcggtccgctaatggcaatcgctaatgtccctgtcccactaatggcgctgcgctaacttttccataccgacaaaatctttcgtcctcaaagtttgtctggccggcaccaattgaatgaacatgccacataactaacacaaaccaaacacacacatatagtagcaaagcggtgtaacaacaaaacactataacaatg

SEQ ID NO: 107143 - DNA, 159 bp, Heterodera glycines
  Promoter: Source sequence=SeqID_28659; Location=1..159; Strand=+; Gene=SeqID_59248
atattttcttggagattcatgcgtttttagacgttggacggttcagtcctaattgtaagccattttgccaattcagtcccgggtctgtaactctagggaattgtttccgccaaaaaattctttcggattcgttagttacagaccaagaggaatcgaatg

SEQ ID NO: 107144 - DNA, 247 bp, Heterodera glycines
  Promoter: Source sequence=SeqID_3130; Location=6183..6429; Strand=+; Gene=SeqID_83326
ttattattatgtcaaatccttaagaaaattatttaaataaagttcaactttaaaactttttagatgaccataggaacaatgagataaaaacaacaattaagaaaaccaaagttattggatttttccaccttcttaattagggcaaaaaatttaaagatttgaatttaaaaaagcccaaacagtatgacaattataaataaataaagaaaacattttttatttaaatcaaaaacaaaaatacaaaatg

SEQ ID NO: 107145 - DNA, 1003 bp, Heterodera glycines
  Promoter: Source sequence=SeqID_793; Location=4903..5905; Strand=-; Gene=SeqID_61382
ccaagaaaatcttggtaaaacttggcctacttagtacggaacgggccaactccgtctggccaactccgtctgagccaactttgagtcaatataactcttgaagtttttgaccgaatcaaacaatcttgatatcattcgaaagctcttcacaggctctattagcctactaaaaattacagaaaatttcgaactataaaaaaaatagaaataaaaaactttgaaaattctgccttttttgcggttttaaactgacaacttttttgagagctgattaatcactgagaaatagcttataaatatcttctaaacatctagggctttcgaatgataccatgattgtgaagtttggccaacaaagaaaaaagttatagctttttgaacattgctgagacggagttgacccctaccgtgaaaaaaagtcctttttgatgaatagttttcttcttttgttagttgtagcttgtgttttttttcttttttttaaaaaaaattaaggtaggggtcgccggcgaaggggaaaagagggaaatttctgaaaaattttgctattttttaacaaaattcattaaaaattctgaaaattttttccgacagcgcttaccggtaccgcatgccccaaaacttctaattcttaaatattggctaaaaccataaaatttagtcatttttattctgggaagggtttacaaatgtgcccgattaatcagcatgggattggaaaaagtgatgattatattacagagttcccaagtgtccttatttctaagatttgtccttatttggaggggccggatcttagaaaatgaaaatgtccttatttctaagatttatcttatttttgactcgacgtgcatatttcgttcttattttggatttgcaaataaaaatctacaaaattgaataactttacttatttttttattgaagcgaatatttttaattaattcgattttcaaataaattatattttacttcgttttcttgagtgtgaatgcccaagatg

SEQ ID NO: 107146 - DNA, 52 bp, Heterodera glycines
  Promoter: Source sequence=SeqID_14814; Location=1447..1498; Strand=-; Gene=SeqID_78965
tctgaagaaaaagaaaatgaaattcaaacaaatattcttaattgcaggaatg

SEQ ID NO: 107147 - DNA, 165 bp, Heterodera glycines
  Promoter: Source sequence=SeqID_5119; Location=1..165; Strand=+; Gene= SeqID_56981
ttttaacccctttaaaaattaacccattttgcatatcaaaaagaaattttttggaatatgaaaaaaaaagtatttgaattttccctggatcaggaaggaaattcgctctatatgagaaaaataggcgattaaaccataaagcattgaataactcttcagcaaatg

SEQ ID NO: 107148 - DNA, 1003 bp, Heterodera glycines
  Promoter: Source sequence=SeqID_18572; Location=164..1166; Strand=+; Gene=SeqID_83202
gacaataaaaaaggaaaaaaaattgaaaaatttgaaaaaaaaaaaaatggggatacaaagtaaattagtacctattgtttgaggatttttgacatcccttcccgtcgatttctcgaacccttgacccaattttgggtccacaacaaaagtttaacatggaaaaattgcccaaaatacaacagcaaactccaaattaatcattccttctgttttagaccaaacgggccaaagactttttggcctatgcccattatatggccgaccaaattggcaccatcggggaacggcggcgtcagctcaaatttttgcatcgctacgaccaaattgagcggccactgaagcgcaaatgtgcattcattcatcgaatctgttctcatcgctgcaaggtttttgattttttttaaatttagaaatttttcatagattttttcaaatttgaaaaaaaattttcaaaacactttttggccaatcccgaaaaaaccctttcggattggtttgaggaaacaaaaattgaattcctttaggttttgattcaagaatcggacaacattccaccaactcgtttttggccaattcattttttaccctactcgttttttgtctataaatttatgtagaagtgcagacagcgacaagttcgacagttcatatactcataacacgtaaaaaacgagttggtttcttttttaccaaaaaagcatgtttttccctttttattccattttttcgttgtgtcaaacaattcatttttcctttaagaaaatcgtttattaccgtgaagaaattgcttttctgcgccatgccaacatgttcaagcagtgcagccaggcgtacactcggctgttgaatgtatgaagattatttgcaccaaatcgttaaaaaaattttcttttattgaaatttcttataaaaatttcgatttttgaaatttgtctgagaaaaattttcaatgacattttaattttttgtattatatgatacctatttcgttaacaggtgcatg

SEQ ID NO: 107149 - DNA, 585 bp, Heterodera glycines
  Promoter: Source sequence=SeqID_10046; Location=4478..5062; Strand=-; Gene=SeqID_73111
ataattctcagaatgacacaattatgtgtgattttaaatcatttattttctgcaaaaattgatgggaaagctcttaataaaaactcgtttctcgaataaattttaaaattagtattttcatggtcgctgatcactaatataatgacatttattttgacactgattttatttgatcataaatttgacataattacatatcattaaacgtaataaaatataaatcattaaacgtatcagttatggcaataaattgcataaaatctgttcaaattcatttccatttggttgaatctttgatcagattacataagatgagaaaaaattgttaatttgtgataagagacttaaaaccccgcttaattattgttagctcatattaattacttccaatattcgctgagaaaagaaaatataataataaattgaattattattaaaatgttgtatcgtattgatgatagatgactaaatgtggttaatattgattgaagaaaaattaagccatgctataaaattaataattacaaaattcattgcgaaaaatatttttataaaaataattcattatatttttacaaaaaaatg

SEQ ID NO: 107150 - DNA, 80 bp, Heterodera glycines
  Promoter: Source sequence=SeqID_12225; Location=1287..1366; Strand=-; Gene=SeqID_75799
cctaacccgacaattcgaactataagcaattaatttaactttattaacagattgtaaaatcgctgcaagagaaagggatg

SEQ ID NO: 107151 - DNA, 65 bp, Heterodera glycines
  Promoter: Source sequence=SeqID_7260; Location=499..563; Strand=+; Gene=SeqID_64282
cctgaccattgaatgttcaaattaattccaatttccataaaatttccagggcaggtgggagaatg

SEQ ID NO: 107152 - DNA, 976 bp, Heterodera glycines
  Promoter: Source sequence=SeqID_4580; Location=1..976; Strand=+; Gene= SeqID_54966
ttttgcgactgaaaacgagcaaaacgaacaattgtttatggacgaaaacgaaaatatcatttcaaagcttgacttaacagaacctgatgcttcatttttgcgttattaccaattcaataagggtgatcaaaatgcaaagtgccgtatttgttgaagtcaaatatcacgcaaaggaggaaacaccacaggaattaagcatttgaagcaacataaaaagtctttaatttatttttcatttctaactacttgttaagttatcactagagaccggcggatcgggactcccgcgggattttacgggagtcccgctcccgactgtaaaaatgcactagtaagaattgaatttttttggaaaaatgaataatttttgatcgaaaacttaaatatctagcaaaaatctcaaaaaaaaattacggcggcgcctatcggcaccgccgggccttaaaaatccttaattttcttaaaaaattggctcaaatttggcaaaaatttgtcatttttgaataatttattaacacattgaactcaatgcggataaaatttcgttgaaattaattcaattttccatagtaaatcatgaaaatgaatatattttaaaatatttttgcaaaataccgaagaaaacaaaaattatacgaaaatcattaggtcattttttagacaaaatatgttaacaaaagaaaacgttttttaaaaacaaaaaaagtcgtcgagttgctaaaaaatctgtaaaatttgccacagggcttgaaccctagaataaattataaaaaatttatttgaagcaatttcaaaacatttgcttctgtattcgataaggaattttcgtccaagctgccgcaaaacaaatgaatattgagcatttccatccgaaagaaaaatggcacaattcacactcgaaatacaaaaaaattgactcactaattttgcttttcatttgcctttcgtgtgagccattccgggaaaaaacggaatg

SEQ ID NO: 107153 - DNA, 477 bp, Heterodera glycines
  Promoter: Source sequence=SeqID_9944; Location=1979..2455; Strand=-; Gene=SeqID_72990
ggcactggtgtcatataaaacaaaattaggctttgcccgttactgtccaatgacaacaatcaatggacagatgcaaatggtcttggtcatccgtccgttcttcattcacctcgattccattcatcctttcctttctcccctctcagctttgcgacaatccctcctcccactcccccccccccctttttttttgtttatgagtagagtgaggatttttattattttaccactattttcgcatttttctgtcactatttagttaattattttgggattttttgccgctaaaaatcctcaccctatttatgagttagaatcttcgggaagaattttcagaattcagagacactaacgaataaattccctccccatttgcgggtttcaaccctatcaaaattttgggccaatggacagctttatttttgcgatttcagttaatccataaataattcaattgccatcgcaacttatcatatg

SEQ ID NO: 107154 - DNA, 126 bp, Heterodera glycines
  Promoter: Source sequence=SeqID_26652; Location=152..277; Strand=+; Gene=SeqID_57407
ggtatggaaacggcagtatggaaatgggtcgagctaagaatttttccgaaaatcatgaaatacttaggcgcctaggtattattttctttgactcgccttgctttgcttattttatttcttcatatg

SEQ ID NO: 107155 - DNA, 67 bp, Heterodera glycines
  Promoter: Source sequence=SeqID_10462; Location=541..607; Strand=+; Gene=SeqID_73665
atttttacaaatcgaacagggattgcgcaacagtttcattggcgggtcacttgggataaaagtcatg

SEQ ID NO: 107156 - DNA, 528 bp, Heterodera glycines
  Promoter: Source sequence=SeqID_20691; Location=806..1333; Strand=+; Gene=SeqID_51249
tgtttaatgactctctcctgatcactcgttgttctttcttcccctcgctctcttctcttcccgttctcttttcatttgtcctccgtcgatctgtgcgcaaaaataaatcagtgaaaattcttccgccaaaatcgatcagagcgaaggacggacggacggacgtggtcagttcagtcagtcagcaacaaccatttgcacatttattatgacgaactctgtcccttccttttgcctctttatgggcgccgaaaattttaaattttaggaattaaatcaaaaatttttgcctaattattaattgctttttaaatttgggttggattcgatgcgataaatgatgaacctcttcgttgcttccaaacggatgagagagtctttaaatgagtctctaaggcttttttaaaatattcttttatttttttcgattttttaccaacaaattttatcggggaaccgcgattttcctctccccgaaggtcggggagcaatattgtttttaattatttttagcttttttcgttaattatg

SEQ ID NO: 107157 - DNA, 197 bp, Heterodera glycines
  Promoter: Source sequence=SeqID_15615; Location=1..197; Strand=+; Gene=SeqID_79904
acaaatcgccctcaatgaggtgagtgatcagagcaattcaattgcttttttactgtcaaaagtaattaattaacatgctttttttggctgcaattgcttagtgtcttcggcgcgaaaaattgaaaaatttaccgtatcctaagactcatgaataaataccatagtcccttgccaatctcaaggttttcgatgccatg

SEQ ID NO: 107158 - DNA, 70 bp, Heterodera glycines
  Promoter: Source sequence=SeqID_31528; Location=1..70; Strand=+; Gene= SeqID_61857
tttattttttttttggtcatggaaagatatatggatttcggtaaatatcttcccacaaactcacaaaatg

SEQ ID NO: 107159 - DNA, 499 bp, Heterodera glycines
  Promoter: Source sequence=SeqID_9515; Location=462..960; Strand=-; Gene=SeqID_71710
tttttcgctgaaacatcacctgattcccatggcaaacacgatagccaaggaatttttttgatggtacttttctctcaaaagcaaaatgtgctctttgtacatttactctgtccgttgtgagaaaaagaggaatccgaggtttaaacattctgtaaataaaatcataaacgaaaggaaataaggacaagttatgaaaatgatgtgataaaaagccttttaatcaaagcgagtcaatttgggctcccaattaggtaagtttattttttattcagttagtatctgaacgccaaatttgccacaatttaaaaaagatttgtgattcccttgtcaaatgcaagagccggtctcgagttgaaaaataacaaacaaaacttctctagaagagatcaaaatatgagcctatgcaaaatttcaagaaaatctgacctcaggaacggatggcgtttttagaattttatttttaaaatgcatttattttgtttttagcgcaattaaaatg

SEQ ID NO: 107160 - DNA, 52 bp, Heterodera glycines
  misc_feature (4)..(4): n is a, c, g, or t
  Promoter: Source sequence=SeqID_35496; Location=43..94; Strand=+; Gene=SeqID_65036
cgtnaagcaaaggaaaagacagcagggggaggaaacaaacaaataaaaaatg

SEQ ID NO: 107161 - DNA, 90 bp, Heterodera glycines
  Promoter: Source sequence=SeqID_3602; Location=891..980; Strand=-; Gene=SeqID_51056
ggtgggaacgtcactcactccccctttgggatcgaccatcttttgaacgcacatttgaacaattaaaattgcaggaatgccatacgtatg

SEQ ID NO: 107162 - DNA, 783 bp, Heterodera glycines
  Promoter: Source sequence=SeqID_12347; Location=2519..3301; Strand=-; Gene=SeqID_75943
ctttttaaacaggccaaaaagtttaggcttaacttttttttcagaaactgatcagaagcgccccaaactttgcagggatactgaaaggaaaagaattaacctgttttatcacattagcttgtcatcagtttttataaaaaattttcaaaattctgagtctcctattattttatttttttttcaaaattttgaagggcgggggggggggcgggatcatcatttgatgcaattcttgtttatctgctttttgagtgtgtcgtgtgcccccgggtaatgatgatagatgtgaagaaaagtaggaccaaatttcatttcatttacaatttatattaaataatacttttaaaatatttttatgggtatggaatattagtgttttatttttataaagccagaaaatttttggaaatttgataacagagttccgaaattttttaagaaaatgtttgggttcaacgtctaaaatatttgttgcacgtaattccgacttccaaaattttttattgcctcgcaacttcttcccttataaatactacattaatatttaaaattatataaataaatgcctggtaaatttgtttaaaaaaatatatttttttttctatttttctgcttttattattatggccctatcacccctctaccacccccccccccgccaacactcgaaaacaagtccctagtaacctgggcctggaaatttttatgattttaaaagaaaaccataatataaccaccaaaaattttttttacctaactatccagtgggtttcaggttttatg

SEQ ID NO: 107163 - DNA, 90 bp, Heterodera glycines
  misc_feature (50)..(50): n is a, c, g, or t
  Promoter: Source sequence=SeqID_28111; Location=1..90; Strand=+; Gene= SeqID_58761
actatttcgtttcaaattgaatcattttttttggctttttgaaataaatntgtgaaaaatatacgaaaattattttagcttttaattatg

SEQ ID NO: 107164 - DNA, 1003 bp, Heterodera glycines
  Promoter: Source sequence=SeqID_1639; Location=4746..5748; Strand=-; Gene=SeqID_75007
atgatgttttaataggtgtaacattttctgcgacttggttttttaaatgcttccctttcattttgagtaaattttaattcttaactcaagcttagtgtgagagaagcaaagttttttggtgaaacaaagaaatatcgatttagaataacggttattgcgcacacatatatcatcattttgacaaaaattgcctaacattataaaaaaaattaagtttcgaagcgaaagttaaaaaaacaataagtgtgaagaaacggcagacactgtatgagttagacactattaatagttaatggtgaacaatacgccaatgaaaaaacagacagctgagttagacactatatctctatgggtcaagcccagtgttagacaaaattgctcatattcaaatggatggaacggcaatacaaatgcgttggagacgaaaggcggtcagttaatggccattccatccatttgaatcgattttggaagataaatgtgaattttgttaaaaaattaaattttgactttttgttcgaattcgggtccggggttcgaaattggtcgaaatgaatgtcatattcgtgatcagcgaccccgaaaaccacaggaaagacgttttgatgaatttcaaaaaaaaaaaattatttttgaaaaaggggggggacaaaccctactattacctgagttttttattattcggatgggccctaaggttaggcaaggggtaatataaaggttatattcgtattcagcgacccgaaaacactaaaaaattttgtttttataaattttgaaaaattttggacatttcgtgggtttttactctattggaggacatttcgtggcttggacatttcgtggcctggacattttgtgggtcagcgcaaaattcaaggcaaaataatttttaaaaatttccacaacgaaaacaccaaagaaaaataataaacaatttcaaaatcgcagaacagaaaaacaaacgctcataatcactattccataaattcgacccaaaatg

SEQ ID NO: 107165 - DNA, 141 bp, Heterodera glycines
  Promoter: Source sequence=SeqID_13741; Location=1..141; Strand=+; Gene=SeqID_77660
gaatttaattttgaaaaaaattattttttaaattccgtatagattaaaaggccactcatttttgactgttttttttaccatgctaattgtacatattgctagcattgttttgcttccttcctttaggcaatcaaacggatg

SEQ ID NO: 107166 - DNA, 134 bp, Heterodera glycines
  Promoter: Source sequence=SeqID_1188; Location=2137..2270; Strand=+; Gene=SeqID_69540
tctaaaataattgacgggtaaaaaatagactttcaggatgtatgtgcaggaattggccactgaactttaacctaatcccggattaacgcaaaattaatgacgaaccccaaagccgaataagccggttgggaatg

SEQ ID NO: 107167 - DNA, 879 bp, Heterodera glycines
  Promoter: Source sequence=SeqID_25912; Location=1..879; Strand=+; Gene=SeqID_56681
ttataaatttaactcattccaaattgtttcttccatttcataattacgtaatggctaactccaattttcttgcaaatttcggcataattttgtcgccattctttggttgaatatttttttcctttttgtttatattcatttgccatttcaatgaatttttttacaatttcaattttttctttatcagttttggattttttgcttttattaatttgtttattaagtcctaattctttaatccatttataaattttcattcgatttgtccccaatttttttgctaatttttctttcaattttattccattcatttgttgaatattttcttcctttttgctttattttttcttttattttataaaattttgcaattttttcttccaatttttcttcttctttttcttcccaattttctccaaatatttcgtcaaatgacttttgctgtaactttttcttttctgattcaattttgacaattattaaaaatataattaaaaataataaagggaataatttcatttttgtcgtcttaaaatgattttattttttcttcaattaaatgccaattcattttttgaggcatttaaatgatttttttctgattaaaaaactgaataaatcattattttactcaataaaataaggaaatcctgtttaatttcaaagaaataatgataataattttatcttaatgacaaaataattgccaattggtaaattaatgcctccatttttgataaaaaataacaatgaaagaataatttcattaattctcaaaaatgtattttattttttattcatagggaaatataaaacttctagtgtttttatacatgaaataaagaaaaaattgaaattgtaaaaaaattcattgaaatg

SEQ ID NO: 107168 - DNA, 549 bp, Heterodera glycines
  misc_feature (73)..(73): n is a, c, g, or t
  Promoter: Source sequence=SeqID_29902; Location=1..549; Strand=+; Gene=SeqID_60361
atgttaaagcaattttcgattcaattggccaaagtggcgatttggagtgccaaacaatcgacaatttgtttgnatgaataattcatggagggggagcttcgacagtgtttctctcctcgcaacccccgcatttttccaattccgtaaattttcagtggcaaaaagtggacaaaaaaaaaaaccaaagaatattttccttagataatttaattttatttaatattcgaatttctcttctcaattggtgcaccgatggaatttattgaaaaggacgacgaacagagccttcttcggtcagttcagaaaaagaatatcccctcaataaataattggcgaaagccccccaaggatttcatttgctttttaatggcaattaatggtaaaaaaggaaaaggctctttccgtactcttctaatgaccccacggggactctttaattggaggatttttgaactgctgaaagttcgtttgacaatttacaatgaaacaaaaaacaaagagagaattgagtctaaagattgtctctaaaccaaaacgctattggacatg

SEQ ID NO: 107169 - DNA, 141 bp, Heterodera glycines
  Promoter: Source sequence=SeqID_27793; Location=1..141; Strand=+; Gene=SeqID_58458
tcttatcactggttttgttcattataaattttacaaattatcaatttttcatttcactcttttcccatattcccaggtcattgactcgtccgatgtcgtcatcgaagttttggatgcccgcgatccgatgggtacgcgatg

SEQ ID NO: 107170 - DNA, 190 bp, Heterodera glycines
  Promoter: Source sequence=SeqID_4525; Location=3976..4165; Strand=-; Gene=SeqID_45839
ggtaattttaaaaaaaaatcgagggtgggggggggctcgaaaaattttggcactttttacggatgggccctcccctgacaaatattgaatttttatgaaaagcggaaaaaatttcgagcctaaaaggtccctatttggggttgggttttcgggggcctaagcatccgggagaacacacccgtaaaaaatg

SEQ ID NO: 107171 - DNA, 263 bp, Heterodera glycines
  Promoter: Source sequence=SeqID_19920; Location=829..1091; Strand=+; Gene=SeqID_84679
ataaaattaatggaatttttcggtgaaaatatttaccaaaagttttatttatggatattacgtgaaatcgaagaaagactattaaaaaaaaattaaaaccctcactgttttatcatatcattaagttagtattcgttttcgtttctcaatttttttttaatttaaaaaaattctctgtgtttttttattttttttgggctttctctcggttctctcaaccccttaaacgctgctctatttttaatattttcagcatttggatg

SEQ ID NO: 107172 - DNA, 94 bp, Heterodera glycines
  Promoter: Source sequence=SeqID_19131; Location=1021..1114; Strand=-; Gene=SeqID_83874
aagtctgatcattaatcagaattcggtgcgttcaggggtagtccgtcgtcatatcaatgaacagttgcgcagcggccaactcagtcttgaaatg

SEQ ID NO: 107173 - DNA, 995 bp, Heterodera glycines
  Promoter: Source sequence=SeqID_26094; Location=422..1416; Strand=+; Gene=SeqID_56840
aatttgttaactcaaatatcaaacaaaaaagcatcgctttcgtcctcacacaaatcgatcttttaaatttccataatattcggctgttaaaagtccgggttaatttcaaaattttttgtcccgttaagcaatgaaaatcaaaactaattttattagccgtttctttggtttaccgtacttactaattagtaccccccggggcttctatttttcaacccccctcgagggggctattctaatttagggggggggggggggttactaattcagtaaatacggtatattgattatgaacatttcaccgcaacatgtagaaaccgtaattttgaaaaatactgactcggaccaggttctgaatatccgagttcgctggcaccggcctggcttagaacaaagcccggcgggcatatttcaacttcgagaaacaaattccgacaaagtcaattaaaaatggaatgagtttttcaaacttgttctgattttcacatttgtcctgagaaaaggaataaaatgacgattttttttgttattataattaatgtaaaatatttctgttttggatgaaaaatttgttaataaatgtcctgattttttatgtttgtactgacttttttataatcgatccaagcaataaattctcatttcttcatttaataaataattcataaagataaaatttcctttttttgaattgtaaattattagaatttattttatttttattgaaaatatgtttattattttcgaatgagctccagtagaaagtaataaaatttatttaatcattaatttaccaattggcaattattttgtcattaagataaaattattattattatttctttgaaattaaacaggatttccttattttattaagtaaaataatgatttattcagttttttaatcagaaaaaaaatcatttaaatgcctcaaaaaatgaattgcatttaattgaagaaaaataaaataaaatcatttccagacgacaaaaatg

SEQ ID NO: 107174 - DNA, 539 bp, Heterodera glycines
  misc_feature (92)..(92): n is a, c, g, or t
  Promoter: Source sequence=SeqID_37920; Location=1..539; Strand=+; Gene=SeqID_66884
gctgctgctgcttcttttttctgcttggcttacactataatttttgttttcattcgaaattaaataaaattgtaacaattttatcattttcncaataagccaccgttttagtgccaatttctgctgatggcacttccttgtgctcggctttgtgcccttttctcagttttggtcgtcacttggaatggtttcgtttcctttttaatgactttttctttcctttttctctctctctttttaaataattttaatttgattttaatttaattaatgtttttgaattcacttcagtttcccgtgcgtttattgtcgcgcgcgttgcgaaaaaggaagtgccggccgagtgccgaattctgaaccacgagacggtgtccgatcaaacggtgcccgacacgataaccgtcaacgagatacggtattgggtgtacggtcaaattcagcacggagccaccagcaaggcaagtcgcggactctgcaacgcacctttggcattatgtattttcacacttttgaaggtgttccatggggtcgaaagaatg

SEQ ID NO: 107175 - DNA, 115 bp, Heterodera glycines
  Promoter: Source sequence=SeqID_24960; Location=1575..1689; Strand=+; Gene=SeqID_55697
aataccccacactgctttgtttttatgtgcattcatcatcatcattcattcaataaaacatggctaataagtttttacttgtcccacaagaatttacaggggtttgacctcaatg

SEQ ID NO: 107176 - DNA, 1003 bp, Heterodera glycines
  Promoter: Source sequence=SeqID_13709; Location=1528..2530; Strand=+; Gene=SeqID_77627
cagattgccgacctgtgtattgtcaaatgacggattgtccatctacaatttgccactgacggactgtccaatgatggattttgttgcactgacgaattaaaccgtcacaacgaattgaagcaatgaaataattttataaaatttattttataataattcaatatatatttttttttaatttttaataaatcgatgtatattttacatatgaatatattcatattattgatgtgccacctttttcaaaacatttccggtatctatctctgcccatcatccgcatttttcttcatattgaaagaattattctatatgcctctctctttttttaattatatttttaattggtggcaaattttggcggcgtatgccacgcaaatggcaaaatggcatttatgagtgtatatgtatttgtatgtatatatatatggggaaaatatgcacctatagggcaaatataatagtaaatagcaacatttcagtaatcgagaaaatgcattaaagtgagaatttttatttattaaattaagaattcatctcgagtcccaaattggtttatgccctatcccctaattcccaaaactcatttataaaactactcaactaactttgatagctttgacccgaattcaacagaaattttggctatcccaaccagaatttcgtcatgccaatccaactcccccctgaattctcgacttcgacattaggccccgaattttatagccttgaattttatgatctaatgctaacccgaccactatggcctgacggagtcaccaactctttcaataaatccaacctcaacgtgaaatcccaaaccaattttttttaaattttttgtcctctgacaatttggccccggatgggtcgcaattagagaccggaattttcaaattttcagctccagctctgggattggaactcaaaattttttaataatatattatttataataattattattgacaaattttattaatattgagttttagaaaaaatg

SEQ ID NO: 107177 - DNA, 134 bp, Heterodera glycines
  Promoter: Source sequence=SeqID_19043; Location=2888..3021; Strand=-; Gene=SeqID_83777
aaaagaacagcactgattgtgagcagatgacccaccaccgcaggcatctcgtagcccccgagggggaaattggatggacttatataatggcacaattggggatggactttggatgggatggggggggggtaatg

SEQ ID NO: 107178 - DNA, 512 bp, Heterodera glycines
  Promoter: Source sequence=SeqID_3705; Location=5002..5513; Strand=-; Gene=SeqID_45614
gggatttacattttgaaaattcccagaaaagtttggtatatttgcttataaaaattgaaactttacaactcagatgaagaaaacgctgtccagcaaaggctttgtgcgcattcgtggcttgccctacaactgtaacaaggaccaggtgcagcagtttttccgaggtctgttcacaaaccgtttatcaatgtggatgaatgaatggcacgcgcaacgggcgggcgggccaatggttttggtggacaaatggccgggagggagttgtttaatgcattaaatatttcttgttaatttaattagtgttgattttcacttaatggatggtagtaacgcgcatggcttttgttagtcttggaaaacttcgaaatatcgatacaaattcaacaaaaattgtatggcgttttattaccatttccaaaaaactcgacatgagaattaaatttatatatttattcataatgtgtttggtgtagtaatacaattgttaaaccttcccatgacaatgaaaaatg

SEQ ID NO: 107179 - DNA, 79 bp, Heterodera glycines
  Promoter: Source sequence=SeqID_22081; Location=1657..1735; Strand=-; Gene=SeqID_52723
agtgactgatcattttttctggtttaaatcactaattttgtatggcattttcagttggagaagggcgcagatccgaatg

SEQ ID NO: 107180 - DNA, 757 bp, Heterodera glycines
  Promoter: Source sequence=SeqID_11296; Location=2891..3647; Strand=-; Gene=SeqID_74669
aaagaaatggcgctcatttagcgggttagagtccaattcgccgccgaccatttcaccgccactaaatcgaactttcaattttacaaccaaattttcaatgtctaattcgaaaatgttttaaaagaatttcaaacaaaaaagttttgacaatgacgaatctttttcattttgtaaacaaatgctaaataaaacggtattgttttgaattaaatttataaattttaaattaaaataataaacaatcttattcaattaaatgctgatttgcttatggatgatcatttatgccattctgactcacccgaaacgtttacacattcattgagtactatgagccgggatattttaaaattttggtacttttccgttatatggccaatattagaattttttaaaaaatcaacagcgggcgcatagatttgctaaaactaggcgccaaaattatttcgggggcataaatgccacaatttcaaaacgtgcaccaatggttgaatttatttttaaataatttattatatcattacgagcctaagaaaaaaagtttataccggttgaactagtttaagccaagttattcatttttcaaatttcaaatgttcaaaccaaagggttcccccttttgggactttttcaataattgaattgaaagaataaatggtcagctattttattcaattgtttaaaaatgattctattctcgattcatgtgcgtaattaaattattgatatatttatatgtaaattcacaacaaaaatg

SEQ ID NO: 107181 - DNA, 115 bp, Heterodera glycines
  Promoter: Source sequence=SeqID_45448; Location=1047..1161; Strand=-; Gene=SeqID_72744
aaaaaacgggggaaaggttcagacaatttggccggaattggaaggggaaatggcaaataaaaggggagggaatttggacctcgggccaattcatttttcggggccctcaaaaatg

SEQ ID NO: 107182 - DNA, 53 bp, Heterodera glycines
  Promoter: Source sequence=SeqID_16262; Location=1804..1856; Strand=-; Gene=SeqID_80645
ggtattctttttggttttcgtcatttaactggctgacaattgatttagccatg

SEQ ID NO: 107183 - DNA, 265 bp, Heterodera glycines; identical to SEQ ID NO: 99798
  Promoter: Source sequence=SeqID_3502; Location=3829..4093; Strand=-; Gene=SeqID_84935

SEQ ID NO: 107184 - DNA, 493 bp, Heterodera glycines
  Promoter: Source sequence=SeqID_31947; Location=1384..1876; Strand=-; Gene=SeqID_62266
ttttttggataaagcgtgcagcaaaaaccttttattgagttttataaatttggaataaaatttaccaaaatgctgatttttgaccccaaatgctgattttttgccggccaaatgctgattttgaaaattttcagttgggagccctgatatttcctctcattttgtgttaaaatttgatcaatgaactgtttgttgttagcttaatgtcacacgaaaacaaacaaatagtgaagaaagagagaggtctaaaatagggagaaagtgaagagaaaatgaatgagcacagcacagaaaaggaagaaaaggagggagggaaagagagggaaaaggagggaaaggaaacgaaggaaaaaggacccccgccccccccccccacaacatccaatcgaataattcccagggcccatcccccacatttgctcattctttgcaattctctgtccttcgttaaattttatcatttccattaccattgtcctctttttctgctatg

SEQ ID NO: 107185 - DNA, 270 bp, Heterodera glycines
  Promoter: Source sequence=SeqID_14983; Location=356..625; Strand=+; Gene=SeqID_79135
tgccattttgccaatcactttttccctaggccgtgcccggcagaagcacagcctgtccattctgttggcgctggacaccggcattgagcagcaggagttcagcaacatgcgcaaggaggccatggcaagtgaaagagcgggattatcagcaaggatggctgggaccaaaagcctcaaaatttaacgaaactccagtccaaaaaaacatgaatacggccccacatctgacttggatgttgattttaaaaaatttattttatccaacagatg

SEQ ID NO: 107186 - DNA, 1003 bp, Heterodera glycines
  misc_feature (49)..(49): n is a, c, g, or t
  Promoter: Source sequence=SeqID_23160; Location=1141..2143; Strand=-; Gene=SeqID_53864
attaattggcatatattattttttccattaaaaaaactgaaatgaattntacttgtattatgtagtggcgatagcgttcctcagcaagtgtcccatctttttgttcacgaataaatgggagagcacaaatttgttggaaacgatgctcattttgtgtccacaatattttcgaaaaattgttggcacttttttccataatttttaactgaattttttaaaagccaaaaaaatgaaaaattttaaattaaggtgttcttctcgttaaaattatttttaattaaaattaaatggagctaattaaatatcgtcgtcaatttgtgttagacgaagactaacacagcaatgtacactaataaatggttcttattaccctaattaacattaattggtttcaccaatttgaccgccacttcattttggtgttgcctaatgataaaaaaggatcgattggctgttttttataacttcgtattaaattaaataatttctttccatccccgtcataaaatatttaaatttaaattatcatttgcttcaaattgtagaataattttcaattaatttttctattatttagtgtttttttttaattttaaaataggcaaataaaatttttattaacgctttttaggtaaaaatcgcatcgcgtaaaagcttaatcaaaaaacataattttgcttatatttcaatttttttaacagttttttcgaataagacaatttttaaaccaaaatttttatcaaaaaaaaaaacaaattacttttggagattaatttttgtgaaaaatttttcaattcttaggggtgtaattttcatatttattacatttttgttaaggatttttccgaaaatcctgaaaaaggcgccaaaaatggcgaaataggcacaaaaattggcattataaaagccatcgtagacaccccaaaccaagcggaaaacgcgtttttcgtgctaatctgtgcgtattaagtgcgcaaaaattttaggcatttgcctaaaaatg

SEQ ID NO: 107187 - DNA, 1003 bp, Heterodera glycines
  Promoter: Source sequence=SeqID_562; Location=5947..6949; Strand=+; Gene=SeqID_56225
tttggaaaatttttatttttagagcaattttgaaatgtaggcccccgtttgggcacaaactgcttaaaaaatattcggcgctatattaaaagtgggcctttttgaaaattttttaaaaggggggacacacttttgttttgcaaaatttttttgtgatagtcataaaaatttattctctggggtttttggggtccccgatcacgaatccttcaattattttgatcaattccgatttcctaatctaaatttgaacaaaaaatcataatttgaaaaattcaaaataatagaaaattcctaaaaaaatttcactttttttaagtgcaaaccaaaaattgtagagcttagaaaatattttaatggtcaattaaaaaaaaaataaaacttacgacttaatccactttcgccatcgaaatgtttgtcgaccagcgcatagaaaggggcgaaatcagtgccaatttgagttcgagttgagaacgttccaaaagggggaaaatatccatcagaaatatcgttgcatacaaagctgaaaaaagtgaaaaaaattgcatgaaaaaagccaaaaaatgaatatggatattttaaaacaaaaaattttttgcaaaaaaaaagctaagtaaggcattatcagactgtgtttttattacttacacaaacaaagggtaaaaatcaatttttcaatagacgtaaaagttgagtaaatcaataacgcacaccatctcaaacatgagaatgaaataaacagatggcatataaaaaaatacaaattatggacaataaaattaattaatttgaaacaaaaaatttattcatcaaaaataatttaatttaaatttaaaattatttattaatttttaataaaacaaaaaggttaaaattaatttaaaacggtgaaaataacttaaaatgcattaattagaagaggtagaggtacaacagtgactaaaagaggtgtacaacggtaattagaagaggtacagcagtgattagaagaggtacaacgatg

SEQ ID NO: 107188 - DNA, 101 bp, Heterodera glycines
  Promoter: Source sequence=SeqID_35091; Location=987..1087; Strand=-; Gene=SeqID_64730
tgcagggaaatataaaatttaaaatttttattgcttttaaatatgcaaaaaatgtaggctacttttttagtgaaattcgatcactcatatttttgctaatg

SEQ ID NO: 107189 - DNA, 1003 bp, Heterodera glycines
  Promoter: Source sequence=SeqID_2307; Location=3088..4090; Strand=+; Gene=SeqID_79008
cactgttatgaattttttaaatgaacatcaaatctcgattttgtttttttcggattttagaggtaaccatcacgaatagggaatccatttctgccaattccgaaccccgcacccgaattcgaacaaaaagccaaaagtccaaattttcgaaatttataatttttgtttcaaaaaaggcgtaaatgatctcttattaaagtattgtggatttcagttagtttccgtgtatttaattaaaccgattttgaaccaaaaatgctaatttcgaaatgaactttcgactttttgttctggtgcacggttaggaattcagaacatttgttcttatagaattttacttttagattacagtatcaatgctacagtactttatttaaaatatttgtatcactgacgcattctcaaatgacgcattttccgttcaccgttcatggttatttgaaattaaaaaatattcttcatgaaaatcttcaactaattaattttgtctcattaaacttatgacgcttttccattttttgtagcaaaaaaaaaaattttaaattaatttcttgagaaaagtctagtgcaaaaatgtgaatgtacctaatgttatactggtcttacaaaaatcttacgcacacgaaaaaaaaatcccaccattatacagactaatttttaattgcccaaataaagtgcctaattaaaaaataaattaattcgtggaataaaacatgcagcacttgtgttcacatttcacgctgtgtgtgtgtgtaaaaattactaataattatcattaatttcgatgtacatcatgccaaattctcactcaaaaatttttgccaatttcccacaaaaaatcagtacaggaacaaaacatttttggcattatgtagcgatggaaacgtaagtgccaaccaatatatatattagaatagaaccagaatttttaaaatttggcccaacaaaccaattattcaatttttacttgccaaaaaattaatttgcggccacaccaaaaatg

SEQ ID NO: 107190 - DNA, 378 bp, Heterodera glycines
  Promoter: Source sequence=SeqID_18887; Location=1..378; Strand=+; Gene=SeqID_83591
ttaataaatcgatttttttgaaaatgtaagatgcaaaatgaatatgtgccgctaatggtcaaatgcgtacggcggagtggacagcacaaacagaggaggaggagcggggagaagagagatgaatcaatcacaggccagcggatggagagtattcggcgtttgactacccccccccccctccccccgccgataaattagcaacaaattggggagaagatgaatggaaaattatggcaatgtcagctgggtagggaagcaggtggaagagctgtttttgtgggggacgccggactgtggggggggggggtaattcaatggctttgattttctgctgtcgacgggggcgggggattcaaagcccctttttttacaggcatg

SEQ ID NO: 107191 - DNA, 350 bp, Heterodera glycines
  misc_feature (135)..(135): n is a, c, g, or t
  Promoter: Source sequence=SeqID_26416; Location=1..350; Strand=+; Gene=SeqID_57148
ggcgttcgcgcccgtttttcaaattttgttgcccttggacgggcgtttcgcgcccgtttttaaaattgttggtccttgacggccgcttcgcggccgttttcaaaattttgttggctttggacgggcgcttcgcgnccgtttctaaattttgttgttcttttcggccgcttcgcggccgttttttaaattttagaacagatacaaaagtgattagaagaggtacaactgtgattgattagaagaggtacaactgtgattagaagaggtacaacagtgattagaagaggtacaactgtgattgattagaagaggtacaactgtgattgattaaaagaggtacaacagtgatg

SEQ ID NO: 107192 - DNA, 596 bp, Heterodera glycines
  misc_feature (47)..(48): n is a, c, g, or t
  Promoter: Source sequence=SeqID_37745; Location=1..596; Strand=+; Gene=SeqID_66740
ttggttagatctgttaacagattttgtccaaaatatgctaaatgtgnnaaattcaattaattactaaaattcgatcagaattaaatgcaaattattgattgtttttgatcagggctggccgactaaatttgcaattaacaggcttaattaagtcttttcatttgttcttttggcgctgtgttgtaaaatgctattcgattaatgatcattgaccatattcaaaatgatcagagcaacaacaaattattgataagccgccaaaaaataacaattaattttataaaaaatcaaattaaatttttaattgttttctccaccatttcgatctttgtcccttttatttatttattttttatttatgtcttttatcattttgtcctctcttttttttaatcattcaatgattaaaaaggggaaaattttttgcagtttttctttgttttatatatatgaatagataatttcgaaagaaagtgttctcattgtgtcaatttattaatgcaaacttcagaaaattcacaatttttcgaaaataattttcaattaaattaaaaatttaaatttaaattaagggaatattttaattatttggcatg

SEQ ID NO: 107193 - DNA, 284 bp, Heterodera glycines; identical to SEQ ID NO: 103000
  Promoter: Source sequence=SeqID_36882; Location=227..510; Strand=+; Gene=SeqID_66094

SEQ ID NO: 107194 - DNA, 1003 bp, Heterodera glycines
  Promoter: Source sequence=SeqID_10591; Location=2299..3301; Strand=-; Gene=SeqID_73824
ttaatataattaaaacagattttaattttattttaaaatatattttggtgtgtcaagaacggaaaatgagagcccattcccttaaacacgcacacttcataaagtgccatcatttatttgtcatggttattaatattccttattaattttattgtggtgcctttctatgaaatggacgatgccaattttccatttttacaaaatgacttttaagacttttaataaagatttattaaattagtttatttttatggaataaatgtttttaccaagaaattgtgatttgttcgtttttaacgcactttaaatttcaccgtttaattcatttggacaaaaaaaaattgataataaaatattcagttttctgttgtttgttcaccataacgacgtggcctttgtgacgtccctttcctttacactttttttaaatgattttttttaatttgaaaacaaaacgccaataaaagcgcaaattaaattttgtatcttccaaattgtccataataggcgtgactaattaggctgccaaggcatgaaaattttcaattttgcaatactttccggacgagaattttccataagcattatggatttcatggattgattattttcaaataacaaaatatttcatttaaaatttaatgaaatatttctatatcaatcgtttaattaaaaaaaattaatttagagtttgcgcctccgaagtttataaacacccgatttctgcagctagaaaaaaatgcaaattttcattaacagtaaaaatttatgccaatttttcattgaaaataggaaaatttgtgccaaattttttaacagtaatatttttgccaaaaatttgtgccaaattctcattaaatataccaattttgtccatccattaattcatcggcaattttctcactttttttcattttcagtgagaaacaatcgacttttactaatccattatttgccctcttcaatcttccacagagaatggatgtaatgtgaagcaaatatg

SEQ ID NO: 107195 - DNA, 80 bp, Heterodera glycines
  Promoter: Source sequence=SeqID_39030; Location=1..80; Strand=+; Gene= SeqID_67700
gagatgttttcacctcggaggatgatctaaagaatgatgatcaactcaatacatttttcggattgcatttgatcggcatg

SEQ ID NO: 107196 - DNA, 362 bp, Heterodera glycines
  Promoter: Source sequence=SeqID_9304; Location=1598..1959; Strand=+; Gene=SeqID_70919
ttttacaccaattttctgatataatgaaatttcataaaatctctttaatttttctaaaatctctttacattgtgaatttattttttttttattgaaatatgtttattattttcgaatgagcgccagtagaaagtaataaaattttatttaatcattaatttaccaattggcaatttttttgtcattaagataaaattattattattatttctttgaaattaaacaggatttccttattttactaagtaaaataatgatttattcagttttttaatcagaaaaaatcatttaaatgcctcaaaaaatgaattgtcatttaattgaagaaaaataaaataaaatcatttcgagacgacaaaatg

SEQ ID NO: 107197 - DNA, 434 bp, Heterodera glycines
  Promoter: Source sequence=SeqID_10274; Location=4040..4473; Strand=-; Gene=SeqID_73434
acttttgcggaacatgggggtccggtggtgccgataggcgccgccggggaaattttgaaaatttgagtgtaatttgttaacagattcttatcaaaaaatgccaattttgcgatttttttttaagaaaaatagtagtttttggtcagttggtgaggtcaatttttattggtgtttttgtttaaaaatcctattcctattcaattcaatatttgtgaccaaaaagcccatatgtactgcataccagggcttacatgtttattttttcgaaaaatgacaaatatttcagaagagaataggcgacccagggaaattgaacgaaatttggttaacccattttgtcaaaaaaaaaaaattttttttgaacttttttgtcaaaatatctgcaattataatgccaaacatatgaaatattaaaattcaaattccaaaaaatg

SEQ ID NO: 107198 - DNA, 81 bp, Heterodera glycines
  Promoter: Source sequence=SeqID_3902; Location=782..862; Strand=-; Gene=SeqID_52362
tttttttattttgttgtttttttacttttaatattaaatgagagaaattatataaaaacctatttacatagcgatgcgatg

SEQ ID NO: 107199 - DNA, 585 bp, Heterodera glycines
  misc_feature (37)..(37): n is a, c, g, or t
  misc_feature (55)..(55): n is a, c, g, or t
  misc_feature (81)..(81): n is a, c, g, or t
  Promoter: Source sequence=SeqID_28212; Location=1..585; Strand=+; Gene=SeqID_58854
tctttaaaattttttttataatttttccatttttttnttgtaaaaacctagatanattgaatatattaaattatttttttntagaatcttttctcaattttcttttcaaaatgataactcttcaatatttaattggatttttgttcgccgctcttctggcccattacgtcaattcatgttggtaggaggaggaattaattgggatttgataagtgctaatgaccattcaaattaaaataattcgccaactttaatgacaaataaggcccaagattagacaaaatgattctgacccaaaaaataaccaaaaaaatttgtttgttcgtgggtttatcttggctagccaaaaacccgaagatattacaaggctgaaagctcgggaaaacccgtaattcagttcttggcacatgattacagtcaactacgtattagtgactgataatgactaaaaattcatgagagatacggaaactacgagaattttctgtggtcgtgattaagaatttcgatataaataagatttaagcgataattaggcaattattatttttttaaatctttattaatttaataggttggttaatg

SEQ ID NO: 107200 - DNA, 218 bp, Heterodera glycines
  Promoter: Source sequence=SeqID_20552; Location=1141..1358; Strand=+; Gene=SeqID_51096
attatttttgggatgcgaattgttttgtgcgaaactgttatgaaaaaagggtacgaaaaactgggaaaaccccactcagagactagctaacaaaatcagcataggcttggacttccgtaccaattattatttttataatgggtttgttaaatgcaaaacaattcacaaaagttgttataactccattcagagatgagatagaaaaaaaacaaaatatg

SEQ ID NO: 107201 - DNA, 205 bp, Heterodera glycines
  Promoter: Source sequence=SeqID_27388; Location=1..205; Strand=+; Gene=SeqID_58079
agcatcatgcctctcatcagtgaacaacttcgtcatccgttgccgaatttgtaaactcgaagcgttggagacagaggtgagtgaaaacactcaatttgtcacataaacaatcagttttttgtggtttcagactgaatcggctaactgtccggaagaagacggcgctggctccggttgcaactcccgcagtgtcacctgccaaatg

SEQ ID NO: 107202 - DNA, 127 bp, Heterodera glycines
  Promoter: Source sequence=SeqID_4412; Location=1..127; Strand=+; Gene= SeqID_54361
ctgtaaagctaatgtaatgaacggtagcgctgatctgagcccggattcgtggtcagcgaccccaaaaaccccttaaaacttttcttcattaatttatatgacatatttaggcatctgaaaacgtatg

SEQ ID NO: 107203 - DNA, 594 bp, Heterodera glycines
  Promoter: Source sequence=SeqID_44900; Location=337..930; Strand=-; Gene=SeqID_72302
aacattaagcatgaatgctaattagattataataaaaaatttctactgattacggaaaaagtgagtataagcaatttatcgtagattttatctcttaatattttgaataacagcatatgtaatagatgatttttatgaataaataagtattacttattttaacaataattttttttttgttcttggatattctgatagtattaatttttgtggtgtttgattcaccaaataataatccattacagtcaaaaagccatgtcaattttttaaattgtttaataattggtggcacattattcggagttcattaatttgttgaatcaatgcgggatgacaaggcgtttcaaatgtgcaagcgcttcctaggcaaaatcctcacccaatgacatccaggcagacttgacatgttctgtcagattaactattgtttccagaaaggcggcctaatcttcacagcatgacagacaataattagttggtaatttatgcgttagtcggctgcatcttcattcaccatgcagtcaatgtggatccattacttatgcgaactatccgcataagtgtccagccctaattagtcaaacgggatggatg

SEQ ID NO: 107204 - DNA, 806 bp, Heterodera glycines
  Promoter: Source sequence=SeqID_742; Location=1621..2426; Strand=-; Gene=SeqID_60281
ttagtctaaaaattcaaaatgcgaaacctaataaccatcattgtcagaaaattttcacaaatgatggaaaaaattttaaaaacatccataatgaatgataaataaatgagatattggactaaatcattatattatttaatcctctataacatatatttaacattgaatgttaatattttgaggtgatcttttttaaaaattttaattattgcaatgttcgcaacttatttttgtgatcgaaaatagacctaatcattcctcaaatgattcttataaccaaattagggccataaaagcctaatatagaattatattaatatagtgttttcagatggcattgcaaattttttattcagagatgtttctgaaaaatgacgtttttggataccactttcaaactcggctacccaataattacaattattttattcatttcaattaattaagtgtcacttctttccatcgtttattaaaagataaaatttgttttctgaaaagtaactcatttagttaaaagattatctttttagagagaaatttgcacctgtttgttaaaaagattaatctcatgtcaagaacaaaatttcattttacacctgccaattaattaacaaaagattctgaacaatattaaaacaacgtttttgatttaattacttttgataaccaaagattttttctattcattagaattgtaaggcaaaaattacatatcgacagattaaaaatataaatttattgtttaataattaaaattatttttattttaaattaagataatcaacttacgctaacatgagaaaatg

SEQ ID NO: 107205 - DNA, 360 bp, Heterodera glycines
  Promoter: Source sequence=SeqID_44659; Location=1142..1501; Strand=-; Gene=SeqID_72117
ttaattaaatgtttattttgcctagaaaaattggcccccccccccggatgttgaccgaaacgctcatactaataggcctcctaactacttgtattatttcttttattatttgcatagcaagttttatcataaagtttatcataaaaatatggcgcattattaaaatttgtttttatgggccatatttggcgttaaaatgggtcttgaacccaaaattagacaaaaaatttaacgatgagatacagaaaagtttattaaatgaatttgaaaaaagagaaaaaaaaaattcaaaaaagaaaaaacagaagactatatagacttggaagcattgtaatattactatttttatgtttgacaatg

SEQ ID NO: 107206 - DNA, 866 bp, Heterodera glycines
  Promoter: Source sequence=SeqID_8243; Location=1602..2467; Strand=-; Gene=SeqID_67412
caattcctgttacatccgcgaggagcagcagcagcgagaagtgaattttgaaggggagagaaattccggaccaaacaaacgaatgccgaagaaggaggttcaccctcacccattccctccactaaaaactgacactgagtatgattgtaaacctgcaaaacaaaggaggttttgtactggatttgtcgaaggggtcccgtcaaatttaagaagttcaaatgacccttttttgatgttagaacatcatttggtgaagctcgaaggttattgtcaattttaaaaaccaaaatttaaccgaatcacaagaaacaaagcgaaacatgatgttagcctgtcattcttattacaatttgttaccccttacgtttctcccccatattttggtaccacataattaattactagagaagttaattttctaatcttagatcattcattatatggcataatcctgtgaaattaatctgctattttcctttagaaacattcgcttattttgccgccgtctccgtacctttgcgcgtttttgaacgaacttccgtctcttacagcgcccgaacaatcggcggagtccgaagcctatcggttgctttctgagccaatcgagggacttttagttgatttttcgaatgtccatcaactcaaacaaatcgtatcaagtatgtatcgaaaactcttaattacatttgaatgtttacgttggcgaatccaatgtttaagacaatttggtgaccgaagtgattctcacggccaattccactgggttggcctcgagtgtttgcgtttggtttaggtattcccattgaccttcaatagaaatatctaataatgagatcaaaattctttcagactcgaccttttcgatg

SEQ ID NO: 107207 - DNA, 639 bp, Heterodera glycines
  Promoter: Source sequence=SeqID_39750; Location=1..639; Strand=+; Gene=SeqID_68247
tttccgggaacgggatcgggagttgaaaatttaccgggacgggagtcccgaacgggaatcccgtagaaatcccgctcccgttaaaaatcccgttcaccgaaaaaagcgggactcacgtaaaatcccgcgggagtcccgatcccgccggtctctacctattaagatctttcgaataaaattacctaaatttattgaatgatattttattttggcgccaattttaaatttaaattttcatggttcgatgaaaaagtcaaaaatgagacaaaagaatttgtccaagaatgtaagctttttccctaaattttgttttcattgttcttctactcgtttctttcgttggttaagttcacgcaggaaactaacaattaaaaatgccagaagttgaagacgatgaatttgccgaaatgcgccgttcgagaagatcgaatgtgtcaaaaaagcgacaacagaatgttttggaagaactaaagcaggcgcgcgcaacaggcaaagcctatcggaaaagagtatgtgaacaaaaaagcgtaaaaaatgagagaaaaataatgttaaaatgggaaacaattcaatttggcaaagatcaatgaataaataccctttggttaggtggatgatttggttgaggacctttacatg

SEQ ID NO: 107208 - DNA, 70 bp, Heterodera glycines
  Promoter: Source sequence=SeqID_2457; Location=1079..1148; Strand=-; Gene=SeqID_79809
gctgaaaatgcctgaaaagtcgtgcccttctcattttttccttctaaaatttataatttattttaggatg

SEQ ID NO: 107209 - DNA, 391 bp, Heterodera glycines
  Promoter: Source sequence=SeqID_834; Location=922..1312; Strand=+; Gene=SeqID_62449
tttggttgattggagaacaagcgcggtcgaagttgacgtgtgtggaagatgtgtgggttgaaggtgttgcgcaattatcgtcgttgagattattttattattgggaagtgagcgaaaatgcgaatgtccgttccttttatacaatctcagccacgacaattcttaaacccaacattttgccaaatttcatttgatatataaggggatgcgttttcatccttttcaccttcgctactaccatttgcccatttcgaagtgcacccgctgcaacatttttgtgagttttttctcttttttttcgtgtgtttttttgtcttctttttacatcccctccatttgtgttcagaaacggcctcgacaaacaagcaaattcttcaccaacacaccgatg

SEQ ID NO: 107210 - DNA, 435 bp, Heterodera glycines
  Promoter: Source sequence=SeqID_3850; Location=3171..3605; Strand=-; Gene=SeqID_52127
tcgatcgccaagctttttctctattagcccgcagaataaaaataaaaatttggtcgactttagaaaaagttgtatgaaaataagtactatttctaccataactactgttaaatttggtaactttttttgcaattttgcaggctaatagagaaaaagcttggctatcgaatggtaccaagaatgtaaaatgtgtttgctttgcctttaaacaaagttatgccatgttttgtcgaaaaatttgctaaaattggtggattttataaaacgacccagcatggcatttcggagataaaagaaatattttaaaatgggataatacatttttaagagcgatggatcactgctggcggcggcggcggtcgctccatttcgacagagtcacgaaatgagggggatgaagctgcttccgagccggacattgtgcaggacagaatg

SEQ ID NO: 107211 - DNA, 67 bp, Heterodera glycines
  Promoter: Source sequence=SeqID_40169; Location=1..67; Strand=+; Gene= SeqID_68582
atttttttgaaaatacggtaatatattttgaaaattctcacgttttccggttttggccgcttcgatg

SEQ ID NO: 107212 - DNA, 78 bp, Heterodera glycines
  Promoter: Source sequence=SeqID_11698; Location=3180..3257; Strand=-; Gene=SeqID_75179
tttggtcaaccacaacaaaacgtgccaagtacaagccaagcggaaagcaacgaacccgcagcatcaacatcacaaatg

SEQ ID NO: 107213 - DNA, 421 bp, Heterodera glycines
  Promoter: Source sequence=SeqID_10415; Location=1627..2047; Strand=-; Gene=SeqID_73610
tcataccatccgtactattacccagcagtcaactgctccctcccgggcttcgcaaatcctttcccagaccccccaacccctttattagaattggttttaacaaagttccacgaaaaaaattatgattttatgggcaattatcatgcgtaaagcctgcacaaatgtcatattgatcaacgaattcagtgttttctgccaatgcacaaaaatttaaaaaacaatattatggccttatggtttttctgaataaaatggttctattttgatttttttaatggcacataagttaaaaatgaaaaatctaaagcttttgaaaaaaccaaagtttctggaaaaggttgtattgcgtttttttctccaacaaaaaaaaattaatgcatctgagaatgccgaggaccttaaacgttcatgcgagcgaatg

SEQ ID NO: 107214 - DNA, 74 bp, Heterodera glycines
  Promoter: Source sequence=SeqID_20146; Location=960..1033; Strand=-; Gene=SeqID_84931
ggttagtttttctaatccgtcccatgccatattttttttgaaaaaaaaaagttttttctgttcagcttggcatg

SEQ ID NO: 107215 - DNA, 128 bp, Heterodera glycines
  Promoter: Source sequence=SeqID_12864; Location=1239..1366; Strand=-; Gene=SeqID_76593
attaatttatcaatatattttaaaaagaaaatctaagaaaatctttttaattctttcaattcaaatattttaaatgtattaaattttaaatttgcggattttttttttagataatcactgacacaatg

SEQ ID NO: 107216 - DNA, 497 bp, Heterodera glycines
  Promoter: Source sequence=SeqID_1288; Location=561..1057; Strand=+; Gene=SeqID_71655
tttatcggtactaattcagtttgggtcccccttttgggtcgaaatttttcaaaaaattttttggttatcttatttttttattttttttcggtttttgtgcttactttgccattttcatccttatttcttgcttaggtaatttagcattgtttgatgctgaaaaatccggtctctactggtgaaagtgggattggttgatgaaaacgcacatttaaatactccttttggtgctcacaaaaaataagatttttttgtctgttgacagatttttctatttaagtgctgtctcgttgctgcccttttcctcattcctttggcaatttctttgcccattcattactactcccgttccgaattttatttagtcattcattttttcttacaaaatcacttatgctagggtaaaaaaaggcgctgatcacgaatccgagttcgggttttgcaaaatcactgattttgtcaatgatttttcatcataacatttttacagaataatg

SEQ ID NO: 107217 - DNA, 297 bp, Heterodera glycines
  Promoter: Source sequence=SeqID_24511; Location=169..465; Strand=-; Gene=SeqID_55240
atcaattttctgatcaaatttttcagtgggagtatatgtttgtgtctcttctgtctctttttctctcttctcttttttcttgtgtgtcttttctgtttctttctctccttttttatctttgataaaaattttttgatgaaattacattgatttattgggaagtaattaattggttgaaagcaaaatattaaaaaatagccaaaaaacttctgtgacttttaactggcctttctagcaccgcgcgccataagtgtttaaatttaattcacattgagaaaaaagataaaaccaaaaatg

SEQ ID NO: 107218 - DNA, 791 bp, Heterodera glycines
  Promoter: Source sequence=SeqID_8562; Location=1..791; Strand=+; Gene= SeqID_68534
atactatttaaatattttccaattttaattaaatttaaataggattattttttgaaaagataaaaatattatttcaaaaatgttgacttcttagcttgggaacctaacagagttatcctggcaaaaataaaatttttatttttttgtggtttacaagcaaattaattttttttttaaattttaatttattcattcttggttattgcccatcttagtgacttatttttttgaaatatattttcatgaggctcgtaattttgtagccaaaaaatacgaagttttcgaggttcgaagcacgaatcttaaagttcacacagccctggtcctgatcttgactttatcatttatttcgttagtcatggccaacttgccggctcttaaatttatgctcaaattgcaaaaatcaatcgtaaaagaaatgataaactcattaaaattaaacttttcggcagttaagtagtcgcaattatttcaaaaagtttttgacactttttccttgacatattttccctgacaaagaaacgtgtgattttttacttaagcatacgtgtgaatttgcacttaataatggggaaatttgtgttaattgtgaatgaattttctgttcttcccccataatttgtgccttttgaatggggctgctgcccttacggctcacacttttgtgccccatttcatttgcgcctcataagtatcaaaatttgtcttatttaatttttatacttcagttcattaaaaacaaatgttttaatattttgaaattaatcaacttatgcaaacataaaaacatg

SEQ ID NO: 107219 - DNA, 194 bp, Heterodera glycines
  Promoter: Source sequence=SeqID_6215; Location=1381..1574; Strand=+; Gene=SeqID_60762
tgattatgagtgaaatgaaaacaatgcaatgatcgagtccgaatgagagtcgaatgaattgggcggcgtcgggaatggcttttggtgtgaatgcttatgaattggccagtccgcgggtcaaatatgatgatgaatgaacataaaatgattggcgtttaaaccgtcggctgtttgtgggaatgcgcgagtgaatg

SEQ ID NO: 107220 - DNA, 1003 bp, Heterodera glycines
  Promoter: Source sequence=SeqID_2894; Location=68..1070; Strand=+; Gene=SeqID_82218
ctgtcacgcccgcgcgccacgcgagcagggcagagccagcagcaacgtcattggccgcaaatgctgccacaatctgttgtaatatgtggtccatttaatttattggttaattttccgcgttgacattcaattggttccgggtgccctgctgagcatttggcagcgcgggcgacgtcgacgggtatggtgccggggaatgtctcggcgtgccaacgcgcttcctccctccctccgcccacccattcggcatggcatattcaaatgtggcacgccgaattacttccagataacaaatttttatatatgcacacacatgagtgagtgcaaaagatattataattttatgctgatgaattctgatgaaattattaaaaaaaaaaattacataaaattatattaaaaaaatttaatataaaaaaatatttattaccaataatttattgtgtttctgacgaatatagggattccctggttctggaatttgctttgcataaatagtggtagaaggtttagccgacatttgcggaccactattttggaattgaactatctaaaaacaaaatgaaataattttttttcaaaaattgtgtgacccaaaatagattttttttttaagcattaagacgaatgaaaatttagaaaaaatttttcaaaaatttcgtttttaagctcccttatggtgctaaatttttggtcacttaatttcatccttaaagaggatcaacttgatcaatccgtgctgagacgatgcgaaaaaaaactcagtgattgataaaataattaaatttaattatctattcattaaattcatgtaattattatacatataaattatattgaagtttttttttaaattataatattatttaaattttaaaaatgaataaaattttatttgctttgaggttatttttaatcaggaaaattataaaactgaataaattatggtttgtacgggtacggcttgcttaaggcctaacagcggattttacctgtataaatg

SEQ ID NO: 107221 - DNA, 364 bp, Heterodera glycines
  Promoter: Source sequence=SeqID_42071; Location=1..364; Strand=+; Gene=SeqID_70065
tttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataaatgtttgagtaccccaaacggacacttgaaaaaatcgatttttttgtttcataaatatttttttcagaaagtcatg

SEQ ID NO: 107222 - DNA, 258 bp, Heterodera glycines
  Promoter: Source sequence=SeqID_2642; Location=649..906; Strand=+; Gene=SeqID_80862
tattttttttgaaaatctgatcaaaatgaaactaaatttgtttgtccccatttatataccggaccgttcatccttttttagctttatataatttgcataattttttgagatggcccctttttcttatcagcgtaataaatattgtgagtaggtcgagacgcgaacggagaagagcaaacatatgccgtcatcgacgacgagaatgcccttctcattcatttctttttacattttttttttctgcaaattcttccaatg

SEQ ID NO: 107223 - DNA, 100 bp, Heterodera glycines
  Promoter: Source sequence=SeqID_8996; Location=646..745; Strand=+; Gene=SeqID_69945
gaagagctaaaaccatggatggatgaggtgcaacatggttcgagaaggtaacaccttggatgtgaagagtcacaaatatgattagaagagtacaacaatg

SEQ ID NO: 107224 - DNA, 588 bp, Heterodera glycines
  Promoter: Source sequence=SeqID_7345; Location=1..588; Strand=+; Gene= SeqID_64536
atgctgaaagtaaccaaattgatttattaatgcctcattagattcgaattagccttatggaacttttaattaacatattatcagaaaaaaaaccaagtttaccttcaaacaccttgaaaggtattaccaatttttttcgtacttttaaaaataatttatgcattagaattttttatgattatatttaaatatttttatttctaaaatattcaagtctgactattatcgatatataaattatattctgatgttttatactaactgctattaattttagaagttttatgtacaaataatgtttttctgtaggcaaattaattttaatgatttgcattatttttacattgtttaaataactgtgcatatctaattaatagaccttttttatttgtattaatactgaaattgaattatccttttcaccttaagtttttaatagtttctaacataatgcttttagtagaaattatatttttgatttcatttgaataaatttgttttatgatatttttcattaatttattactaaagctgtagttatctaaattatatttatcttatactatttattttttaagttaaaaaatg

SEQ ID NO: 107225 - DNA, 62 bp, Heterodera glycines
  Promoter: Source sequence=SeqID_15145; Location=249..310; Strand=+; Gene=SeqID_79336
ggcattaaaaaaatatatatttatttttaatatttaaatttatttctgttttattaaagatg

SEQ ID NO: 107226 - DNA, 356 bp, Heterodera glycines
  Promoter: Source sequence=SeqID_43862; Location=500..855; Strand=-; Gene=SeqID_71443
ggtaagaattaatagttagtccttttgttgaatttttagaaattctttccgtccaatcggcttttggaattttaatgagtaaatcagggaaccgtaaatgacattctatgcttctcttgtttgatacacgggaagaaataatagttagtccttttgttgaatttttagaaattttatccgtcaaatcggcttttggaattttaatgagtaaatcaggaaccgtaaatgaaattctctggttctcttgttggatacacgggaagaaataatagttagtccttttgttgaatttttagaaattctatccgtcaaatcggcttttggaattttaatgagtaaatcagtaaccgtaaatg

SEQ ID NO: 107227 - DNA, 1003 bp, Heterodera glycines
  Promoter: Source sequence=SeqID_18363; Location=1539..2541; Strand=-; Gene=SeqID_82962
tgttaaaaatcgtcaccaattaatatgcagaaaaatataaatacaccttttttaaagagaaaaaaggaccgtttagctttttactaattatttaaataaaagttttgaaacaaataaaaaagtaaacatgcaaagtttcgcatgtagttcaaaggaaaaatttaaaaaaagaaagcaggcttctcgatcaagagtcaagaaaaagattttctgactaaaataaacataatataaattgcagatttctttttctttatgtcattcaactaaaaaatgaattaaatatctgaagagaaattagtgaataaaagtggtgaaaaattataaagaaatattttggtaaaaatcaaatatatttcaaagaaagataggttttttttaattttagatattgatggtaaaccattatgtaagaattttggtataaataaaaaattcctttcagctgtaaatgcgatgtctaattagccactctcataggctaattaaatatattatgatgaaaataacaaaattgaaacaatgaatattattaggttttctgcttataaacctagcaatttcaagataaacatttaaaccatatttttatttaaaaaattttgaaaaaattcatttattcgaaatgttatgtgcattcatatataatgtctggatttaatttattttcacggacttttttattggacttttttattatatatatatatatatatatatttacacaatttagtaatgtaaaattgtatatacatataaaattatataatattttcagttatagacgaaatacgcgacttaagaaaaaatttttgaaaaattacagtttaaaaaaacttacttataagttttgtgtgtgagaagaattaatttgtcaaataaataaatgttcaatcaactcccttcatttttaatagtcgtcgtcattttatttttaaatctgttttttttgttcaataaataatttatgtatgatttgtgaaataatcactttatttaaatg

SEQ ID NO: 107228 - DNA, 322 bp, Heterodera glycines
  Promoter: Source sequence=SeqID_41753; Location=1..322; Strand=+; Gene=SeqID_69815
taaagctaaattaaattaatttgagcattttcctataaatttggcctcaaggagaggggggtttcaaaggttaaagacgaggaagtaaaatgtgttcaagttttatctttttttaaggccgatggaaattaattgctacgctaatgttttagtataaaaatgccttttttcttctcctccgcctcattcaattcattcattcgtcacatttccggtaattttgttgctgcaaaagtctttaagaatttctaaaaatgaatgacaaaatttgatatacatatgtaaaagatattaaacaaaaaaaagtttcagaattaaaatg

SEQ ID NO: 107229 - DNA, 254 bp, Heterodera glycines
  misc_feature (60)..(60): n is a, c, g, or t
  misc_feature (89)..(89): n is a, c, g, or t
  misc_feature (124)..(124): n is a, c, g, or t
  misc_feature (136)..(136): n is a, c, g, or t
  Promoter: Source sequence=SeqID_13761; Location=2744..2997; Strand=-; Gene=SeqID_77680
attatgacttcaatttgcatagatgtatagcatttactatttctcaaatattattgtaanagataaaaatatctttttacaatgatttnaaagattaattcaaaaattataggatttatttttntactaatatttntagaaattatgttatttagctaaattttttcaattttccatcttaattgttatcagtaattaagttaaattaaatttaaaataaacgcaaattaaaaaggcaatttttgtaacaaatg

SEQ ID NO: 107230 - DNA, 394 bp, Heterodera glycines
  Promoter: Source sequence=SeqID_19203; Location=1230..1623; Strand=-; Gene=SeqID_83947
aaccccgaaaatggtcaatttcgtagatttcaggaatttctttgggttttaataatttcttcgtatttaaaaacttggatttttggcttcgatagaataaattttaattataatctaaaaaaaaaatacaaagtctaggggagctctaatccataaaatattgcaacttttaataattcatatctatctaaatgttttttgcttctcggttaagtcatcggaacaatttctgcgcacgccttcgccgcgtgcagaaaataacggcggccgcgaaagcatcatattgaaccgaatgttaacggagcaggtgttcagaaaaatttaaaaaaaaaatttgaaaaatttccaatttcccaaggtcatgcctcggctgagcgccgtacgtcccgcaatg

SEQ ID NO: 107231 - DNA, 668 bp, Heterodera glycines
  Promoter: Source sequence=SeqID_28670; Location=715..1382; Strand=-; Gene=SeqID_59259
attgaaaaattggttggcttaagtaattaaataataaattttcgaatattactttattataattcctgattttttatgattttagttaatagaaaaatttttaacagaaatttaaaaaaaatttggtaaaaaataaattattatcacaattactaatatttaaaatcattcagcgacaaatttattttaatcatttttaaaagaattaaatttaataaaaaaagatatttttttttgttttacttttgctttgatcgatcattgggtcgaaatgtttcttttttggggcattggattatcttcaattcgttccatcattactcatccatcagcttcgttcttcaccagcagcagattaatgccataaaatcaacatcgtcactaaacattttaattaaaataataaatttattttgtttaaaaatttatttttatgtaagaattgttggcatttaatgcaaaaatgatttttcgcctgtcctaattattattttatttttttataattttttttcatttaattcttcaaattctatccttttttgccgaaatattttttagtttttttccccattaccaaaaagcagcaacaaattgctgctgatccaagtgaaggcggaaacagggccaagcttctcggctttgctgctgctgctgttactgtgatg

SEQ ID NO: 107232 - DNA, 1003 bp, Heterodera glycines
  Promoter: Source sequence=SeqID_11760; Location=1320..2322; Strand=+; Gene=SeqID_75259
atttgtaagaaatgttctgattttggactattgttcttattggtcaatttttagacaaaatctgttaacaaatcgcattaaaaattacaaaaatttttggctctaatgcactttatgagtccaatcgacttttatgagtccaatcaattgacaatcccgggttttgattaattaattaattgctgattattttcgtttgttactttctttaaatgttagaattctctcgttttctcgtattataacattattcagactttgtgctttcgaatgataccaaaaagatagggtttgtttgaacatgaacaaagttactgtataaaaaacaaatgataccatgaattcatatacctaggtcttgatcaagtaagaaaaaagtatggctaacaataacaaaccaagtatggtcaatggattggacgggtaaaagtcatttgacgattaaaatgcagtagagccggctttttgtggaaaaaggcagggaccggaatttcgacagacccgaggctttcgaattccggtctaaaaacatttttttgaggattttctccaaattttcataaatgtttgttttgcacatatttttccatttttatacatccgaattatttccttatatgaggttttttgataaaaaatattttatcaatgaaaaaaagggttataaattatatggactaaaaaccaaaaaattttaacgtagaaatgctatttttgagcccctttcttcgtagcatatgcgcagaaaaaatatgttaatccatataatttataagtagggatgggatttttagtgataaaaaatcccaaaataattaactaaatagtgaccaaaaaatgccaaaatagtggcaaaaatagtggcgaaaaagttccaaatttaggggtgtaattttttaaatagctattttagtttgaaaataatttaaaactaaggaaaaacattttattatcactgatgaatagggctggtaaaaatatggatataaaatcgcgaaatatg

SEQ ID NO: 107233 - DNA, 415 bp, Heterodera glycines
  Promoter: Source sequence=SeqID_12600; Location=1..415; Strand=+; Gene=SeqID_76262
aggaaataaaatcacttgaaatttgtttacttttaaagcaatttatttaaatttattaagaatatatttcgtctgaaatgagcaaaaaatttttcttgttattaatattttccgttttttgtcggcaaagaatcgacgggagaaaaaatggacaaacaaatcaaaatgttcaaactttgatccgtcaatttgaaagtaaaataggctttaattagctagtcttattaatattaaaaggatatttaagaaattaatttattaaataataattgtttagcaaatgaattcagtcaaaatggacaagagaatgctgaaaagtttcttattattttatttttaattattattttaaaataattttttaaggaaaattttggaaatattaatctcctttcttaaaattcaatgcgaaatg

SEQ ID NO: 107234 - DNA, 202 bp, Heterodera glycines
  misc_feature (13)..(13): n is a, c, g, or t
  Promoter: Source sequence=SeqID_7755; Location=1..202; Strand=+; Gene= SeqID_65841
ttcttaggttttncaaattttgttaaatatcattgaaatttaatgattcataaataattataaattataattttgtttatttatttaaaataaattttgaaaaattaaataattaaaatggtatttaatttaaaaatttaattgcaattgtactccctcaaaaaaaggtttttgtgtgttcgccgccggcgcttcactgatg

SEQ ID NO: 107235 - DNA, 242 bp, Heterodera glycines
  Promoter: Source sequence=SeqID_10135; Location=1099..1340; Strand=+; Gene=SeqID_73230
aaaacgtcaccactcaaaaaggtcaccgacccaaaacgtcaccaaaattaaaaatcacttaaaaattaatttttggtctctgatcagctatgcttcagtcacagatttaaggatagccaatgtatggtttttgatctacaaatttgagagaaaattaagaaaagagattatagaaaagtttataaagctagcaattcacttaaattctcattacaaaattattattttgctttattaatatg

SEQ ID NO: 107236 - DNA, 146 bp, Heterodera glycines
  misc_feature (18)..(18): n is a, c, g, or t
  Promoter: Source sequence=SeqID_31396; Location=231..376; Strand=+; Gene=SeqID_61755
ttgcaccagtgactgtgnagatcggacagttgctggaggccttcaaatcatcattgtcggccgagatccgttcatcagtcgaacaacttcacaaggagttgacgggagaagtgcaccacgcactgaacgcactttggaccaaaatg

SEQ ID NO: 107237 - DNA, 84 bp, Heterodera glycines
  Promoter: Source sequence=SeqID_32440; Location=447..530; Strand=+; Gene=SeqID_62747
aaggtagaagcgggagcaaagctgcaacgctccaaagcggacagagacgcgcgagtggagcaaatagaacatgcaaaagcaatg

SEQ ID NO: 107238 - DNA, 438 bp, Heterodera glycines
  Promoter: Source sequence=SeqID_15359; Location=2204..2641; Strand=-; Gene=SeqID_79617
attagagaccggcgcgggacgggatcccgcgcggaattttgcgggatcccagtccgcactccgatttcgggattaatcccgcggaatcccgtcccgcaaagaattttgaggtccaatcccgcagcgggatccgcaaaatattgatttttgtgcgggattatgcgggattttattgatttttttgaaaatttttctaagacagaatgccaaatatttttaaataaattaaataataaatttaattaaagttaactcatttttcatcgcaaatttcattcaaaatttgtgaaattttcccggcggcgcctatcggcacccccggattggcttttacttaataaatcctgtagaaattgagttaaaaactgcgtcatttggtcaattttagacaaaatctgttaacaaatcgcattaaatttcaaaaatttctcgcagatg

SEQ ID NO: 107239 - DNA, 889 bp, Heterodera glycines
  Promoter: Source sequence=SeqID_2079; Location=7086..7974; Strand=-; Gene=SeqID_77740
aattttttgtaatgataagggtttaatcccattacctaactttttttttgaaaattaacaaaatttaagaaattagatgcaaaacctaacattagacaaagattacgagcaaatgaaaagaaatgacaaaattttcggaatgcttctttttgttatttatggactttactttttgtgttttatttttgcattaataaggtgttgtcgacacggttaattcttcatttgaaaatcatttaaaatttgctataaccccttttttgaaaattcaccaacattatgccctgtccgctccccgccgaattgatcaaggaaataattgatgctcttccccctccaaaaacacatcgactgctgtgcataaattttgttttggcatcctttgttaaatgtcggttttattccatgatgagaagattgtttcgctcagatcatattttaatgccaatggcccgaagaactggaatttatttatttttcgatgtttttattccccacacaactcatccaggatataaaatttaaataaattataaattttttactttttaatttgataattttaattgatatctttgataattaaacaaaattgtattttccccaaaagaaattttctcacagtagcaactgcggttttttactcctttcaaaaaaatgtcgcccttttgctctcttgcccaaatcaaggaatcgggtcggattagcacaccaaagggaaaatttagtgagttcaaaatcgttattttccacaaatgaaatcttttacttgtgtttaggccttttttatgcccttgaatttgctcgcaattaccaactaattgatcatgtaatttctcggaaggctttccgttatttattggaaacggagaaaaaacaacgacaaatg

SEQ ID NO: 107240 - DNA, 1003 bp, Heterodera glycines
  Promoter: Source sequence=SeqID_4824; Location=493..1495; Strand=+; Gene=SeqID_55859
taaaaaagtaaaatttttgggattaacttgttttaggggttttcatggccggggaaacgaatttcgaaaatttttaaattctttataatttcaaaaatcacgaaaacatgttccgaggggcttttgggtctcagatcacgaatccggcatctacttcgaccaattacgaatcccggaccccaattcgaacaaaaagtgaaaattcaaaattttcaattttagtttaaacaggggtgcgatctgtcgtgatttatcagtttgtcctggtttggagggtccaaatctgataaagtgaaaatgtcctgaattgtcatttaaaatggttatataaatcataaaatttagagaattttaacaaccctgtgcttaaaaaattatattttcttgaaaattaaaaaatttatgtatagaaacctggtaatcttattatttggtcaattcttatagctgtttaaacgtagagttaaacgtgtattagttattgtttgaacttacacctgaatacccagatttgttgggtctagcaaagtaagcatgcttaattgagcaaatattcgttcaaaaactttcgattcctagcttgattaaaatttactctgcttttaaattatatatttgcaatttaaagaatcaattaaaacttttttatttttaaatccttaatttggtgcccaaacttcccggtgcccaaatttctggtgcccaaacttcccccccccccttattctaccgtagtgaaaccactcattccaagacaaatttaggattacgccatttaaacattatgccataacaattttagattaatttatttatttaacagtacggggtcaaagaattcaagaagttcacgtttttatcccgaattcggctcggtaaatttcttcgggattgccctcaattaccccctcaccttttctcttttttcgattttttgaaaattttagttaattcttcctaaattgttgttgcatctaagttctgttttataataatagtaatg

SEQ ID NO: 107241 - DNA, 930 bp, Heterodera glycines
  Promoter: Source sequence=SeqID_9970; Location=2111..3040; Strand=-; Gene=SeqID_73016
tattattgtttataataataattgtcttgccggccgccttcaaattatcccccaacgaattttcgtcgtggccccaatttttttttgggttgccataattttttggcacagaaaatgccatatttaaaattaggctggaacactaaggttgggagtgctaaatcttctcggattttgtgggcaaaaaccaatccgataaattttgtttgtttgatttgcctttatagaatttaaaaaacataattttattggattctcgaacacagttaatattattttaattttttttgtttgaaatttcattttaaacaaatcaagttttctccaattttcaatttttcatcaaaatttatgtaattttgttttttagaaattgacgaattaaaactaattgatacacattaattgctctcactttttggaatttaaatgacattaacttttaataaagttagatttccaagtttttcatttgttattttggcatccaatttcccaccaaattaattttaaattttgtactcaattttataaatggaaatacgcagcaaatctcaattttccataaatccaacaaaattctttttgggaaaatacgaaacaaattcttggaattctgaatatttttgaaatgaatacaataagaatttggcatttatctgtttattttcccatgatattttttacgtaaatttcatgttcttatttgatttgcgcgcaaccattaaagaatttgacagaaaaggatttctccatttttggcattacagtaacccttagcttttcttcaataacacaatgccaaaaaagaattctcccattgaaacgaggccataaatttatcattaatttcacatttttgcaataattaatataggctaatttgcttaatttaaggtaatcaaaaacaaacaaaattttacaaaaatg

SEQ ID NO: 107242 - DNA, 264 bp, Heterodera glycines
  misc_feature (36)..(36): n is a, c, g, or t
  misc_feature (48)..(48): n is a, c, g, or t
  Promoter: Source sequence=SeqID_27950; Location=1..264; Strand=+; Gene=SeqID_58610
atgaacgaaattacggatcgtgaacagaaaatcacngacctgcgaatncaattgtttgttataaaaaattggagaacccacaactgggatcccggtgctggaccggaatcaatcaaaaatgggaaaacccgggaaatccagctgcttaaaatccggaacctgggcgctcgtcccggtaaacaattggatctgtcccatgtcacgacatactcgagttacaaatttcaactaaaaaataattagatcaaagacaagtccgacatg

SEQ ID NO: 107243 - DNA, 495 bp, Heterodera glycines
  Promoter: Source sequence=SeqID_38479; Location=364..858; Strand=-; Gene=SeqID_67275
tctgaacagttcaacaacaagaaatgaaataataattggagattttgaatttttttttcctgatttatggccaaaaaacgattgaatggccaaacgaaagaaaaaaaaaaaatttttaatgtaggaaaaataatacaaaattttttttttaatacgaatagtaaaaaattataattatttaataatcggtttttatttcggagtaatttaaaaagaaattcaaacagaaatgtagaaaattttttacaataaaaaaacttttgaaaaaatttttgtagcgattttttcagaatttttattatgaatgattaagtttttttttctaaaatttttaaaaaagctttgaaaaatatttgaaaattttttaaggttttttaaaggtttttgaaaattccgattccctaaaattttgcaatttttttttcatccatccatttcctttagtgtccatttttaaatttaaattaaattaattaattaaatttgcctaaaatg

SEQ ID NO: 107244 - DNA, 70 bp, Heterodera glycines
  Promoter: Source sequence=SeqID_15062; Location=1..70; Strand=+; Gene= SeqID_79232
aaaaacgcatggtgaagtttggctgtacctgagaaggtatgcgctctctacattgcgaaacctgggcatg

SEQ ID NO: 107245 - DNA, 713 bp, Heterodera glycines
  Promoter: Source sequence=SeqID_8014; Location=2739..3451; Strand=+; Gene=SeqID_66689
tttattcataatctaattgtaaaacatttttttaaatgggattttggacccccaaatttggcatttgaaagtcttccgttgcttctttttattgatggtttgccgatttctccttgattttggaggtcattattattattattatttttctgcccatttgcatatccgttttccatctattggctgagaacaaatgacctttacaagcaaataaatcgttcatttattcacattaaatgccggctcatcacagaagagcataactttttcaacttttcgatttcctgacgaattaattaacttttataaaaaaccgtcccataaaaaataattttatttgctatttaaatgctatttttattatatattcatttctatgaaatatattattaatttacttccatatcattttattaataatattcgaggcaggcgcagagtttgatccaacatttttttttggggggggggggaacagttttccaggcgcaacgaacctaaaccaaaaaaaaatttatcccgaagatggatgatccttccttttcttaaatattcttttgactttcatctcgaaaaacttctgaaaactccaggttaggtaggcttcgtgcttcttacgatttccactgattctggcgcttggcggcagcgaaaatcctaacaaataatcattaatttttaagatttgtgcaaatccaaaagcaaaagaaatg

SEQ ID NO: 107246 - DNA, 631 bp, Heterodera glycines
  Promoter: Source sequence=SeqID_29809; Location=1..631; Strand=+; Gene=SeqID_60267
tattgggttgtaacataaattctgtcatagttgtgaatttatttatttgtatatttttaaaaaatgtcttcgtttttcatctcgttgcttttgcccaaagactggggagcgacgaattgttttttcttgttgtttgagcccaaagactgggaacaacactcgtcaattgcttttctcttcgctcaaagattgagataaagcgactacaactcctttggatacaattcaccgcaccagttttcgagaaccaagacggttgagaaaagtgtttgaattcggcagaaccaagacggttaaaccgaagattttgcgtgaaaaatttgagaaccaatacggttgaaaacaaatggttattacacgctcgccaaacttaactcgccagagaacccgacagcagggaataattttgaacaacgacgggaatcaaattcgggcaccggataacgagcaacaaatttagagatcatgattccggcttcagagcaaaatgaaatgagaaacctgaattagccgattaatcccgtaaatgatctttcaggagacggcagcattttgagtgaaacacagctgataaccgacttttggaagtggacccgcacgaattaaaccggcagcgaacgaagaaaggatg

SEQ ID NO: 107247 - DNA, 972 bp, Heterodera glycines
  Promoter: Source sequence=SeqID_35507; Location=1..972; Strand=+; Gene=SeqID_65049
tatacaaacctaaaggaaattccggaagtggcatcggcagatgatttgagcggcatttgactcagctaaacgatggcccgactcaccaaaacacaaagaaattggtggcggatgaacggactgacggacggacacaacgtcttcccgtggaagaagaactcaacataacaaaactcattatcagttttcttaaaggatttttctttattttatttttccccaatttgtttatttaccatttaattactctatcccatttattattgttaaccaatttgacttctgttaagtcgcaattcactggttttctttgttatcattcatacatattaacctaaacacttatttaatcactgtagcaattaaaaattttttgtttggagaacaaattttcctttccagcaatttggattactaaacaccacactgagtatagtctgtttttcccaagataattcgtttgttggttttttccctcatttcttggtgcaaagtttcgttgttttgatgacgctttctgcccttgctttttttatgttttagctgctgcgcagcttaagtagtgattatatttatttatttgttctattttgagtttcttctatgcttttgcatgaccataactcaacaaaagggaaaaatggcggaggttcaaatccgcctcacgccaacatttttggatcaaaaaatttaaaaaatgacgcttattgaactttttgctagtagatgacatgaatttcggttttaataaaaaaaaataatacgccaaaatgagaggtgtatttttctctgcactctcttctttacgacatgcatttattaatcatgataaaatgttattacccataattctttaatcaatttaaatggttgagtcattattaggcatttgattaatttttctatcttttgcaaatctacattttttctaacttgttaaatcattttaaaaagaaaaacccgacagaaatg

SEQ ID NO: 107248 - DNA, 157 bp, Heterodera glycines
  Promoter: Source sequence=SeqID_285; Location=1671..1827; Strand=-; Gene=SeqID_81142
tattttattatttattggtataatttttaccaaaaatttttggactatttgtatttagcgcgctaattaggtaattaatgatgaaagagaaaaatgatttaagaggaggaggtcggtcggtcctgtttttgtttgtttgttggttcattttaaaatg

SEQ ID NO: 107249 - DNA, 82 bp, Heterodera glycines
  Promoter: Source sequence=SeqID_17125; Location=2160..2241; Strand=-; Gene=SeqID_81563
agagcaaagttagggtgttagaaccctaaaatttaaatttttaattcaaaaattaattattggagaacgagaagtgaaaatg

SEQ ID NO: 107250 - DNA, 389 bp, Heterodera glycines
  Promoter: Source sequence=SeqID_1234; Location=558..946; Strand=+; Gene=SeqID_70391
atttgaggaaacttaattaggacaatagtaattaataataatgacatatggtcaaaattaggacaattagaacccttataatttattttgggaattcgtcataattggaacacaaataattttttggttttgtaaattccgaaagaaaatatgggaatgaatgccatgccaatgtaaagtggtgacaataaatgtcatgccaatgccaatggaatgctgcgttttgtttagtgtccgcaaggccgggcagactgaacgcgcgttcgccgggcgcgcgagtgcgcgccaatcggcggaacccgcgaaggcacaaacgcggaagtgcgggtcatttcatctcgtgcacattcttctttctgctggccatgttcttcgccatcaacaccatg

SEQ ID NO: 107251 - DNA, 51 bp, Heterodera glycines
  Promoter: Source sequence=SeqID_31711; Location=775..825; Strand=-; Gene=SeqID_62013
gaatgggaactgaatagcgaccaactgagtcagaatgatttcaataaaatg

SEQ ID NO: 107252 - DNA, 160 bp, Heterodera glycines
  Promoter: Source sequence=SeqID_41934; Location=358..517; Strand=+; Gene=SeqID_69968
tttgaagcggatcacttgctgtgagatggttggcctcgccgatgggcagtccgcccttctgattggtattccatggatatttaaatatttgaaaaggaaaagtgttttgaattaaggcacaataatcggcaacatttatgcacttttggtgcgcaacatg

SEQ ID NO: 107253 - DNA, 362 bp, Heterodera glycines
  Promoter: Source sequence=SeqID_36474; Location=438..799; Strand=-; Gene=SeqID_65775
aaaaaagaaattttattaattaaattataaatttattagacctaatagatttggttgctctaatgaaactactaatcaccattattatcctcatattatttgtccaaagttcagaatttgtcatcaaactgcaggcaaatgactttaaatcgaaggcatgttgaaaagaaaaactaaaatttaaaagtaattaataaatttattatagcaattttttccaaactgaattcggattatagttattgcttttacattgaaatttcgatttaagattgtaaattttatttgaataatgacacattttccgggttcttaatccataccaatccaaagactccgccgtggaaaatttaggagctatg

SEQ ID NO: 107254 - DNA, 455 bp, Heterodera glycines
  Promoter: Source sequence=SeqID_11526; Location=729..1183; Strand=-; Gene=SeqID_74952
tttttttgtttctaaaagaaatataaattaaaaagtcataaaaacgacgactttggtacttgtacagtttcggaccggctcagtttaagttgttttagtagggcgtcgttttagcccggcaaaccgttttcgcccataactcttacaaatattttttttgtcaatcacataaacacaccgactcaaaaaacgagacatgtgtcaataaaaagagagtgcagagaaaaatacatctcccattttggcgtactatttttttttgtctctgttaatagagaaacactgagttcagtcggattttctgtataaaagtgttgatttctcttctccacctccacaatttcttttcttaaaatttttcttcttttttttagttgtttttgttcatagtcttcaaatcaattctaatgatttcctttccccttcaatttttagcggcagcggatttcaaaatg

SEQ ID NO: 107255 - DNA, 162 bp, Heterodera glycines
  Promoter: Source sequence=SeqID_18027; Location=490..651; Strand=-; Gene=SeqID_82605
ccttaaagataaaacaattaaataaaattaaatttttagtaataattcaacataaaattcattttgatcaattccattagtgttccatggatattaattaattaatttcttttccaatatgtaatttttgcaaaagaaaattccaaaaaaaaaaaaaaaatg

SEQ ID NO: 107256 - DNA, 251 bp, Heterodera glycines
  Promoter: Source sequence=SeqID_21904; Location=1475..1725; Strand=-; Gene=SeqID_52539
tgtaaaatttagataaaattaattaatttgtacagcatgggacaaaatactcacttttcgagatcaaactttcgcccatttcactccaattaaaaatatattaataaaatatatagaaatttgcaatttcttacttacgggggggggggggctgtaaaaaatattttatagtttagaaaaaaacccaaaattttttttcttaaattttagtgaatttttcgccacctccgtcaaccaaccctccgccaatg

SEQ ID NO: 107257 - DNA, 121 bp, Heterodera glycines
  Promoter: Source sequence=SeqID_32678; Location=407..527; Strand=-; Gene=SeqID_62957
gttcaacggaatgggtcatggtggatttggattcatatattcatacacaacaaactttttaataataaacataattatatcttagtagcggcacaaataaaactacccacaaaatcaaatg

SEQ ID NO: 107258 - DNA, 302 bp, Heterodera glycines
  Promoter: Source sequence=SeqID_5652; Location=518..819; Strand=+; Gene=SeqID_58786
gtttttcaaaaaaaccaaaagaaattttttttggtattttcttataaaaaatttttaaaatttattgtaaattttcaaggtttgaatttttttttcaaaaattttccgggggtaacgatgatacttgaaatttgtccaaaaaccactaaaaattggcatcactgaaggtgaccggcgtcaaaccgcagcacacctacgagttccgcgtggctgcagtgaacgcggcgggccgaggcgagtggagcaagaactctgtgccaattgctgccacatggttcccctgtaagccgttgatcaccatg

SEQ ID NO: 107259 - DNA, 972 bp, Heterodera glycines
  Promoter: Source sequence=SeqID_8779; Location=2037..3008; Strand=-; Gene=SeqID_69200
tttttgaaaaatggaggccaaaatggaaaaaataataattttttggcgaaaaattttgtaaaaatgaaccccccgaattcgagatttcaaaaaatgaaaaatacacccctaaaaatcgattttttgacttcaacccccccccccccccccaaagccaaggtctggctgcgcccttggcatatacgtccaattttttgccgcagtatttcaaaaaatcttgttgcaaatggtggggggggggagggaacgtccgattggtgccggaagaaatcgccgggagaattttgaaaatttgaatagaaacatttgcacatttgttaaacaaaattctcccattcaaaattttttcgagtgttatcaaaattgtttggttgagtttatgatgcagcgaattatgactcataacgaataatcgcctcaaagtccattcactttttcactttctttcccttctctccgttttaatatggtattttatgggcttaattagcacactaatcgctgtcacaaattcccgtcaaaaattggccggcattcttttcacacattaattgttaatttttggttgtcatggcacacatttcgccattttctgtcaaattcaactaattgtcgttaagcacaatacgaagagaaaaaatgttatttaattagccgcgccttttgaggcaattcattcatttccattctttcaattgttcactctttcctcccatttttgaaaaggaatcgccaaaatgttcttctgctcgcttcttaagaaagacgtaagtttcctttttacttttttggcactttccgatcattttggactaatgccatcgcacaaaaaaccaactctaatcaaatgctatgccaattccatttgataaatgcagtgattaagggacaaatgagaaaaaaactgactttgaaccgataagaactccgttgatagtggtgggatagcccatccatcggttaagtgccatg

SEQ ID NO: 107260 - DNA, 266 bp, Heterodera glycines
  Promoter: Source sequence=SeqID_6765; Location=1..266; Strand=+; Gene= SeqID_62813
ttaagcttgtgtttgatctgacctaattttctgaacaaaatttccaagaaaataattaaattagagaattttaagcattttgaataaacaatttctaaaatcttctactttcgatatattttaccatttatccaaattttattttttgccattttgtccatttttcataatttgattgttttttgtcgtccattttgctacttttcccccaattttcagccattgataatccgtcgctttttttgctgtccgccggcgccgcaatg

SEQ ID NO: 107261 - DNA, 633 bp, Heterodera glycines
  Promoter: Source sequence=SeqID_2968; Location=2051..2683; Strand=-; Gene=SeqID_82558
gatttattaatattatttttattgctctaataaaaataattgaattgccagaaaattaattaatttaaaaatcaaatgaataaaaatatttaaaaataaacagaaacggcaccgggcttttttccgctattttaattctgttggtgtcaggtccataagcagaaaaaaaaattcggttgggatgaatccaaaactgttttaataattagcgtccctttttgagtctcattttcgtttttttttgtttttgtccgtttgaaaattctcttttccctttctgttttcaaaattttgaatttttgtttcgttttctgtttttttttttaattttttctttcgttttcgtcagactaaatttggatatggatgaaaaaagtttcgttccgtttttgttaaacaaaaaatcaaatcttctaacatttaaagtcctctcatcccacttcgtcggcgaccccacccgccgcaatggtcatccataaaagtctaaaaatttcttgggttcctgatactataaacccaagaccgagaagcgaaaagcccgagaaatttctccagtcgagaattgagaaccgagactctcgcttatccctagtaaatagtgtcataataatttttcaaataaattaggaaatg

SEQ ID NO: 107262 - DNA, 152 bp, Heterodera glycines
  Promoter: Source sequence=SeqID_18238; Location=870..1021; Strand=-; Gene=SeqID_82835
actggtgaagttttgttttttatgcaccatttaaataataaagaatttatttattgctaaaatcaatattaaaacaatacaaaaaaggattaaaaattattttaaaatcgaaattattaagatgaaaatttgaatttacaggcacaaaaatg

SEQ ID NO: 107263 - DNA, 437 bp, Heterodera glycines
  Promoter: Source sequence=SeqID_41520; Location=1..437; Strand=+; Gene=SeqID_69611
tgcgttggttggcattgtgttgaacggcacagttttggtggtcactgccaaatccaggcaaatgccatggcatttttaaattacaatttaattaatttctgtttaccaatttaattcaatttctcatttttcagttccctccgcggctccgccaattttttgatggcactgatttgtctttgtgaattggtccaccaaattgggcacactttttttctggttgttgtcatttcgggcacaaattttgtcagtttgctcactgctgacttaattatgacgttaaatttaattttaaatatttttttatttttaattaacgcccacaaaaccctaattaacaccaattaatcctttccatttaagcctaattaaaactttaattatttatttaatttgttttttagacactcctccattttcacccaatacaaaaaatg

SEQ ID NO: 107264 - DNA, 1003 bp, Heterodera glycines
  Promoter: Source sequence=SeqID_3409; Location=150..1152; Strand=-; Gene=SeqID_84565
atttgtgaccataatatttatattatgtaaaagcacattttttttataattaatttatttgaataaattaatggtaatatacagtaaaaataatcaaatggtcaataaaaatataatggaacaaatattacaaaaaaattattgaaggaaaaagtaaaaaaccaaacttaaaaccaataaaatataatgtgaaaaatagttttttaattaattttgaattttttttactttttccatcaattattattagtttttatcaatttttttgaattttcattatccatttaaaaaataattaattaactttggttttaatcaattaattaacatgtgcttaccgataattatttgtttcgaattttactaaaatgaggttttgtaatttgcgagaactaatatcagattcacaccaacacccgatgaaatttaaaaacaaaaaccaaatggtctgctgatgctggatggatgggcaacaaaaccggaacgtaataatttcattagaaaaatagacgctcaattaaccagaacgaattacgcgtcatttaattttgttcttgagcaacttttaattaattactaatgaatgtaattaaattgttattcgaaattgcaaaattttaattcttttattaaaataataaactttaatttccgtgatgcaacattttattttatgcttctcatttcttactttctgctgtttttttatgaaattctttgaataataaattataaaacaaaattaggaaatttagaaaaaattgaaaataatttttgtattcagcgaacaatttttttttgtgcacaaagaatataacgtaatttgctgaattttcattcaaaaaccaaatttttatccttcaattcgtcgaattgggttcttttaccactaattaattagtaattaaatgtgggcaaatattttccatttaaaagcaaatgattgtgtttaattggaaatcattcgaatatttttgtagcaccaaatttcacactgaaaatg

SEQ ID NO: 107265 - DNA, 527 bp, Heterodera glycines
  Promoter: Source sequence=SeqID_9538; Location=916..1442; Strand=-; Gene=SeqID_71793
tttttctgtttcacaactggccaacggcgactgtgctcattgacacgtagttgtccaattaaggtacttggactttccacagtaaaatgtggtgcaaattttggaactgtcccgcctcacggcggggcttaaaagcatttgtagcgcaataaaagttttttgttttgaatttttcacaatttatttaaaaaagccaaaaaatccggatccaattttaaaaacgaaaatagtgcacaaaaaggagccgcctcacggcggggcttaaaagcatttgtagcgcaataaaagttttttgttttgaatttttcacaatttatttgaaaaagccaaaaaatccggatccaattttaaaaacgaaaatagtgcacaaaaaggagccgcctcacggcggggcttaaaagcattcgaaacagaagcataattaaaatcagaaataattttattatattttttcacaatttatttcaaaagacaacaaaaaaatgttcccaatgttgaaacgaaatagtgcacaaaaaggggggatg

SEQ ID NO: 107266 - DNA, 106 bp, Heterodera glycines
  misc_feature (35)..(35): n is a, c, g, or t
  Promoter: Source sequence=SeqID_39761; Location=969..1074; Strand=-; Gene=SeqID_68257
ttttagctaaaatttggtatatatggggggttccnggatgcaaatcgcgaaccgaatctgaaatttacaccaattaggtactttattttacaattaaacaaaaatg

SEQ ID NO: 107267 - DNA, 145 bp, Heterodera glycines
  Promoter: Source sequence=SeqID_24049; Location=1..145; Strand=+; Gene=SeqID_54745
tttttgttcaacaggtgttggggtcacttttgaaaaattgtaattttttccattttccaaaacaactcctgatcaattggaaatcttttatgaggaaattataatatattaatagtggaaaactttcaaatttaaaaatgcaatg

SEQ ID NO: 107268 - DNA, 306 bp, Heterodera glycines
  Promoter: Source sequence=SeqID_25923; Location=1..306; Strand=+; Gene=SeqID_56693
cccccccccccccatctgctttgccctttgtccttaatgcctgtgcaaaaaaatagaaggagacaaaagacgacaaatggatgcttgttctacatttcctttatttttttaaaactaatattgttacattttgggtagtaagagtgaaaacagctaaataagtgtgatttaggagttcgacattttgaaaatgcatgaacatgtatgtcgaattctaagttaacaaaatttattcatagcattgaaatttcatctcaatatttgcactttaattagccggacaattggcaattaacatgcacaatg

SEQ ID NO: 107269 - DNA, 102 bp, Heterodera glycines
  Promoter: Source sequence=SeqID_13109; Location=3926..4027; Strand=-; Gene=SeqID_76904
aaatagaaatggaggacataaagccaaaagtaatgcaaaagattaaaaaggaaaaaacattttgaggaacaaaataataaattaaaaataaaaataaaaatg

SEQ ID NO: 107270 - DNA, 681 bp, Heterodera glycines
  Promoter: Source sequence=SeqID_18900; Location=319..999; Strand=-; Gene=SeqID_83609
aaaacccggaaaacccttactccgtataagtccgtatgcaggaaaaatacggacccgtatacggatcagggttttttgaaaagttttttaatcaataaaaaccatattttttttactaaaatactaatatagattcgttctaaattttattacgaacattaaacaagagtttttggagtccggcggtgccgataggcgccggcgggaaaattttttaaaatttgattgcaaattgttaaacagatttatcgaacaaatttgcgctttttaaccgattatatgaattttgctaacgatttttcacaaaaattaggtatctataattttgaaaaaatttgcaaatccatcgtaaaaaagttaagaaatttaaaacgaaattcatttcaaatgaaatttacgaattggaaattaaaatgtctaaaatttgtgtttatattaaacaattccaaaagaatgctccatgcaatcaaacatctttgaatgttttttcgaaaacctaagaaagataaacttcaaaaaatttttttaaatattttcgaaaattgctttatgaaaatttttagtttcattcttttagagaataataaatctatagtttcttttttactcacggtttactcagtgattacccatttcacttattaaaaaaataataattttatagaaatcttctagagcatg

SEQ ID NO: 107271 - DNA, 147 bp, Heterodera glycines
  Promoter: Source sequence=SeqID_11116; Location=1..147; Strand=+; Gene=SeqID_74457
gcctccgtctagctttgctttggcaattgcgatcgccggtctcgtcattctgctgtgatggactgatcagaaacagagttgaagggatcaaggaattacgaacagcgattttttgggattaactaatcaattatataattaatcatg

SEQ ID NO: 107272 - DNA, 273 bp, Heterodera glycines
  Promoter: Source sequence=SeqID_37756; Location=664..936; Strand=-; Gene=SeqID_66747
aaatgaggaaaaatccctggaatcgcgtctttttagggatagtcggtattcaacaaggcacccctcagcgaatacttcctatagagcaatcattcaaaggccattttgtagagaattttgtgctctttctgttcgtcataatcatcttctacggaaaattttttccaaccccctagaatttttttttcgaatttactcagattttcgtattttttcacccgcaaaaattttgtgtttaatgccttttttatggcataaaatgaatacaaaatg

SEQ ID NO: 107273 - DNA, 419 bp, Heterodera glycines
  misc_feature (376)..(376): n is a, c, g, or t
  misc_feature (380)..(380): n is a, c, g, or t
  Promoter: Source sequence=SeqID_36893; Location=1..419; Strand=+; Gene=SeqID_66099
ttcctttacgccgttttccttccttccccatataaccattcccaatgtgtatttgtgggggcattttttcacattcccatttttcaaaaccgagagaggataagggaataaccagcatgtgatgcggctcggggctgcaggaggaataattgcaatacagagagagagggaataaataaaaggacggacgaactatgagcatccctcagagtttttgttgtcaatatttgggaaaaaagaaccccattttattcaaaagcgaatgtctgatatattttaatgatttgttaatggggatcgaattctagtccggctcaaaaaattgttgaaaaactaatacgtaattcgaatgtcaaccatccccaaatgccaccanccanccaacacaagacgaaaaggaccaacaagtgccataaatg

SEQ ID NO: 107274 - DNA, 205 bp, Heterodera glycines
  Promoter: Source sequence=SeqID_26111; Location=2153..2357; Strand=+; Gene=SeqID_56860
attttctaagaatgttcgtttttacgagcagagatattcctttgattttaatctgactcacaacactttattttaaatgcatttttaaaaatttagctcgcggatgacttcaggtcaatcatcaaaaaacattacccgtccgatgccattgcgcgtcaaattggtaagaaattggcctaaatttcaatcctgaaaaaacaaaatg

SEQ ID NO: 107275 - DNA, 649 bp, Heterodera glycines
  Promoter: Source sequence=SeqID_16501; Location=1..649; Strand=+; Gene=SeqID_80903
ttttgaatttttttcactttttttttggtcaatttttttttgtttatttttacacataataatgaatattaaacattaacagaacaattatggcgaatgaaattataaattatggcgaataaaagtacattcacgattttttatgtcaaaagaattttgcgaaacaaaagggttcccccctttggtttttgataaattcaaaatctttcactttttaactatcgccaaattttcttttcaaaattattttcaattattaaatagcgtgaaatacgtaccatcggcgcccccacaaaatgtccaagccacgaaatgtccaaaagagtaaaaacccacgaagtgtccaaaactcgaaaaagctattaaaaagccggaaaatgggtctaaattaaggtattcggggtcgctgaatacgaatacgacatttatataacccatttcctaaccttcgatccacccgaataagaaaaatctcaaattcggttaaaatatatgctgttttttgtcttcagattttgttattcattgatcgaacaaaatgggtgggccgagtattatccacctggcattctggctacacccggccaccagttagagaggaatcttttgttgcaagttcatgccatgattcagcttccgcttcaatatg

SEQ ID NO: 107276 - DNA, 590 bp, Heterodera glycines
  Promoter: Source sequence=SeqID_26105; Location=1230..1819; Strand=-; Gene=SeqID_56852
ttttatggccaaaaaattatatttcaaaaaaatataataatctaaaggaatatgtgtatgtaaaaacggaattgttcaatctgtatattatgttatgtaaagttaaaagttaattaaccagaataattaactccactgcagtgggcaattacggggcatagcccggggctaattatccccttcttttgtggtgcttaatcaataatataacgaatgacaaaatggaacgcataaaatggcactttttcttaatcattttttagcaaatgataaaccaattttaaatattctttttgttaaaagaagataaaaattattggcgcttttagaaaagtaaaatgcatcaaaatttaaaaatcaactgatcaaaaaatatacacacaaatggaaagcaaaataaattactcatcgaagtcccactctttgcctaagaattggatatatttgaaaattaaatttttataacgaattcttcagtttattattattttggcatgctcatatttgttataacatttttattttatttttatttgctttttcttcaacttttactgaatactttgtaataatctttagcctttaaaatg

SEQ ID NO: 107277 - DNA, 284 bp, Heterodera glycines
  Promoter: Source sequence=SeqID_3914; Location=4490..4773; Strand=+; Gene=SeqID_52413
atggctattacgctcttaaacattttaacaactgcaataggcaaacaacaaattttaactgtgaataagcctatgattgccaaacacaaaagcaagcaatgctttgggagctaccaattattcaggggtgtccagcaataaggctaagggtagacaattcacccattactcaaaatcgtcagctgtttatccctaacagcattgaattttcaacaaaagcttgggcttgtaggaaaattaagaaaattgttagaaaatatacaacactaacaggagtaccaatg

SEQ ID NO: 107278 - DNA, 1003 bp, Heterodera glycines
  misc_feature (432)..(433): n is a, c, g, or t
  Promoter: Source sequence=SeqID_2968; Location=4202..5204; Strand=-; Gene=SeqID_82559
atttgtggatttaaagaaaaaatttttttttacaatttactcttccgtaaacaaaattttgaaataagatacggtaatgttaattgatatggttacaaattgacaataatccagttacagtatgtttgtcgcctttgggttttgataattttcaaaatttatttattgaattacacttaaaacgaggttgtacaaaattttaaccttttgtacaacaatactttatgctacataagtttatttaaaataacttattacagacgcatttttatggcgcattttccactgacgcatttacatgagcgtaaaaaactccgtcccgtacttagaccatgaaatgggtcggtgctatgtcgttatttaaaaaacaccaaattgaaattttcaacaaagaactggctataaccttatgtcaaagtcaaccaaattagnnacattcttggtatcattcaatagcccaaatcaattctctgtttgtctgcaaaatttcaaaaaattacgtcgagtttcaacaaagttatgaccaaaagtacccaagcgaaaccgggttttcaaaaattttaggccataaatttttgaaactcaacaaaatttttttgaaattttgcaggctagtagagaattcttagggtttatattagaatgaaagctagaaaccaaaaactaaaaataattattaacgaaaatttttaattaaacaaaataattttgatcatccaaaattctgaccaaaacattcttagaaccaacaaaattaagaaatcttatcatcattcaatagccctaaatgttttctacaagcctgcaaaatttcaaaaaaaatttgttgagtttcaaaaaagttatggtcaaaattttttgaaaaccctgttgtttgtgtactttggccataccttggttcaaacttgactaaattttttgaaatttaggttagctaatagataactctagtgagggaggcgtgttgggtcccccagtcgacacaccgttcgaagaataaatg

SEQ ID NO: 107279 - DNA, 1003 bp, Heterodera glycines
  Promoter: Source sequence=SeqID_2473; Location=2424..3426; Strand=+; Gene=SeqID_79898
gcctatgggaggggtgcagccctttgatgttgccgcacgaacccatgcctatgggaggggtgcagtcctttgatgttgccgcccgtggacccatgcctatgggagggtgctgccctttgatgttgccgcccgtggacccgtgcctatgggaggggcgcattcctttgatgttgccgcccaaaacccaaacctattggaccactttcaagttgccgcccagaaccaaaatctattggaccactttgaagttgccgcccacccaaatccgatttcccaaaaccgcacgggtgctttttttttgcccaacccatccctcccggccgatgcatcgccgcgcaaattaatcgataatgacaccgccctaccctccccatcgatgtcgccgccgcgcaaaaaaaaaatcgataaaattaatcgataatgacaccgccactctcatccgctccgtcgatgtgcagcgattccgagtcgtgaaaaaatcgataagcaccaaaattgttaatgaaattcaattaattctaagatataggaatattaattgtacaatagttgaataaataaaaattcattaaattaatgaaattgaatttttctgaaataattgatggtcttttatttttcttccattatttcgcaatctgcacgtgactttacgattcgcaatatggaccaaattaggtcacctgtcaatcaaattttttatttcgcaatttccccatcgatttcgcaatctacacgtgacttttttttgttgcatatttcgcaatagacacgtgactttctgccattgcgtcgaaaatataacatttgtcaacgaaatattcctccatgtcaatgaaaaacagtcacgtgccaggtgtcagctgacacgaggcattctgcggccactataaaagccccacaaactcacttctccattcagttcaaccaaaaagttggattttgctaaaataaaaattgtgcgctcttatttaaaaaaaaatattaaatttaattaaaaatg

SEQ ID NO: 107280 - DNA, 190 bp, Heterodera glycines
  Promoter: Source sequence=SeqID_14138; Location=160..349; Strand=-; Gene=SeqID_78133
gagggcaacggctgcactgttgtggtggaggaagaatggaccaaaatgctaaattggaaggactaattaattatccaataattaatcaattaaataatttgatggcaagcctcacttcggaatgccggtctcccatggaacagttgcgctgtgacgcgtgtacgggttgggccgagttcgtggcgaaatg

SEQ ID NO: 107281 - DNA, 919 bp, Heterodera glycines
  Promoter: Source sequence=SeqID_22094; Location=1..919; Strand=+; Gene=SeqID_52734
catctgctgataaagcaaataaaaattatgggaaaactcaaaatagaaacgtcattttgtatcgatgtttcaatgttacggaaaatattacccaccaatcaatcatcaatataaaaaaaaaagacaatttcatttaaatgttcctctccaattttttctgaatattaattaatttaattatccttaattgatttgaattttcttcggtttttctttcggtgaatatttgataaattttaaattttattagttttggcgtaatgccatttcaaaataaaaagaagacgccgcttccttttttgtctcgctccacaaacacggcatagcaatagcaattggaatgtggtggatttgcttttattttatgtgtgttttatgtgccttttttgtttgtcgagccttttccgtttgccctattggttttcttccgttgcatgagaatggcactggaggagagaaatggcagcataaatttttgagtgacagcatcatcaagttttgtggatgatgccagcatttttaagcagacgaaaagctaaaatttccgaatgaattattttttctaaaaatatttttatttttcacaaaaaaccgaataattctctatttaaaacgttaaatttagtgcgccaaaattgaaaatttatatccattcacatgttgagcccaatttcaccttcccccttccccttttcaaaatttgtcagttttccgtgtgatttatttgtcacactttctccccttttagggcgaatttatcgcttatctcattgattgattggatttggtgttggtgtatatgaactgtttagaggtcagaccaccctttttctgtttatgcatggcatccgccgaccaaaaaaacacttcctccgccaccgcttcgtccgccgcttttgccagcgaccccccaaaaatg

SEQ ID NO: 107282 - DNA, 245 bp, Heterodera glycines
  Promoter: Source sequence=SeqID_7198; Location=3955..4199; Strand=+; Gene=SeqID_64117
cctagtttgaattttgatgtggagtgctatggatttatataggggaagatatttttcaggttcttttttgagtttcttccaaagagctgccttttctttaagctttttgtcgctaacattaacgcagcatttattttttgattattttttgtatttaattttaaatttgttttttaattttctctttttttgtgtgtttttattccttccattttttccttatgcttcagccaagacggctgatg

SEQ ID NO: 107283 - DNA, 123 bp, Heterodera glycines
  Promoter: Source sequence=SeqID_25186; Location=1698..1820; Strand=-; Gene=SeqID_55924
tttcaggcctttttggatgcttcttcccctgcaaattacatcattaacatttggttccattcatctacttacacttcgattttgccctacgatttgacaaatgatttgactggagagcgaatg

SEQ ID NO: 107284 - DNA, 1003 bp, Heterodera glycines
  Promoter: Source sequence=SeqID_10846; Location=1551..2553; Strand=+; Gene=SeqID_74119
aaccactcaatgtttgaaatgttctaatggagatggtagcttttttcaactggaaaatacaaaagttgcaggatattgtctacaatgtttttcgaaaatgattagacagaaatttgctttttgtcttggcaaaaatcgcgtgtttaaagaccaacaaagggtaagtcgaattttgggcattagcaaatcgtttttgaattttattagaaaccaaaggaggatggtcgggttagggattaggaattagtcaaaatgggtgtcagatgcgtaatcacgacccggaaaacccacgggagcaaagtttcacgacttattatgtatcacaaaaaaaatttgcaaactaaaaggattaccccgttggtttttaatactattcaataaattggtttttaatactattcaataaatcatcgattacaatattagtgccgtgtttttactccttattcaaattttagcgtgatgttttaattgtttgttattcaaatgatattaaatcgcttcaattgcttcggttggtacgtgaggcaacaactgaccaaaatgtacacaaaagactacggttgaaagcacaggtaaaagcccttttaaaattcaaaataggtagttaacttaagattttgtacctttcaaatgccatttcattgtttaatttgactcaagacgccgaaaattgtcgattgtatatcacaaactttaccaaataattggatttggcattttgcacatgaatcagatattctcaatgaagacttcagaaacaaagaccaggtttttattaaatctgtatgcttctaaaaatgttagaatgataaaacaactaaacaaattgttcacggaaatcctaagaaattcactgctgcgatacaatgagttatttgcgttgtgtctatcaaattctgatcggaatgagttcaaacgactgcttcgtacgaaactgatatattggtaataaaaatcggacacaaataattaaaacatttattgcagtctttccgaaatg

SEQ ID NO: 107285 - DNA, 138 bp, Heterodera glycines
  Promoter: Source sequence=SeqID_37036; Location=1015..1152; Strand=-; Gene=SeqID_66220
ttcaaattaataatcaaaaattctcttaaaatttttttcactcaattcaaaaaaggaaaaaaatttgcagtcaaaaaattattcgaatttctccaattttgtttccataatttccgaaagttattcggtatcataatg

SEQ ID NO: 107286 - DNA, 196 bp, Heterodera glycines
  Promoter: Source sequence=SeqID_9061; Location=1167..1362; Strand=-; Gene=SeqID_70134
tattgtcagcttttcccgttagtcccacgcttggtgttgtttccaagtcaaaaccccatttcattgacagttaacctttgctgatagtgagatggtcccaagacattaatactttgtgtgtttatcgcgtcccacttcgatttcaagtttccttttcacctgttcaaccgacaaaacagtgcgcgtgtgggacatg

SEQ ID NO: 107287 - DNA, 167 bp, Heterodera glycines
  Promoter: Source sequence=SeqID_2192; Location=5837..6003; Strand=-; Gene=SeqID_78407
ttcattaatttttttttctccttaatgcataatgggattaccaatttttttagcaaaataataaaatcttattacgaactgaacgacttcgaatgtctacatcagggggctcgtcaaatgagttctccttcggtacatcccaagccttcgggcaggaaacaaaaatg

SEQ ID NO: 107288 - DNA, 358 bp, Heterodera glycines
  Promoter: Source sequence=SeqID_15707; Location=574..931; Strand=-; Gene=SeqID_80020
atgcgccacataagagcactaatgtgcctgtggtttgctcaataaatatatttaaatttgaaatatatgtttccttttaaaaaaattgtggcaattttctcagcccttcaatcaatgacatatttggcaaaaatatagattttttatacaaattttatttttgattgtataataacataaattcattttcttcatttcattgaaaataataaattatacaaatattataaaaatatcattataatattttttaatccttgtgaatttttttaaaatattaagccttttcatatttcaattgtttaacaatttttatatttattaaaaaattatgatacaattttagtgtcaaccaatg

SEQ ID NO: 107289 - DNA, 115 bp, Heterodera glycines
  Promoter: Source sequence=SeqID_7009; Location=2264..2378; Strand=-; Gene=SeqID_63561
cctcgggggacgacatgtcgggggtcggggaataggtccaaaaaacgtctcgggtcgggtcgggggtcggaaggctcggggtcggggcttaaccctattttcaaggctcgcaatg

SEQ ID NO: 107290 - DNA, 196 bp, Heterodera glycines
  Promoter: Source sequence=SeqID_21046; Location=1..196; Strand=+; Gene=SeqID_51634
ccacagcaatttgagctcccacagctattttcgatcacctatcacaagcagtaaatcccgtttcttttcttttttacagtccctattttgtcttatttttggattacacacattatggcacgctatcgccaacggggccatcatcgtccgtccgaaaagcagcagcaaaatcacggcaacatttttgacaaagatg

SEQ ID NO: 107291 - DNA, 487 bp, Heterodera glycines
  Promoter: Source sequence=SeqID_18178; Location=2062..2548; Strand=-; Gene=SeqID_82762
ttcagtaagcggaccaaccaaaaacagcagttggcataatctgctgccgccgaaagggccacagcaaattggcaccgttaaacattcgaaaaataaaaacggtggccgattaaaaatggacacccaaaaaatgcgaaaattgattgaaaaactagtcaacagacaaaaatttatgaaaaatgatcaattattgttatgattaaggagtcactgataaccagcgctggcttatgtcttggatcgtagaaaaattaaccgatacgaattcgagagtcataatttattaacgaataattggaaccgggaaaagccaaaggaagtttcggatttttcggaactcaaaataaaactggcagatgagtgagtcgagattctcgtgctcctaaattatgaaaacccagaatatatataagcatggaactcgaagagcttggttcttgacattttagaaaaaagttcggttttttcgggtattttagcaaaaatg

SEQ ID NO: 107292 - DNA, 374 bp, Heterodera glycines
  Promoter: Source sequence=SeqID_101; Location=5375..5748; Strand=-; Gene=SeqID_46607
ttgcgttgcgttgcgcactgaagcggttcgttggttggagtgtggtgaagaagaagaagaagaagaagaaatgtgaagcggagggaaagacgaccccttttatacggatccaattctgctggaaggaatttggaaaaaaattgatataaaaggacggaaaatgcccaaaattctcacttattccatttccttcaattcacgcctattattttcgacacgcctcgcgcctaattactgaggtgcgccttcttcaccatcgcccgttttcccctcaccccctccatttgcacatcattaatttttttccccttttacagtgatcaacaacgctctgccgcgcatttcaacctcaacgcacacagcaaacgcggatg

SEQ ID NO: 107293 - DNA, 539 bp, Heterodera glycines
  Promoter: Source sequence=SeqID_5449; Location=351..889; Strand=-; Gene=SeqID_58087
ttttttgcggttattttctctttttttgtttatttttcatttttaaatttccccgggaataataagtcaatttggagctgtctcacttttgttgttattttctgcacatcgtagcaaattaatgcgtccgccgatgcttaaaactccgattcgaatgttccgtcaaaagcggattatcccccgccggcaatttgaacctttctccgccaatgccaaacattgccaatccctcccaaaaacacattttgccattaattaataaagttgactaaagctgacgttttaacaaaaagcacttaaatgaattaccacgaacactcaaatggcacttaattattatgattgattgcacttctttttccacctgcctttctctttctcttcctcttctttttctccaatctctcctccgctctctttggcactttttttgtttcacttttggcattttcctctcccattttgacattctctccctttttccttctctcatccctttcagttcctcccattcattctttggttcgcctcgtccaatg

SEQ ID NO: 107294 - DNA, 59 bp, Heterodera glycines
  Promoter: Source sequence=SeqID_3694; Location=2202..2260; Strand=+; Gene=SeqID_51482
aattttccggtaatttgattccgaatgtattttttcaggtaattcgtgtccaaccgatg

SEQ ID NO: 107295 - DNA, 344 bp, Heterodera glycines
  Promoter: Source sequence=SeqID_10434; Location=826..1169; Strand=-; Gene=SeqID_73633
aataatttagtatttttgagtttattttccgctctatcctcgcttctctggcccaaatttatcgcacaagcaaacgttgatcagtagcatttttggtaatacactgatggtaccccctgcctttttagacaatataaaatattttttatgaataagttttttattgctttccagggttggagaatttttttagtttaggtgtaccaatttataacctattttaatattggcacaaactatttaatatcatttaatttaactaatcggcattactacaaaatcgacatgcgtaaatatgcgagatttttccattgtggtaataacatttagctttgccgataatg

SEQ ID NO: 107296 - DNA, 211 bp, Heterodera glycines
  misc_feature (32)..(32): n is a, c, g, or t
  misc_feature (39)..(39): n is a, c, g, or t
  misc_feature (105)..(105): n is a, c, g, or t
  Promoter: Source sequence=SeqID_33240; Location=1..211; Strand=+; Gene=SeqID_63365
aagttaattgcctcagatctgatgtttgatcngggttcncaatagggattgctgtttccatttcaatgaaatttgggtgaaatgtggccagttattgtttggatntagtgtaatagccgttacataacttggtgtactttgaaaaatcaattgatcgaattccaaatttaaatgttttcgatccaataactcattctgttcacccaaaatg

SEQ ID NO: 107297 - DNA, 732 bp, Heterodera glycines
  Promoter: Source sequence=SeqID_40728; Location=1..732; Strand=+; Gene=SeqID_68990
ataaccgtgttcagcgacctcgaaaacccctaaaaatatgttttccttttattttggaatttggatttttgttcgaattggtcaagtttttaagataattttttcgaattttttaccgtttttcttaaaatataatcattcatttaaatactccaaaatttcttcttgaaatagtttctttcattttgaatcggtttatgaattttcaggatttttgaaataaatgatttttgttgtagtgttttctttttgatccgctttgacccttttgttgataaaaaataaaaataataaaataaattatttcatttcaattggaaataaatatttgtaaactaaaacaatttgatgatggaattataaaatttttagctatattatttaataaatgaagaaatgagaatttattgctttagattacttataaaaagtcaggacgaatgaaaaaaactttcattttagtttcacccaaatcagaattatttttatttaaaatctttaaaatctaatatttaagggttgtaagggttagggtatttaggcaaaaaccgggttcgggtattaccgggtccagaaaagacgggtccgcttcgggtttcatgtttttaaaccgatccagtgtccgatacccggtaaaaccaggtattaaaaaaattttgaatttttattttttttcaaaattataatttaacagaaaattttttgctgtaggaacaggccttgcgccacatg

SEQ ID NO: 107298 - DNA, 830 bp, Heterodera glycines
  Promoter: Source sequence=SeqID_31092; Location=642..1471; Strand=+; Gene=SeqID_61468
tctggttttcataattttttttcttctaacttttccaatttttgtgcttttttaatatttgttggacaggtatgcttagcaaaaaaaaaatacgtaaatttttgttaccattaaaatctcttttttgttatcatcaataactacttgattaacatctttttgatttgattacataacttgaaaattttctctcaagaagcaatagaaaataaaaaaatgtgcgacttaattcagcaaacccagtgccattcggccatttaatttcccaggaatttttttttttgaaaaatatcgtactgcaaaagaaagtgccaaaaaatcaataaactattatagtttttatcaaattttaagatagaaaacttacaaaaaatccgctttttggatcatatcttctgaatttcaaggacgtttgtactaacattaataactgattttccgattttccctcttttaatggtcactttttgcactatcgttcattaaaaaagagaaaattggtgaaccaattcaaattctcatgtcatttactttgcccatattctctgttctcctctctcccactttttgggtcatcattttgccgtacatttatttatttatttgtgtcgaccctataaatattggcaatcaatcagcagtaagccattcaaaatgcacacccatcatattaatacgcttacataaaaaaaattattttacaaataaaatttttatcattttagaaattttttgaaaaaaaataaatgtcaacttttaccaatttgtcaagcagcagcattttcacaccagcagaacagggtaaaaaaaagattaattggcaaagaatg

SEQ ID NO: 107299 - DNA, 145 bp, Heterodera glycines
  Promoter: Source sequence=SeqID_43769; Location=875..1019; Strand=-; Gene=SeqID_71365
caattatttccgataagctgtcgctgatttgccgctttattttgtttgttactcactttcattcattcgcattcgaagtgaatggccaaaagataaaaaatattaattaaattaattttattttattaaagtggccaataaaatg

SEQ ID NO: 107300 - DNA, 930 bp, Heterodera glycines
  Promoter: Source sequence=SeqID_4859; Location=130..1059; Strand=+; Gene=SeqID_55989
tcgaattgaattcccttttaaatgtttaaaattgaatattgaattttataaattttttaaatattttatgggttttcattattgtgttcaaaagaaaattttaataaggtggcaatttcaatttgtttattgaagatttaattaaaaaattaattgcccttaattagtgattgaaattatttaaacattttactaacattggtttgtcaattaaatcatttcggtcagcacgataatcggaaacatgcgcaccaaacttgtcaaagtcaaactctgttcataaaaatataaatatttttttattttaatttaattgtcctactttgtccattaattaaaactgagagatgggaaggctcttaaaatgataaatgattattaacaacaattaaaactttcaaaaaattacttgttttgtgctgaacaatttctatcacattttctttggtacaaacaaaacaaaaaagaataaaagtaattattataataaaaatgtaattcattttaaataaataaaatttgaatatttatttttacggcttttttcttttttatataataaaacacatataaaaagcaggaaatgttgaaatgccaacgatggctgtcattaatgcacttccgcaatttttaattttacgaaaacaaattacagacaatatttgacatcagcagataagaaatcgatagcagtaggaaaggtccggaaacagagttaatttttaaaatattaattaattttttttgcaatggaattaactctggctaaagcagacgtaattttgtctaattttgtggcttagaattaaatttttaaatttttttttattttattgaaatccccaaatgtcgggtccctaaatgtcgggttgccaaatgtccgtggttttctaagtgtcttttgctcaaatgtcgtccggtccccaaatg

SEQ ID NO: 107301 - DNA, 399 bp, Heterodera glycines
  Promoter: Source sequence=SeqID_32136; Location=136..534; Strand=+; Gene=SeqID_62466
cctgtaaaaaaagatttatataaaagttgtattttcaagagatatggacattttgtcatgcctgtctacactttgtccgttcaccacaaaaaggcctaaatgtttgtgttcgggagacaccatttgaatatgtgtgcattatgtttttgttatttccccctccgcacattcattgttgaccccttatatttttgcatggagattggactcaacatttggcttcaaatttgcgagtttgaaagccaatcggtttttcagctttcagggaccgagaatattatcttagaaacaccgaaattttctatttaacaataaatattgcttatatttatttaaataaatattgcttatatttatttaaataaatattgcttatatttatttaaacttttagtgatg

SEQ ID NO: 107302 - DNA, 991 bp, Heterodera glycines
  Promoter: Source sequence=SeqID_1325; Location=395..1385; Strand=-; Gene=SeqID_72558
attgattgatgtatttgataactctcgaacaccctttatcattttgtccatcctatcattatcctattatcacaatttttaaacgatcattgattgccacttggcatttgcaattctcactcattatttaaactcatccaaccaatccaataaaccttattaattgaaaaataaataaacatcaattcgttatgcatttataagagggggacgggaatgaatgaatgaatgaattttagaaaaatttagtgtccataagcacggggttgggcactagcaccgtatccaacccttcgccttaatgcgtaggtcggaggccacaagccgcgaccaggcactagcacgccaaccccaagcacgggttgggcactagcaccgtatccaaccattcgccttaatgcgtaggccggaggccacaagccgtgaccaggcactagcacaccaaccccaagcacggggttgggcactagcaccgtgtccaacctttcaccgcaaaagcgtaaggccggaggccacaagccgcgaccaggcactagcacaccaaccccaagcacggggttgggcactagcaccgtatccaaccattcaccgcaaaagcgtaaggccggaggccacaagccgtgaccaggcactagcgcaccaaccccaagcacagggttgagcactagcaccgtgtccaacctttcaccgcaaaagcgtaaggccggaggccacaagccgcgaccaggcactagcgcaccaagccaatatcaaaacaaaaaacataaaaatgaatgaatgaatgaatgatgaaaaatatttagacaaaattcaattcagtaaatattaatgcatgagaaaggtcagagaattgctggacgggcaaaagaaagaggggggaggagagaacgggaaagttaattatctcataattcagtgctgtacgatttttatttaaatatttttttttataaataattttaaaaaaactttttagattttttaaaaaatg

SEQ ID NO: 107303 - DNA, 448 bp, Heterodera glycines
  Promoter: Source sequence=SeqID_24522; Location=1..448; Strand=+; Gene=SeqID_55249
aaaaaatgaaggatttgtttaaaaaaatatgcgtgtctaatcaaacccataataaatgaatccgacagctttttctgtctaaatttttaagtggactcaaaatagcccatttttaacagttttcgtcaaaaaattacccaatatctgtatttttgggtaaattaaggcaattcagtctctctttttggaggcgccgccttggcaaagttttgcaaatttatttggatgaaaatggttgtgggaaatcaggactgattataaagcacagaaaacaatgaaaagatgctgtaattcaacagtcgtttcaaaatcactatttctaactggaaattttcggtatttatagagcataatttgtttccttttccccaattttcgctttatttatcagtgacactttccctttgccctttaagaaaatcacccgaatcggaaagataaaacaatg

SEQ ID NO: 107304 - DNA, 215 bp, Heterodera glycines
  Promoter: Source sequence=SeqID_344; Location=1..215; Strand=+; Gene =SeqID_83241
gcccaaggccaatcaaatgctacaaatgcagacagctgcacccggccgtactctgccaagaaggcaccaatgccgcaacgcaaatacaacaaacagcagccgtaacggaacggcacccaaagcaggatgaacagaaatccacaagtcaaacggcacaattaatgagcaatgccgttaaaagcagtgacacccgagctctgctgatgacaacaatg

SEQ ID NO: 107305 - DNA, 310 bp, Heterodera glycines
  misc_feature (8)..(8): n is a, c, g, or t
  misc_feature (31)..(31): n is a, c, g, or t
  misc_feature (38)..(38): n is a, c, g, or t
  Promoter: Source sequence=SeqID_11677; Location=1288..1597; Strand=-; Gene=SeqID_75144
acagatgnatgcatgataaaatttaggacanttattgnaatgaattttttatctatcctataatttttggtatacaaattgtgccaatttttatagggtttttttggcttttatttattgatgaattctttggtaaaattaaattcattatttaattgctgttcatttaattaatgctgttcattttgttgcagccagtggtgtgatcgacacttggggctgtcagccgtccaatgactattgctcaaaagttggcaaattgtgccatttttgcaaactaggcaaaaaggacgagaaacactcgaatatg

SEQ ID NO: 107306 - DNA, 495 bp, Heterodera glycines
  misc_feature (26)..(26): n is a, c, g, or t
  misc_feature (52)..(52): n is a, c, g, or t
  Promoter: Source sequence=SeqID_6531; Location=2852..3346; Strand=-; Gene=SeqID_61911
cagatgaaaattttgaaaagcctcantttggcaagcactcccccctcatttntgggtcaaaaagcctcattttcacaaatttattcaaaacacgtataaaatgttcaaatgttatatttttgattgtccatgatcaatttgagcatttttttttgttagaaataagcattttttgggattctgaacatgaaaaacgaagttgattttttttgcggcgctttttccaaaaaacttttgggaaacaaggggggccggcggtgccgttaggcgccgccgggaaaaattttgtaattttcaatgcgatttgttaacagattttgtccgaaaaatgaccaaattttgcgattttgagcaaatttttcctcattttgaaaatttagcctcattgacctgtcaaaaaaccacaaaatgaggctaaagcctcagatctgccatccctgagtataatagagatttagatttatattttttacgcagaccatcgcggaaaaaatg

SEQ ID NO: 107307 - DNA, 72 bp, Heterodera glycines
  Promoter: Source sequence=SeqID_3935; Location=1..72; Strand=+; Gene =SeqID_52522
aaataataataaaataattgatttgttttatagctttttgtgctcataaatttaatgttttgtcgtgcgatg

SEQ ID NO: 107308 - DNA, 1003 bp, Heterodera glycines
  Promoter: Source sequence=SeqID_21272; Location=120..1122; Strand=+; Gene=SeqID_51865
ttccttcctatttttggtgctccccactttgctccgtccctccgacaaatattttttgtattattttttccatttgtgttaaataaatattttggtgttcgacattcacaaataattgtttgagcaattaaccggctcaacaaataattcataaattagtaaaaaaattaaataaatgtgttatttattataaattgatgtatttaaaatcatttcttttttcaatcggctatttttgtcaaaatgatgcatgccttttggcattcgtaccgcagcctatcccccaataattagacgattagagtggaataataatagcctttattctatccgtacaaaaatattagatgaaccgcttcgagggatcgagaatagccaatttctcctcctgaaagaaaaaagaaaacttgttctggagggcagaaaaatagtttaagtgggcagagcaaacggaaaatgacgtcttaaggcatactgtacgaacgaagggtcgacggtacacattaaaataataaggatacgttacaaagttttttagtttctcattcaatggaaaaatttaaaaattttgctaagttttgctaatatttatttttaaacaaattaattttaatatcgaaaccaacttaatgtttatgtaaaaaaaattgcttaattaatttttattaataaatattaataaaagacaaaacgaatttgatgatctcagagttttaaaaagccatgaaaaaacaattaatgattaaattaaaatttctcaatttttattgtttttgccatgcttttttcagtgtggcaaagtgttcctccgtttttgatatatcagagcgttagaggtggtttattacatatttttacatagccacacaaaatgttcaaggtacttagaacccgtcttcgcactaatccagagtctgttcttattgatttcgagctcggttttttatttttgaacttttgaatttattgaaataataaggagccagaagcgcatttaaacatg

SEQ ID NO: 107309 - DNA, 1003 bp, Heterodera glycines
  misc_feature (996)..(996): n is a, c, g, or t
  Promoter: Source sequence=SeqID_19493; Location=409..1411; Strand=+; Gene=SeqID_84212
aacaaatagacaacaacaacaaaataatgacgaaacaatgttggagaatacgggaccggggcgggaattcctggtcctccgaggtcccgattcccggtctcagattttgaaaagctcatgtcccggtgccggtctgttaaatgaattaaaagtgtattttgtttgaagcttatagcaagcagttttatttgacttttttttttaaatttcgcccaaaaatgctttgaaaatcaaagcaaaaaatgtccaacttttaattttttagaaaatctgaattcttagtcaaaatttacattaaccctgtttgtcctgaatttttaaatataaatactttccattcacaagaagataattcataataattaagttaagggtgaaaaatttaaacttttaaccattttatactcaaaaaagctggtcaagataaatgaaatatttccatttttagggggcctacttttaaaaaattaaatcgatccataagagatctatttttcgtgtacatatagaattttatggtggtgttttcgcagggttatttaccaaaaattgcaaaaaatatatatgccgaaatatttacactaacaccaaatattttaagcctgttgatcattcgattagtttatttggcccatttatatttaacttatgataatttaatcgctttcataaattcttatattatttgcgaatgttttttttctgtcatttcattatttattatttatttatttattattcatttatttatttatgcattcactttgctttgttgcatttatcacatcttctcatctcgttgtccaaagattcattccttgaattgatttggccttacaattatttatattccacattcatttattcaacaaacaaagcgactaaatatgtaacctaaaggcctatatttaattcgaaattaattttgattaattatttacatttaattatttaatactaaaaaataattagatgaataattatattacgctttanaaacatg

SEQ ID NO: 107310 - DNA, 108 bp, Heterodera glycines
  Promoter: Source sequence=SeqID_44736; Location=760..867; Strand=-; Gene=SeqID_72177
aaaaaatagaaaatttatttatttattttttttctcccgtaaggaacggctgaatttgcgtcgcccgaggtggtgctcggcaagtacgtcagcttttactcggacatg

SEQ ID NO: 107311 - DNA, 183 bp, Heterodera glycines
  Promoter: Source sequence=SeqID_43873; Location=1..183; Strand=+; Gene=SeqID_71452
tttgatgcaatggttccgttttgactccaaaaatgaaaaacttctaaatggtaaaaaagtgctaattagtgcttaattgtccttccatgctaatactttaatttaatttactaattagcatctgctaattgttctgctgttgtggaggtccccgatgttgatccatcagcattcaaagtgatg

SEQ ID NO: 107312 - DNA, 97 bp, Heterodera glycines
  Promoter: Source sequence=SeqID_25507; Location=1..97; Strand=+; Gene= SeqID_56251
ctatttaaggaataccgtaatgccaatttgctactcttttcattttccctcccgttttattcctcaccataaaagtcgtatgttcaggtaggcaatg

SEQ ID NO: 107313 - DNA, 872 bp, Heterodera glycines
  Promoter: Source sequence=SeqID_10724; Location=333..1204; Strand=-; Gene=SeqID_73971
ccctaaaatttttaaaaaacaccctcctaagaatcgacttataaaatttcagaaaaatacaccccttaaaaatcgaccctaaaattttcaaaaatacactcctaagaaatgaaaaaaatttctcaaaaaattctgttaagagaattttataaaggaaatgaagctcattggataatttttggctaaaacctccccccccccctcccctcatatttaatgcatttttaaattctttttcacttttcatataggctacatgacatttcgccaactgacatctcaccaactttacatctcgccaacatgacgtttcgccaactaatttcgccaactagtcgaaaattgaattttaactatataatgatattaaatttattataaaagtgcttcaagcattgaaatcttcataaaatatataaaatatcaataaaaaaacaataataagaaaatgtttaaaatcaattttcatcggcctcagtttcttcaccactctctgaatttccacggacgtgaagtccctccacaaagctctgcatcacgagcccgagcaggtgcaaggcgtttgtcaatccttcttccgattcaaagtcggcctcgtcaaggatccgcaccacattttgttctttgatgacgtaccgttgtcgtcgttaattcttaagctttgattgatccaaaaatggttggaatgaacaaatatgaaaaaagttaggacataagaaatgatgatggtcactgattggacgtgtaaactggaatagggctgtatttgatattaaaacagctaattttttaatggcaaaatgtcagattttggcttagtaggcgaaatgaatgtttttggctgagttggcgaagtgtcagttggcgagatg

SEQ ID NO: 107314 - DNA, 674 bp, Heterodera glycines
  Promoter: Source sequence=SeqID_31235; Location=1..674; Strand=+; Gene=SeqID_61609
ttttataatgcacaaaatttcgccccgttaagtcctcgtgctacgtttggctctttcgtttggagtggacagtttcagaaacttctttgcctgatttttaacagattttgtattaaaaaatgccaatttggttgatttttcgtcttaaatttaatttaaaattaaggatctgagaccggcggtgccgttaagcgtcgccaagaaaatttttgaaagtttaattgtgatttgttttatgtaattttcgagttgttgatcacgaatctgacatcaaaatttagattattcagaaccccggacccaaactcgaacgaagtcaaaactcaaatcttcgaattccgcatttttatctcaaaacgaaactgaatcttagtccaaaataaaaaagttaaattagggaccacaattgtttgccattaccataaaaaatcatttaaactcgaaaattcggaatcatgacatttttagtggatttttgtctttttcgtccttttatactcacaaatttgtccattgaaattgcgcaactaacagatttttcattggttgaaatggctatttaaaagcgattcttcgtcaattgttgtcattgtcccagaatcatttctttttttttgatgtttcattttttcattcgtgtcaataatttttcagcctccaatttcagccacatg

SEQ ID NO: 107315 - DNA, 297 bp, Heterodera glycines
  Promoter: Source sequence=SeqID_8851; Location=1..297; Strand=+; Gene= SeqID_69427
taaaataataattaaattaaatattactaacattgatactttacgtgaaattacatctctgtaaatatatctatgcattattttctaaattacactcaaaatgcgacctcttatgtcctattcttttttcgaattttttatttttaaaattccaaataatatttttttacttcatttttcaatggtcaccttttcaaagcccttaccttcaaagttattttttcatatttatcataataatgtgttcttttgtcacaggagtggacattttggggcgaaacaagagaagaagacatg

SEQ ID NO: 107316 - DNA, 160 bp, Heterodera glycines
  Promoter: Source sequence=SeqID_22366; Location=403..562; Strand=+; Gene=SeqID_53037
ggtaaattttgtaatttttaatgcgatttgttaacagttgaggaatttaggacccggcggcacctataggcaccgattccccaaaaaattcgaaaagaattcgttataccttgtctaaaattgttgaatttgaataaatattacattggctttaaaaatg

SEQ ID NO: 107317 - DNA, 363 bp, Heterodera glycines
  Promoter: Source sequence=SeqID_23779; Location=586..948; Strand=-; Gene=SeqID_54480
acgcgagccggcgcccgccagcgcactctccaccaaactgatcgggcgatctctgatcaagcagaggggccaaacaagtgggggattttgcgagatttccacgttggatcagttttaggtaggatttacccaagaattcaaatcaggttcgaacctcgggagaaattatttttgtttacaatttaaaaaaaattcggagagaaacgatacgggtggaaacgtaggacatcccttgatccgaattcaaactcatttttgtcgcgggatccgagatcgtcaagacccggattaaggaccaaaacaacccgtttttacaagcaattcccgcatccctaatgtgccaaattgtccgacaaaaaaatg

SEQ ID NO: 107318 - DNA, 101 bp, Heterodera glycines
  Promoter: Source sequence=SeqID_569; Location=4752..4852; Strand=-; Gene=SeqID_56338
ggtttgttcaacatgttgtttccgtccaacagatacacacattattatttttagggggcgtgtttaagttggaattgtttctgccggaggagtatccaatg

SEQ ID NO: 107319 - DNA, 626 bp, Heterodera glycines
  Promoter: Source sequence=SeqID_7777; Location=552..1177; Strand=-; Gene=SeqID_65927
atagcctcccattgggcagctaatttattgaaatggcccacaaaatggccagcagaaagccgggggaatggcgaagtgtaaagacacaaagacaaaagtttaatttcaattattttggccaaatcataatttagcttaaacttagtcaaattaattaatcttggtattgaaaggtagagctctacctatcctctactatagtataattttttttttaatctagtaaacatttacaaaaagttgtaagcaaaaaattccgaaaaatttaggactcactaattccaataccaaatttaattaatttgactaactttaagctaaattatgacgtatttttagcaaataaaataaaataataattaaatttaaatatttttcaatcattgatacttttgtaacttcgtcctagcaccggggtcaggactggacgcaattacgagtgacggaaatttcaaaattcccccggcgaagcctatcggcaccgccgaattaaaagggtcgtttcggcgttggtcgacgtttcggttgccagcccaagtttttgggctataagttttttttgtctgcgttcacaaacggtaataaatgatgcgtttcgggcaaatattcatttaatagctcatatg

SEQ ID NO: 107320 - DNA, 574 bp, Heterodera glycines
  Promoter: Source sequence=SeqID_14850; Location=957..1530; Strand=-; Gene=SeqID_79001
ttgccgcgcacaatttggaccgggaaaagaacggacttttgctttagggaagaaacggtgagtgcaaattgacaaggaataattatcccataattggcggctcattagtgcaaatgcgtcaatgatattgtattttaaaaaataaattctgtaactgaagactgtaaaacttgtaaattttcagaatttgtgaatatatatatactgtaattggtatactgtaggtagttccttctcatacaaatcacacttaaaaattcagatcactttgcaacgtgtatcgcccttcactattagcaccgtacaattaatttgatcatttttacgctgtcttttccccgctggggccacacttcccacttccatgtacatttgagggttcaacattcggaatgaagaaattaaagaacctcattttattttggggaaaattgagagtatgggtaccaaatggcacccaatgaatactatggtatctcgtttaaaaatactgtaaaatcactgacgcattttcacactgacgtatcgtcaccattcacataattagcggaggaagaactttttcgaaaaaatg

SEQ ID NO: 107321 - DNA, 189 bp, Heterodera glycines
  Promoter: Source sequence=SeqID_21452; Location=571..759; Strand=-; Gene=SeqID_52059
aagtttcaccctcattttttttagaacaaactatcaattagggaaaattcgcaaatttttccccattacaattcaaaaaatcgaaattttcgtattttttcgccaaacatggttttgcaggggatacggtttttcaaaaattaaaaaaaaattcgtttaaatttgggaaaaaaacaggtgggcaacatg

SEQ ID NO: 107322 - DNA, 370 bp, Heterodera glycines
  Promoter: Source sequence=SeqID_25682; Location=1..370; Strand=+; Gene=SeqID_56429
cccccccccccccccgccgcccaaccgcacatttcgcctccgaatttgcgcataagcagtttaaaaacagtgtaaagttcaagtctcccaacagttctagggcgagcttaaaatgttttgttattaattctataatggacttcaaaaatgtgcaccaattcaattcgcatttaagcacaattttaaggcccattctgcggatttgctcaaacacatcgaacttaatgtgctgaaaaagtttgtcgctaatctgtgccatccatcgaatgttttgttagacgaattgtctcctccaaatgtccaattttcttgcgaaatccccgatgctccgtacggtcccatttttggtgtgttgcgcaatttctttatg

SEQ ID NO: 107323 - DNA, 379 bp, Heterodera glycines
  Promoter: Source sequence=SeqID_20364; Location=1..379; Strand=+; Gene=SeqID_50883
tggtctcataataaagaagtaaaaaaggggttatgcaattcttttacgcattggctttttgaacctctaacccggattcgaacatttttcgaaaattaaaattcgcgtttcttgcaaaaattgttaaggcattgttcgaattttacaataaaacacaagggattcagatatgaaaacggaaaaacacattggctgcattcaacaagcaatgttagtaaaaaaaaatgagaattttaaattttcaaaagagttcgaatctcagttcagggtacgaaattaaccgaaagaaggccagattcgcgctaagcgcatcggattaatttttgggaccgataatctttaccattgccttaaatagatgctgtcactgctgacaatg

SEQ ID NO: 107324 - DNA, 290 bp, Heterodera glycines
  Promoter: Source sequence=SeqID_15376; Location=1..290; Strand=+; Gene=SeqID_79634
atgaattattaaaatagtttcacattttatatcaaatatcaatttcgacttcaagtacgaaacttgaatgaaatttattctacatatttgcagttgctaaaatttaaaatattcttgttgcgttaaatttatcgagttttttaaatattaaaaataatttgctttaaatgattttgagaaagtaggcaaataaattttgaattattgtaaatatttattttactttttttctaaattttaatttaattaattttctaaatatgtgattattttagttttccttcattatg

SEQ ID NO: 107325 - DNA, 173 bp, Heterodera glycines
  Promoter: Source sequence=SeqID_23447; Location=226..398; Strand=+; Gene=SeqID_54155
tgcccgcgagatgtttgatcccccgccgaaagtgataggtaagtccccaatgccatgagtaatgagcagtccccttgggtttagtttgggcttacggtgagtactcctcgcagatccccgagctcgagaggcagggcgtagtcccgcacgctggtcctccctccgaagaaatg

SEQ ID NO: 107326 - DNA, 1003 bp, Heterodera glycines
  Promoter: Source sequence=SeqID_13534; Location=1929..2931; Strand=+; Gene=SeqID_77436
aaacctattgcgcgacttttttttgaaacccaaacctattgcgcgacttttttcttgcaaacccaaacctattgcaggggggtgcgcgacttttttttggtgcgcgactttatgcaaattattttaattaaatttatttaattttaaattattttaaacgtcttaaaggtcaaagacgttgaatttaaattcatttaaaattctccaaaaattccccgcaccaagcggatccgaaccccaggggggcggccagactgacgcactaaccactcggccacattggcaatggataataaacattaatttgctctcataaagggaaaaattacgtcaccagcggcgggagggggcgagagaagcaacaagcagatgagagtggctgtaattaagaacaagagagacacgctgtgaaactggcgagggctaatgtcatgcgaaaggccgttggcaagaggtcaaaaaaaaaaaaaaaattaaatgaccaaatttcgaatttaaaaaaaaaatgttccaaaatgaggggtttattataaattaatatttttaaataatcaaaaaaaaaaaaaaaagatttatataaatattataaattcttgacatttaaatttaatctaatcgagttttttcatttaagcatatatgctgttttttaaatgtattacatttttttaatacttttaaaaatatgttatttaaaaaaaaatcaaaaaaaaaatccaattcttttttattcttttttgtctcaacggtcaccagacaccaaagggccatctgtcacaacttttgaccaaaaagtgagaagggatggcctaaaataaacacttttgaccaaaaagtgagaagggttggcctaaaataaacacttttttaaggggaaagggtatccgaatgtgtattttgcttttttcgccatttacatccaatccaaacaattaaccctttaatattaaaaaaacattttttaaggaaaaacccaccaaaaaaaatttttgtttacagtatg

SEQ ID NO: 107327 - DNA, 243 bp, Heterodera glycines
  misc_feature (16)..(16): n is a, c, g, or t
  Promoter: Source sequence=SeqID_26434; Location=999..1241; Strand=-; Gene=SeqID_57162
cgtgatgaaacccccnggaggaagtgttcccgaaaatcccgtagattgacgtggacgcctccggctctccgaagcattccctgtttttcactgccaaacccaaattctattctttgctttcggtgaatttgccattcgcttttaattttatttatcccaaaaaaggaaataaacaaacgcacacaaaaacttgtgaatgcattcgacggacatcagacaaaagtgaacgaagttgaaaagatg

SEQ ID NO: 107328 - DNA, 930 bp, Heterodera glycines
  Promoter: Source sequence=SeqID_4859; Location=128..1057; Strand=-; Gene=SeqID_55990
tttggggaccggacgacatttgagcaaaagacacttagaaaaccacggacatttggcaacccgacatttagggacccgacatttggggatttcaataaaataaaaaaaaatttaaaaatttaattctaagccacaaaattagacaaaattacgtctgctttagccagagttaattccattgcaaaaaaaattaattaatattttaaaaattaactctgtttccggacctttcctactgctatcgatttcttatctgctgatgtcaaatattgtctgtaatttgttttcgtaaaattaaaaattgcggaagtgcattaatgacagccatcgttggcatttcaacatttcctgctttttatatgtgttttattatataaaaaagaaaaaagccgtaaaaataaatattcaaattttatttatttaaaatgaattacatttttattataataattacttttattcttttttgttttgtttgtaccaaagaaaatgtgatagaaattgttcagcacaaaacaagtaattttttgaaagttttaattgttgttaataatcatttatcattttaagagccttcccatctctcagttttaattaatggacaaagtaggacaattaaattaaaataaaaaaatatttatatttttatgaacagagtttgactttgacaagtttggtgcgcatgtttccgattatcgtgctgaccgaaatgatttaattgacaaaccaatgttagtaaaatgtttaaataatttcaatcactaattaagggcaattaattttttaattaaatcttcaataaacaaattgaaattgccaccttattaaaattttcttttgaacacaataatgaaaacccataaaatatttaaaaaatttataaaattcaatattcaattttaaacatttaaaagggaattcaattcgatg

SEQ ID NO: 107329 - DNA, 189 bp, Heterodera glycines
  Promoter: Source sequence=SeqID_9994; Location=1357..1545; Strand=-; Gene=SeqID_73043
ttgtttgggtttccgggttgtgccacccgtggttttttttatttatcattatataaacccaaacataattttgtaaatttttccattttggaaaacccaaaatgaaaaaaatatataatgctaattatggtgtaatttgatcatttagaagaacagcgacgaacagaaacagcaaaactcaatgaaatg

SEQ ID NO: 107330 - DNA, 89 bp, Heterodera glycines
  Promoter: Source sequence=SeqID_26674; Location=907..995; Strand=+; Gene=SeqID_57431
agtgatttttaaaagtaaaaaaatagaaaagctttaaggaattaatctcaaaattttatctggtttaatataattttcttcagggcatg

SEQ ID NO: 107331 - DNA, 293 bp, Heterodera glycines
  Promoter: Source sequence=SeqID_8116; Location=1..293; Strand=+; Gene= SeqID_67013
ttcaaaaactaggaacaaaggggtccatctatgccgataggcgccgtctgaaatttttgaaaattttatcaattaattaactgattttgaccaaaaaatgaccaaatgtcacaccttttgacttaattctacaggattaatgtcgatccaatggtgtcgataggcgccgccgggaaatttttttgcaaattctaggtgaaatttgagctgaaaattgaatttattttgattgattttattataaatttattcaaaaattttggcattccgtcttataaaattttcaaagaatg

SEQ ID NO: 107332 - DNA, 62 bp, Heterodera glycines
  Promoter: Source sequence=SeqID_5586; Location=1..62; Strand=+; Gene =SeqID_58560
atcccgaaatgctaaacagaaacaaagcaaagtcagtacaaacggaaacaaatcccgaaatg

SEQ ID NO: 107333 - DNA, 300 bp, Heterodera glycines
  Promoter: Source sequence=SeqID_2146; Location=4482..4781; Strand=+; Gene=SeqID_78075
tgttactaaaatggagcgaaaaagacaaataagccgatttgatgggattttgattaatgagacccatttttgtaatttttggaaaaccacaaattatcaatgctacacgaaaattcgaaaaaaaacaaaaacatttttttttaatatataccgtattttctcgaaaggccccggggggattatttttcaacctcttcagaaaggggggttaattggagacagggccataattagaaaaaatacggtatatttctcaagtactaaatgcggaaattaataaattcaccgtttaacaaaatg

SEQ ID NO: 107334 - DNA, 271 bp, Heterodera glycines
  Promoter: Source sequence=SeqID_35518; Location=1..271; Strand=+; Gene=SeqID_65060
acagaaaactgtgattattattatcacttatcatccactcccccgagattgggagacatatcaacgcaaaacattaattaactattgataatttattgattggtaaatgattttcgagcgtttcttaatgaatttgaacctgcggttttttcaaaacacaaaaaaattttgatgtaatttcgctcattaattattatattttttttcgacagtgcagaaaatgaaacatttaacgacctcggcggaatggaaaagtgacaacgaaaaaatg

SEQ ID NO: 107335 - DNA, 125 bp, Heterodera glycines
  Promoter: Source sequence=SeqID_3446; Location=1..125; Strand=+; Gene= SeqID_84716
agatttatgattccatctagattcatgctgctcccttttccgataatgttgctaacaatcatgcagggatcaatcaacctgctgcgaacaaaccactttttaaagttcccgcgcccccaactatg

SEQ ID NO: 107336 - DNA, 302 bp, Heterodera glycines
  Promoter: Source sequence=SeqID_26608; Location=230..531; Strand=+; Gene=SeqID_57350
ttttctttgaccgatcgttgtggtgaaaaattgggcgttggagtgaagagaaattcatatcagggaacgttgaaatgtggtggaaacgagacggatctgaagtgatggggaagggcagttcccccaattttgccattttaattttcccattttaagatgtgttttctcccttcaaatagcactgtttttgggcgttccattggttttattcaccaattcggtcgtcgctttctcttcccacccattgcccaatgtgaacacgtggccggactcaaaatggacaaaatgcttcagctccaatg

SEQ ID NO: 107337 - DNA, 542 bp, Heterodera glycines
  misc_feature (12)..(13): n is a, c, g, or t
  Promoter: Source sequence=SeqID_41216; Location=1..542; Strand=+; Gene=SeqID_69391
tctagagtcaannattttttggaaaattctcaaatagacgagcatatactaaaaatatttcttaacacttttgtccatgatgacttgaggatttgtgtcataagtgcacaaaaaggtaataaattttgaaattcaaaaaagcaaacactttttatcaacgtaattttttgtgcttatttcattttgcatctgtccaaacaatccacttcattgctcatcatcactttcgcttaagtgagcaaacaaagtagtggaaaaatttggaaaatttaggcaattcactcaaaacgaagagaaatcatttatttgccaaaattttaaaatttcttcaaaagctgaaataacaaaaaaactatgtgatttagttgaatatgacagaatttatgggcaaaaaaaaatcatgaatagtttagcataaaatactaaacccatttcacactttgactcattaaagaaaaatttcgataaaaacacaattaactcataatttgtccataattgcatcataaataatcataatttataggctaacaattgaaatg

SEQ ID NO: 107338 - DNA, 113 bp, Heterodera glycines
  Promoter: Source sequence=SeqID_43632; Location=338..450; Strand=+; Gene=SeqID_71263
aaaataggcggaaacgaaacaagaccagtttaatttgtccaaaaaatattgattggaatgataaagtttagacgacccatttttcaaaatttggtaaatttcttaatgaaatg

SEQ ID NO: 107339 - DNA, 255 bp, Heterodera glycines
  Promoter: Source sequence=SeqID_840; Location=1..255; Strand=+; Gene =SeqID_62545
caatcagacaaaataaaataacaaaagaattttgctatcccccccccggtatgcaaagacaaacatattattaaacgacgcccctcttattgtggtgaaaaatgtaaatgtccagagggattcaaattatgtagctttgcatcttacaataaaatcaaaaatgaatccgttgaaaaaattaattaccaaaacattatttcgttcttcaaaccaaatatctgcgcactaaataaaactgaaaactgcccaatcatg

SEQ ID NO: 107340 - DNA, 247 bp, Heterodera glycines
  Promoter: Source sequence=SeqID_39457; Location=1..247; Strand=+; Gene=SeqID_68021
ttgttttttttttgtttgaaaaaattgtgtgtccacccattttgaccctttgtggatgggggcgtgcggtctaacccaccccccccccctatcaaagaaatttttttaacgaagcggggggtggggggggactgggtataaaaatgcatcagccattattgatttattttttttagaaaaatttctaaattttttgcctttcccaacagcaggtggttcggctggtgcatggagtcagcaaatcatg

SEQ ID NO: 107341 - DNA, 102 bp, Heterodera glycines
  Promoter: Source sequence=SeqID_1274; Location=4609..4710; Strand=-; Gene=SeqID_71245
agtgcgttttgctaatatttgattttttaaattaattaaataattggttaatttttcaatttaaatgcctttattcctctttttttgagcttcccatcaatg

SEQ ID NO: 107342 - DNA, 182 bp, Heterodera glycines
  Promoter: Source sequence=SeqID_17141; Location=1625..1806; Strand=-; Gene=SeqID_81580
tcaaatgacctccaattataatttaaaaaaaaacatttcttttggggaggaaatacgaaagacattaaaaatggaactttaaaaaagggagaaatacgtaaatagaaaattgtaaaaaaaatgaatcagaaatattttaggcgtctttccatgcttaaaatcataagggcaaacaaaaaatg

SEQ ID NO: 107343 - DNA, 686 bp, Heterodera glycines
  Promoter: Source sequence=SeqID_2816; Location=612..1297; Strand=-; Gene=SeqID_81764
tcgtcgtttaataaattactaaagcttgctattcctgtattttgtgtacgtagaaatattgtaaagacatgtcttctagtttttggggcagtcattggaaatggaaagttaaaaactgataagtgggttttctaaaatgttgactaagaatttgaggttctagtcggttttataaaaaacaatcaaaatttgttttgcttgttaagtttatacgggcgagtaaaaataagcgggcaaagtgttagaaaaagttggaatggtgaaatgctcagatttttttcttttatgtacgcaattttttttttatgaatttcgaaatcaatgaaatcgttttaaaaaataatcatttttgaagtatttctttttttacttatagcatttttaaaattgtaaaaatgatttattatcggaatttgaactaagaaagaaggtacagagtggagaaaaaatgagtaaaataaaaggatgagggggagagggggcggagggaatgagcggtggggaaaggagacgacaatttgtttaacggcgggggatgagaaaaaatttgctgctcaccggccaataaatgcaaaaatagcgattagattggaacggagagatatgtatttatgtgtgttgggggggaagaggcaaaatgtttccatctcccgttgttccttcggatggttttgcagtggaaaatg

SEQ ID NO: 107344 - DNA, 848 bp, Heterodera glycines
  Promoter: Source sequence=SeqID_5827; Location=1657..2504; Strand=+; Gene=SeqID_59355
aaaaaattgcgtttttatttcgttttcttgagtgtaaaatgctctaaatttcagtgaaaattttgttaaaaattgtcaacatttctatttttcctccggcggcgtctatcggcaccgccgggccttccaaaacttattttttcataaaaattgaccaaaaattgtcatattttgaataaaatttttcaaaatgctgattttttgtcggccaaatgctgattttgaaaattttcagttggcagccctggtttttccgctaataaaatattgttttaagtcgatttttcatatttttattgcgtttccttcacgctactattagttttagaaaaatcttatttttggggtccgaattttagtttttgagccattttgtcttattttgaaaaaaacatggaaactctgttttatttacctgctgaattttccctctaaccctccccctgcggtctaaatttttttgttgtgtatcgattatttttaatgctttcgatgtgaactgtctgacttctcgctgtctgcactcctacacaaaaacaaaaagaaacaaatattgctgataatttcgcaacttttaaaaaaaatcattgttttgtttttcatttttttgaccggcaccaccggggaaaaaactcataaaaatagagggaaaaattggcatagatccataaatttggcaaatacctttttaaacaatatggaagtttcagcaaatttttggccaacgatttttcaaaatttgaaaagactttcaaaaaatatcaaaaattatggtaaaactaaaattcgtttttttttaatttttatttttatcccttttataaatgcgcctcatttcagagctaatg

SEQ ID NO: 107345 - DNA, 327 bp, Heterodera glycines
  Promoter: Source sequence=SeqID_25934; Location=1..327; Strand=+; Gene=SeqID_56697
gaaacttaattgaccgaaacacggtgagatttgacgagaaacccaaaaaacgcacgcctccccaatttagtcattgtggagtggttggctgaccaaggggccccaacacaaatttttttcgccggtgacacgggcctttgtgccgacgaagaagcgatcggaaaaccgaagctgagtccatgcaatgttgaagcgaaataccacgacggaacaaaatgcacccttcttggaaaaggggaagctgagttcgaattcggagggataatccgaaaagggcaattttacgtctccaagagagggtcattgaatttgttcggcatcgaaatg

SEQ ID NO: 107346 - DNA, 513 bp, Heterodera glycines
  Promoter: Source sequence=SeqID_2554; Location=1789..2301; Strand=+; Gene=SeqID_80396
aagcttccggcacaaactctaactcatttttcgggaaaattttcccaatggcccagtttttgggacgattttaaatcctcagtacataatgatccgaacatggaaaatatacaaaaacttaagtaccttcgtggactgttacatgatgagccttatcgaattgtatccccatacccccttattaataaaaattacccaataataataaaattgctgaaatcacgttacggtaaccccgaattaatcagagaaaatcttcacagtgaattacgtaacttgaaaaggcctattgaatccacgattgaattaagaaaatttattttactaattgatcgaataattttgcaattaaaatcccaaggcgaagacataaatcatccccaaattaagcagtctatagaaacaaaacttccatataatttaagacttaaattgagagaaaaatttaaaatttattcaacaaagcagttaatggactttttaaatgctcacacacaagcacgtgaagacatg

SEQ ID NO: 107347 - DNA, 160 bp, Heterodera glycines
  Promoter: Source sequence=SeqID_9266; Location=321..480; Strand=+; Gene=SeqID_70803
actcataaatcagcaaaatgatgaatttggatgtaattgcagtttttacatggacttttaaacctaggggtatcgactttttatagtgcctgttttgctagccttgttttacgtggtaatgaaaatggaacgatttggataaaattggaatttatacatg

SEQ ID NO: 107348 - DNA, 955 bp, Heterodera glycines
  misc_feature (12)..(12): n is a, c, g, or t
  misc_feature (36)..(36): n is a, c, g, or t
  misc_feature (53)..(53): n is a, c, g, or t
  Promoter: Source sequence=SeqID_15883; Location=1028..1982; Strand=-; Gene=SeqID_80217
ttggtcattggncagtttaatgttcaaattggcacnagtgtctgtccacaggnctgtaaagtaaattcggattttgaggcataagcctttttttgcgcactaatttcaatatattaagcataaataacacacttttcacttggtttgaagcttttaggttgagttttattatgtcttttttttgcccttttcgggatttcgtgccttagatgccttttttggcattttttcgtgccttttttggcgtttttccgaaaaaattccagtaaaaatgcgataaaatcgggaaaatacaccccctaagaaatgcctgaaaaaatttcagaaatacaccccctaagaattgaaaattcttctcaaaaattgattgccaaaatttcattttttttttttataaaaattttagatttacaaattttccctattcgaaaaaattataaaatatttaatatttaataatcatttaaatgaccaaaattaaatttttttttttttttgattcagtttacatgatttatttataaaaaatttttgggcctcggaattccgattccatgtatgagtcctggttttataaaacaaaaaaatatatatctttattataattactttactattttttattatttcgcttttaatgggccttaaaatctttcttttccataaattcaataaaaaaagaatcaattgctcaattccgggcctaaaatttccttttacataaaatgaaacaaagaaacttttttaatattttcagtaggcttacgtcataatagctttatctttacgtggtaagaaaaaagactttgcctctataaatagccgtgccatcaacgaatggcacacatttcgtcaaaaaataaaattcaattcccatcacaaaaagaaaaaaatccatcaattttacaattcattttgcccatctatctttttgaaacaaatttccaccattatg

SEQ ID NO: 107349 - DNA, 448 bp, Heterodera glycines
  Promoter: Source sequence=SeqID_6366; Location=902..1349; Strand=+; Gene=SeqID_61275
atttcgacagtgaccgatttcgacagtgaactattttcatttattttactgttttccgacatttccgacagtggctgattacgacagtgaccgatttcgacaatgaacaaaattatatttgtgtattagtcatttttatttaaaaaagtcactatttaatgggtgaaatttatatatgatgtagtaaaataaagcatttttcttttattttcaatgaggtaaaactcagttgtactgtactttggccgtaggccgttgatagtggaagggccggtcgttcactttatattgggaggtcaattttcttggaggtcaatttgataagagaattttgagaggaattgttttggtgttcccgaatgctgatggtcattctcgacttgtcattgctggtgttcatcatttgctgttccctctattcgtttttttccgaattcattgaccaatg

SEQ ID NO: 107350 - DNA, 666 bp, Heterodera glycines
  Promoter: Source sequence=SeqID_1745; Location=2971..3636; Strand=-; Gene=SeqID_75654
taattcgagaatgaatgaagctaaaaagaaaatttggatgaaatttacgcgattattgaaatattaacgagataaaaatgaatgaattttctaacaaagtattttgatatgaatgctaatgcaagaagcaggacatccctaataaatctggcagcgtttcagccattttcagttttttccaatataatttttttatatttacatatcgaggattttcaattcctcaaaattcaggcaaatctgaaaagcgaaaatgcattttttttaccattatttgaaatctatacataatgccaatttaaatgacaaattgcgaatattttgatttaaatgaatcagagttggcttggtttgctgccgactcggcaatcggcaaatacctaggtgcactgtcacaactttcataaatacactttcctttttttaattgtttaagtttaaggatataataaatcttaaaagttaatgttttcctcaatgaattctgaacggaagagcattcttgagcggaagagtatgatgcctcctccgagtcgtactccgctcacaaaccgccagcctttccacccgactcccaaccctcgttccattcggtaaacttcgtttgtttccaaatgttcctttaatggcaaatcagggcttatattgtaaaaatgctttaagatg

SEQ ID NO: 107351 - DNA, 182 bp, Heterodera glycines
  Promoter: Source sequence=SeqID_4594; Location=1031..1212; Strand=-; Gene=SeqID_55022
cccccactttcggacccatgtgccacacgcgcggtaaaaccgcgcgccgcctcccccctcactctcgcacgcacccctccctcccgcacgaacccgtgccacaggcacgccttcgtgcggtaaacccgcgcgcggcggcacgcctcaaaggccagctgtcacttcaaaagcaattaatcatg

SEQ ID NO: 107352 - DNA, 399 bp, Heterodera glycines
  Promoter: Source sequence=SeqID_40424; Location=430..828; Strand=-; Gene=SeqID_68765
agcacacatttcagataagcttcctatcattatttcttagaaacaactaataatctgttgaacagttatttcaaaataaattcgaatatattagcttattatgcatcttcagtgtgcattctaaaataaaatcattttttgttctaattttatgatttatttgttttctgttgactaaattgtcagttcttatagcaaatattaatttatatttgcgtagcttcaaatgagcattctgccttgaatttcgaagggaagtgaattttttataataaattgatagagagcaaaatgcacaattgtataatattcaaaaatttatctatacatttgttgaacgtttctaaacccgatcaaattttttaaacctttatatgaaaacatttattgcaggaaatg

SEQ ID NO: 107353 - DNA, 66 bp, Heterodera glycines
  Promoter: Source sequence=SeqID_16852; Location=829..894; Strand=-; Gene=SeqID_81275
tgtttctataaaagacatcattccatcggggattttcattatttctattaacgcagcaacacaatg

SEQ ID NO: 107354 - DNA, 382 bp, Heterodera glycines
  misc_feature (64)..(64): n is a, c, g, or t
  misc_feature (98)..(99): n is a, c, g, or t
  misc_feature (101)..(101): n is a, c, g, or t
  misc_feature (105)..(105): n is a, c, g, or t
  misc_feature (111)..(111): n is a, c, g, or t
  misc_feature (113)..(113): n is a, c, g, or t
  misc_feature (118)..(118): n is a, c, g, or t
  misc_feature (124)..(124): n is a, c, g, or t
  misc_feature (147)..(147): n is a, c, g, or t
  misc_feature (149)..(149): n is a, c, g, or t
  misc_feature (161)..(161): n is a, c, g, or t
  misc_feature (167)..(167): n is a, c, g, or t
  misc_feature (170)..(170): n is a, c, g, or t
  misc_feature (176)..(176): n is a, c, g, or t
  misc_feature (184)..(184): n is a, c, g, or t
  misc_feature (188)..(188): n is a, c, g, or t
  misc_feature (195)..(195): n is a, c, g, or t
  misc_feature (202)..(202): n is a, c, g, or t
  misc_feature (204)..(204): n is a, c, g, or t
  misc_feature (212)..(212): n is a, c, g, or t
  misc_feature (214)..(214): n is a, c, g, or t
  misc_feature (217)..(218): n is a, c, g, or t
  misc_feature (221)..(221): n is a, c, g, or t
  misc_feature (243)..(243): n is a, c, g, or t
  misc_feature (245)..(247): n is a, c, g, or t
  misc_feature (249)..(249): n is a, c, g, or t
  misc_feature (267)..(267): n is a, c, g, or t
  misc_feature (270)..(270): n is a, c, g, or t
  misc_feature (272)..(273): n is a, c, g, or t
  misc_feature (278)..(278): n is a, c, g, or t
  misc_feature (298)..(298): n is a, c, g, or t
  misc_feature (300)..(301): n is a, c, g, or t
  misc_feature (308)..(308): n is a, c, g, or t
  misc_feature (312)..(312): n is a, c, g, or t
  misc_feature (316)..(316): n is a, c, g, or t
  misc_feature (318)..(318): n is a, c, g, or t
  Promoter: Source sequence=SeqID_10641; Location=1..382; Strand=+; Gene=SeqID_73880
aaaaatgaaaatattttttattagttttatttttcccctcccccagcttgattatttggaaggncataaatccggatttcttctaagggtaaaaaatnntnaagnaatatnanttgtnaaaagntatgaaaaaaaggaaataaagananttgatgtattanatgganaanttatgnataaaggnatanagatttntatatgnantttgaaangntanntgnataagataaaaattgtttttgngnnnanaaaagataatgttgattnatnanntaagnttgaagtggaaaaatggttntnnaaaaagntgantaanantatttatataattggaaatggatcaattggagaaaatacattcagactaatgaaaagaataatg

SEQ ID NO: 107355 - DNA, 118 bp, Heterodera glycines
  Promoter: Source sequence=SeqID_6090; Location=841..958; Strand=-; Gene=SeqID_60300
atcgttcgcagggcttccaaatgacccattcgcttggcggtggcactggctcgggcatgggaacgctgctgatctccaaaattcgcgaggaatatccggaccgaatcatggccacatg

SEQ ID NO: 107356 - DNA, 637 bp, Heterodera glycines
  Promoter: Source sequence=SeqID_4025; Location=3181..3817; Strand=-; Gene=SeqID_52857
actttgtgaggaagaacgccgactccactctgtcgtggtcttgaacctgccggaaagtgaagaaactgtgccctctgctcgtgtcaactccgattttgtggatgctcaatcaatgctcgacacctgtgagatcgaatgccggccatgtcaggtttaccgaatgggaaagaagtccgaccgcccccgtctcattaaaatcgaattccccaccaaaaaacacgcccaaaattttctgcggaacaagacaaaactcaaaaatcacaataaatttaacaatgtcttggtccgcccatctctatccaaacagcaactcgctgaacgttcccgacttattggcatttgcaaaaatgaccatatgagtaatcccaattcgaattctgtcatttatgccggccatgttatgtttgcctctgacattccccgttacaaatccaaccccgactcttttaaatgtatttgtcatgtgcataatgttgatgactcttaatgtgtaattggtggccactgtaacacgaaatctcttaaaacgcaagctcttttacaaactaaatataggaaatttgaacaccccatagaaaattcgaaaactttactaaataaaaaacaaaattttttatactcaacatttatcaatatg

SEQ ID NO: 107357 - DNA, 147 bp, Heterodera glycines
  Promoter: Source sequence=SeqID_15655; Location=876..1022; Strand=+; Gene=SeqID_79959
ttttttcaggagaaattggcaagaattattataaaataaaatattgaagggcaatttttttacatttcgctttaaaattaaaatttatttttttaaataaatcaatatctaacaaatattaatttgaaggtctaatgaccgtaaatg

SEQ ID NO: 107358 - DNA, 1003 bp, Heterodera glycines
  misc_feature (519)..(519): n is a, c, g, or t
  misc_feature (552)..(552): n is a, c, g, or t
  misc_feature (731)..(731): n is a, c, g, or t
  misc_feature (794)..(794): n is a, c, g, or t
  Promoter: Source sequence=SeqID_7130; Location=2364..3366; Strand=-; Gene=SeqID_63925
tacctatattcttggtgattaaagctaaaagtcccaggattttataatgcaagaaaagagctggtattaaaaagaaataacgaataaaaaacaagaaattcaactttttcgtgaataattttttgtctattccatttaggtaaaaaagttatacaaaaacttctataaaccttaagttctcgtttaatcctaagcatataggtattgaccatttaaaaaatgtaaatttgactcataaaaaatcggctggactcataacgtgaaagcaaatccaaaaatccccctgtgtcaaaattatttttccaattgtaacaaatttaaaaccttggacgtgaagcaattcgtgaatgaatccattcattgccttcaaaaaagtctgaaccatccaaaaaaagaacagccgacgagcaggttctctcaaaatttgacttgtggacaaaaaaacaccctgacaatgatttaaagaaaattagcgtaattataatttaattataatatattgcaaaccataaatcgtanagcaacgcacacgtccccgcccccgccgcttgngcaaaatacgcttttattgcgcttcgctttttttccaaaaaataattaatacttattaccctaaaaatttaaattcatttggcatttataaattatacaaaatgaatttgaaaagtaaaataaatcatttaaaaattataattcatcgatccaaaaaatatatgcataattaattattntttatggctactaatttttctccatttctctaacacaatctgtctttctcttttttccatttnattctccatactactctctctctctcgcttcactctattacttctcactctctctcctctttctctctcgcctctctctctttctatctctctcttctctctctctatctctttctctctctctcgctatctctctctctcacttttttctcccgaaatcatccaataggcttgggctttggggggggggggggttagagggaacaatg

SEQ ID NO: 107359 - DNA, 353 bp, Heterodera glycines
  Promoter: Source sequence=SeqID_12499; Location=2121..2473; Strand=-; Gene=SeqID_76135
tggtttgttacaaaatgcgtcggtagaaaatatttttaagtgatcgtattttaaaattgggtttttgtaaaaagaaataaatatttttattaagcattatgcgaaaataaatattgttggtttctcaccgtataattttaatgtataattgaacctattaaaagttaaaaaaatttaaacatttttataattttccagcatttatggggattggtagtaattcgatgaatcgtaatttaagtactacactaacgatttttcttatttaacattttaaattgatagattttccactggcgcactttcagcctcgcatattaaaatttaattttaatttttttaagccaaaaatg

SEQ ID NO: 107360 - DNA, 406 bp, Heterodera glycines
  Promoter: Source sequence=SeqID_480; Location=5698..6103; Strand=-; Gene=SeqID_53919
ttttcaatacttaagatacttgcatcctaaaatctatttaattttttaagctgttcatatcaacatttccatttcatgatattttatttaaaggatatcatttctgacaaaatttagaatttaaatctggcaaataatatgaaatgtcgacaatcgtgaagaatagggtcccatgttttcttttgttatttttggataacaacttggagttttcaaaggacgctaatctcgaatctgacattagattggcgatccgttttaactttttttaaaacgacaccgacggtgactcatcgtgggatcgatgggtccgatccaattgtttacttactttgctcttgtttacattacaatcttctgtgtgcttctttaagcattttaagtttgcattttgattttaaaaatg

SEQ ID NO: 107361 - DNA, 578 bp, Heterodera glycines
  misc_feature (8)..(9): n is a, c, g, or t
  misc_feature (23)..(23): n is a, c, g, or t
  misc_feature (75)..(75): n is a, c, g, or t
  misc_feature (101)..(101): n is a, c, g, or t
  Promoter: Source sequence=SeqID_15646; Location=1..578; Strand=+; Gene=SeqID_79941
ttttatannttaatgctctcaanttatccattccattcattggctaccactttttccaaccgattggtcgtcggncccaaaaaaaaaaaagaaaaattatngtacggaatattaaacgaaaattgtccaattggtccattcccatccatcggaaatggcattccatcagttgttttaacgatgattcggcttcctatttttcgctttttccctttttttcatcgcttttgttcaatttgccaacgcttttcccagcgattggacaaaaattgtgcttgggaagtgtaaatttgtggtgatttggcgcccccttcagctgctttcccattttttctactccttttttgtctgtccataaataggcaccgaaaagccacccaaatcacacattttccattcaaatcacagctaatccatcctttcattcaatcatcaatcagttgaaccttccttgcacccttcatccatcccatcactctgcccttcatccaatcaaaaacggtaaattaaagaattagtataaaatgtaatttttaaaaaattaatttaaaaaaagcaaaaaagaacttcacaaaatg

SEQ ID NO: 107362 - DNA, 273 bp, Heterodera glycines
  Promoter: Source sequence=SeqID_10370; Location=3857..4129; Strand=+; Gene=SeqID_73557
attgtacgcgttcggagcacactgaagaaatggaagaagccaaaaattgacaccccgcgggtaagaacatcaatttaaaagatatataaataaattatcaaatgaaatttcccaatgcaatataaaaattatcatttttcaaaaaagtgtcaaaactttttttggcgacccgatcatttcggcgttcgtttttcgccgaccgttttttgtgactcattttttgtgttcgttttttcggcgcccgtttttggcgcacgagtaaaactatagatg

SEQ ID NO: 107363 - DNA, 161 bp, Heterodera glycines
  Promoter: Source sequence=SeqID_13610; Location=916..1076; Strand=-; Gene=SeqID_77517
aacgtaaaatattttaaaacttaatttaaaatcatatttatgaataaaatagatggatttgtttcaactagtgaccatgagtaaaagtgcgcccagcagcagaacgtatttttgtgttttgaattaaaattaaaaaaatacctttcttcagaatagccatg

SEQ ID NO: 107364 - DNA, 94 bp, Heterodera glycines
  Promoter: Source sequence=SeqID_7601; Location=4597..4690; Strand=-; Gene=SeqID_65366
agaaaagtgcgcattgtgcaccaatactacttactaaggaagaaataaaattggggaatgtgcaacaattagtgagagagagtagttgaaaatg

SEQ ID NO: 107365 - DNA, 64 bp, Heterodera glycines
  Promoter: Source sequence=SeqID_23184; Location=953..1016; Strand=-; Gene=SeqID_53890
ataatttttcaaattttgtaggctaatataggacatttacagctttcgaatgataccaacaatg

SEQ ID NO: 107366 - DNA, 490 bp, Heterodera glycines
  Promoter: Source sequence=SeqID_4199; Location=2916..3405; Strand=+; Gene=SeqID_53568
ttgaatgtgcttttaatttaattctattaaaaactatttaaatataaacaaatacatattttggcaacaaatattaattgcattggacatttagtgacttatttgtacaaagtcgtaaaaagacaaatttatgaattcatttcgaataaatcacgggtggaccctgataaattttggaaaattttttgtcaaaaatgcaaaatcaaaaaaataaaataaaaaataaaagaattttttgtcaggtgtaaaaatggaaaaaccttagaaaatgtggaaaacatttttagaaagtgcaaatgctacgaccccatgatcaatacatatttttatgtcagaaatcgttgtttattagatgaatttgtttacatgtgtaaaacaacaaagatgtgtaaacaaataaatatttgaataaaaagctaaggaaaattactaataattttatgaaaaataatttattttaatgaaaataaataaaatttggagtgccatg

SEQ ID NO: 107367 - DNA, 401 bp, Heterodera glycines
  Promoter: Source sequence=SeqID_2113; Location=843..1243; Strand=+; Gene=SeqID_77919
ggcaatggcacggcgaagggaagcgaacggagcggagagaatggggaaagggcgcgaaagcatcgcaaagcttaatggggcaattgacgactatttatttcaggtggagacgaacgaaaatagggaaaagcatatgggaaaagaaagaggagaaaatggaaaagcatagggaaaaagaaaaagaggaaaaagaaacaaacggggagagggaaaaaaggaggaaaagggaaaaaatattgaaaaaaggaaaaagaaaaccatatggagaaaaagaaaagggataaaagaaaggaaaaagcatagggaaaaagaaaaataaaaaggagggaaaaaacattgtagaaaagaatttcatttcaaagagtgacattttactgagtgccaatcaaacgagcgaaatg

SEQ ID NO: 107368 - DNA, 299 bp, Heterodera glycines
  Promoter: Source sequence=SeqID_13124; Location=272..570; Strand=+; Gene=SeqID_76921
tcggcgagagggaaactccgtgttctatgcaatttgcgatgaaagcactgcacaaatggcatcaacttcgaggtgtaaccgaatggaaaatgggggagacaaagcaattggaaaaggaaatttaaaaccaatcgaactcggtctgttcagaaaaaggaattttatattgttgcaattgttgggcattacccgtaaaatttttatttggttgaattacgaacagttaaaaaatttgggccctgaaatgtttttgcttccacaattttggtctttgacaaaaaaaagtaactgtaccaatg

SEQ ID NO: 107369 - DNA, 72 bp, Heterodera glycines
  Promoter: Source sequence=SeqID_27815; Location=1086..1157; Strand=-; Gene=SeqID_58480
ttctgctgatcagctaattttagtgatcattcaaattttatgtcgtttccgatcattctaaaataaaaaatg

SEQ ID NO: 107370 - DNA, 394 bp, Heterodera glycines
  Promoter: Source sequence=SeqID_20660; Location=1819..2212; Strand=-; Gene=SeqID_51218
tttttgacgatttagaaaaaaaaaataagggcggtcaaaaaaaaaaaattttttttttctaaccgaccccacttcaaaaatttcggcggtgtgtattgcaattttttatgtctgtgaaattatgtgttcgttcagtctttccaaaatgggcgttggaaattgagcggagacggaacagagaaatgaccactggcgcaacacaaactgatcacctcgtcggctcaacggtgttgtgagatttgcttatgacatacacctgttgtggtgtttgaatttggcccactgcttctgctcattcaatttcaaccaatgccgaaccccggaatttattatttttcccttgaaaaatttttttaaaaattctcaaaatttgaaattttcagaaaaaaaaatg

SEQ ID NO: 107371 - DNA, 312 bp, Heterodera glycines
  Promoter: Source sequence=SeqID_18914; Location=2134..2445; Strand=-; Gene=SeqID_83631
attataactagggctgggatttttatgttttaacattttttttttgcggcttagttatggcgagcgaagcccaaaaatagcattttctccgaacaatttttgatttagagcgagttataaaaacataaaaacacatattttggcgttttggcacataaaaacatatggcacatatttcggggttttggcacatattttggcatttttgagaaaaatcgtaaaaaaaatacaagaaaatctgaaaatgcaccctaaaaattgactactttacgtttcttaagcatttagaaaatttctttatatatttaaatg

SEQ ID NO: 107372 - DNA, 1003 bp, Heterodera glycines
  Promoter: Source sequence=SeqID_11137; Location=59..1061; Strand=+; Gene=SeqID_74484
tgcccgtttgtcctgccgtgcttgttcgtcctgttgtgcccgtttgacttgttcgtcctgttgtgcccgtttgacttgcttgtccttcactgtgctgcctgtttggtctgcacctgttcgttcaactgtgctgcctgttcggtctgcacctgtgccacgtcaaaatcgccgctccccaactgctcgtcatccggaagtataagggtcaccaagcccatacaaaatcaagggttgacaaacccaattaaaaaaaacaaacacacacacacacacggatcgccaaacccaatcaaaaaaaccgaaaaaggacaccataaaaagccaaacataattaaaagtcataataaaccctacaacaaacccatcactaatttaaataattaagtggacagagcgactcctaattcaattactccgacgaccaaagccaacacgaaaaagaaacaagtggcgaaaagcactacactgactgaacttataaaattaaaaacacaaacggaatacaaattaacaaaacttcgcccgaaacatacagagaatatactgaaagaattttacaaaaaaaaggagcaaataattaacaaaaacaaaaaaattctgtgattatatatattttttttaaatttcgtaacaattgttaattctgtgatcattaaaattataataatatttattaacttgtgataaatacctaattaaaattctcatttttctgattatccactaaataaccataaaaggatacttagttaattattttaaaatacaaactatgtccggtacgcttcgtagcaaaatacccctccttaatcgcgtattaaaaagggaaatagaaacgatcaaaacaaaaattgaggaaaacaaattcgaatatgatcaaaataatcccggagaatgcatgcggatattcaataaaacaaaggaaattatccaaaaaatagagccaaattttgaaaaattaaaagccttaaataaaaggtggcaaaatttaatgagaaaaatg

SEQ ID NO: 107373 - DNA, 1003 bp, Heterodera glycines
  Promoter: Source sequence=SeqID_17736; Location=1646..2648; Strand=-; Gene=SeqID_82275
tgaatccgaagacttaaatcagacatatctttgctagttgagcttgtatttcttcaactccatgcatgaagttggagcagtaaaggccatattcggtttcagagtggcagatttacctaacttaattgttttcagaattttcatgatcatttaaaaaaaattttgttacttcgtggtcttacaaagcggtttttggagcccatttttagcctcgcctctccaatatccaatttgtaggaattaaaatttttccaattatttctatagtcctaactttgctctatttaatcactatttcaggatttttttttaattattggtatttaaattgggggacaacaataaattacccatttattttgtttcaatcaaaaaattcattttaacttgtaaatgtgagattatagccttaaactcgttgtcgcgagcccaatcacgtccagcatgcagattgccttgtctctctgtccttctttcaattttaaatttgtataattttcaaattctcatataaattaatatgttgtttgtcttttatgaatttaacaaatttaatagattaataattgcattatttataaacaattcatataaatatattaaaatttaacttttaatttctaatatattaattcttgacagataaaatttccatttgggttatttttaattttaaatgcttataaaaaattccatattaaaaataattaatttttaattcggccaaaaaaggctaatagagtttatttttaattgaattttattgcttctgacaaaacggtgataagtttgtcttatttactttgtacattgaatatggaagtgattttttcgaaaatcttttctttatttctccacccgcaattacaaatgtcaatggaaatatgttcacttgttatcggtaaattttgatctttttttaaattattgtaggaaagttccttcatttttataaaaaaatgtaaataaattcactcattttatagaaattgcttgggacatg

SEQ ID NO: 107374 - DNA, 732 bp, Heterodera glycines
  Promoter: Source sequence=SeqID_27238; Location=540..1271; Strand=-; Gene=SeqID_57929
ttttgcagcaaaaaaatggctaatttaatctttaaaaaaccaattaagaaaatttgagatattttcatttactaaatattaacaaaataaggacaaatgctagagaaataaggacacttgacttgacagcccttggaattaaataatcggtctcacagttacagttcaggacagggcaggagcgcagcaggacagcttatttgtttttttttaaatccattgtggcgttatgttttactgtctattatttttgttttgtttctttttgcttccaaatttgcgagccactaattgtgtaagctcctgttctcagcaaacgcgaaaatacattaaaatggaatttcagagctctatgcattggtacgaacgttgtgaattttcaaaatttggaattttctactttcgagttcttgtctggcattctaaattggtcaaaatgaatggcattttcgagatcaacgtccctaaaactccaataacatgttttcaaaacctttttttccaaaaaggggtggggaccatctgcagtattaccagatcagaaatcctctaacgtcgtctaaaatctgtgaaaattggataaaaaattcctatgctttttttaatgcgcgattcgcgtactgctaccgcggcacccttaaccttcactaaatgaacggatggatgaaatggataatatattcctttttttctaaaattcatatttaacagaaatttgttttttgtcaaatg

SEQ ID NO: 107375 - DNA, 147 bp, Heterodera glycines
  Promoter: Source sequence=SeqID_4119; Location=3827..3973; Strand=-; Gene=SeqID_53254
tgcaggtcaacaatttcagttcgttggcagatcaaagacctgctttttgacaaaacgctcagctggcgccaaaaacatgaggccattttcgcgctgacccaatcagtcccgccccaaaagcggcgctttgcgcccatccaacaaatg

SEQ ID NO: 107376 - DNA, 391 bp, Heterodera glycines
  Promoter: Source sequence=SeqID_13869; Location=1576..1966; Strand=+; Gene=SeqID_77813
ggtgaaattaattaatataatatttaaaaattaagctaattaatgtcttttaaaagagaaatcgaattttaaatgaatgaaacaaaaccaaaaacaattcgtcggattgaatttatatatttttaatgattattaattaataacatcatcaaataacaaaatttaactaatgatcgaaatacattaatgaattttagcaggaaatgaagaaaacaaattgcgtaatattctcgttgattggtgtctgaccacttttcccaatggaaatattaaaatgtagaaagaacagaaaaacaaaaaagagataaattatcacagtgtaaatgttatatatttattttattgtctgtataaaatttattttgaaatttttattgttttcagatgaatg

SEQ ID NO: 107377 - DNA, 236 bp, Heterodera glycines
  Promoter: Source sequence=SeqID_32905; Location=497..732; Strand=+; Gene=SeqID_63131
agaaattttctatgcaacaaacgctctcgaacatgaaacgaagtgcggtgcgccatggccattttatttttcaaataatttttatatttaatagatattccagaaaaatggctatctctttttttgagaaattttctatgcaacaaacgctctcgaacatgaaacgaagtgcggtgcgccatggccattttatttttcaaataatttttatatttaatagatattccagaaaaatg

SEQ ID NO: 107378 - DNA, 363 bp, Heterodera glycines
  Promoter: Source sequence=SeqID_37767; Location=1232..1594; Strand=-; Gene=SeqID_66759
taaatggattgcgaaactcttccggatcaacttctctttttaaaaatgtttattaatgatcagcagataatgaaattatgtgtgatcatactgtgtttttaaagcagtttcggactaaaaattaatttgctgttcaaagagtgaattacagtgaaaaacaaaaaccctgaccttttgtccattaaaaatcaattttctggcattttttccataaaataaatcttttaatggcaagtttacagtttttagtcaaaaacttttgtaaaacccgaatcaaaaaaaaaacataatttgtataacctaagtctgaatattgattacatctaaaaaaatttcaggcctctatatataataggaaggatg

SEQ ID NO: 107379 - DNA, 820 bp, Heterodera glycines
  Promoter: Source sequence=SeqID_19169; Location=628..1447; Strand=+; Gene=SeqID_83917
ttcttttaaaatattactaattttcaaataaaatgctcaatttgacagaatttgtttaatgttttgaatatattattaaaaataatccataaatttgatgacgttaattagaaaaattttcgcctgtttattggctttttcaaaatttggctgtttttgtacaaatttttgtacggtttcaaattctattttcaccagcagatttcaaaaaatttaaattcggaaaaaacccaaaaatccaaaaattttcttttcatttttggcagaagtgtcgggccatggaatacataaactgctcgtgcttttgctaggcgccgcggtccaatcaccacaacgtgaacatttcattgaacgcaatggattttttccaacatttttttttgttttcactgatcatttgagcatgaaaaatcgaagttgattttttttttgcggtgctttttccaaaaaacttggggaacaagagggggccggcgtgccgataggcgccgccgggaaaaatttttgtaatttaatgaggtttgttaatagattttgtccaaaaaatggccaaattttgcaattttgagttctgaggaggttgaacaataatcccccatggggataattagaaaatatacggtaaaaggcatatacataaatttccataaaaattttcttttcccaacttttcccactaaaaaaattgtgttaaaacaagcacatttttaaatgcaattataaagccgaaatttactgattttttaagttatgccacaattaaaaaatggaagaagcaatttggcattagccgaaaataataacggaaaaagaaaaaatg

SEQ ID NO: 107380 - DNA, 78 bp, Heterodera glycines
  Promoter: Source sequence=SeqID_43465; Location=1186..1263; Strand=-; Gene=SeqID_71120
ggtaagggccggtcttttttcttcgttttttttttcgttcctaatttgcattaatggcactgttaagccctgatcatg

SEQ ID NO: 107381 - DNA, 1003 bp, Heterodera glycines
  Promoter: Source sequence=SeqID_3975; Location=427..1429; Strand=-; Gene=SeqID_52642
ccccatgcataaatgggccgattcaaccttaaaagcagagagacagacgctttttataatgtaacgcgaaaaatatggagtttttcactccatctgcgcgtattctgaaatcgcttctcttcttttttaggaaatcgatgagagggaagctcgagaattatgaagcgtaatgaccagcaattttgtataataattaattgaattcgatatttcagtactaattttatatatcattgcacatttcgttcctcgttttatataaccccatgcataaatgggccgattcaaccttaaaagcagagagacagacgctttttataatgtaacgcgaaaaatatggagtttttcactccatctgcgcgtattctgaaatcgcttctcttcttttttaggaaatcgatgagacggaagctcgagaattatgaagcgtaatgaccagcaattttgtataataattaattgaattcgatatttcagtactaattttatatatcattgcacatttcgttcctcgttttatataaccccatgcataaatgggccgattcaaccttaaaagcagagagacagacgctttttataatgtaacgcgaaaaatatggagtttttcactccatctgcgcgtattctgaaatcgcttctcttcttttttaggaaatcgatgagacggaagctcgagaattatgaagcgtaatgaccagcaattttgtataataattaattgaattcgatatttcagtactaattttatatatcattgcacatttcgttcctcgttttatataaccccatgcataaatgggccgattcaaccttaaaagcagagagacagacgctttttataatgtaacgcgaaaaatatggagtttttcactccatctacgcgtatatttttcgtgctttttgtgtctttttttgtgacttttttatttgcaggacaattattacctaattcagtacttattgaaaggaaaagtgtgctctaaaattgcagcaaaaaatg

SEQ ID NO: 107382 - DNA, 551 bp, Heterodera glycines
  Promoter: Source sequence=SeqID_14497; Location=1..551; Strand=+; Gene=SeqID_78541
aaaatgttctaaggcaattttttggctaaaaccgatccctgacgagttatgggcccggggactcaaatgtcccgctgaggccaaaatttttttctatttccgggaaaaaatcgaaatttttccgaaaaaaataccagtcgatagagctcgaaaaactatgttttggaagtggtctccgtttctctgggaaaaatcgttaaaaaatcctaaaattcaaaaacccgaaaaccgttttttaggcctaactcgaaaaattttgaaaattttcgaaattttaaaatttcaaaaaatcgagctttgaaagctctacaataagttcgctgaccaccccccgctcagatcaaaccctggcgcggtattcacctggtactgaagtgtactttttgagcacgcttcagttgccattttttgcaggccaggggtttgctcaaaaaaaattttaaaaaatacctccttgtagaggacccttaggcggagtgccctttcagcgggcactttttgattcgagttttacaaaaaaagttaggggccgtcaaacgcacgaaaaaatg

SEQ ID NO: 107383 - DNA, 1003 bp, Heterodera glycines
  Promoter: Source sequence=SeqID_3223; Location=665..1667; Strand=-; Gene=SeqID_83764
attttccgctttatttgcgtgccttaaaatttcgtgcgaaaatgacggcactccctccgcgaaataatggcttatggccacagaaatgcctttgttttattcttattacaaaatagcaccgttccccgccccaccaaaaggccaacatttttttcccaccaccgacggacgaatgaactgaatgaattttttcctacgcagtgggaagagattgcgtgccaacccaaaatgaatggaggcgtcgccggggggcgggtgaaaaaaatttggagccggaaagtcggcactgctcaattaggcagaaaaatgagcccaatttgaatgcccttaaggtatggggtggtcgtgggatgggataggattgggatgggtggaatggccaatgtttgccgtacggattggccaaggggggggagaggaaatgccaatgccaatggaagaggggggggggggatgaacgaatgaatggcccccggggggagaacataaattaggaagaagaaaaagaagaaatataatgcaaaaaatgccagcaaaacaaagcaaaaaagtgcgaaagttatgaatgacttatgaaaacgcaacgggaagaatgtctggcgaaaaaaatcaaaaaattttttaaaataaagagaaattaattctcaaaaagagcaaaaatattttttcagtagggaaagtcgcagttgaaaaaattcacatcactttcatattttattaacgctttttgccctctctttcaaagaatcattcgcacatttaaaatttgaatttgagttgaaaaatatgtgtctttatcaatgaataacaaataaaaatattattgggaatattatttaaataaaaataataataaatctgaaaaaacagagatataattccatggaataagtgcatcaatgaaactggagagtccatttccgaaaaaaatcactcttctcctcccctcccccgcccacttctctaccgatgcgcttccttctcattcaaaacgtacaaaatg

SEQ ID NO: 107384 - DNA, 76 bp, Heterodera glycines
  Promoter: Source sequence=SeqID_2374; Location=1620..1695; Strand=+; Gene=SeqID_79398
agtttgtttcctttttaaaaactttcattacccatttgttttaagcgttgcgactcattcgggcaaaaatcggatg

SEQ ID NO: 107385 - DNA, 1003 bp, Heterodera glycines
  Promoter: Source sequence=SeqID_5091; Location=4812..5814; Strand=+; Gene=SeqID_56870
ccctatgggaggggcgcagccctttgaagttgccgccccggacattttcccgcacaatcccaaacctatggaagggtgcacccctttgatgttgccgcccgggacatttaccgcacaaacccgcgcctattgaaggggtgtttttcctttgaagttgccgcccgcgcaaaatcccgcgcctattgaaggcgtgttttcctttgaagttgccgcccgcgcaaaatcccgagcctattgaaggggtgttttcctttgaagatgccgccttaggattattacctcaaaatcccgcgcctattgaatcctgagcctatgggatgttctttgaactctgccgccttgtggattttaatttccccaaatcctcgcgggtgtttttttcatttcccctccccgcgccgcgcagtgccgcggaaggtcatcaatcatccgtctgtcacgaaagtgacaggtggaggaaattcaattcttgcaaattaattccaaggaaattcaattcttgcaaattaattccaaatctttttgctcgcgcgcaaaccttttgggcggttttattttatgaaatcctgagattttttatcatgattttttatcctgaaattaaactatttttgaaaatttgctaaaaccgtgcggttttttgcatatcttcccttcgccgcgcagcgccgtcatcaatcatgcacctgtcactaaagtgacaagtaattttcaaaaattcaatttttattttgcaaatttaattccaatttttatttatttattttggattttaatcaattatttgatcccccgttttccaattctcaattatttttgccagctcccccgagcccctaaacctcgcgggttcctcgcgggtgttttccgcacaatcccaagcctatgggaggggcacacaaacttttgaagatgccgccctaaaattccatttccccagaatccgagcgggcgtttaccgcacaaaccggtgcctatgggaggcgtcaaacttttgaagatg

SEQ ID NO: 107386 - DNA, 150 bp, Heterodera glycines
  misc_feature (15)..(15): n is a, c, g, or t
  Promoter: Source sequence=SeqID_1918; Location=1616..1765; Strand=-; Gene=SeqID_76783
tagagatcggtattntgaaaaaagcctggacctggacctggattccatgttggaccttgagaatggacaacaaatttgccaaattgatgggctcatttcccaaattgcactcaaaaacccctttcgtccgctataaaaggcggcacaatg

SEQ ID NO: 107387 - DNA, 274 bp, Heterodera glycines
  Promoter: Source sequence=SeqID_11473; Location=1955..2228; Strand=-; Gene=SeqID_74875
aaaatattgataaataatattaaaatagttttaaaaataccataaaatatttaaaaacatttttggattttaaaaaggaagtcccatttaattatttttaacaaaaaaggtcatttaaaaattagaaaaataaatttcaaaattcagtgaccactttggtgttggccgtaacttttcatgtgattttgccggcaattttctcggattattccggcagaaaaattgaggtaaaaaaaccaaaataattttttttgaatcgctttttgctcagatg

SEQ ID NO: 107388 - DNA, 1003 bp, Heterodera glycines
  Promoter: Source sequence=SeqID_17337; Location=2300..3302; Strand=-; Gene=SeqID_81816
attaatattttttctttgataaattccaatctaactttgaaaaaaaattcatttttgcaaatttcttatcttttgtttttcaaaaattttctttaattttgcgaaattgcttcggtccccgcgcaaaatgagaattagcctttgaacatgtatatttttcgcgaaattttaataaatgagtaatttgcacattgacatttctctgtcgaaaaaacttttaaactctgtggaggtagtgcgctttttaataattattttggtcgaattcttcaaaaattatatatgtaaaagaaaatattttttttccattttttatccctttagcatttttatctcggcactcggactcattcccaaaactcccgaccgaccctggagaccttacttttataaaatttgacggtcagaaagagttgttcaattaatacaggtctaattcacaccaaaaatgatagaatcaaaataattctcttgtttacgcttcatacaaatgggatattttgaaaaaatgttttataaattgttttcttgtgcctatttagtaaatgatttacgattttcctacctaaaatttgcatcgttatttaataatgtttttaaaaagacaattagaagattttttattgccaccatacaactaattgttgtagtgggttgtagtgctatcgcccgatctccattggatatattttaattcggtagtcttttcgctaaattaaaatttcccatcaattatggtgaattttaaaatttccttaacattaattggtttttgccccgtcgtaaaagaatcattcaaatatcttcaatgttatttccttatttatttgcccttctgttcttctctccctttttgggtcatcattttgccgtacatttttttatttgcgttgacccaatgaattcttttgcaaataaatcagcattaatcaaaacattaatactaaatgcatcagaaataatttaattttcacaaggatctttttatttgaaaaaacaaatg

SEQ ID NO: 107389 - DNA, 96 bp, Heterodera glycines
  Promoter: Source sequence=SeqID_7269; Location=2148..2243; Strand=-; Gene=SeqID_64307
ttttttcaatggcttttataagttaaagaagcagcaaccaatcgcttcaaggttggccattaattgtgccaattcactgacaacctcaagaagatg

SEQ ID NO: 107390 - DNA, 603 bp, Heterodera glycines
  Promoter: Source sequence=SeqID_20196; Location=1461..2063; Strand=-; Gene=SeqID_84992
ggtacggtagacggagatggtattaggcagggcaacactgatcaagatactgtaaaaggagggatggaagaataagcaaaataaacaacaggaaagtggaaatgaagaaaagcaaggcaaaaaaaaaaattgggaattgaaagcagcagcaggtgggaggaggttgaaaaaattagggttataagttgtatgcactaaaaaatgccaaatatgcgcataaaatatgcactaaaaatccctcaaatatgcctaaaaacccgaaaaatgcccaaatatgcactaaaatatgccttaaaaattgccaaaaatggctcttaaccctcaacaatgccaaaaattgtgtataaattaagaattgacttttaaaacaatgggctaaggagcattttttagacaattacaaaaaatattgaatttcaaaattctaaatttttattatatgctaaaacaaaagtacatttttatatagaaaaattttatttcaaaagctcttacaaaaatttaaaaattttccgattttaagggggtattaaaaaattccaaaagtcgatccttaggggtgtatttttcgcatttttcttatgaaaatttgccaaaaaaatg

SEQ ID NO: 107391 - DNA, 687 bp, Heterodera glycines
  misc_feature (56)..(56): n is a, c, g, or t
  Promoter: Source sequence=SeqID_9172; Location=3475..4161; Strand=-; Gene=SeqID_70491
cagatcactcctttcagtgtgctcgttatacgacaaatcagtaagtggacaatcgnacagtaaaatacacaaaaagataaaaaatgccgttgtcgaagaggaccgattgtgccaagaaaaataagcaaatgaattgatgagttttgggaacaaccctaaaaatcaaaagatgtgaagatgaatggcaagaaaaatcatttaagttaaacaaatgtgcaacagtcgcttacaatatgccaaattcaaactaatttggaacgaaataatgattttaaatgctttagaacatttcttgttcagcatcaacgttatagcaggaagcttttcagattcttttattcaaaaaatggtctttgagaaaaattgcttaaaattaaaaaaaattaaattaaatgaataactatttcctttttgggtttgccttctcgtccacatttttctctctccatttccattagctttttgtgcttttttccgttcgtccgtccaattttacgtcattcattcgctgcatattataattatcattttttcattcacttttatcatttgaataatctttttgggtaatatttattaacggattcccattcttttaagctttgaaaaccataaaaatataaattaaatataattcaataataaattttattcttttttgcattttcattattaattgtgagaatg

SEQ ID NO: 107392 - DNA, 67 bp, Heterodera glycines
  Promoter: Source sequence=SeqID_906; Location=3527..3593; Strand=+; Gene=SeqID_63692
ataaacaaaaatgttttttaataaattaaaatgtaaattttactcctctactaaagcaaagacaatg

SEQ ID NO: 107393 - DNA, 880 bp, Heterodera glycines
  Promoter: Source sequence=SeqID_14158; Location=1..880; Strand=+; Gene=SeqID_78158
gggatttccttggcctgatcaccagggcttataattatttggaaaaattgcaaaaatcaatcacttacttgaaactcaggcctagcctaagcttatgtacgaaaattcaatattttatgggccaaaaagcactgaaaattgccctaagttatctttttatgtatattaaaaaaagtctggcactaacttcatctgcgtgatttggacaccccaatatacacttttttgcaattttagccggtcgaccaaccacgcaaatcccatattttttccctcgactgtgggagggctgaaacgcccgaatacatgtttttagcttggtttgaagtagggttcgagccccgccgccgcccccgcccccgtgattcagacccccgcatcccccgcccccgcgaccagggatggacgaaatttcgtttcgttttcgtttcgtcctacattttcggcactttttgagtttcgttttcgtgtttcgttttcgtctaccaaagttttttcgtttcgttttcggtttcggttttcaaaattttgtttttcgtttcgtgtttcgttttcgtcagagcaaaattggacgaaaaaagtacgaaaaagcactggtaagaataggccccgttggtagatttttcattggcattccgttttttcaaaaagggggggggacaaaccacagaattaccatttttcttagtccgttttttccgtgttataagttccgttttactacacatcaaagtcttttttaggcctattaatgtcttccaaaagcaaattccagtattttaattgttgcgacacaattccaagcggcaatttatggttttgccgttctgaaaattgcagctacaaatttgaatcaaagaaattgtctgggtatccaatg

SEQ ID NO: 107394 - DNA, 435 bp, Heterodera glycines
  Promoter: Source sequence=SeqID_171; Location=6688..7122; Strand=-; Gene=SeqID_76061
aggcaagcaaagctccatcgctcggaaatatttgaaggtgtatccaaattatttaattttacatttgtcgactctcagtggcgtgccgaagaagaattgcgggagaatggtcgggtgctgcgccatgtcgaaagccctggaggggagttcaagttcggcaactacagcttggatgggatgatggagcgtccagatgaggacaaaaatttggccattgaggtcaacgggtaaggaaaaaattccaaaaatgtgccaattttcccattgaaaagatgctattggcatggatgcccgagctgcttccccgacgatgcggcaattgtgggcggaggagaaactgccggagctctaagggcccgcgatgcaaaacggactcgtgacattgcgcgggaattcgaagtggaagtgatttgggagtgccacctgaacgcaatg

SEQ ID NO: 107395 - DNA, 128 bp, Heterodera glycines
  Promoter: Source sequence=SeqID_16037; Location=1211..1338; Strand=-; Gene=SeqID_80398
ggtaattttgaatttgttttttggattttgcaaatatctatcttggcaggaaatcgtccacaggatgaaaattgtttggttttccacaaatatcttgtctgattttttccattttagggcggcagatg

SEQ ID NO: 107396 - DNA, 1003 bp, Heterodera glycines
  Promoter: Source sequence=SeqID_10103; Location=925..1927; Strand=-; Gene=SeqID_73184
tccgattacctataggcatagcagaaaaagtgcatttacaaaaatgttatgtgcctagactataaagtgtcaaatttaaaaaaaaatttattttcccctaattactctataagcctactaattttcaaaaaaaaaaaacattgggccttcttcggtctttttgtttctcttatgatgggtgttttcctctcggcttttagtcctgtaattttaggttttcgggtcattaacgattgttttttctttctgtaagccctcattatctcgtgcaagtcaatcatcagcagctattgagagctttgctcaacatcttcaaccaaaaaaaaagaatccgctgtaggaactctcaacaactttttatctcataaaaattttcaagtgctcagaaaactcagaaaaaataaacaaaacaatttttaaaatcattggaaaagagccacttaattagtaaaaggagtagggttggttaagtgcttcaaagaaataattttccgtaaatttcttttccgactaaaatgctattttcattttttataaataaatttgttgttatagtttatctcgcatttgagtattcaatgtgtgacatatgttcaattttaagagtggataaagctgagttggctgggtcagtgtaaagttaacattcgccggcttatccggttgaataaatcatccaaaatccactattttcctgctcttaatcgatcggagaagtgatcgatcgccgcccccgccctcccccgtcggcaagaaaacgatttgggatggccatttagcattattagtcagctcagccgttgctgtgcagggataagcaagaacggagactaaagtttttaaaatgtccaaaccaggaactgaccagaatttaaatgtaatttttgcgaatattttatttcctcatttttatgtatttattattgctatttattaatccgttttaataaatatttctgttggccaaatacgaacagttttatttctactcagttaataaatg

SEQ ID NO: 107397 - DNA, 772 bp, Heterodera glycines
  Promoter: Source sequence=SeqID_2531; Location=1223..1994; Strand=-; Gene=SeqID_80223
aattttgtacaccgaaagattggacagcccaattttacctatttttataaatatattttgaaataagaattaaataaaaaaataaactgattggaaatagcgtggattaataatcaatttattttttaaaggatttatttatttttcatttccttttgcataatgaatcaaaatttcggggagtaatttttggatgccaggattttgaaatcaaagcttttgaatcaatttgttttttttcatttgccactactttgttggtgccacgaaattttaaaaatgtttgccagattttaacaagaatggaatttttctttggcaccgtcgtcgcactagcaaatttaaattttaataatatttttaatagaatgtaaatagacaaatggatttttgggaagtatttaaaattaattgtccgtcatggaatccgctcatttagaggacaatttggacacaattcaccacaaatccgttgaatgccggaaaattcattggaaaaatgtgcgcaaatttttggattacttttttgcgccaaatttaaaattgcaaatgcattttatgatggctataataatattttaattaccccttaattggccaattttgaataatagcaacaaactaaagtcattacgggaaaatgctgaacagatgaaaatgtggccaaaagaaaaagttaaggccaaaaatgaatttggcaaaaaatattgtttaaaacgcccaaaattctttccataataaagtaagtaaaggcatcttcaaatttaaaatg

SEQ ID NO: 107398 - DNA, 73 bp, Heterodera glycines
  Promoter: Source sequence=SeqID_17588; Location=1206..1278; Strand=+; Gene=SeqID_82096
agtaagtgtctgtttctgtttttgtatccattttttctcatttccctttagccattgcgcaaaattggccatg

SEQ ID NO: 107399 - DNA, 1003 bp, Heterodera glycines
  misc_feature (117)..(117): n is a, c, g, or t
  Promoter: Source sequence=SeqID_28377; Location=398..1400; Strand=-; Gene=SeqID_59007
cggcgctttcgctgcacaaaatgccaagtcaaattcggaagtgagcaatttgttgttaattgttaattgcaaacattaggacaatcatttgtatattaaacaaaaacccttaatatntgcattttaaaaatcacaaaatgcaaaatacacacacaaatattataaaactacgggagatgcagaattaataaataaataaaattgatttagaaaagttcatacgtttaaaatcaatccttagggagaggggggggggtgtatttctttgtagagcttacattttgaaaaaaaaaccttgacctggatccatgttggaatattcgtgcttattatacatatttcttcggttttggtataaaaataatttaaaaaaatattaattttacttaattttaaaattgccaattttattgaaaacctgttaacaaatcgcattaatttcaaaaatcttccctgcggcgtctttcgacaccgtcggtccaaaagtttaaattttaaatcaaaattaaattggtttaatcgaataatttacaaattatttataatcaccgcatttaatgctccaaaaatattatttttggtctctgatcagtgatatgcttattttggaaaatttttgatgcgatctctgctctaaagggtgtcctaattgttatcatcgattaacaaaaaaaaggtcaattaattaattggtcacccaaacaatgggacggaatacaattcaaagttatgcatttgctgcagcattttttaagctgttgagatggccttcgctgaggggagggatttgttgggattttggggtgtcctggcgcgaattggggcatttgtggtgcaatccctccatgacaccgatcgcccaatgctctcgaccgcgtcatttgtcctctcctcccatttttgtgcaacaaatctgtcgaaaacatacacaaatgatgggaagggatgatctgtcgcctcatcagagagaaactcattggtcagccaattgaacgaacgaatg

SEQ ID NO: 107400 - DNA, 126 bp, Heterodera glycines
  Promoter: Source sequence=SeqID_34075; Location=629..754; Strand=-; Gene=SeqID_63959
ttcatttatttggcagtgatgaattttattttccaaatttacatttctttttaatatgaatgttaatttataaatttttaacatttttctagatagcacaatacattttctttaattaaaacaatg

SEQ ID NO: 107401 - DNA, 374 bp, Heterodera glycines
  Promoter: Source sequence=SeqID_25372; Location=1..374; Strand=+; Gene=SeqID_56116
aaaaggaagaagttaagctgataattaaattttggaaaaaatttcgttttgtcggaaaaataattaaattcactgttatgaaaaaggtatttttgaaagaaatataggaaaaaaaatctgcaaatttttccactatgggggtgcctttatttttttatcgaatcgggatcaaattttttattttgcactaattataattctaataacctaattccatagacttaaaattaaaagcccgtatgtcatttttttaatattacaatgccgcaggtcaaggccaaacttaattgatgactcattttatgaatgaattaattgtctaattaattatccatttcaatcaaatttcagttccaactggtgtgttaacaatg

SEQ ID NO: 107402 - DNA, 648 bp, Heterodera glycines
  misc_feature (90)..(90): n is a, c, g, or t
  Promoter: Source sequence=SeqID_9490; Location=2877..3524; Strand=-; Gene=SeqID_71615
acttactctaaggacaattcagaacaaaaatgtgtagactctcctagtgacataatatatggatgatcagtgatcacaagacataagagncgaagacttgtaaaaattgcgaattttcaaatttttcgagaaaaattcgtctttgtttatatcattcgaaaataccataataattttttttataagcctgaaaacaaaaaagttagcaagaaagttattttttgatttttagaatcattttaaaatgattattcaaatgacccagagttcctgaattattaaaaatattggatattatcagtgctaagattataatatcttctaaagccaaatatgctttactacatacagtcatggtcataagtgttgtcccatcatgctttgaaaaaaataattgcgtataaaattgtcattttccaatttcaacagataagtagcataccattggatagcattttttatgggctttccaatgataccatatttgcatttgtgacataaacatttatttgatttattttaccatattcacaatttgatcaaaatataggtggtcaaaagtgttgtcccatttcatttttaaaatattgcttctctggatcagcattaaaaaatctaaaaaaattcaggtaagcataactttggatg

SEQ ID NO: 107403 - DNA, 408 bp, Heterodera glycines
  Promoter: Source sequence=SeqID_31103; Location=1..408; Strand=+; Gene=SeqID_61485
gtaatcttttattaccttttgtcgtaaatcacaaatgggaccacaattcccatgcaaaccaattgctggagttcggcaaaagtgcaaggattgcaataaaatgttcttcaataatgattgctagcagtatcatctttcttccaacttttgtcaaatgagcaaagagtgcaaatactgtggcgtcgtatgggacatgcgtaaaaattgcgataatgggagagaggtttcttttaaaaatttaataatagtttaatattgtaatagggtcacaaatgcaatgaacgctggtgtgaaaattgtcaaatcttccacgaatttgagcggggatgttttattcgcccattggagccgaacaagaagaaagaaacaaatgggtggcgccttgtcaccttcgacgttgaaacaatg

SEQ ID NO: 107404 - DNA, 979 bp, Heterodera glycines
  Promoter: Source sequence=SeqID_4890; Location=1..979; Strand=+; Gene= SeqID_56103
ctatggataaaattgattcacccaaatgaatataaaaattgatcaatgcagaaattatagaaaaaagtaaatatcgaataaaattatataaaaaagtaatgtaataactgcaaaaatttatattatatagcatacattggataccagaaaaatggaaaccgcccaaaaattggatactataggggataaaaacaatttaataataataaccaaagatcgccagtagttagtatccagatatcgtcgtcatgattaattgctttttggtgacagctgccctttgaggcgtgccgccgcgcgcgggtttaccgcacgaacgcgtgcctgtggcacgggttcgcgcgggagggggaggggtgcgagagtgaggcggcgcgcggttttaccgcgcgtgtggcacacgggcggggggaaggcggcgtcgcttttgaagtgctggtggagtggaaactttttttgacaaggagggtggcaaaaaaaaaaaaaaaaaacttttgatgtatggggagggggctcaaactttttgtggaaaaaaattttaccaatggaatgtgttgcggggaaggggtgggtgattaatgatttgttgtatggaagggggggggtgctgatggtcagcggcgcagcagcgatgaacggcgcggggaattagagaaagagaagagagtgcatgcaaaagtgagagagtgaaacggtgagaggtagggagagatagagagagaagaaacaaacagtgggtgagagagtagagagacagacagtcagagaaaaattttgtgcacaaagtgagtgcatagaataaaaatggcgacatggcttactaatgaagaaggggggggggcgctgaccaatgcattgacatattgattcgatactccaaataaattgggctcattttagcataattataccattaaatttataatggaattgttttatttatttatttattgttagataatacagtattactttcatg

SEQ ID NO: 107405 - DNA, 546 bp, Heterodera glycines
  Promoter: Source sequence=SeqID_14911; Location=922..1467; Strand=-; Gene=SeqID_79076
tttttgcacttttcgcgaaacgcccatttttgcacttttcgcgaaacgccccattttgcacttttcgcgaaacgcccatttttgcacttttcgcgaaacgccccatttttgacgtcgtcatttttgcacttttcgtgaagtgacctagcaccaggcgatggacctttttttagaactgcttttttgcggcactctttttcaaaaaaattttggtgacgtgtggggggggggagggttcggcggtgccaatagaggccgccggagaaattttttttttttttttgtataaaaattatcaaattttgaaggacccgcggtgccgaaagacaccgccggggaaaattttgtaatttttaatgcgttttgttaacagataatttgtccaaaaattaatgcgaactttagtcaaagtttggaaattgttaatgatttcttctttaacttcattaatacataagttttttttttaattaccaagaccaaacgccgagacaaaaaccagttttgtggccaaacaaaattcgacgaaattttggccagaaaatg

SEQ ID NO: 107406 - DNA, 239 bp, Heterodera glycines
  Promoter: Source sequence=SeqID_6556; Location=496..734; Strand=+; Gene=SeqID_61999
cctaaaaaacttaaaaacatgcgtttataatttgattggaaacggagtttctgggcgaaattccctttcgaatgcgccgtcgtctgtcccgcttattatttttttattgagtttaattttttcatttacattcattccaaaccttcctccggcgccgagacaaaggcgccgaaaactgaggcaaatgcgacggcatttggtgccgttgttggcttaggggaacggggggagacaacatg

SEQ ID NO: 107407 - DNA, 224 bp, Heterodera glycines
  Promoter: Source sequence=SeqID_35042; Location=1..224; Strand=+; Gene=SeqID_64700
aaaaaagtaattactcggtaattaatgcaaaaaccccatacaattagagctatcggcagtgtttgaacgatacatttcgacactgtttgacccaattggacttccattcggccgccacctctgccacgagacaatggcacaaattcgaatgccatcgtttgctgacgttgagcaaaagcactgagcaaactgagcatcgaatttctgttgctgatggacaaatg

SEQ ID NO: 107408 - DNA, 148 bp, Heterodera glycines
  Promoter: Source sequence=SeqID_3746; Location=268..415; Strand=+; Gene=SeqID_45623
gaatattcgactcccttttgtatcatataaataccgtcccgtactattcactatgataataaattttccggtccacccacttttcatatagcgccaatatttggcagttattcatttttagattaaaagaattgatttgtgaaaaatg

SEQ ID NO: 107409 - DNA, 207 bp, Heterodera glycines
  Promoter: Source sequence=SeqID_17650; Location=2457..2663; Strand=+; Gene=SeqID_82178
aacacaacccgacacacttttgttgatctgcgacgaatcatgatcattttgctttttgtttgaattttaattaaaaaataaatgagtgaaggaagacagagaaagaaaagaatatattgaatttgaatcgattaattttgtgaaatttttaataattcaaatatttgttcccaattgttctcatttgtccattttgccattccgatg

SEQ ID NO: 107410 - DNA, 508 bp, Heterodera glycines
  Promoter: Source sequence=SeqID_19507; Location=1..508; Strand=+; Gene=SeqID_84232
ttgccttaggcaacattgggcaccaaccatcccacaatttccggtgaacgaccgacgggggtgggcagctacgggttttgcaaaaattgaaatcccggatagagaggattttgcgtgaataatccgccaaatccggtccgaacaaatgtgcaattcttatttccattgcaaaatgtaccgtaagcgtgccttgggcgcagccttctttcattttcttactgtacaatccccgctcattttttcaaaaggatctttaacaaaaacagaagcgatttaggatttaccaaaacaaaaatggtattgattaaatatttgaaataccgcgcatttggcgttatgtttttttttgtttttgtgattttcgcaacgccggtggccgccgtttccaagaaatgtcagaggtcgcttttttaaacgtaaaatttgttaaaggtttcaaaaaattcacatttttacatttctttcgtgcgccccttcaccaccaaatcgacaacaattttcaaaaatg

SEQ ID NO: 107411 - DNA, 417 bp, Heterodera glycines
  Promoter: Source sequence=SeqID_7524; Location=644..1060; Strand=+; Gene=SeqID_65115
tatttaagtaaaataatatttaggtattacaaaattaaatataatttaaattgtgtttttgatcaatatttacttttttattccaatcaaattttgtcattttttcctttattcttattaacgatttatacacacattaaaatcaaaattttataaaccaattcgcaaatttcgtgtttaaaaaataatggttcatctgttcaaatgcaaataattaaaattgggattttggggggggggggggaggattttttggaaaatttcattgttaatgaatgatgaattaacagatgagcaaatttggtgactgtggccgacctaaataaaattgaattttttatattttcattatttcgtaattttgtgaataatttctcttttatttaacaaaaaataataattattattttagcaatg

SEQ ID NO: 107412 - DNA, 223 bp, Heterodera glycines
  Promoter: Source sequence=SeqID_15178; Location=1..223; Strand=+; Gene=SeqID_79377
ttaattcattaacatttggctctgcttcatcaggatcataatagtcggaagtcgcacacgcacagaaaaaggcatttgcaaaaaagaaaacaattaaaaacatcaaagacaataaggaggctaatgagtatgaactaattaagtgtctgccattaatagaaataatttaaaaaaataatttgtagtttaaatttgctttatgtaagaaattcaatgaaaaatg

SEQ ID NO: 107413 - DNA, 274 bp, Heterodera glycines
  Promoter: Source sequence=SeqID_10745; Location=260..533; Strand=+; Gene=SeqID_73990
tctaaaattcaatgaattcttccactcactaattataatctaatgaaatatgcctaaaatacgaaaatttcttacggtttaaaggggagggggggggggggaacggaaaatctcagcgatttttaatttaaaaccgatgaatttcagcaatttttaatttaaaaacgagaatttcaggggtttttatttttttcaattgttttttacgcagtccacgaagctgtggtgcaggaagaacagcgggtcatttgccgaggtcgaagtgtccgacatg

SEQ ID NO: 107414 - DNA, 103 bp, Heterodera glycines
  misc_feature (45)..(45): n is a, c, g, or t
  Promoter: Source sequence=SeqID_40912; Location=800..902; Strand=-; Gene=SeqID_69141
tagactaaaaaccaagcttcaaactttcgtttttgaaattttgcnggtggtttatatcacggcgatttcagtttttgtgataaataatgttttttatttcatg

SEQ ID NO: 107415 - DNA, 164 bp, Heterodera glycines
  Promoter: Source sequence=SeqID_13802; Location=986..1149; Strand=-; Gene=SeqID_77731
cctgtaaaattacaaaaagtataagttaaattttcgataatttttgaaccatgcaaattgggccacagtgatcagccattgatgcgactcgttgtactgtaggtaaacgtaaattgagctggccaatgtgttcagtgccgagacaaaaaacacttgcaaaaatg

SEQ ID NO: 107416 - DNA, 1003 bp, Heterodera glycines
  Promoter: Source sequence=SeqID_25197; Location=217..1219; Strand=+; Gene=SeqID_55936
ttttaaaatttaataattttcctgcaccgaaggtactcactcggcctcttcgcggcctcgtggtgggccttcgcccccccccccccagtattatcttacaaaaatatttatgaattaattatgcaaaaataaataaaaatttctaaaaatttgatcgtccataaataatttgtaattgatcaggggctcaccaaattttgcaggaatacgtatcgtgaacactacaaatgcttactaattttcctagattttttaaacccggtgaaaattttttgcagacaccaccacttttgcacttaaaaaaatttcaaaaaactttaaaaattcataaaaaatattaaattcataggtactactgctaaatcaacgcagagacgcctttccttgacctttttaggcccctgcaaaatctggtgcgcttctgatcactactcgaaaaatgagtgattgaattttcactaaaaagttaagcctaaactttttggcctgtttaaaaaggaattaaaaattttaaaaattttattcatctccctttttgatagaaaaagcatcagagtgcctaaactaacatgtaaataaaatttggtgcgtttcagagcattttctgaaaaaatatttatgaaataaaaaaaatcgatttattcaagtgtccgttggggtactcaaacaattatggggagcaaaaatccaacgcagaattaaagtacagactatagggaagctaatcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacagactatagggaagctaatcccgaaggattcggtctccccataaatctgggcgcattggttcggggggactgccccgaaaacaaaaaaatcgattttttcaagtgtccgtttggggtactcaaacaattatg

SEQ ID NO: 107417 - DNA, 369 bp, Heterodera glycines
  Promoter: Source sequence=SeqID_34390; Location=663..1031; Strand=-; Gene=SeqID_64196
tccaccccattttctgggtcccgcttttcctaataaaaagtggataatgatggggttcatacaaattccggtttgaccattgccctgtccgaactcgggataaacacaaaattttgcaagcaaatgcgtgtcagcataggcttctgttattttttattagatccggtcctctgtgtttcgaaccccactaattttttcgtaaaaattgccgaattccgggaacttttttatgggttttactggtggtcccttttccggcttttttttctaataaacaatggaccaaaatcaaaaaatgcctcccctccaggagaataccacgccacattctctccttttcaactgtcactacagtttttgcatgccatg

SEQ ID NO: 107418 - DNA, 722 bp, Heterodera glycines
  Promoter: Source sequence=SeqID_924; Location=4023..4744; Strand=-; Gene=SeqID_64148
ggccattcgactccattttacaacaatctcagagaattagttatacccattttcaatttggaagaatttttggaccgtatggactatgtattgatgagcgagaaataaaatagttaaagataagatatctcaactttcgttgtctgttttataaaatcgaatttggaaacgttaaaattacattttctacatttgactttttcattgttatgcaaatccatatatttacctacttacacacgtatagtatcatattaaatattggtataatattaaaatagtagcaatggcaatcattagggaatagaaaattcgaacaaaaagttgaattttttcaaaatatgcattttcctggggtaaaagcttcgaattcatttaacattatttattttggtgtaaaacaattgcttcacaaatttgcgccaaaatttgatttattttaatgcaaattggggaaaaacgaatttttgtgcaagtccagagttcggatttgagcaaatccgagattcagattcgtgatcactgatcagtaccctcgtaaattgattttgatcccaaaataaaagagtttaattattgaccgcaattctttaccattgccaaattaacgacattttaaacactatgttgtatattttcattttgatctaaaaactttattgccaatcacaaattaaggaaagtgcttaattcgcaaagggataccaactgcttaggagatg

SEQ ID NO: 107419 - DNA, 205 bp, Heterodera glycines
  Promoter: Source sequence=SeqID_13689; Location=2844..3048; Strand=+; Gene=SeqID_77602
aaacacttgatcagttatacaatgacccttcttcacctgcagcatttgctggtgtcagtagattactagaagaggcaaagaaaagaataagtgatatacaccggtcagatgttgtgaattatttggaagggcaccgcacatatacactgctgcgcccaagacgagttcatttcccgaggtcaaaaccgtggccgcaggttttatg

SEQ ID NO: 107420 - DNA, 896 bp, Heterodera glycines
  Promoter: Source sequence=SeqID_20378; Location=1..896; Strand=+; Gene=SeqID_50898
gtttcgccaactaaccataattatgacatttcgccaactagtcatctcgccaactgacactttgccaactgacatctcgccaactagggcaaattcttacgtttcgccaactaagctagattcggacgtttcgtcaactgaaatttcgccaactagagtacattacattttttactcatatcttgatcggtgactcgaaattattactccaagtgcaaggctcacataaaaaaacttatctgcgaaatatacattgctccagaagaaagatagaaaacttgggtacttttagttcctaaatcttggccttatcgtattactaccacttataacgacataataaggtttgccccaattaaaataggtctcaacaattttgatatttaaccgatttgggctagattttcgggattcgaccctaaaaaagagttgggcgaaaacgaattgaatgccgtccgtacgtttcatgacggaaccgaaccgaattatatgtttttttgccggtgcaatgataccgagggattctgaatctctaatcaaagaaatacagacactgcggtgaattgataagtgatatggataaggagaataatctgtgagagccctggctttcatagagatacattggcattacattgtattactattctagtgcaaaatcttttttagagtaactggcaatattatgaggtgatacgtgcattgttgggagggagaaaatcactgagagccctggttttcatagatatacatttgtattaaattatattactattctagtgcaaaattttttttagagtagttggcaaaattagttggcgaaacgttcaattttgggtgagttggcgaaacgtccgaattcggcttagttggcgagatatccagttggcgaaatg

SEQ ID NO: 107421 - DNA, 654 bp, Heterodera glycines
  Promoter: Source sequence=SeqID_18205; Location=1578..2231; Strand=-; Gene=SeqID_82801
ttttctggccaaaatttcatcgaatttcgtttggccacaaaactgatttttgtctcagcgtttggacttggcaaataatttcaaaaatcaaaaaattatatatattattttgataaaattaaggtggaatttacccgacaatgtttttcactggcattgatcgattgatcggaataatttttgatgaaatgtaagaaaaaaagggtattttccgttatgccgcacccccccccccctctaaaaatttcatgattcatagctaaaatcatagagtttttgcagttttggcgcccgattcttaattagtgcctaaaattatgctagaaacgtgcttttctttgtttgaatcatgccatttatagggggctgcggcatagcggaaaaatagcgaaaattaaaaagcaaattaattttaattaattaattaaatcagaatacaggcagaacacacggaaaatccgactctatttgtctatggtaacaattttttgttgtatggtcggcttaaatttgtgctatattttttaccaaaatatgtcattgtacggtgatcagatgatcactgggacaattgctgaacgcgctaattcaaatattttgtctaattagggctattcttatgaaaaaatcatacggttttgtaccgttttaatg

SEQ ID NO: 107422 - DNA, 771 bp, Heterodera glycines
  misc_feature (86)..(86): n is a, c, g, or t
  Promoter: Source sequence=SeqID_38329; Location=472..1242; Strand=-; Gene=SeqID_67177
tgacactttttttgtgaatattattatttgttcttatgtgtgtgtgtgtgtgttggacagctttctgctgctgctgctgctcttgngactaaaatatgaagccgttttaatggaattactatttgtttttgctaaatccacttaatctaatcatcgacgccggcggcggcagcggcgacgtcggccggcgatcaaacgaagaggtaaaggaggattttggcgattataaaagcactttgttgtacataaatgtttcaatatatacatacaacacatggcttcatcagtccattctaatcagatttagttaagcaaaaattgtttgatcggaatttccaatcattcattcattcggtttggggcggggggggggagtaattgtcgggagaagcatttccgggatagttaaactatttgattgatctaggaatttttggggccttattttatctttcaaaattggggtttatcaaaaaatgaatgtttcaaaaacatctcgactagaaaaatctctggccaaattgtttcttttcaacaaaaacgatcaaatcccatttgaccaaatcctggattcagccaaaatcagaaatctgatcattggttgattatccgggcattttttcgtgaaatctcattatatttttatcattttaattatgaaattaattgaatagcttaatgatgactcattagtgacaataatcagaatttgccaatatttaaattcaattttaaagggtttattcaatttttgtggacgcttattcaatg

SEQ ID NO: 107423 - DNA, 202 bp, Heterodera glycines
  Promoter: Source sequence=SeqID_29659; Location=1..202; Strand=+; Gene=SeqID_60132
tatattattttagcaaattttcattttccattacccttctttaaattttacaaggataatggcgcatactgtactaatttacctctgagatttgcatccaatagttttgcttaaatttttacgaattttcgacttttaaacctattgttttttatgctttcctgtaactctaaataatttgatcatttttttcagttttatg

SEQ ID NO: 107424 - DNA, 328 bp, Heterodera glycines
  misc_feature (67)..(67): n is a, c, g, or t
  Promoter: Source sequence=SeqID_2911; Location=1928..2255; Strand=-; Gene=SeqID_82305
tgtctccgccgtccgttcgtcggccgtcgaagggccgcctacctaggtgagcgcctgctcaacttgntggatgatgcgaccttgctaagcaaagaatgaactgtcaaacggaaaaaagagaagtgatcggagtgaaattggggaaaatttcagctgccgaaattttttttgggcatttttgccgtgccaccacaccttgtccagcttctccacctcggccaccgtttggtccacgtccgacgtgagcacctgcgtctccaccacaatttgagtgccagccggcaaatcgaccggcacacaaacggactccaccacgggcaccgtaatg

SEQ ID NO: 107425 - DNA, 1003 bp, Heterodera glycines
  Promoter: Source sequence=SeqID_73; Location=4770..5772; Strand=-; Gene=SeqID_62112
ttataaaatgcatttttgaatcaaaaaatattttaataattctattaaagattattgtggtgcatcaataccacctaatttgtcgctctttctattctctctgattctttatgagctttttattccattttttatagccctagtactgtgatcatccatataccggtatataatatattctgtcattttactctatggtaatcaattttattttggacagtcgtcaaagtgtgagtttcgcccttctgctgacagcttattttctttgcgaataaataaatattttttgactttaaatgcatattttgggctccctatcgttataaatcatttttaaataaattttctcttggtgataaacaattttttgggccttgtctgctccaccattcgttgtcataaatgttgaaaatattttttttaaagtgatttaaaagtcccaatttttaattggtaggatggggcaaattcgttttgtaaaatcaaatgatttgacgaatcccattctgattgatttgattttattgatttttttgctttcatttgagaatcggcattttattttttgagtgcatttaatcaaaaaaaattggctgaaaatgtgcgagtgattcatttaacaaattgatttgttttcgacaagattaacgcaaaattatatgaataatttattttattttgaccaaatggaatgtaaaatataataatgtaaatgcattttaccgctgttaaaataattttactaaattatttttattccccaataaaattattttttgcaaaaatatttagtggggatggttgagatattcggactcattatttcggattagcatgagaaattcgattttttggtcaatattccgaaattgaacatcgaaattccgatttccgagtgattttcaggcacctaaattaaaattccgagaaatcagacatagaggtcccaatttataaattcgaaactgatccagcttgtttaagcaaaacgaaatcctccatg

SEQ ID NO: 107426 - DNA, 348 bp, Heterodera glycines
  Promoter: Source sequence=SeqID_19918; Location=1..348; Strand=+; Gene=SeqID_84673
aaaatttccccctgggcgcctccggcatcgcctgaacatttatttattaggatattctatattttttttttaagtgaaattgattttaattcgttttaattaagctcaagtttcgggattgaagtcttaaggagccaaaagtcgagaaaattacacgaaaaattgggcattttttaagtattcaaaaaaataatttttgataatttttttcgagggtcttaaggtgccaaatttcgagaaaatatcacgaaaattcggattttttgtcataggcatgactatgtgccaggcaatcgttgtgagaaggagcagaccatcacggaagacattctgactgtgttggcaatg

SEQ ID NO: 107427 - DNA, 1003 bp, Heterodera glycines
  Promoter: Source sequence=SeqID_12074; Location=2086..3088; Strand=+; Gene=SeqID_75624
ggatcccgacccgggatccctcccgatcgtttttccaaaatgttcgggattgatcgggattcggtcgggatcccgactcgggatccctccgaccccagttgtccggtctctagtgaaaagtgatttggttgtcaattcaaaataaaaattcttataaattaatttagtaaattatgaatttattcaaatatttgattgactccttaatatttttgttaaaatataaattttttaatataatttttatttcttacaatgcgttgaattattttttataaatccaaaaatgttgtctgtttttgctttttgaaagaacactaaaattagccatatttttatcattctttttgttctatttatttttcttgggtattatatgtgaactagttgaaacttcctattattattgataataggtcgatccttgcatcgcgtttgcagggatcttcaaatcattatttgattgctcttattataacaaattagttattattcttattattctggggttgtatacgttaatttttcaaattattttcgaatatattcaaatttatactttatttatctatgaactactaataatcattattcggctgtacaggattaattttttatgttaattttcatctggttattctcctgtagttctgtagcattcgttatcacttatatgagagagatactaggcggcattaaacgggttatccgcaagagaccgtcctccccgtttccaccctttgcaatctctctgttctcgagctgctagaggagcatctcgctatcgcgcccgccccttgtcatgagcagcatcggttggcgcttgctcggcgtactcgctcgtcgctccgcttcgctccgctcctcgctcacacgcctcgaggggcagggcgcttcgcgcccgccccttgtcgataatgagcagggaaatgaaatggaaaaggaaaagggaaaagaaaagtaaaaagaaaatggaatggaaaagtaaaagaaaaaggaaatg

SEQ ID NO: 107428 - DNA, 545 bp, Heterodera glycines
  Promoter: Source sequence=SeqID_32385; Location=1..545; Strand=+; Gene=SeqID_62698
catagaaatgtaaattccgtttttctctattaacagagataaagaaaaagtccgccaaaataagagatgtttttttctctgcactctctatttattgacacatgtctctttttttgactcgctgtgtgtacagaatgaccattctttgatattccaatggtttgtgaccaaatttagcatgttttaatcaatttaggaactaaagtgagaattttggagttttagactttttgttcgaattcgggtccgggattcgaaatttgtccaatgaaggtcatattcgtgatcagcgaccctgaaaaccccccataaacatgtttccaagacttttcagaacaaaaaaactcttcgtcacaaggggggggggggggggggtaccatctatagtattacccgcttttcttcttaagaattgattagaaagtatgtgattacgccataaaaaaagttttccttttatttgtagaggctttatttccttttatcaaaacgaaatgcgccacacgcaaagcggcgggccaacgcaaccgccgaacggcacaatg

SEQ ID NO: 107429 - DNA, 1003 bp, Heterodera glycines
  Promoter: Source sequence=SeqID_8137; Location=1082..2084; Strand=-; Gene=SeqID_67098
gcgtaaatattgattggacgcgtaaactggaacagagccgaaaattgaatatattcaaataccattgggtaatgtgaaactataaaaagtttgcgccaaaaatagacacttttatcaattttttgactaaaaactgccattttttgttatttattatcaaaatcagacaaattaaaaaaaagatgaagatgaagatgaaaggcggaattaaggacaaatgctactccagtcagtttgtatcccattttttagtcaacatttttttcaactcatttttggattaaaagtttatgaaaacaaatattcgggggtttttgaggtcgctgaccacgaatatgacaattattttggcctattgaacacaccatcccaaaaaacgagatgtgtaccaataaatagagagtgcagagaaaaaaacatctctctttttggcgtactatttctttgtctctgataatagagaaaaatcgaatttacttcgctacgtttaatttttttctatacgttagatccactccaaattttgcatatcgatagagaaaaaaattacaaacaaaatgtaagggtttttaaacgcaaaaaaagggttaactaaaaagttattcgagaaccaaaatttcgaaccctaatatctttttcctattcaatccaattgcttagcagttgcttagaaaaagcttctcctcataaagagctttcgaatgatatcaagtttttccaatttggttgggaaaaaccttcaaaaataattcccaaaattcgtcattttttaatattttggacataaataaatgaaaatattcatgttgcacaacggactcgaaccaccaccctttgtccctttactatcttacaaaaaccactgagccacacacgcaaatcttttttggtacagcagctcatttctgggatggtgtgtgaagaattgaaaaaaaatttgatcaaaaaatggggtaaaaaaactggactagtaccggacaaatcttagaaacaatgcaaaatg

SEQ ID NO: 107430 - DNA, 96 bp, Heterodera glycines
  Promoter: Source sequence=SeqID_16902; Location=1..96; Strand=+; Gene= SeqID_81335
tcatttgaatgctttaatcaaagtcaaagaatgagtttgctgagaaaatcagtaaaaaaaaaaagattttctagcctgtaaaatattaagaaaatg

SEQ ID NO: 107431 - DNA, 950 bp, Heterodera glycines
  Promoter: Source sequence=SeqID_3486; Location=1867..2816; Strand=-; Gene=SeqID_47630
ttgaaggggaatggatgaaaaggattccaataaaacaataaaatatggattcacttttatatgttttcttatacactgataaaactattaagccatcaaaaattgtaaagcgcttcaactttaaaacagtttttgaattggttcaaaatgcggaaattagagatcggaattttgagaaaatacggatcaggatcgggattacggactaggcacacatacggatttacggaccaaaaatccggaaaatccgtactccgtaaaaatccgtatccaggaaaaatacagatacggattttttataaatttaaaaaatccgtaatccgtgtcttaatttatacggatcgggatcaggattacggattaaagatccgtagtccgtaaaaaatccgtatcggccgaaaaaaatacggattcttctaaacactgcaagagaaaaaaaatcgatcatgctgaaaaatctaatttcagcctaaaaaaagtatttcgcctattgcataagttgcaatatacctaataagtagggagtccaattacctatatggaaatctatatctttttcctggactgtgggaggcctgaaacgcacgaaaaacatctaaatttggattttgacccttaaagaccagaaaattttccaaaaagtcatttttagcgaaattttgtcgagaatattgattaaattaaatttttttttttaaattggttagtttatgtcaaaaataagcaaaaaagccaaaatttcgctttttgggttgatttttcgctaaaaatgagtaaattttagttgtatcatgtttttttcttctaaaatagttttaatgccatatttatagccatttttataagttttacaatattttttacactttgaacaattaatatttttttattgtttccggttaagtgatagtacccttattttataaactcaaatttgctgaagtatcatg

SEQ ID NO: 107432 - DNA, 838 bp, Heterodera glycines
  Promoter: Source sequence=SeqID_7203; Location=574..1411; Strand=-; Gene=SeqID_64126
tgtaaaagtgcaaatgttaattaaccgaaaataatactcctcataataaagcgaataaaaaacggagttttattatgtgctttggatagttgttgaatgaattcgacataattatacaataaaatgttaaaagggaacattccgagctgtaactcggaaaatccatatgtgttatatgccattcgatagagcagggccgacttctattgtgaatttttaattttagcggtgtctggcgtctagttcaaacgttacagggcctaaaaaatcgaattttaggccaaagagcccttttccatcttttttcactttctattaatttccaatctttacatttatcatttattaattaaaatttatttattttcatgttggatttgaacccgagctccaaaaatgcgaatttaaccaactgagccaccaattttaagtgaaaacacagccaaaattttgatttttgaggccctatacatttttattttttttttcacaaattgtgttctctatttgccttgaaaatttcaaagaaattcgtcaagtttaaaaaaagttatgacctgctgagaaatcaaaaaaaccaagtttttttttgaagagttaataatttttttgaaactttactaaactttttgaaattttgcaggctaattgatggcacctagagctatcgaatgatataaaaatttaaaaatttggttccttttaaacaaagttatatgaaaaggcccgtgttccgggaaatttttttcgaataatttcctgaaaaatcagtgaatcttttttttttaaatttaattaaattaaatttttaatttagttggaaaaaattgaccaaatg

SEQ ID NO: 107433 - DNA, 121 bp, Heterodera glycines
  misc_feature (10)..(10): n is a, c, g, or t
  Promoter: Source sequence=SeqID_9592; Location=1..121; Strand=+; Gene= SeqID_71991
atattgtcanaatgggcgagtgaatgaatggtcattagccattagccagggcaaacaaacggacacttttcggagtcaaccgaaaagtgaagtgtttgtggccatgacaacagcaaaaatg

SEQ ID NO: 107434 - DNA, 1003 bp, Heterodera glycines
  Promoter: Source sequence=SeqID_7400; Location=3042..4044; Strand=-; Gene=SeqID_64709
tcaccaaatattaacttttccaaatgcccacaaaagggggaatgcgattggtttatttgtgtttaagaattaagcaaaggaaaaaggatgaaaagtaaagtaaattggtttagtgtgagatgagtaagggtcaggatgagaatgggaaaagaatggttaaaagcgagaggcaattggggagcttaaatactgacataatgggaggggccaagcgagtgacattacaaaatggttggccaaagagaaatgggaaaatgggtcaaattgagtgatggatttgtggatgaatggcaaaggaaatgttttgggcaaaaatgagaaaagggaaaatgtccgaaaaatccaaaatgaaaactgaactgaatcgaaacccaacagtttttttttgaaattccgattaaattgaaaagcaaataagtgtaaataatgatagaaatacaatatattgctcattatgtatattttgctgttgttggcacatttttttaggaggatcccgctttgcgtgtccatcttgttggtgatgacccgcgacgtccaaggcgaggacaaccgaagcaattggtttcgtacgaagtgggggtcagttaaaaaatacgttttacaatattgaaatgcaccgtttaaaatgacaagaaaaaaaatatgaaatttttcatttttttaaataaaaaacctattgaattggaacaatgctcacattcagaatactagcaaatctgaaatttgaaaataaatttacggaagtaaaaagcactttttttaaattaattatagtaaaattgaaattaaacataaataccatcaaagaatctttgagcgatggcaaaaaattggcaaaaattagaattttttttaaattaaattaattgcgttgagaatgttggaaacaaaattggcactcaaactgcaattttcatttttataaataattcaaaaaaaaaaaaaaaacttttttaaaatttttttctatttcaactgtgtatgtcattattgacagatg

SEQ ID NO: 107435 - DNA, 308 bp, Heterodera glycines
  Promoter: Source sequence=SeqID_42022; Location=676..983; Strand=-; Gene=SeqID_70035
gctgaaattttgagaatttcaaagtgataatgaaatgtaaatagagaatctcacaatttcagctacttaatctctaaataaatactgcagcaatattgtagaaggatcgggttaataatattctctgatttattattttcactaccatccttgtgaaattctcaaaatttcagctaattatcatctaaatataaactctaacagggttgcggaaatattgagttgatagcgccaatattctccgacttattattttcacgaccatctttgtgaaattttcacattttcagctcattttcctcaaaatg

SEQ ID NO: 107436 - DNA, 428 bp, Heterodera glycines
  Promoter: Source sequence=SeqID_11926; Location=2763..3190; Strand=-; Gene=SeqID_75444
acatacataagttatatgtagaatttattttaaaatatttgtatcactgacacatttttactgatgcatttcaggtgccaatcatttttgtgaccccctgaaattttttttataatattttttctaggttaattttatggaatttatagaaatgggtgtcagattttcgataattcccaggttttacacacatttttaaaaatgttcaattatttttcgaaaaatgggggggggaggggacaaagaaacctattgccgacgacaatacagtagtttactggtcaaaaaatttcacaaaaaggataagtacccattttccgggagccgtttttcctcttttagtttctcggacaatttcgcttgaattcgacggcaatttgcgactttttttactgaagatccgccccttatgtcgccggcacagaatg

SEQ ID NO: 107437 - DNA, 246 bp, Heterodera glycines
  Promoter: Source sequence=SeqID_27654; Location=1..246; Strand=+; Gene=SeqID_58333
ttaaaaaaaaaatgttcataggtcaatttctgcttcgcccacgtgacttgcaccaggtgcattgaatagggcatatgggaccaggaattggagaaggcctgcgcgctttgtggccgattccgaacttatgcctggtccccgttcgaattctggcacacggatgtggaatgccgcaaggtcgtcgaagacccactggctgccttcaccaagtggttattgaacttcgaaacggtagtcctcggcatg

SEQ ID NO: 107438 - DNA, 59 bp, Heterodera glycines
  Promoter: Source sequence=SeqID_39468; Location=1..59; Strand=+; Gene= SeqID_68037
catttacgtgtagcaaatgtgcgggagtaacaaaaaattgcgaagtatgtaaaacaatg

SEQ ID NO: 107439 - DNA, 185 bp, Heterodera glycines
  Promoter: Source sequence=SeqID_1304; Location=4990..5174; Strand=-; Gene=SeqID_72162
cgtgatgattcccgatctcgtgggaatccttctaagatttgcagatcttccgttgggctcggattcccttcggagtaatttcttcgccatttattttggctgcagttgtccagaagcatctgaaggagaaagcttcccccttggcgttggaattcgctgggaatgcctttgtggacaatctaatg

SEQ ID NO: 107440 - DNA, 129 bp, Heterodera glycines
  Promoter: Source sequence=SeqID_32528; Location=651..779; Strand=-; Gene=SeqID_62840
aatgtaagatttgttaaaatattttaaaacagtctaaattgttttttttaactttaattagagctcgacctggatctggatcacaaggcctgggttgttgtcaggaaatccaggtccaggtcaaatatg

SEQ ID NO: 107441 - DNA, 74 bp, Heterodera glycines
  Promoter: Source sequence=SeqID_36496; Location=1..74; Strand=+; Gene= SeqID_65792
taaatattatatataatattataaaaatgacttttcattttcttgttttaatgaatcccttttaaatttagatg

SEQ ID NO: 107442 - DNA, 190 bp, Heterodera glycines
  Promoter: Source sequence=SeqID_18622; Location=863..1052; Strand=+; Gene=SeqID_83275
aaaacataaaaaaattttaaaatatggcattcaaaacaggcatagataagcctgttttttgttacacctattttggcatttttagttaatattgaacgcacattgttggagtttttagccccataaatccggacataatttttatttatttaattatatttaaatatttcaataaatattattagtaatg

SEQ ID NO: 107443 - DNA, 459 bp, Heterodera glycines
  misc_feature (23)..(24): n is a, c, g, or t
  misc_feature (87)..(87): n is a, c, g, or t
  Promoter: Source sequence=SeqID_14876; Location=1..459; Strand=+; Gene=SeqID_79023
tgaagcgcggaaattttgtgacnnatcgcaatggaatggtaaaatacttatttgctttctgtatacttcttactatacttcattttntcctaaagaggatactgtagcgttttccatttctaccaatatttagaccatttttctgattccacctctctctctgtctttctctttctctctttttctctccctatttctatcgctttttctcctctctctcgcttgctctttatctctaccgttctctctcactcatctctttgtctctaccattctctcgctttttctcctctctctctcgcttatctctaccgttctctctcactcatctctttgtctctaccattctctcgctttttctcctctctctctcgcttatctctaccgttctctctccctcatcaatttatatctaccattctctctttctcctctttttttctctctaaccccaaaatg

SEQ ID NO: 107444 - DNA, 173 bp, Heterodera glycines
  Promoter: Source sequence=SeqID_6392; Location=4852..5024; Strand=-; Gene=SeqID_61366
ggtcaattttctttcggcacgtattacgtgcaccgattgctgtgaatcgtcagagtcaaaaaatgactgtgaaatttgctgtcaaaacaatagagtgctggagcgagaaaaagaatggtgggatgtgattgagaaaataaacttaaattcagataataggagtgaagcctatg

SEQ ID NO: 107445 - DNA, 100 bp, Heterodera glycines
  Promoter: Source sequence=SeqID_10260; Location=463..562; Strand=+; Gene=SeqID_73418
tatttattgattttttgattgccaaccttcaaatgaaatgcttttcctcaattaaatatttttcgtcattcattttatttaatttgccaaaatttcaatg

SEQ ID NO: 107446 - DNA, 147 bp, Heterodera glycines
  Promoter: Source sequence=SeqID_30483; Location=521..667; Strand=-; Gene=SeqID_60890
ttccgcaattcctttccgtaaataaacgtcattttgcattcattccttttctccccccccccccccattttcagtttgttttgttggccttggtttaagcattgatcagcccgtcttctcccatagtccgaataatttcatccaatg

SEQ ID NO: 107447 - DNA, 858 bp, Heterodera glycines
  Promoter: Source sequence=SeqID_10661; Location=160..1017; Strand=+; Gene=SeqID_73901
tctttcgcaatttaaacgtttatatagttttctctccgtcaggacgccgataatgttggcagtttattgggtacttaggcactttagaccataaaaaaaatttctttttaaatcatataaaaaatttctagggggttttcggggtcgctaatcacgaatctgacatctatttctaccaaattctaactccgaatctgtattcgagttattttcgcaccataaaatgattttttgaaaatttgaattttcaagtttttgttcgaatacgggtcggggttcgaattttgtcgaaatggatgtcagattcgtgatcactgatcagcgaccccaaaaatcctttagaaaatttttatatgatttaaaaaataattttattttttatggtctgtaaagtgcataagtaccgtttattgcgctgtgaaaacgagtctaggtattctcggttgccgagcttaaaggttcttcattcgagctgggattttatgtaaataaataatttttcctggatttctacacgctctaattcccggattaaaattagagatttttcatcggacgaattctagtgtttttggcaaattttatttttacaccttccgtttttcggattgatatgcgaaaatcggatttgaatgattcgattaaattccaattttgactacataggtattttaactaggtataatgctggcaatcatggagtttactggtcccgttttttttgcttttgaaaatcttggaaaatttttctaattgttctctttgtatagcgccgctaagcctatgtgcaaattgtctgtgttgtatgagttgctattgtacgttttaccgtgacaccaatttcacaagagagcaatg

SEQ ID NO: 107448 - DNA, 88 bp, Heterodera glycines
  Promoter: Source sequence=SeqID_1279; Location=8147..8234; Strand=-; Gene=SeqID_46755
ggtcctcctctttggatgttttgattttgttttcatctccgtttaggctatggtttgcatggtgaataaaacggcaattacattaatg

SEQ ID NO: 107449 - DNA, 1003 bp, Heterodera glycines
  Promoter: Source sequence=SeqID_2415; Location=975..1977; Strand=+; Gene=SeqID_79610
aatttacactggaaaatgtcttttttgtattttttattttgatctgccataactcgcttcattcccaactaaactgaacaaatttggtatttaaaaaaagtttttgaaaaggtgaatctttttctaagcgaatgctaagcaatttgacatctcagaaaaaagttgtgatactttcaaatttttatcacgttataactcaagtcctaaactgctgatttcaaccaaaatgcgaaaactaatcatttttctattggttctaaatgtccaaagtgaatttgtacccgtataaccaaaattataggaatttgcgaatttgatgttttttcatgtgttagagacttgaaaatagtacgccaaaatgagaggaaaaagaaatacgtttttattattatttacaacttttgagtttgaccatagacaaaattaaattcactatagaaagatgcagaattcttttctctatcgatatgcaaaatttggtgtaggtttaacgtatagaaaaaaagttaaacgtagcgaagtaaatgttactttttacataattaaaatgaagagatagtacgccaaagtgagagaaattacaaagaaaaagagaaacgacgagatagtactaggcttttctctgcacagtggagttgacccatagtgcaggggcagcagttgaagtgaaagggacgcggtgaagaggacgtcgacgagcatcgcagggaattaaataatttgtaattgaggaatgatgaggatgaaaaaaggtgggaaaatcgcaatatttatactcaattttcatttttgagttacaatttctaaacaaaactttttgttgctaccattttcatttaaatatagaaaataacaaaaggaattcctcagtcaatctcaattccttcttcgccgactgttccattctcaaaagcgtcgtaccataacgtcaccctcttcataaccctgtagatttttgtcatttgttttacttatttgttctaatttcaattttttcagcatg

SEQ ID NO: 107450 - DNA, 1003 bp, Heterodera glycines
  Promoter: Source sequence=SeqID_13324; Location=369..1371; Strand=+; Gene=SeqID_77189
cccctggcccattccagcatttttgggtccatatgataaaaagctgaaagtccctgctcaatttggggagggggttggtgggcttttagtccgcgagatttttgaaacgaaatatttcctaatttgtaagatttaagcaaagacgcgggcggatgggcgagcctttgtctgccgtcgcgccaaaaggcgttttgtccggacaatgcgtgggacgcactcaatgtttggcatccgtttaaaagctcacaatcagaaatcaaatcgctttttcgtttttctttacagtcccttggagagaacgatcgctttccgttctgttgatgggcgaattgaaaaggaattgaatttgttggaaaatgctaattttaatcattttttattgtatgttttttaatcaattctcgacaaattatcccaaaagcaaatacattttagccgtttcagtctctgagggggcggggggggggggggcaattgcgaattgcctaagcatggtttaggggtcctaattgtggattgctgttacgaattttttcgattttgcgcaattaatccgcaattttgaacattgtaagaatgaggaactgagaattttgaataaatttataagtatgcaattttcaatgcattaaaaattaaaaacaactaattcaaagtcgtttttagataacttttgttaaaaacccgacatgtccctgctcgccactatttcccttaaatctttcaaaaattaattaaattaacataattttctttaaaaatttttattaatttcctttacattaaaaaaatttttatccgatttttgttgcatatatttttacagcattacaattattgaatatgtggcttaattgattaaatttatatcattaagcttctcatgaaaatattcaaattaagaaaaaaaaattaacatacaaatttaggaaatggcattattatttgaaaatcatcaaaattttataatttaattattttatatttaaaaaatagataaatg

SEQ ID NO: 107451 - DNA, 344 bp, Heterodera glycines
  Promoter: Source sequence=SeqID_5568; Location=1..344; Strand=+; Gene= SeqID_58509
cagcagtagcagataacgatatttcaccatttatttgggcttcttctttcccttttggtaataggtaaataaaattggctttttctaattccaaacaaaaaaagacccaaaggtcatttaaattaatttttatttaaaaaaaggaaaataaattaattgcaaattttctactttaattcgcattaattttaaagcacagggaatgaatgaatgggtgccaatttggcaattggtcgttctcagcctggcccaggtattctgtccaccgcgtgtttcagtttcatgtacatttgactcaccgggttctgccgaattgcttaaattggaagtgtaactcattaatg

SEQ ID NO: 107452 - DNA, 497 bp, Heterodera glycines
  Promoter: Source sequence=SeqID_73; Location=8069..8565; Strand=-; Gene=SeqID_62113
acggatttctgttcccgttggcccttgggaaaggcactttaaataaaaattggaaaaaggtctactgtagttaaaaaatgtattgtggtttgtctattgtgttgtggttagtatgggctcaaaattctgcgcctcctcgcggtgagtccggaaacagttttatttttaaaatattaattaatttttttgcaatggaattaactctggctaaagcagacgtaattttgtctaattttgtggcttagaattaaatttttaaattttttttttgttttattgaaatccccaaatgtcgggtccctaaatgtcgggttgccaaatgtccgtggttttcttaagtgtcttttgctcaaatgtccttcggtccccaaatgtcgggtccccaaatgtcttgatccccaaatgtcggatccccaaaagtcgggtccccaaatgtcgggatccccaaatgtcgggatccctaagtgtcggatccccaaaagtcgggtccccaaatg

SEQ ID NO: 107453 - DNA, 363 bp, Heterodera glycines
  Promoter: Source sequence=SeqID_8081; Location=4406..4768; Strand=+; Gene=SeqID_66925
agtacatttatttgcataattttagattgtatttatattaaattgtcccagatttacaatttccacaaattttaaaaaattcggattggatttaaagcccgctttcccgaatttaaatcctgattttgtcggggttccgattccgtttcttttttcaaacaaaactgggatcggtaacccgggaaaattcccgtccacgttctagtgcacgaaaaatacattcgatgcaaaatccattacaattttcaaaaaaaaaaccccgtttttggaaactccttcctgtttatcctgacaatttttatcagcgattcaaatattatgttataaaataaaaatttttatagggattattcaacgttgatg

SEQ ID NO: 107454 - DNA, 967 bp, Heterodera glycines
  Promoter: Source sequence=SeqID_222; Location=8753..9719; Strand=-; Gene=SeqID_78404
agctaatcaccaacaatcgtccgcaatgacgttaaactagcctaagccatcaacaactgtccgaaacgctaatcacccggctgctacgagtccggaatgacgttaaactagcaaagcatcggccaacccacacaacaatcgtccgcaatgacattaaactaaagaaccaaccaaacaacaaatgtccgcaaagacattaaactagaaaagcaaacaacacatgtccgcaatgacgttaaactagagaaacaaaccacccaaagtccgcaatgacgttaaactagcaaagcatcaattgtccgcaatgacgttaaactagcaaagcaccggccaccaagcaaccattgtccgaaaagacgctaaactagcaatccatccgacggtcagggtccgaaatgacgtccaacaagcaacgacaattggtccataaggacgttaaactacgtcaccaattcaagcaaaagcactcgagcatgcagctgacagcacgtttccggaagcaaattcacatgtcctcaacgattgaggaggttcagcagcgaatgaaccacaacaggccgcaaccgcggaggtcacaacagaggagactaaggccaactcaagcgcctaaaatatgccaatccgggatcgcacagtacaagcagggtcgagggatccgccttcaccctgcgtcttctgcaatggcactcactggaccacgacgatgactcagcgaacaacccttgcaacgagagcaaggacacgaatccagtacgtcaccagggcgagaacgcagaccacgaaagagccaacgacacgccccagatcgctcccccgccatcactcactgctcaatggctcaacctggcaattgagctcttcgcaaaaaatcatcaagcccgagcagatcacctttgcatggcattgctccttcgtcaccatcgagaaggaatttccaccggtcaacaagcggatctgcaaacaaatg

SEQ ID NO: 107455 - DNA, 828 bp, Heterodera glycines
  Promoter: Source sequence=SeqID_12517; Location=2563..3390; Strand=+; Gene=SeqID_76164
ttgaaaagtgtcgccgcagaaaatgcgggcaaaatttgctgatcaaattgttccaattgatccttcgcgatgccattctgttgtatttgttgttgttgctgctggaggttcaacaacagaagcaacgggttcagctgcagaaggggcggcgacgacggcgaaaggccgtcgttggcaattgccgaaaaatccattggaattgtgaaaaatataaaaataataattataaaattaagaaatattttaaaaggcattaggtaaatggagaattttttatgcaattattcgaagacaaaaaagtggcaaatggccttaaaaaagaaatgggcaaagtgtccatttgaatggtcaatgatcagtgacaaaagttgccactccactccaatcacttctcccattttggtgggatttgtcagagggcaaaatgaagaagaaaaaaagatcaaagcaaatttaccgccaaagagttaattactccgtttgatgggaatggcggattattagcaaaaggaacaatttttccatttgcttttacacccaaaacaaagtgaattttcatgttaagaataaatttttatgcaaaaagaagtgacattttacagcaaaaaatataaaatgataaccattttattatatatttaattttgctgattttatttttattttcttaatttttcaaattaaaatacatttttataaaatggagtcaaatccctgctctcatctcaccaatatattaagaagataaattaagaatttgaacacatcggtcgaatataaaagaacgaatgattggattatacaaaataaaacaaaacataccgtatg

SEQ ID NO: 107456 - DNA, 124 bp, Heterodera glycines
  Promoter: Source sequence=SeqID_23009; Location=978..1101; Strand=-; Gene=SeqID_45750
ggaagggggcgagtgattgcgctcatccgttgccccctcccccatcccgtcacacattttgcacaatcattctttttttccacttgctactgttggtgaaagccgtcctttcgcgttaaggatg

SEQ ID NO: 107457 - DNA, 85 bp, Heterodera glycines
  Promoter: Source sequence=SeqID_5031; Location=835..919; Strand=-; Gene=SeqID_56639
ccccccccgcctccattatttcactgcatttctattggaatttggttttaattttttaaaatttcagcacgaaattcacaaaatg

SEQ ID NO: 107458 - DNA, 209 bp, Heterodera glycines
  Promoter: Source sequence=SeqID_28150; Location=306..514; Strand=+; Gene=SeqID_58799
actccatgattattggcactattaaatatttattaaaatgaattttctacatcgtatttttttttgttttgaaataaattttttaatttatttatttaagtttaaaataatatttggattaatattagcaaatttttttatccagataattaattacataattaaatcaactaattacctaattaaaataacattaatcaccaggaatg

SEQ ID NO: 107459 - DNA, 382 bp, Heterodera glycines
  Promoter: Source sequence=SeqID_242; Location=2260..2641; Strand=-; Gene=SeqID_79585
tgaatttccgatcttttgctcgagttcgggtctggggttcgaaattggtcgaaatggatgccggattcgtgatcagcgactccaaaaacctaaatattggtgtgtgttttgcttagaaagtgagaaaaaaattggaatttttttttatttcgaaaaaactaactaatttatcataaaatttcaaaaaaaaaatcctgaaactttttcaaaaaaaatttattgataaaattctaattgtaactttaaaagcttttaaagatttatgcggcgagatttttgtctcggcgagatttcgggcggcgaaattttgtgccgtcccctttctaaacgcatcgccaatttccctccccccatttagcaattcccccgtattttctgcatg

SEQ ID NO: 107460 - DNA, 1003 bp, Heterodera glycines
  Promoter: Source sequence=SeqID_9116; Location=1394..2396; Strand=-; Gene=SeqID_70299
gtgaaccttctctggtatagccgccagaggaacccgaaattttacaagcttaaatgaacaatattaaattatttgcctattgattgaaaagcccaacaaatttgctctttatgcttcaactgacagaaaaggcaaaagggtggcggttaaataacagtcaatttggcctccgtcctcgctttatgattagtcatttctttctttcttttttcgtgcttcgtcatcgctctgcgaagcgatgacaaaatatgtaaataaaatatgtataaaaaaatgctaaaatgtgtataaaatatgcacaaaaaccaacaaagaggtattaaaatatgttaataaaattaaaaaaaatttttttttttggaaaaattatttgtaaagggttaaataagcacaaagcttagaatcattttagtataatttttgtttataaattttaaaaaattcaaaggtcgtaaagaattgaaagggctaaaaataaacggatttttgtggcgcgaaaatattttaggactacgcaaagcggggaaagtcgcaaaaagcgggagaggggtgaaaaagccaatccaattgaaacgaatctgagaaatcggtgaaccgattggagaaatttgtggcgatgaaaagcgcggaaaaagtggaatttgcgatgaatgaattgagacaattgaacaattgaaaaggaaggaatgaatgaatgatttgttgtggtaaagcgggggaaaagcggggcaatcaatccctatgaatcgagggaaaatttttgggtgtcggatgccattatctttttctgaaattttgaaaaaagattggaagttttcggaagtttatttttgattttttcaaaaaattagaattttacggttatcatagaaaaattaaaattgacgcaaaaaactaaagtgctcttttgactgaacttttgtcattcttatggaaaagtgacaaagcgagttaagtaaaattacaacaaatttttcttcagctaacactcgcccggcaaatg

SEQ ID NO: 107461 - DNA, 147 bp, Heterodera glycines
  Promoter: Source sequence=SeqID_2799; Location=2693..2839; Strand=+; Gene=SeqID_81667
gcaaagcacacatcgatcagtgaacattcactcatcaaaggaacagcagcaagagcgcaggtgacagactcagcggaagcaccgcttaaccatccgttcagccgcttcacctccccccccccccattcggttcagacttcaacaatg

SEQ ID NO: 107462 - DNA, 301 bp, Heterodera glycines
  Promoter: Source sequence=SeqID_21353; Location=819..1119; Strand=-; Gene=SeqID_51955
ttcttcttgtccataacttttttgaaccttaacgagattttccgaaattttgcatgctaatattggcaaagaaaaaagttatagccaaaaacttgtgctcgtacgaaaacggcccgtgccaaaacgaccccgacccgtttttgttaccttttatttgtttccgattatttaatggtcatttaaattttacgacagtttttgtttgaatttgggttaaatgatcaaaaaataatcctaataagaatctgttttatataatagtttaaatcaatttttaatgtttttgttttagaaagcgatg

SEQ ID NO: 107463 - DNA, 299 bp, Heterodera glycines
  Promoter: Source sequence=SeqID_25140; Location=1469..1767; Strand=-; Gene=SeqID_55865
tttatgtgcatatttttcattttttatgtgcatatttttcattttttatgtgcatattttgcaatttttggtgcatatttcatgcgcatattttaagatttcatatcatcatttatttactgtatgtactaaaattttgaaaatgtattttttattggttcggcgactgttaaggcgatcctcaagagtgtttcttgctttatcggtaaaattttgtgcattctgactggttttttgtgcaaaaataaaatttgtgttcattttagctcatctttttcgttttttgccttttgtacatg

SEQ ID NO: 107464 - DNA, 554 bp, Heterodera glycines
  Promoter: Source sequence=SeqID_26418; Location=817..1370; Strand=-; Gene=SeqID_57153
gaatgccgagattttgaaaatgcaattgtttttatgtgaagccatttttcactatcatgcttaaaagttttagaccaaatattggaagaagaaaaagaatgtttgttgcataattctttagaagacaataaaaatcaaaacaaaagcaaagaaaatttggaaaaaatgaaacaaattttgccagaaaataaatcgtatgaagctgttgatcatgttggggcatcttcacaaatatccaataatggtgatcaacacaagcaatcattcaataatagtgaaccaacttttttgataggtaaatttttcattgttaaataaaataaagtcagaaaatttaaattgtatttattaaaatttatttgaaaatttatgtttatttatttttaatattttattcaattgctgagccaaattctatctaaaattaagtgaaatatatttaccatctgtttatcaatacactgaaatgtctggtgccagaaaattttttatttgcaaccgccgccgaaaattttttggaaatcattgatggcaaatcaaagtatttggaaatg

SEQ ID NO: 107465 - DNA, 1003 bp, Heterodera glycines
  Promoter: Source sequence=SeqID_5512; Location=367..1369; Strand=-; Gene=SeqID_58290
tttgtctattttttaagcatttataaactttaaaagttactaaaaatatataaatttgctttttaggtgccttttttaaaccaacgaatttttcttgtaaattaccatgcccaaagcaggaattgcttggttaaagttgatacttagcacgggagagtatttcagttcattcgggatcaaaaaatctgctgattttttaaaaatttttgcggcgcatttttccaaaaaacttttggtgaatgggcgaggggagtgggtacggcggtgccgaatgtcaccgccgcaaaaaatttcataattttcgttcagatttgttaacagattttcacaaaaaatgccaattttgcaattaaaagccaagtgacgactttttttcgcttttaaaaaagctttttttgcggcgcgcttcttccaacaattttgggagacaaggggggtccggcggcgccgataggtgccgccgggaagaattttgtgatctaatgcgatttattaacagttttttgtccataaactttcaaaccaatcatttgatcgattgatggatagaaaatctgaagtaaaaaaacagaacatgttttaacaaagttttgagcttttttcttattcgggtgggtccagggttatgaattaggttgtataaatgtcatattcgtattcagcgaccccgaaaaccctaaaatagacccgttttccgggtttttacgagctttttcgagtattggacacttacgtggttttttactcttttggactcgtggcttagacaatttgtgggtcagcgctcatttcagcataagcatgttgtggtttatcagaaagcattaatatttccctatttttccactatcccagcccctgttgctcttcacgtgaatccgagtatataaagccggccaaatccccttccagtcatatccaatcagcccattcacatttgtttgaaaaattcttttttcagttcatttctttggaaattttgtctaattactcgcaaaaaatg

SEQ ID NO: 107466 - DNA, 542 bp, Heterodera glycines
  Promoter: Source sequence=SeqID_15257; Location=2751..3292; Strand=-; Gene=SeqID_79470
attcgggatggaaaaaaaaatttaagtttgcacccgattttggacataggcgcaaatgtggtaagcggcggaacaggacaaaacacacccgtcgacgaaacacagccgtcgacgaaacacagccggtaacaaattttttaaaaattttcgttgcaaattctatgacaaaaaaaaattttcaaaaatttttagcgattttttttgaaaatttaaattttttgaaattcttagaattcgtcattaaatttttgaaaaaatcacctgagaattttttgaaaattttttttttcatagaatttcctaagaaaaaatttctaagatttttttcttgaaaaattgctgtttgaaaattttttaaaaaatttattcccggctgtgttatgtctcgactgtgtttcggcggctctgttttggggtgtaccgggtaaccggaccactcatgtccccaaaaaaaaaaaaaacgtgcaggcagcaaaggtcggcccaccaatgccgctgctgctgctggtggtggtgcgtccccttcctacatcatcccaatg

SEQ ID NO: 107467 - DNA, 577 bp, Heterodera glycines
  Promoter: Source sequence=SeqID_21967; Location=637..1213; Strand=+; Gene=SeqID_52599
tatttcaatgataatgcttgacaaaattataaattcacaaaaaaaaattactaatttaataatttaacgaaataaattttatagaattaatattttttcgattaataggaaatgttttccaacgctaataattacgtattaaaaaattaaaagccttggatttattaccaaatctgcaggacaaaaatatgtaaaataggacaatttatgattaaatattacaaagattttcatttccttaggacaaacataaaaaacacaacacacatttaaaaaaaattagttatctttttaatatgttaatttttttacaaaatttaatcgaataaaaatatttcgtcatcagtgccgtctgatcattgctgatccggcagctgaaatcaatgccaatttgacgtgccaaatttcgcggcacttttaaatattttttgcgtaaaaaacaaactcgatgtttatctggcatatggcaacagcaaatttgtcgtagtgatctgtgtcaattaaaaaggtgtgtaatttaacttcattatgtaatttgggaacaattaattaattgcatgctaattgttacaaaatg

SEQ ID NO: 107468 - DNA, 762 bp, Heterodera glycines
  Promoter: Source sequence=SeqID_40750; Location=538..1299; Strand=-; Gene=SeqID_68997
gaaatcaaagattttcaaaatctgagctcagattcccttctagcgcattttttaagcctagaaaaatatccgacaaacttttaacattttttttcgtcgggacaccaattattaatgattgccccctttttgatggcttttttataacgactagagctcggcctggacctggatccaggcctggatttttcctgaacctgtattttcctggatttttgtacaggaaatccaggtccaggtccaggcttttttcaaaataccgagctctaataacgacatagcaccgggctgggttacctatgttcggacttgagtaaagtaagtgatttttgctgtattattttttcatgtttattaaacatttaaatgaatttcaatttagaattaattaaaattaatttttattaaaaataagattttaaaaaaataataattccatttatcccccggggggataaatagagacgggaggattatttttcaacatcctcagaaagggggacataattggagacagcgggattaatggagacagggccttaattagagaatatacggtaatttaaaagttttggcttggcatatccccttttggagataacaaaaaatcagcacaaatgcacttaaatgggccaacattttttgtgggaatgatacatatagcacagggatggcattccgaggccccaaaaattttttggaagtcggaattccgtgtcacccctggtcgtaaaataatgccaatttcagtgtgatcccatg

SEQ ID NO: 107469 - DNA, 1003 bp, Heterodera glycines
  Promoter: Source sequence=SeqID_11158; Location=202..1204; Strand=-; Gene=SeqID_74509
tttagtaagagttaaagaatttatacaaaaaatatttttgacaaaatttaaaaaaaaagttttaaaacagattttcgaactaaaaatatatgtacaaaataaattgtaaattgtgtacaaaaaaatgggaaatagtttagcattttcctaattaattgattacttaaattactaatgaagtaaatttatttgttgatttttttaagcaaaataaattgaaaaattaattaatttttcaaaaaaaaattcaattaaacttacaaatttattttattttttctttaaaagaatttaatttgaatgtttttagatttctcgatctgcaattaccctagagccacacagctcgatgggagggatatatacggatttgtattccttttgaatacgaggggtctctcgctttctctattttctttctcttttccatttcattcattccttctctttcttcttctatctcatcattatgttaatccattttatattctctttctctagttttatttttctctggcactctctctttattttctggcatttccctctctctctctctctatatatatctatttttctcggtttctctctttcttctcaccccccccttctctctccccctgtctctcactctctctctctctctttactttctctggttctatctttattcttcccctctactctttctctctctctctctgttctctctctctctttctctctctctctatctctccctccctttctctctctctctctctcccctttctctctattactttttttctctcttccattcacttccttttcacgaccaattggctatgcaaatttcattgtttaatagttttgttaactatcaatcatccactaatttattaaggtcatttgattatttaccctgcttttgtcattgaacataactaaatatttaaattgttcatttttcaactaatttgatttttctaaagttttccgagctcataaaacatacattatg

SEQ ID NO: 107470 - DNA, 680 bp, Heterodera glycines
  Promoter: Source sequence=SeqID_20672; Location=1..680; Strand=+; Gene=SeqID_51234
tagcctgtaaaaaagatatagagaaaaaactccaaaaatttcgactttttcgaaatttcatgtataactttttggtaattgtctaattgagaaagcttattgttaaaaacagcttctaaacatgttaagctttcgaatgataccaagaattttagatttgatcgacaaagaaaaaaaaaaccaaaatacaaatttttcgagttaaatctttctgtttattttcttcatttccgcttttaattgcctgttttttttcttcggcacttgtacagaataagttgctctaacaaaaaatattaactgtttggctccctttgatttccatctctgaaataaaatatacttttgaaaattaaaaaaagacgaaataaaatacaatccgagctcctgataaagtaataaaaaaaattttttaaattcgatacctaaatggaaatataaacagtgacttttcgcttttatacccaaatttatatatgccgacaaattttccggtcattcattttcccttttctgtgaaaaccacactcaaaaacatataaatatggtcactttttgattcaaaaatcattttctccatttcttcaacacaatttcaatttgtcttctaatcccccccccaatttcatttagcttccacacattttgccatctgtcaaccaatcatcatcatcaacatg

SEQ ID NO: 107471 - DNA, 201 bp, Heterodera glycines
  Promoter: Source sequence=SeqID_27249; Location=1647..1847; Strand=-; Gene=SeqID_57934
tctagagtcatattatataatatcttctgccgttatcgtaaaaaaaactgtctattttcattacaagttaaccaaataattgagagttaaagctcaaaagcccaaaaatttatggcattattttttatttggcagttatgtacgaactaattagtataatttttttaaatttttgaccgaattcagcttgatgacgtcatg

SEQ ID NO: 107472 - DNA, 813 bp, Heterodera glycines
  misc_feature (23)..(23): n is a, c, g, or t
  misc_feature (62)..(62): n is a, c, g, or t
  misc_feature (101)..(101): n is a, c, g, or t
  Promoter: Source sequence=SeqID_8794; Location=2342..3154; Strand=-; Gene=SeqID_69250
atttttaaaaaattatttctcangtgacgaactaaacagtgacgaaacgatcggccactctntaattaagctttcttgcgagcgaagaaataaataaattntaaaaaatcattttcaaaatttgcctacttttgaaatttagtgaagcaaaaactcaaattaaatttattagtcattgagcagtcgacaaaaagcatcgtcgccaaaagtgtgtgatctgctgacgccgatttggccattccatttttctttggttagtcgtgttgcttttgcttcttatgacaatgaaagtggtcgcccatttgcaccatatgatcagcgaaaatatgatgcggacacttcagacaaagcaaaaatccttttaaaaggccagaaatttgattcatttgcgccatttcaaaaaatttaaaaatttttttaaatgagagtcatttctcgattttaattcattttttaccaaattaacattagcataaattttataggtttgcccatttttgtgacaaaaaaattaaatttatgattgtattaagaaaatctcttattatgttatattaactgtgttagcattcgtccagacaaatattaggcattaacatgaccatgaatattaaataaatgacccttgtctgctaatgaatgatcatgacccgcggcgcccaacattcattagtcagcgccactcgccgtggtcattcccattctaatgaatattttaaaaaatcacaattctatgaataaaaattcatttcaaataataaaaatgcattaatgacacatgaatattatcagatagcatttgtcataaaaatg

SEQ ID NO: 107473 - DNA, 79 bp, Heterodera glycines
  Promoter: Source sequence=SeqID_32947; Location=758..836; Strand=-; Gene=SeqID_63163
ttgttcccaatcgtggctcgactcttcgtctctcgtcatttcaacgtacgcaaattccactcaattggcggcaccgatg

SEQ ID NO: 107474 - DNA, 590 bp, Heterodera glycines
  Promoter: Source sequence=SeqID_4005; Location=1..590; Strand=+; Gene= SeqID_52779
gagcgagaataataaacacagcgccaacgatgagaagcaaaagttgaaaagggcacaaaacggaagggagaggaaaaagcattttatgggaggaggaagaaggacgaaatattatttattttgtgtattgcgacgaatgaaaaaaagcgcaaaaatgcccatttaagtaccctgtagatttaaaaaaagttataggtagttggcctagtacgatttggggttttcccatgcttttccactataacttttctatataaagcagcagtttttttatgcattttcatttctactgatttttaattttatttcactcccctttccccgcgctttttgcttcctcaaaaattcttgtttataataatatttagctccaattcattgtccttattattaatggcacatattcgagcgaccgcacaaaaaaacccacctgaaaaggtgaatcactcatttctatgtacatatgtaatctcgaattttctttccaaaacaggccaaatgtttatccgaactgggacctgatctccgtgacgacaaattggacgtcgacggacaaattggacgtcgtcattcgcaaccagcacgaaatg

SEQ ID NO: 107475 - DNA, 1003 bp, Heterodera glycines
  Promoter: Source sequence=SeqID_11896; Location=587..1589; Strand=+; Gene=SeqID_75409
tttgcattcatttaattacccttcaccgatggcatttgtcgccagaacaacaaaaaagagcgaaaagcaaattaaattcattttgattttgggaaaggaataaatttgctgaaaatgggtaaaatgattggtaaattagtgggtttagctggctttgcaaacgcttaaaaagccaaaaaagccaatagaaacggtgactcatcgtttattggctttatctttctgctgatcggaattttgtccattccatattcacaaatcagtgcagtgtttgggagagaagcgattcaaatgcctttttttcattttatgtggacaaaacggacaattttatccactttcacattgaaccatcgctaccacaaaaatatttaggaagaatttatgcataattattatataaagtaaaataaaatgatttaaaaaaaatcgtttatttattaaaatatactatcagatttgtgatataaagtataaaatatttctaaataaatggtcgatttattagtagggatgcgatttttagtcaaatgcttaaaattctgcgcacttattgcagagataagcacgaaaaacacattttaattaaattaattttttttcagaaattatggaaaaataacaaaatttgacccaaataaaattatattaaaagatggataaaaaattttaaattatacaattaagctttttgaaaaaatcgagttgataaaatatttaatttgtttattttagtcggcgttcgatcaaaattttttcagatcagagcagaatttttttagataaacttttgtggtcaaaatcagaaaaaaacactacaaaaaaggagcgtaaggtgatttcaaaggacataaggagacaatttttgaatttaaaggacttttcaaaagggagccggaaaatgcgacaccgagagaaagtttttcatttcaagaaaatgcgacactaagaaaatgcgacaccaaacttagatttttaaaaatattttaaagtcttgaaaatg

SEQ ID NO: 107476 - DNA, 88 bp, Heterodera glycines
  Promoter: Source sequence=SeqID_18523; Location=1585..1672; Strand=-; Gene=SeqID_83151
agcaattaaccatttaccttgttaattaaccaactggggctttatttaggttgaacatcggacacgcggtgatgggcgtgcaccaatg

SEQ ID NO: 107477 - DNA, 52 bp, Heterodera glycines
  Promoter: Source sequence=SeqID_9683; Location=4295..4346; Strand=-; Gene=SeqID_72334
ttcgttacctcagcgtgtcgctaattcctccgtttctttgctcggaggaatg

SEQ ID NO: 107478 - DNA, 472 bp, Heterodera glycines
  Promoter: Source sequence=SeqID_7921; Location=737..1208; Strand=-; Gene=SeqID_66386
attatgtggaattggggccccgtggttatttttttttttgatgaaataatattagaaataagcaaacactttgaaatttcctaaaattggacccttcacgtaagcacaaatcaagcagaattaagaacatttggcagccctttttatctcattagtgtttttcatatattggttatttttctttaattgccgggtgtcccttcagtgtgccaacgtatttttggcttttcggcattcttcgcattcgcgacccgaacaaatgtgaaatgacggtgctggaaaagcatgaaatgatataatttccaaatttgtctaatcattttaggtgaatttcgaattcgctcccggcatggaatacttttacaccattttcatcactttgttttgcatttgtccaattttttcgtctgcggtggtcagctgctatttgctccgattgatgcggacaaaacgccaattcctgaacaaaatg

SEQ ID NO: 107479 - DNA, 211 bp, Heterodera glycines
  Promoter: Source sequence=SeqID_10216; Location=892..1102; Strand=-; Gene=SeqID_73347
ttccgctgggtgccagccgggctgccgccactggtgatactagcgtacgaagaaacgttaccgttaatagagattcagaaaaatggttatcgtgttttttgagaaatgttctatgcgtcaaacgctctcgaacatgaaactaagtgcggtgcgccatggccattttatgttgcaaataatttttatatttaatagatattccagaaaaatg

SEQ ID NO: 107480 - DNA, 785 bp, Heterodera glycines
  Promoter: Source sequence=SeqID_1958; Location=1..785; Strand=+; Gene= SeqID_77020
tttttcgtgcgaaatttaaattcctttatttttagcgccgggggctccagccagtcgtaatttttcaattggatgaaaaagggatcagaaaaaaaatcattttgacggcttggattttcttaacgactttgcattgttttcttttgtttctcctttttatttgcttcttaatttaacaaaataaaagttcaaatgcctttggaaatttttgttggactctgacgggcgcttcggctaattaattatactgcaaaattttgtgtttaataaataaaagggaataataatttacttttaaattaattgttaatgcatcatccatttttaatcttattttgcttaaaaaaatacatagaataatttgcacacagtccgggttcgaacctgacccatcccccctcagaaagatgcctcagaatccccatttacgaatggattttgaggccttaatgaatgcatataagctatataccaaaaagttacagggcctccaaaatcgaaaatttggctgtgttttcacatgaagttggtggctcagttggttaaattcctaatttttggggtccgggttcgaatccaacgtaaaaataaataaatgtaattaaatttttaacaaattaaagattttaaaaatacatttttaaatagggttgcaaccccgaccccgaaccccgacatttttggccattttcggggaaaaccccgaccccgaaccccgacgcttcataccccgacaaccccgaaccccgatcggggtcggggttaaatatacacccctaagaatg

SEQ ID NO: 107481 - DNA, 245 bp, Heterodera glycines
  Promoter: Source sequence=SeqID_6320; Location=1362..1606; Strand=-; Gene=SeqID_61135
actgaatttttgtaaatagaaaatatctcagaaaaaagatattcgaaaacttcgataaagatttttaaaggtgtatgatgaatcgctggtttttctacaaaaaattttaaaaaaattgcatgaaaatttctttctacaaatttactttaatttttccgggaggcgaaggcattgcaccctaattttgtacactggcttaaaggccgctatttgccaatctctcctcccttccctcttctctcatg

SEQ ID NO: 107482 - DNA, 181 bp, Heterodera glycines
  Promoter: Source sequence=SeqID_27421; Location=854..1034; Strand=-; Gene=SeqID_46044
ttaaatggcggccaaattcatagaattcgttttggatattggaaaagttggaatttgttacaggtcttcagaaaatttcattcattttttgtttttagtcagtgccgattgttacgactcgttggcgatgacttttgatgatgccaaactgtcaattgttggcgtgaacccggccacaatg

SEQ ID NO: 107483 - DNA, 298 bp, Heterodera glycines
  Promoter: Source sequence=SeqID_3039; Location=2718..3015; Strand=-; Gene=SeqID_47509
gctcaaattaacggtgcccttcagcaaagaaatcggccttctttccggcgattggtctcgtcgacttcgtcggctatttccttaactctaatcccaaccaaattgaaactgactgcctgcaaaaggcgcgaattattaacaaacaaatcaaaggtaacccttccgccattttgcatgtttgcttaactgaattttcaggtcttgctgttcaaacgatgcatttgcctgaaaatcaggtcgtctctttctttggatgggcgtttgtgcgtcctttcactcattgtctgccgttaagatg

SEQ ID NO: 107484 - DNA, 183 bp, Heterodera glycines
  Promoter: Source sequence=SeqID_2545; Location=2748..2930; Strand=+; Gene=SeqID_80312
ttgaatgattattcaaaaattcggaagctaaaaactttatatatgtcaatatgcgaaatgtgcgggaggggggagggggaaggataagttgctttttaatatatatatatatatatatatatatataatgagtaaaatgtctttttagtttatattttgggacaagagctaaacggcataatg

SEQ ID NO: 107485 - DNA, 1003 bp, Heterodera glycines
  Promoter: Source sequence=SeqID_222; Location=6237..7239; Strand=-; Gene=SeqID_78405
aactgtgatggccccccaattttgatcattctttgaaccccccgattgttgatctttgatctatggcccggtgccctccatttctgtttctcccggtcccattcattgatttctgtgatttcccatttgccccagtaccgaatgcttcctttctgaaaattttcctgtcccatcccggtccccaattcatttgtgattaatcccccggtgatggcattttatctgtgatcaattttgtgatattttgttcaccatttttaaatttttgtttaattacccaagtttgaggtcatttcccggaataaattttttattaattccgtgtctcgtccctgcctgcccctgaaccccgcaccgtggaattcatttggcccgaccccagagcaagtcgggacaaattggcgctcctgggtggatttgctgtgaaccacggactgaaatcgacggatcccggtgacaaagggggaagggaaaagcaaattagagagcctagacaagaccctctgaggcttgtctagtgttcatagtttcgtgtagttattgtcctccgaggcataacttcacgagggacgtagcggacttagtgtttaccctctgaggaagcacttcgtccgaacagagggttggaaggtgttgtgtagtggacgaagtacttgccctccgaggaagtacttcgtacaaaagggtgttcaagcgcgcacaaggccattgacaaataaggaaaaaaggcaaactaacagtcctccgaggctttagtttagccataaggcaaaaggcaaactaacagtcctccgaggctttagtttagccataaggcaaaaggcaaactaacagtcctccgaggctttagtttagccataaggcaaaaggcaaacaccttgtcctccgaggcaggtgtttagtcacaaaaggtccaggaccaaggccagactgatctcggaaaaagacacaaaacaacaagtgcaccacaacacacacacgcacaaccaaactgcacgcaatg

SEQ ID NO: 107486 - DNA, 159 bp, Heterodera glycines
  Promoter: Source sequence=SeqID_11374; Location=4359..4517; Strand=-; Gene=SeqID_74766
ttcgataaaaaattatatgggaaaatggagggggggggagggggaagataacaaaatccaaattcaaatgccaatgggtagttgagttcatttttcgacccatatcaatagctaaatgttgcttttaaaaaaaacgatgggaaaactggcagaaaaatg

SEQ ID NO: 107487 - DNA, 159 bp, Heterodera glycines
  Promoter: Source sequence=SeqID_17960; Location=1..159; Strand=+; Gene=SeqID_47489
tattgtattttattgactttctttttgttgggattataagtttataattttacaaattttctcgtctgttgtttatttgcattcattacattacctatttcacattttctctctaattcccactccagtatatttttaagcgttttttaagccaaaatg

SEQ ID NO: 107488 - DNA, 912 bp, Heterodera glycines
  Promoter: Source sequence=SeqID_25208; Location=687..1598; Strand=-; Gene=SeqID_55952
tgaaagttttccatgagagaacatcgtcagcttaaagtggaggcgttgaactcgccacttgacaacacgcagcagtgacaaagatggatggtaaacattcacccaaattccaaaattttatttttaatccgaataaaagtagaagattaaaaaatttaaaatgggtgctaatttcactaaattaagtgcctaataaatgcaagaaaaagattgtcaataaaagaaaaatgcacaaaaaagagccaaaggaatattaaaaaaaagcaatgctaatcaaactaaaaaccacaaacaaaaaacgaaaattttaacccaaaacaatgattaaaaaaacctatgatcgacggacgcacaaacaaaaaaacggcagaaccaccccaaatcgactggtggcacattttatccgccggatggtcaaaacaaaacaaaacaaaattcttctttcaccacactttgtgctgaaccgacaaatcagatcgacctgcggctgctgctgatcacatcaaatcatcccctccccccacctcccccaatgatcgcaaaaatgtgattggagagaatgagaggaaggcaggcaccacggacggacggacacggcggtggcggcgacgaccgacggacaaacgcaataaatattcgttcgcgcaggcagcagaaagacaaaaaatgaatgaattattattggcattcattgtgaaatgagaaaaaagaggggcattatgagattgatcaaatttcaacaaagtatgtgtggtattgaaagaaagaaaatattttacgctttttgaaaattttttgacaaaaaatgggaggaaagggggacaatggttgaaaattcgttattttcagattatttaatgttatttttagtcattaagtggaaaaatttcgaacaaatccagccaaaaaatg

SEQ ID NO: 107489 - DNA, 80 bp, Heterodera glycines
  Promoter: Source sequence=SeqID_10928; Location=1206..1285; Strand=-; Gene=SeqID_74232
ttatccaactgcccaattcctttgctttgacacttttccccgccttttctgaattcaattttccgttataagtgcatatg

SEQ ID NO: 107490 - DNA, 1003 bp, Heterodera glycines
  Promoter: Source sequence=SeqID_31980; Location=391..1393; Strand=+; Gene=SeqID_62293
ctggcaattaaggcaccaaaaagcgcaaaatggcactgaaaaaaagcacaaaaatcccgaaaaaggcacgaaaaaaggcatttaaatttttttttttattaatgatttttagggagcaaaacacgtaaaactaattcaaaaaactaaattttgggcgctggcgtttaggcgcggccgtttgggcgccagcatgtttttcaactataacttttttctatgtcatccaaatccaacatttttggtaacattcgaaatcttaatatgtttataggccagcgcccaaacgcgtgggtccagaaaaaaaagaattttggcgaacaatttttgtgaaaatttttcaattcataaaggtatattctctgaatttttttagatcatttcttaggggtgtatttttcagatttttttgaatttttaatggaatttttcgggaaaaaacgccaaaaaagacaccaaatcgctaaaactaatctttgtggtttttttagaatcaaggagcaaacacatgttttttggctgccttttctatcattttccaaacctcttagtacaccattcaatagagtttcaatagctctacaattttactcagaggtgatctttcgctttttctattaatagatagtttattgcttttttgaaaaaaataaacaaattcaaaaaaaccgaaaccgaaaaatcgaaataaaccgaaaaattttcttcggttttttcgatttcggtttttttcggtttttaaccgaaaccgttcgattcagatgaaaattcaaaatgaatttttttttttcacaaataaagggttcgccaattttttgagatttaaaacaagttcttttggaggatatcaatggccaaaattcggccaccatttgccagtctcgagactgtttctgctttttctcgacccaaatttgagtgaaatgggcaatggcactttttgcttctcctttgctcccccccccttcccctgtcaggcgattcgtgctgcaacccgtacagcatg

SEQ ID NO: 107491 - DNA, 384 bp, Heterodera glycines
  Promoter: Source sequence=SeqID_7062; Location=903..1286; Strand=-; Gene=SeqID_63713
tttttggaaatctcggtctctactattaacaactcagaataaaattacaaaacaggcgccggaccctctctcctcgcccatttcccaaaagttttttggaaaaatgcgccgcaaaaaattgttaaaaatctgattttttgagccaggtgttctgattttggtaaattttcgttcgcacccctgttctcttcccatcaacatattaattaataaacttaataacattggcattaagggaaaactgctaacttggttatctgaatttttaaaggatatattttatagagttaaaattaacaatcaattttctaattaacatccgattcagtcaggtgttccacagggttctgttcttggtttatgtctcttacaaaacacgtgatg

SEQ ID NO: 107492 - DNA, 813 bp, Heterodera glycines
  Promoter: Source sequence=SeqID_19278; Location=1..813; Strand=+; Gene=SeqID_84024
cggagaaagtctatagaatttattatcttttaagcattttgccgaaagcgaacgtcttttttcagcggcgggattgatcataaatgtcttgagaaaacgcttgacgcccaaaaatgctgaaatgttattgtttttgctagagcccgacgggatcgggactcacgcggggtttttacggggttcccggtcccgcttttttcggtgaacggggaatttttacgggagcggttatttttggacaaaacaaaatctgacaatgtattgtattcaaattttttccaggcggcgcctatcggcaccgcatgcctccctcctcctcctttgtcccaaaaaagttttttcgaaaaatacgccgcaaaagctgttaaaattaataaagggattcgaaaatactaatttaataaactttttgttcgaataaattttaaaaaataatttatttgaagcaatttgaaaaaattttccgattttcgaccccaaaatctaaaatttcgccttttcgctttcgccttctcacttccgctttttatttttatttttacacatccctgccaccagtcactagttgacaaaaatattctttgacgcaaaagccagttttttcgctttggtgatgaaattttaaaaggtattcggattcctccttccaaatttttttctggctacgggtctaaattagggaatagaaggtttagatgacaaaacaaaaatgacggaataaaaaaaaaaaccaaaactttttataatttttattacaataaaatagaatggctgtataattatgttacaataatttaactacagaaagacatg

SEQ ID NO: 107493 - DNA, 145 bp, Heterodera glycines
  Promoter: Source sequence=SeqID_12488; Location=2443..2587; Strand=-; Gene=SeqID_76119
aatcgcttcttcttcccattttgtccatctgctttcatttcgctcaattggacaacgaatcagaagaaaacggcctatatcgaccatcattcttttcaaggtcaattgttcatgagtgaattcgttggttagatcaaagggcatg

SEQ ID NO: 107494 - DNA, 216 bp, Heterodera glycines
  Promoter: Source sequence=SeqID_29355; Location=691..906; Strand=-; Gene=SeqID_59863
tgtttgggttggcacgagcctatccaactcacacgaatgattcatcgaaaaatttcaattcaaagtctgatcacgtgatttacgtgatggatgattgtataaaagggtgggagccttcccacccaaccacttttttttcaaacataagggaaatgcctattccctttcgagaaggtcctttcttctcggctcgtcgggtgaacatacccgagaatg

SEQ ID NO: 107495 - DNA, 257 bp, Heterodera glycines
  Promoter: Source sequence=SeqID_4750; Location=3141..3397; Strand=-; Gene=SeqID_55606
atgtgctttttatgcaccagataattattttgatccctttaatcattcctgagcatgagtcgttcgatcactcattactcaaaaaagggggcacgactacatttcgccaacttggcattcgccaactcagccaaaaacattcatttcgccactcagccaaaattaaattttttttgatgaaaaaagatgtttttatttaatgttttatacgcttgtattttaaaaattatttcgctaattatttttagttttaaatg

SEQ ID NO: 107496 - DNA, 928 bp, Heterodera glycines
  Promoter: Source sequence=SeqID_17223; Location=839..1766; Strand=-; Gene=SeqID_81690
aattaatttaaacttccacccgtgggttgtacctctttcacaacccaatagcttaccgagatagcgaagctcaaaaagcgcgcagcgccgtatcccagtccagagacgacggttcagtccgattctttcgacaaaaaggttactttgttgaagtcttgcccaattccatgtcccattttacaatgcgttttaatatgacaaatttggaaaattgtaatcgaatttaatcgtttttgtaaaatgctattctataattgtttcaataatggtattcttttttacattttcctaatttttcacgacttttttacatttttttcgagatttttgatgttttttatgactttttcgtgattggcgattttttatgacttaaattcccagccctactaataaataaaaatttacaaatttaaaaagtttttcggaaaaataaatttattatttttattatttttttttgattgcttaacattacctttacattattgccatgtaaaatgccctttttggccaaaaaataaaatcgaaaatttgctatatttatcatttttaaaaaataattttattcccacctgctattaacatttgctttacatcattgccatgaaaatgcccttttattaaaaaaatcgaaattcactatattttattttttctgcatttatttctagcaatagaaatagtaataattcacagaaatagtaataattcatctttattttatggaaataatgcttaaataatattttccaatcaatgatcagctcagcattacgtcaatgagtaggatttcttcatatcattaagtagaaaattctgcataaaaggctatcactgctcaattaattcactcagaaattttcattttgcatttaaatttgatcataatttaaaataataattttgtttttacctttagaaaatg

SEQ ID NO: 107497 - DNA, 690 bp, Heterodera glycines
  Promoter: Source sequence=SeqID_14514; Location=1..690; Strand=+; Gene=SeqID_78565
aaaaaagtgccggattagcgggtttgaaattccagtctctagtttgacattatatgtatgtatcatattctattttttttcttttttagccataaattgactcttcttcaacaaaaatgtcctatcaaaatgtaagcttttcgtctttctccacgtcctacatatattcgaaaatcactttttagtatcctggactggccgaatcgccaccaccgtccgcaataaacaattcttgtactaaaaacgaaccattagattctgattttaatcggggcggtggcggatggaaaagacaatctcagaacgcgtcttccgactcgtgggcaccgaaggcgggcgcatacagtgaaaatggcagatttttgggtgagattgaaaaacaacgacaaaaactattggaaaaggcaaccttttttgaagaaatgagtcggcacaattcgaccgcctcttccgctgctttttaccgccaatcgaccgcaacttcgaccaacaattttcaggagcattactcacatggcagcagttcatcggcggtttattttcaagaggaatttcgtggtgcttcttccttttctttttcgtttttcaaaaaccctttaggcccttttcccaccgattcttccctctgcgcttttcctgccgatttccatccgcgcacaaaaagtcgttttgacgaaattgtggacgatg

SEQ ID NO: 107498 - DNA, 51 bp, Heterodera glycines
  Promoter: Source sequence=SeqID_19003; Location=164..214; Strand=+; Gene=SeqID_83741
tttgggcatttctttgtttccaaagtcggatccaagaacttactcggaatg

SEQ ID NO: 107499 - DNA, 534 bp, Heterodera glycines
  misc_feature (59)..(59): n is a, c, g, or t
  Promoter: Source sequence=SeqID_13513; Location=1..534; Strand=+; Gene=SeqID_77407
caacattttgttgttgttggttgaacgattgccatgccaaaggaaaagcaaagagaagncattagtagcagcaaattgaagcacattgcagcgacaaatgccacaaagtcagagattcaaatttggttttagcaaaatgtattcacatatgcaaaaattaaaaaaattggatttgaattgacatttgtaattgaggtaattctgatcagcaattaatgattgggagagaatggtacggatcaattccctgattaaaatcatggacaacaattttggcttcattaaagtaaaaactctgtgatttataaatttttaaaaaataagttcaaatttaaaaaaaaaatttctcttgctatactggttttacaatacaaaaatgctaaaaatagtacaggaaaaaaagtttggctctgataaggaaaaaaattcttcgccacgaagtgataaccaacagcacctgaggacctgatcaatacaataaaaataaacctatgaaagcagtggatttgggcaaatgatcaattatgaaaaatg

SEQ ID NO: 107500 - DNA, 384 bp, Heterodera glycines
  Promoter: Source sequence=SeqID_9683; Location=3603..3986; Strand=-; Gene=SeqID_72335
gcaagtggatcaccgatcgatcactcatgcctaatcaacttgatcatcctcaacacatgtcattttgtgctatgctcctcccttcgcatccattcgaatctcctcttttcaatgttcctcttcaccccacccaatgaacttgcagatttatctacctgatcaattttctattttctcgtgcgaattttggcccttcgtttttgtcttgttttctcttagggaatgtgcccacctcatcaacttagtgccagtccattcattttccccatttattcaaggtgcagttcatcgttctcgtttttgccaaattgtttaaaccgaaatacattttcaaatcaattcaagataaatattgactattttgacttaaactggcaagcgatg

SEQ ID NO: 107501 - DNA, 82 bp, Heterodera glycines
  Promoter: Source sequence=SeqID_28531; Location=1..82; Strand=+; Gene= SeqID_59138
ataaagtcaatgtgactttcgacgacgtgcgcggggttcgatttgaattgaatgtatttaattctgttttaattgatagatg

SEQ ID NO: 107502 - DNA, 599 bp, Heterodera glycines
  Promoter: Source sequence=SeqID_1847; Location=3870..4468; Strand=+; Gene=SeqID_47066
gaggggggggggtggcaccatcggcactgtaaccttttagatttttcacgtaaaacatacacgttatggctaaaaataaaggtcagattcttgatcagcatcaaaaattagcctagaaaaaattattagagaaaaaatttcaagggggtgacaaaacccggaagtacccaattttattcactttcccgaatgtatacattgaaatattttgaaatataatttcttcaggtttgtccgttggacaatcgcgactggtaagttcgtattctttgttcctaaaatttttgtaaattattagggagttccaaagatatggacattgagttgccttgcggttattgcacacggctgaatatttgggatcacgatcattatttaaatatgtgttttgttaggtacttgacaaaatcatgactttgttttttctatgaaagtattaaaaaggattcaccatatgaattcgcatttattacacattttttgaaaacaacttcgtttgttttgacaaaatactgaatatcattgataatatattttcaatgtaattaaccgataattttagtgaatagctttgctttatctaattttgcgtaaagatg

SEQ ID NO: 107503 - DNA, 254 bp, Heterodera glycines
  Promoter: Source sequence=SeqID_18010; Location=1098..1351; Strand=+; Gene=SeqID_47492
ttccgcgcagtaattgacagccctccctcaccatctcccttcgttcgcccgcttcgctcttcttgtcccccttggtcgtactcctaccaatccaattgcgcacaaatcgatccgcaaattcctttacaacttcaataaattgcggagataattctccgtttacattttacgttttatgattatgttttatataattttatttttagcaataccttctaaaattctttttaaaattcccaactgtcttcaacatg

SEQ ID NO: 107504 - DNA, 240 bp, Heterodera glycines
  Promoter: Source sequence=SeqID_5118; Location=1324..1563; Strand=+; Gene=SeqID_56980
atttttttctgaaaaagatatttcggtcttttgattacaattaaaacaatttaactgaaaaaatgtttatctctctctatccattatttatatcgcatttaaaccatttaattatcctctctttcttcagaaaacttaaaaatacttccgatttttttctgaaactttttaaaattacatttaatatttcaattgacccataaaacacctttaactctcaaatttaagaatgccgaaatg

SEQ ID NO: 107505 - DNA, 838 bp, Heterodera glycines
  misc_feature (519)..(519): n is a, c, g, or t
  Promoter: Source sequence=SeqID_30322; Location=1..838; Strand=+; Gene=SeqID_60747
aatgccaaatatttttggataaattacttaataaattaatttaaaatgaactcattttcatcgcaaagttcattaaaaatttgtgaaattttcccggcggcgcctatcggcactgccggtttgaaaaaattgcgcagcaaaaaaagcggttttgaaatcaaaaatagtcaaatttatggaccattaagagatttttgtctgaaaattatgtttcactatttgtcactatttcgcacttttttcactatttggtcactattttggcacttttccgtcactattttagttaactattttgagatttttcgacaataaaagtcggggccctaataattagagaccggattttagttttttgattaataaaaatggttattttttctcaaatatttgttatatctattaattactttttttcctatttattattttttaaactatctcgaatagttccacatcttttaaaaaggtgtatagcctcagtgagtttgcgaccgaattattagcattttcctattntaataaaaatttcaaaaaattttcgctggctgcgcctatgtccgccggagccccaaataaagtaaaaatttaataaaaagtatttattcttagtttcttttttgtcatcaactttcttttcaatgctttgccatttcttttaattttgcatgttttttgctatggataaaaaattttatatacaagaaaatgtaaaagaaaatgttatcttcattctcaataatatattatttattgccccagtatgtttattttttgtctatttaaaaattcattttaattaattaaatctgatgcaaacatggtttaaattgtgatg

SEQ ID NO: 107506 - DNA, 675 bp, Heterodera glycines
  Promoter: Source sequence=SeqID_1796; Location=5764..6438; Strand=-; Gene=SeqID_76016
aaaaaagtcacaaaaatacatgttagaagcttcaaacaaagtgtagaacactttttaagtcattttaaggctttgactttaattcccagccatattcttcagattcaagcaaaaaaagggaaaaggagtgtaaaacccccaaaataggcactaaaaatggaaaataggctctaaaaaactcattttttaggggtgtaaaatgacaaactttattaaaaaaggtaaaaaaattaggccaaatcagtattgagctaaataatttttaaaatcaaaaattctagccaaaaaaaaaaaaataaatattggagatgaatttttgagtaaatttttacatttaagggatgcatttttgaaatttttgggtcgattcttagggtgtatttttaaaattcccaaaaaactattcttcggggtgtatttttagtttttattgcatttttgttaacaaattttgggaaaaacgccaaaataggcaaaaaatttttgtgcgtttcaggccacgggaagctcaagaaaaaaataggcttttgcctaaaaatattagcactaattataagcaattcaaattttcaaactttgcaaaagtttgaaaaaattttggatttatgccaagtaaaattggaaaaaaatgtaaaaataaaatgcaattaatttaaaaggctagaattcaaaatg

SEQ ID NO: 107507 - DNA, 91 bp, Heterodera glycines; identical to SEQ ID NO: 100405
  Promoter: Source sequence=SeqID_30942; Location=849..939; Strand=-; Gene=SeqID_61310

SEQ ID NO: 107508 - DNA, 1003 bp, Heterodera glycines
  Promoter: Source sequence=SeqID_959; Location=912..1914; Strand=+; Gene=SeqID_64972
aagtacttcgcattttgatgcttttctttttcttccccccccccatagatatcgctattaccatttatttgttgccgatgaattggacgatttgttgttaaaaatttggacaatcgatagaaatctggccgatttccaccgattatcagcgaatacgaaatgggcaattggtgcgcggtcatcgggaaaatcggcgacatcaaagagacgggaaggggggagggataaagcgaatcccacggaatgagtgattggcggaaagccaaaaaaggcggaaaagagcaattgtgaacaataatttgattttcctattaaataattggccattaatgagtttttttggtgttttgctttttttgtccttccgtttgcttccttttccttctcctcctcattcttttcccattttccctccgtttgtcataacattcatttaattttcgatggcaaaagaacagtttttcttcctttaataaataagcgcttttttcatcgcatttcactcgcttactctgctctcattagcgattgttaattgctttttctgcttctgattgggaaaggattaattaattatctgcttaagggggggggggtccaaaagttattttagggaggggagagaaaacagcggtgttttgccaaagagtgttggccgggggggcggggaatgaaaagcgatcggtcggtgttttctccgatttctttccgtccgtccgttgtattcttttcctttttattaaattgttttgttccaataaaaagtttattcattttcatgcggaaactaaaatttgcgggcgatgagtaattttaatgagcgaattgaaattgacgaaatcggatgccatcggcaaagaatgcaaaagtaagcgaagggagggaggaaaagcagaaaaaggaacaaaacagacaaagaaaaagcatttaaaggagcaaagggacaggcaaaaaataattaagtaattaggtaattaattggaaataattattcagcaaaatg

SEQ ID NO: 107509 - DNA, 75 bp, Heterodera glycines
  Promoter: Source sequence=SeqID_6262; Location=2877..2951; Strand=+; Gene=SeqID_60917
cctgaatttaaatgtatttaaaatgtttatttaataatttgctccgtgcaaataccaagtccaatcacaggaatg

SEQ ID NO: 107510 - DNA, 59 bp, Heterodera glycines
  Promoter: Source sequence=SeqID_23093; Location=964..1022; Strand=-; Gene=SeqID_53798
ctcttctgtagtccttaagatcgcaaaaaacaattatttcttgctaattattcgacatg

SEQ ID NO: 107511 - DNA, 875 bp, Heterodera glycines
  Promoter: Source sequence=SeqID_9664; Location=896..1770; Strand=-; Gene=SeqID_72256
aatggagcgaaacgccgccgagggaaagtgcccaaaaaaacggacagtgccattttattatttgccaattttaaatgaccctttttaatttatttgccatttgaataaatcccatggaaatgatgcgtaatttcccaaccgaaaacaatgcaaagcaatcggtgatcacatatttgaaactcgacagttgactaataaatgaatggacggcgaggaaagggacgacgggtttcgggagggggggggggcaaagcaaaaggatgaacgaataacggtaatccatgtaataataatacagagggggaagcacttgtaaatacgaataagcggagtttcgagggggggggagaacaagtccatccgatccattggagaaatgcgccgaccatttgggaaatgaacgaatcgaaagaaagagggggggggggaattgggagggagccgagggtttggtttgggaagtttatggatttacacattggaggatggacgtaccaaacactcagcaaagagaccaaatttgaacataaagcaaaacgaattgttctcttcaattgatcagcaccctttcgatcactttcctctcatctttcgatcatttttctccctgatcattttctctcatccctctgaatccattcgatcatttcttccgatcacttccgttcataagcactttttatttaaccttttaatcattcactctccgatcccttccctctcatcacttccgtttcgatcactttgcctggcccctttgatcagtccactctttcccttttttgatcattttccccattgatcactttatctcatttgaatttccgtccgctgatcactttgtgccttcccttccctgtggtcactttcccatg

SEQ ID NO: 107512 - DNA, 969 bp, Heterodera glycines
  Promoter: Source sequence=SeqID_14492; Location=1077..2045; Strand=+; Gene=SeqID_78535
attattaactaattaaccattaattaatggaaattgcaggccccactaattagtagtgataaattaattacaaaaaattaacacttcaagattttttgattgtttaaaaattttcataaattcactttcagggagggttagtaaaaatgttaattaccggaacataactagaaagaatagaatttaaaagttgaaaatatttacctactagtttttttcagaaaatttcaaaaattttgaattttttggcaacaaacatttacatgttgagaatttttgaaaaatttgatcgaaaaaaatcgagtaaatgaaaaattgctttgcttgtacagcagggccccaaaaataagggaaactttggccaaattttatcttaaatttcagttcattccgccgaagcttggccagtatcattggcattttaaatgtcgcttcggcattttattttgcccagaaaatcgagcgggtggtagaaagtgtgatgccctggctacacacgctgaaaatactaaatgaaaatgtattgaattatggaggagcaaatttgggtaatataaaaacaaaacaaaaattagggggacatttggacattccgagcctaaattttagtttatttttatttttttgaaaattacttaaaggatttggaaaagtaaaagatttaatgcgatttataaaaataattcattttccaaaatgagttttccaaagctaatacctctttcagaaagtataaaactcaataaatttatcgatttttctttagatgaaaagatttttaaaaaatccaaaaaataatatttattttcactaaatttttaaataaagattaaaaaaacttaaaaaataataatttatatttttttaccaatttttaaaataaacatttaaaaaagaatcaaaaaatttaattaataatttttcactattttttttcattattttacgaatttagaactttcgagaatg

SEQ ID NO: 107513 - DNA, 291 bp, Heterodera glycines
  Promoter: Source sequence=SeqID_1816; Location=1..291; Strand=+; Gene= SeqID_76149
aatataattgtatcaatttaagatttgatcttgttaaactatatttagctgtttgtacaattttatttttgaaagttatttttaaatatttttattatttgtcaatacaatttttttaatttaaaataaagatttcgacactgccgtatttattgaatcagagcccactttcgaggggttgaaaaatagagcaccagcagactccctctaaaaggtaaatatgaatttttaaaaaatattttaaaaacgaggaaaattcaagccgaggaaaaatccaggttgctgaaaatg

SEQ ID NO: 107514 - DNA, 369 bp, Heterodera glycines
  Promoter: Source sequence=SeqID_20392; Location=661..1029; Strand=+; Gene=SeqID_50912
taatttctggatttaattttcaaaaaaaaaattttttcttaaattggatgatcatctgaatattgaattttatatgtgattttgcggagttaagcaagttaatgcgaatgaaaatatgaaaaacgacatttgcggaccgacttttgcggaccgacatttgcggaccgacattttgcgaccgacatttgcggaccgacttttgcggaccgacatttgcggaccgacttttgcggaccgacttttgcggaccgacatttgaatattgaattttatatgtgatttttcggagttaagcaagttaatgcgaatgaaaatatgaaaaatttataaagtttttccaaaaagttcttttttcaggggtgaataatg

SEQ ID NO: 107515 - DNA, 562 bp, Heterodera glycines
  misc_feature (4)..(4): n is a, c, g, or t
  misc_feature (15)..(15): n is a, c, g, or t
  misc_feature (17)..(18): n is a, c, g, or t
  Promoter: Source sequence=SeqID_26524; Location=919..1480; Strand=-; Gene=SeqID_57262
aaantcgaattaatntnntacgacactttattatgcgttttctcaaaaagttggcgaaaaactgccgccaaatttttaaacaatttttatgtagaaaatataagtaatttcaagcagcatgttttcaacattttcaaatatttaatttggttcaaaactataattcgtgcattattatattaaaaattaactttgatttgggctctttaaatttttttctcatccgactatttttacagaattttttaatttgaaaaaattaaattaaaattttgttttatctattttgatcggaatgtaaaatctaaagtggtttgaacatgcaacaaaaaaaaaggttaaaagtgataaaaatttattttcaaaaacaattttttttctcaaaaaattttactttatttcgaagttaaagctaattaatcttccatatttcattcttttatggtggtaaaaagtttctttttataataaaaactgttacaaataaaattaaatttaaaaaaatttctggaataaaatcttcatcaagagaaactttggtgtcaagtgcagtttcgtaatg

SEQ ID NO: 107516 - DNA, 51 bp, Heterodera glycines
  Promoter: Source sequence=SeqID_45111; Location=736..786; Strand=-; Gene=SeqID_72477
gcaggggcagatggtcgacgtcgccctgtacgagcctttgttcacatgatg

SEQ ID NO: 107517 - DNA, 563 bp, Heterodera glycines
  Promoter: Source sequence=SeqID_30494; Location=1..563; Strand=+; Gene=SeqID_60898
gagtaccccaaacggacacttgaaaaaatcgatttcccccgccttcggggcagtccccccgagccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataaatgtttgagtaccccaaacggacacttgaaaaaatcgatttttttgtttcataaatatttttttcagaaagtcatg

SEQ ID NO: 107518 - DNA, 67 bp, Heterodera glycines
  Promoter: Source sequence=SeqID_38340; Location=829..895; Strand=-; Gene=SeqID_67185
taaaaagtcccatgcagaaaaacaagcatatgctatttttcaggattttatctattatatacatatg

SEQ ID NO: 107519 - DNA, 69 bp, Heterodera glycines
  Promoter: Source sequence=SeqID_44615; Location=890..958; Strand=-; Gene=SeqID_72083
tttcttcccctcattcgaatttaggatttttgttgaaatgcgagttttaatagtcattcgcattaaatg

SEQ ID NO: 107520 - DNA, 414 bp, Heterodera glycines
  Promoter: Source sequence=SeqID_3397; Location=2597..3010; Strand=-; Gene=SeqID_84514
agtagccttacgagacagtcatcacctccaacaccaccgccagcaccaccgaagcagccaattttgaagcaacaaacaagtggggtggaaaattttttgaaaaactttgtaatttgtcaaaaaattgtggattagctagaaaaaaaaaccttaaaattttctcatgattttttttactgttagttttaaaacaggcctgtaaacagaaaaaaaaatccgaaaggatgaaggggaggaacccaaccttttttaggcccctaatttttccagtgtaattttttcaaaaaatataggcgctaatttctgaccaaaaatgtctttactttcgccgttaggccgtgatgacagccgcagttgaatttttttactttaaaaaaaagcaaatttttctttaataatagattttttaagatg

SEQ ID NO: 107521 - DNA, 321 bp, Heterodera glycines
  Promoter: Source sequence=SeqID_24797; Location=2048..2368; Strand=-; Gene=SeqID_55544
cggcattcgtcgtttgttaaatttccattgaaaatcccgttatttgaatcaggtgaaaacatgtctggcgtgataagtgttaatttaagattgaatatttctcaattctcaatatacataatgatgctttaaaataagtaagaaattcaatgatagaaataaacattcatgaaaaactatgaattcgttcgaattaaatcattttttatcgtttacgtaataaaaataaataaatatcgtagaacaattaaagaaatcatactaaaactaagaggatatcaaggataagtggttttacattcatattaaaattcctcaatg

SEQ ID NO: 107522 - DNA, 491 bp, Heterodera glycines
  Promoter: Source sequence=SeqID_41066; Location=1..491; Strand=+; Gene=SeqID_69272
cgctgtgatcggtgtgtgatgattttccatatatatatcttttttgtgtaaccactgattttattaacttggatatgtggtggataaagttaattgaagacttgactagtaatgaaaaaatcgattaacattgcccagaatttttacttaggtaattaaaagataaaacaaaaatttctgtaaattcacaaaaaaacatgggctgcggaattggttcttttgcactttatgagtccaatcgcattttatgaatccaatcatatttatgaattgagtccaattaattagccattctccattttttgcatcataacattattcattttgagcgaatccgttaaaatgtaacatttattcggaaacggaaaaggttacgaccaaaaattggttgttaaatattgaacagtttgtatagaatttttcctcactttctggttcgtctgacctttgaacacacaaaaattcgtttttctagcggtcgccgtataatg

SEQ ID NO: 107523 - DNA, 432 bp, Heterodera glycines
  Promoter: Source sequence=SeqID_7509; Location=3488..3919; Strand=-; Gene=SeqID_65069
ttcggaaagtggataagttcgtgctcttcgtggccgaacttaaacacataggaagggaaggagggaagcaaaatttgggctttgttgggcactgttcggtctccgtgccaacagtgactcgactaattacagttcggtctccgtgccaactgtaatttgactttgggggttgtaagcgtaggtctaggaataactgtctggtcttcgtgccggtagttgttcagttactgggcgacctccgtgtccccagtgacaaagtactgcttgctctccgtggcggcaatacttcgacggcgcagacaagtcaaacggccgacaacgacaaactgctcgaacaaaaagcagtaaccaacaagcgcagcaaaacgcaaactgaacagcagcagcagaacaactgaagagcgcaaagcccacggcaaacaacccacaatg

SEQ ID NO: 107524 - DNA, 256 bp, Heterodera glycines
  Promoter: Source sequence=SeqID_9912; Location=3711..3966; Strand=-; Gene=SeqID_72941
ggaaagtttcgcaatcccgctgcgtcaaattttctcatcaaatgtagaagtaaaaatgcactgggttgaatcgaatttttatgttaattatttttaagtgaaaatctgacaaaattttcgattccttccacaaaaatattttagaaataccactaaatttcggcttatatttttatattttttcttccattaaattattgaccatcgagctgtgatttgtgcttatttttgatttggtacaaaattacaagaaatg

SEQ ID NO: 107525 - DNA, 778 bp, Heterodera glycines
  misc_feature (10)..(10): n is a, c, g, or t
  Promoter: Source sequence=SeqID_44210; Location=1..778; Strand=+; Gene=SeqID_71730
cacaaaattntcggttaaatatcaaatttaatcaattgacagaattgctagagaccaaccaacccctttcgataaataaatataatgaactttttgagcaatatattttataaattttataattcttagagtattaacggtttttgacaattaaaaaatgaaatggaacttttgagtgccagcggtgccggtaggcgccgccgggaaaatttttttaaatttgagtgtaatttgttaacagatttacaccaaaaaatgaccaaattttgcaactttgagctacttttttaaataaaataaatttttagggtccggtggtgtcgatgggcgccgccggtgaaaaactttaaatttttagtcattttgttaacagatttaatccaaaaataaaaacatttttcgatttgaattgttaaatttatattgaatttccgtcgaaaataggaataactttgaaaaattgaagaaaaacaactactttgatgagaactgatccaaaggaaacataatgaaaaatgccaagagcactcactaccaatcgaccatgcatgcgaataaacaaaagaaagcaaaaagttaatatatatatatatataattactcccgcggaatctcgtcccgcataaaaattgagttccaatcccgcagcgagacccgcaaattttcaattttttgtgcgccgcgcattgcatttttttgtcaaacgtaatcccaaaatattttctattactaaatttaaataaattgatattaaattgagcaaacgacaacaacaatg

SEQ ID NO: 107526 - DNA, 139 bp, Heterodera glycines
  Promoter: Source sequence=SeqID_15530; Location=3135..3273; Strand=-; Gene=SeqID_79812
tttgtgttccctctctcttttcctcttttatttttgacattttatcgcgaattttgcatcagaatttttcatttaatacaaagaataaaaatttaaaaaaatcaaaatactttataatttattgcaatttttcaaaatg

SEQ ID NO: 107527 - DNA, 129 bp, Heterodera glycines
  Promoter: Source sequence=SeqID_5421; Location=2974..3102; Strand=-; Gene=SeqID_57965
aaaggtggaataaaaataaacccaactcatgctaccacggaattagaaattttggttgataaatattttatcctaaaacgaaatccacagagtgaagaatttatttctctacctacaaaaattactatg

SEQ ID NO: 107528 - DNA, 205 bp, Heterodera glycines
  Promoter: Source sequence=SeqID_2327; Location=1236..1440; Strand=-; Gene=SeqID_79140
atgcactaaatcgtgctattttggattaaatagaccatttttacaaataaaatgcttttttaaacgtaaaaagatcgaacctgtagagttagttgttttgaatatgtgaagttagtatcatttaagtagccaaaataaagtttgggcggacgaacagtgccttcaaaatggcatcgaatgttccgcagaaaatcgacgcgaaatg

SEQ ID NO: 107529 - DNA, 197 bp, Heterodera glycines
  Promoter: Source sequence=SeqID_40065; Location=1004..1200; Strand=-; Gene=SeqID_68506
ccgttttgtttacatttttatccttgtcacttaaatcaatttgttttaattttttgaatgtttcctttttgatttatttgctaaaaaaaattagtttgtacgtcacatatgcacaattcgaaactctattgttatcttgctttgtttttcatgttgaagttttcttttagttttgccaattaaatttaaacaaaatg

SEQ ID NO: 107530 - DNA, 507 bp, Heterodera glycines
  Promoter: Source sequence=SeqID_30637; Location=1..507; Strand=+; Gene=SeqID_61045
aattgtcgtgctcgcggatcagtgtttgatgccggcaaaagcacctcaaacaaacaaattaattaattaaataaattaaatataattttaaaaataatatttaaaattaaataattcaatataaaaaataaattattatttttttgataagagtatagaagtttctttgcaattaacacattttagatgattattaagaaaaagaaaagaaacattctaaaaaatcattactaataaataaatatttactttttaaatttaaaataattaaattttactgtttattttctgaaaatatttaattttgttttggacataaaaaataaaattaggaattcttttttttaataataataatgtttcgaattttataaatttttattaaatttactggataaaaaaacgaaatttctttttaattaaatttaaaaataagaaaataaataaaatttgtttattaaatcgctttaataaaagtaaatttttatatagaaatgatagaaaatg

SEQ ID NO: 107531 - DNA, 474 bp, Heterodera glycines
  Promoter: Source sequence=SeqID_3522; Location=1..474; Strand=+; Gene= SeqID_85015
aacactcaaataatcgtcattttttctgcaaatctacaaaaaatttaagtatttgaatctaatttaaaagttcccggacgtgcctttagccataacaaaccctttgttcttaaaatttgtttaaaaaagcttgaattggatgttgccagtcctatcttttctgcaaatcaaattaatttcttttttaagaagaacataaacaagaaattaaagaattggaagtaaaacaagacacattaaaaagaaaaattcgccttaaaaatattcattcgccttaaaatattcattcgccttaaaatattcattcgccttaaatattcattcgccttaaatattcattcgccttaaatattcattcgccttaaatattcaattcgccttaaatattcaatgacaaaaagaccctgccccgaaaccgaatattctccaatttcacaaaaaaatggtatccaccagttaattgactctcaaatg

SEQ ID NO: 107532 - DNA, 640 bp, Heterodera glycines
  Promoter: Source sequence=SeqID_28; Location=2366..3005; Strand=+; Gene=SeqID_83725
aacacttatgccatttattttacgaaccacatccctttgtaaaaaagggttcgcaatccgtgccaatggcaccgggattcccagcacacaccgcgaggaggtttgtggtggaaaatggacgaaaaccatgtgcaccaaaaaaaaatcgggcatgacccctctcctagccgatggtttgggccatttttggagggccaaaaacacgctagggcgccccctttacgcattttctacccgccgacccaaggccaacggatgggagggcatgcccgccacctgtgaccatcatagcaagcgattatggaaccgctcatggaactcaaagtgtgtggcactaccatcccaaagtgcaaggtttggtgtaggcctccctatgttgggtaattactcccttcataaggcacttgtgccaacgcccacagcacatatgagttccgtcaacgcggattttaatccggggtgttaagtttgagcagctgcgcgttcgacactgctcagtgactcacggtcctccgggccagccagtcccggttattctctcgctgtacgaatgcagcccgaaggcaggacacattacggctaggaaccgccacccccgctgctaggtgcaagctcaccttcaccccaaagcgcagggatg

SEQ ID NO: 107533 - DNA, 393 bp, Heterodera glycines
  Promoter: Source sequence=SeqID_1090; Location=2335..2727; Strand=+; Gene=SeqID_67612
agccagccccaaacattgactatatatttattaatgctaattatgtagtaaattatgctaatgcaatttaattatcgtcggacaatcaaatgattttagtcatttaggaaaaatactgtgaaaatcaaaatttattttattttattataaaattttgcacttttcttcggcagtttcattatccccaaaaattgaaggtcaacattttccttcctaatcattgaacaaaaaaattgggtcgaccttgacaaattatcgcaaaaactgggttacacaattgttaggtttattcgcccgtttgcggacatatcaactgatttattcaataaattctttttaattttttttataatttaaatttataaatttaattgaatttaaagaatgaaaatg

SEQ ID NO: 107534 - DNA, 518 bp, Heterodera glycines
  Promoter: Source sequence=SeqID_27665; Location=264..781; Strand=-; Gene=SeqID_58340
ttttcggttttattattcatagctcaataatacatcgtacactaccggggggggggaatggcgcccgaaaggcgcttttccccgcatagtttttaaaaaattatttcccagtgaagaaatgatagggagccattctccttcccagtctctttctcttcccatgattatctttatttctctcttctctctcactgttatgtgttttccttcatttttctctatttactctattttcccgttgtcttaaaatgtctagccaattctatttctgctttgaatcttttcttccctcccataagaattcaaaaaataattgtttacagtaagaatgtttgatttttgctcctcccgctttttgggtcatcattttgccgaaaattgcataaaaattaaaacaaaattgacggaatgaatggtcatttattttttattaatctttttattctcggtcatttattataattctttaaaggaaatttaaaatataagcttattttagagatatcaaattcaaaatg

SEQ ID NO: 107535 - DNA, 208 bp, Heterodera glycines
  Promoter: Source sequence=SeqID_28950; Location=1070..1277; Strand=-; Gene=SeqID_59522
tcgaacacaacgtgagcagggagcagtgcatcaaaattcacagttatgactcaccgagactctggaattgggcacaagctggtcagtagctctctcatcaattatttacccctactcattcaccgcactcggtataaacggtcaagagtttattaaagtatgggaaaacgacagcagtgtcccgactcaagtttatttaccggacatg

SEQ ID NO: 107536 - DNA, 402 bp, Heterodera glycines
  Promoter: Source sequence=SeqID_33363; Location=1..402; Strand=+; Gene=SeqID_63446
aaaatcttttcgctttttgtaaggctaatagagcatgttaagagctttcgaatgataccaacagtgttggatttggatgccaaagaaaaaagcttaagtggaaaaacgagctggcgccgaaacgcgtgggtcccttttgagttgggcattaaaaaaatatgaaaaaactcatttatgctaattttcgaaaaataaataaaaatttaaaaaaaaatcgtgtaaaacgcctttcctggggtttttaggtcgctgatcacgaatctggcatccatttgaaatatctatctaattccggactccgaacccgaattcgaacaaaaagtcgaaaatttaaattttacaaacgcagactccgacttttcccaccccgaattgctacgcaaatattttagtataaaaatg

SEQ ID NO: 107537 - DNA, 751 bp, Heterodera glycines
  Promoter: Source sequence=SeqID_382; Location=3322..4072; Strand=-; Gene=SeqID_50939
ggtaaaagtctatagagacgagaggttcgaataaagaacgaattgtatctagcattggttgagcaaaaagctgttcttatggttaatgcatttttttacagggcttttggaaaatgaaaaggattcgttattttgtaaatttattttacctaaaattaaaatttttctttattgtatttttatagtcctaactttgctctatacactcaagttttctctgcctctgtatctattttcattttctttaaatcagccttcaaaaatacctaccccgaaaatgagcatttttacttaatcaactctagctcctaattaacttttccatttctattgatcttttgcctgaaaaatggcaactcattattgataataaggggattatttcgaatcatgattgtgttttgttcaattaaaaaaataataaaatctcgaaaataatttcgagggtcaaaacttagttgacaccctaagtaaaaatgacgaaaagtagcaaaaaaaaagagctaaagtgataaactgtttaaatagtgtcaaaaatagttgcaaaacaacaccatttgcgtcattattttggtggtcgataaatccaaaattataatatacaatgacaattaatggacttaaaataaattccggctaaaaatgtttttttttttggttttttgtacattaatttgataaaatccgtcttttctaatagctctaaaatttcaaaataaatgaattttttttttgcaggtttccgaaaatg

SEQ ID NO: 107538 - DNA, 474 bp, Heterodera glycines
  Promoter: Source sequence=SeqID_39479; Location=197..670; Strand=-; Gene=SeqID_68042
tcccttttttcatgtatgtttttgatttaaaaaaatacatttcaattaatttcattaagatttctttattctcgattttcgactccctattatgctcgagtgccaatcttcaaatgtcgcatcactaaaaaattctccttgtaaaaaatttaaaaaattttcggagggtggataacccggatgtactacatagttttgcgttgtttgaagaaagaacataaaggtaatcacaattttaatctccgcaagatttaaatttggataattttccaaacaaaaaaatggagtgtaatataagacataatgtgttttaaattaattgctcattttatttaattaaatacttaaaattagcaaaattctgaaaaaattttggaaataatattttaaaatagaaaatccaccaaaatcattttaatactaaaggataattaaaatttagttcgtttaaatccaaccaactgtctccaaatg

SEQ ID NO: 107539 - DNA, 81 bp, Heterodera glycines
  Promoter: Source sequence=SeqID_17172; Location=1666..1746; Strand=-; Gene=SeqID_81613
ttattatttttaaagtttacaataactctaatcccaaaattatcaatcaaaaaatttaagtgtgctgttctcgcggccatg

SEQ ID NO: 107540 - DNA, 330 bp, Heterodera glycines
  Promoter: Source sequence=SeqID_3518; Location=1286..1615; Strand=-; Gene=SeqID_84990
ctcaatggacactccccgaaccctggtatggacaacccatcgttctagtattggcagtattcttcaattttaccgataattgaattttttttaaattaattttatcaaaattataagtcctttacatttagctatcatagcaatatgataagtaactatttgaagtcccaacttgaacttgtggaagaacattcgactcgtttaaatgagcgcactcaaaattggcggcagaggaaacagacactgagcgcacgcgaagtcaattcctcaagaaacagtacaataaagcataattcgttagtttagaaggaaattgtcagtgccgatatg

SEQ ID NO: 107541 - DNA, 242 bp, Heterodera glycines
  Promoter: Source sequence=SeqID_32539; Location=726..967; Strand=-; Gene=SeqID_62846
tttttaggaaaatggaagaataataatacaaagaactaaaaattttgcattttatacctttcaatgtttatttaacctataaaataaattggaccattaaaaattattataaatagcatattatcccttaattttttcattttgttgtcttcatctcattaatattgcatttttcctctataaattgcactcttccattcgttaatttttttcaaaattgtagcttccaaattctcaaaatg

SEQ ID NO: 107542 - DNA, 131 bp, Heterodera glycines
  Promoter: Source sequence=SeqID_19148; Location=1..131; Strand=+; Gene=SeqID_47564
cagaaaaaagtgtcaaaaacggaaaggcaagtgaaaatggaaagggggcattatgtagatgaaaaaatataaatgctaacccaattttgaaaaacataaaaaaatattttggctttttagtgccaccaatg

SEQ ID NO: 107543 - DNA, 294 bp, Heterodera glycines
  Promoter: Source sequence=SeqID_3578; Location=1..294; Strand=+; Gene= SeqID_50931
tatgtgatagccaaaattttagaatacaaaaattttcacctcctcgactaatgatgaaaaataatagacaaaatcaatgactttgcaaaatctgagcctgggttcattaataagaaaatttattttttccgtctggacaccaattccgaaggactaccaaatttaggtttttgaaaattaaaaaaaaaatttttgttggaaattactagtaattcctttttataactggtcttttaataatcccaactttttccacaggaagcgcccactctttacgccttctcctacatcatg

SEQ ID NO: 107544 - DNA, 607 bp, Heterodera glycines
  Promoter: Source sequence=SeqID_14120; Location=749..1355; Strand=+; Gene=SeqID_78110
aatttttgtgctgtgacaagtcattatgttcttgttgtgaaacggttggcatggataatggctttaatttgattaattaatgagaatttatttttcatttacttaaattggtcataaatttttctttaaactggaatgaaaaaaatttaaccgaagatttgggacaacattttttaagtaaatgtttagtgtccaccaatgcagaacaacactgataggaaaaaataaaagaccagaagctaaaaacttatattttttgaaattttcttcaaaaaatctaaaaatattgaaaattcaaatttggattttttttggaatttttgctttaacagcaagcacgtgaaaaccttttaaaaagctttattaaacattagaatttatatagagaaatttctttaatattatatagattttcagtcactaattgcgccaaaatttgatgtcatttaggacataaaactagccaaattggaccaataacgaaaaaattctgtagaaatttaggttgagaattggccttatgaatttctgcatcagttgttgagaacgagtttttaagaaaataaaaaatttattaataaaattttgaagccaaactcagagaatg

SEQ ID NO: 107545 - DNA, 192 bp, Heterodera glycines
  Promoter: Source sequence=SeqID_1058; Location=955..1146; Strand=+; Gene=SeqID_67028
ggtggttttgggggacgaacgaaaggggggggggcagcagcactcattaagacgaaatacggggattgatgtgcactgatttgagtgttcatttagcagatccaacggacaatcagtgcccagtgggccccgcgtctgcgcgaaaggcaccaaaatggacagaacacaacggaggaccaattggcggacatg

SEQ ID NO: 107546 - DNA, 81 bp, Heterodera glycines
  Promoter: Source sequence=SeqID_6144; Location=895..975; Strand=-; Gene=SeqID_60502
tgagcattttggtttcggtttgccgtttgtggggctatttaagacggtagaaagttattgtgatcgtcattcgagcaaatg

SEQ ID NO: 107547 - DNA, 249 bp, Heterodera glycines
  Promoter: Source sequence=SeqID_2950; Location=2485..2733; Strand=-; Gene=SeqID_82478
tctttatacaacagggacaggttgtcccccctccctccgaaatttgattactaaatttttataagaaaatttcaaaaaataatttttcttgaattttcataaaagtttttctaaatttttcttaaatttctaagtttaaattttgtttttttttctttagcggtccaaacgcagacggaggacactaacaacaacgaaatgttattaaacagcagtttttgcgccaagccgggtgcgaacaacgacatg

SEQ ID NO: 107548 - DNA, 220 bp, Heterodera glycines
  Promoter: Source sequence=SeqID_833; Location=4550..4769; Strand=-; Gene=SeqID_62447
aaagaactaaaaattttaaaggcaaaacttcgactgaaaaaatgtgtataaaaggagcgaaaatgtcggttggtcactcattcccttcacagcgacaacaacaacaacaaacaatcagcaacgacgacaattgcgcaacgcttcaacacagcacatccatcgcccgtgcacacgtcgaatccgatcacttctgctgctgctgctctccaacaacacaatg

SEQ ID NO: 107549 - DNA, 166 bp, Heterodera glycines
  Promoter: Source sequence=SeqID_22547; Location=1112..1277; Strand=-; Gene=SeqID_53215
ttttataaaaataagtgaataatttattctaatgttaggctaaagcgctgctctttttgtgtatagtgaaagcaaaaacaataaaaatgttatttttatttattgcatttttaattttttcctattttatattatttccaactttaatcattttaaaatcaaaatg

SEQ ID NO: 107550 - DNA, 1003 bp, Heterodera glycines
  Promoter: Source sequence=SeqID_10043; Location=969..1971; Strand=+; Gene=SeqID_73103
ccgtatccaaacaaaaaattagttttttttgaaaaaacgaccccaaatgttttgtatcctgggtttgggtacggtatcaaaatcttttgagtttggatacagtatcaacaattgaatgttaagaatttgctgttttttagatttccaaattccgaggaattaaatgtccagtccgagcgattcaaagttcgcctgctcaaccaataaaagttcgtttgggattcctcccgccgccgttcgttcctttctgtttgcttctgtactccgccccttcgcttccatccttatatactgttaccatttgccctccccattctattaccgtgtccccacacatatccaccgtatcccttttttgtgcctttctcccatttctttcatccattttctcaaaagttatttagtattactattatttttattgtcctttatccagtaaatttcaacaaaatttcattcttagttccttccaatttattgtgccttttgtatcggaacatttcaataaattgtcggtttcttaaaagggaaattaaaattccatttttatttccaaaccgacaaaagaaaagtgacgccattgcaccaatttaaacaattaattaattaattctctccaatactttcggggtgacaattacgtcactgatgcacatttcgaattgtttttaaagaatggactaatgagaatgaccgtagaaggaaaataaataccgtaacccgtcacaatttgcttgaaaattaatagccacacgtatttgaggaatgataaattcttaattggggttgcacggatatcccaaaattgcgaatgggtgggccgatttgggacgaagggacagtccgacactcattcatcaaaagttaattcgtcatttattcggcggaaatttacgtataaaacagtattgggggtaattagctacagattattgggttggtcagagagagagagaggcataacgcgcaaattcggacatccgatggacgaatggccaaaatg

SEQ ID NO: 107551 - DNA, 205 bp, Heterodera glycines
  Promoter: Source sequence=SeqID_28804; Location=1624..1828; Strand=-; Gene=SeqID_59382
ccaattaataccatttttattttcaaattttaaatttctctaattaaaaaatatattttttctagcgctttttcttcgaagtgcttccacatttgatagtacaaatcaccaacaaaaatcttcttcggaaatgacccaacggcgggagagcgacgaggagcagcaactttacgaggcacacattgccgaaatttaaaaaaaaatg

SEQ ID NO: 107552 - DNA, 123 bp, Heterodera glycines
  Promoter: Source sequence=SeqID_23908; Location=370..492; Strand=+; Gene=SeqID_54600
agattattttaatgttttgtagtttgtttaaacagaaaatttttgcataaataaatacccatcaataataaaaatcattctttttaaaaaaatatccaatttgagaatatttttaaagaaatg

SEQ ID NO: 107553 - DNA, 634 bp, Heterodera glycines
  Promoter: Source sequence=SeqID_15689; Location=1238..1871; Strand=+; Gene=SeqID_79999
gtatgttaaataaaaatcgtattatgttggaattgagggttattttttaaatttcattattttacggttaaaataaaatttttgttcagttaaaataacttacgattcaataaaaatttagtgtctgcttctacgcgggtgtcactttgcgtcgctaagtcgaaacaagcgttgaccgcggccgagaaaaagttagacggatttttgatggtttgacatgctttacaattttatttacggtttttcagtgaattttgaataaaatttcaataggagtgtttacgcttgtttagtcgaaccaaaaccaaaaaaccggtacgcccggttagcactcgaccgtaaacaaccctaattttcattataaaaaattctgctgaaaggccggatccctttgaatgaattcgcttatacttactgatgatgatgatcttccataccattctgacacatcccatttttatacgtagacttccatctgatctaaaaaatcctattttccttcgttgcaatgttttgtttaaactcataaatttcaaaaatgctattgcattttaaaacgatacatgattgagaatttcgctgtttacattatacatttgctttttctttttagtaataaatgtttaaggaaatg

SEQ ID NO: 107554 - DNA, 100 bp, Heterodera glycines
  Promoter: Source sequence=SeqID_3067; Location=3380..3479; Strand=+; Gene=SeqID_83055
tcttaaattttaaattttttgccccaaattccccattaattaattaattaatttagcgattaattaatttctccttttaattttcccattcttcaaaatg

SEQ ID NO: 107555 - DNA, 391 bp, Heterodera glycines
  Promoter: Source sequence=SeqID_36650; Location=1..391; Strand=+; Gene=SeqID_65904
cataccataccatatcataccatatcataccataccatatcataccgtatcataccatagcataccatacccccccctgttttgttatgtcactgtgttaacctttaaaaaactaataaaaattattccaatagaaattaatttgttttacttcgtcccatttattttattttatgattttttttacatgtaattttaatgttattagcatcactgaaaccttaatactagtttctttttattaatccagagttattaaagtattattccaataaaaaagaattttgattttttacttcgttccattttattttatgaattcattaataataataatttatttttatttttataagaattagtgaacttaccatttaaatttttctccatg

SEQ ID NO: 107556 - DNA, 114 bp, Heterodera glycines
  Promoter: Source sequence=SeqID_5561; Location=2372..2485; Strand=-; Gene=SeqID_58467
agtaaagttttaaattaaaacaagaattttatttctggtgtgatcaccaaattatacattcacaataatttataacaaaaacatgtttccaaaactcagtgcgttgtcggaatg

SEQ ID NO: 107557 - DNA, 548 bp, Heterodera glycines
  Promoter: Source sequence=SeqID_5421; Location=3477..4024; Strand=-; Gene=SeqID_57966
ttaaccgtccattaaaattgctatatccgttagaaattaacaaaactgactgtgaggagaatgagactctcacaaatttaatcactgaacacgaacaaattggtacagttcaaaagagaaaacaagcaagtgtcttatcattaccaaaattaagcaaagtatttttaaacacactcacgtttcttctattatttatgcaaatcttaccatgcttatcccatttatatgaatgtccaaaaaccaatgaaaaatggagaacgaagtatacaacattttgtgttgaaaatggatttactataagacaaaataaattaacaatggaattttgttatcgtaaaatattttgtcacaaacaacacgtcataaaaaatcacccaccctattgtggaccacaatgcaaatgtcctgattggactaattcttgtagttttgcctcatatcacagaataaaaagagaaataactgatcaggaaaatattaaaaaaattatttcattcttcaaaccaaacatttgttcattcaataaaacggaaaaatgctccctaatg

SEQ ID NO: 107558 - DNA, 95 bp, Heterodera glycines
  misc_feature (28)..(28): n is a, c, g, or t
  misc_feature (80)..(80): n is a, c, g, or t
  misc_feature (85)..(85): n is a, c, g, or t
  Promoter: Source sequence=SeqID_23021; Location=1..95; Strand=+; Gene= SeqID_53719
attcgccaccatcaattggagattctcncatctttctcatccacttttcttctagcacatccccaaatgatttgtcttcncatcnttcaggaatg

SEQ ID NO: 107559 - DNA, 296 bp, Heterodera glycines
  Promoter: Source sequence=SeqID_5054; Location=997..1292; Strand=-; Gene=SeqID_56737
gactaataatatttccggctgacacttacttgcacaacaaataaaaattaatagatattattgaatatttaatttaacggatatacatacataatcatatgagttggcggttttaagaaacgccctggcggttttaagaaacgcccaaagtggcggttttaagaaacgcccacctggcggttttaagaaacgccctggcggttttaagaaacgccctggcggttttaagaaacgcccaatgtggcggtttttaagaaacgacctagcaccctttgattgatcatttgaaagaaatg

SEQ ID NO: 107560 - DNA, 260 bp, Heterodera glycines
  Promoter: Source sequence=SeqID_21789; Location=788..1047; Strand=+; Gene=SeqID_52401
tttggttgcaatatctttctatttgagtgattgcgaaccaataaaattttgaaaaattactatttgagagcagaaggaaatttaataataatatataataagtaaagataaagtaaaatattcaaaattgtttctgccttttattgcaattgtttttataaatgtaatttattcaaatgattttcttactgctttatttacgtcatagttaccccattgttacgctttacgctttggaatcatagggaaatttaaatatg

SEQ ID NO: 107561 - DNA, 1003 bp, Heterodera glycines
  Promoter: Source sequence=SeqID_2829; Location=2071..3073; Strand=-; Gene=SeqID_81834
agaatcatgtgttttagttaacaaacaaatgtttttttaatcaagacaaaacggaggttccggaaaatcgaatttggttatattttatgaaacaacaagggcaattggtaatctttgaggacttttgaatcaatttctgtagacgtacatagaaattggaagtgaggttagctttttataaaggaacaaagcgccaaaaaaagaaaagattaattatttttaaattttcagttcaaaaaagccgtaaaaaaattctaaaaactaaacttcaatgattcggaattatgataattatttataatttagagatattctcatttaaaatgatcaaaaattttctccaaaggatgctaagcccaatattaaggtcagaaactgtcatcaaattaaatcaaaaaagtgcactcaaacgaattgacgcaatagaaaaagggaaaataaaggcattggctcccaaacacacaacgacagcgaagcttcagcgagacattgacaaggacaacaaaatcaaagaagtttaacagaatgttttttatctactgatctaaattcatgctttaggtgctaaactcaaaagaaaattcgtttattgacagaattaacaaaatcactattaattcttccgatcctccgataacagcaaataggtaagcataaaattgggtgcatattaatgacaactaagagttaagccagttttcaaccttttttcgaattgtacttaatttgattcaatccaatctttaattggaatttttgttaaaattaataatttacataaactttttcttgctacgccaccggacacatattcccttattgttagaatatacaaaattcaaaaatgttaaatattatgaactggtaaaatccaacaaatgtataaacctttcctaattgtaagcattaaatttttagacaaggtatcagaaaggagcaatatggtcagcagaatttcagtgaacacgaatacggattttttgaacttcctttggaaaagatg

SEQ ID NO: 107562 - DNA, 399 bp, Heterodera glycines
  Promoter: Source sequence=SeqID_17477; Location=871..1269; Strand=+; Gene=SeqID_81984
aaccgataagaaacaatgaaatttagtgacttaactaataaattcctgtacatttacgcatttttcttttgaaaaaaagttgtattacattcactatttgattactttttccgttttagacgacttaaaatctgattaaaaaaaataaaacaaattattgtgtaaagacactgtacaagcatcatcaattcgttcattaaactccgaacaattaagaaaaatgagagctcaaaaaaatatggaaaataatgataggtacttgtatttggcgttttcagcatttttctatttcaaataatttgggttatttttttctgaaaagttcgaaatttagtcatctaaacggcaaaaaaaaaatccaatatttttcgtttttttatttttaaaatattttaaatg

SEQ ID NO: 107563 - DNA, 433 bp, Heterodera glycines
  Promoter: Source sequence=SeqID_88; Location=2900..3332; Strand=-; Gene=SeqID_64507
ggtgcgaagctggtcccgcactttgtcaagaccagtggactggtgagaagtaacgtaggaaatctgagttcatcaaaataaatgtggactgccttttgaggattgtggttcaatggccagtcccttaaaggattgtagttcgcactatgctgatctttcccctacttgggaaagattcggcaaaaaatgcataatttttatctgcattcttaatgggatgtgtgagcgatcaatttctgcactcaatgacctttgtgcgaaattggacatgtttgattcgcagcggcatcactgtggaaaacaaggaagatgcaccttaatttttcacatttcaatgtttttgataaatatttgattaatgtggtttattggttgttttccccaaatattttgccgcatgtacacatcattgcttcatttttgttttcagatg

SEQ ID NO: 107564 - DNA, 129 bp, Heterodera glycines
  Promoter: Source sequence=SeqID_45177; Location=664..792; Strand=-; Gene=SeqID_72528
cgaccgaagccgcaatcgcatgggcttaagtgatttcttttggaataattttataaatatatcgcaaataaattttaaaaaatcaactgtttgaatgtcctttcgtcttttagtttgtggagtattatg

SEQ ID NO: 107565 - DNA, 386 bp, Heterodera glycines
  Promoter: Source sequence=SeqID_7896; Location=2953..3338; Strand=-; Gene=SeqID_46498
tcccccgtccctttttgactctaccgccctgttacgtttcctttccatttattcttccgctcatcgctcactccattcgatttctccctttatctgtgtccccgctctcattttcctttccttcccctctcttttccagttttgcttcacaaattgtgaattcttagggactttgaattacccatttgagcataaataaaacgttttttcttgtttgattttgaaaggtggagccaattcccgctcctcctcccccccccccattcgcattcattcatttaatttcgccacctcccccccccccccacttttcccattttgtttctctcctcctcgaccttgtcgtctccgtcaaaggtcacttctccattccccttcagcagatg

SEQ ID NO: 107566 - DNA, 85 bp, Heterodera glycines
  Promoter: Source sequence=SeqID_527; Location=2726..2810; Strand=+; Gene=SeqID_55416
ggtatgtttattttgtcacgaatggtttttttggacagcccttttgtttttagacaccgactccatctactacgtcagcaagatg

SEQ ID NO: 107567 - DNA, 148 bp, Heterodera glycines
  Promoter: Source sequence=SeqID_35930; Location=1..148; Strand=+; Gene=SeqID_65386
tacaaaatttaaatttgccttttgtttatgtttttaacacacacaaatatttatttaaattttaatttcatttgatttattatttcacagccgacgaacgcttttccaaattcgcccatcacaagcacaatcaatttcggcacaaatg

SEQ ID NO: 107568 - DNA, 186 bp, Heterodera glycines
  Promoter: Source sequence=SeqID_79; Location=3104..3289; Strand=+; Gene=SeqID_63060
tcttggctttttgagttttaacatatgttttagtgtttttataatatatatatatatatattgtgtttcctaaaatagagcccggggcctttatttttcaaattgtcaaaaaatcagctgaaaatatattaaaataaatttgatacaatcggctcccttttttatttagcttagagattatttatg

SEQ ID NO: 107569 - DNA, 172 bp, Heterodera glycines
  Promoter: Source sequence=SeqID_31673; Location=806..977; Strand=-; Gene=SeqID_61985
tgcctatcagcagaagtgccaatttcgtttgaccaaataaatcccggcggcaccgccagcagtcggctgcttcaaatcgtaaaaaaatacaagaaaatctgaaaatgcaccctaaaaattgactactttacgtttcttaagcatttagaaaatttctttatatatttaaatg

SEQ ID NO: 107570 - DNA, 103 bp, Heterodera glycines
  Promoter: Source sequence=SeqID_3469; Location=2392..2494; Strand=+; Gene=SeqID_84799
ttcctaataaatacgagtaaaaaagcgaaaaatgctagtaaatttaacattgttatttgaatttattaaaatattagcatgcgtggtatttctatctaaaatg

SEQ ID NO: 107571 - DNA, 155 bp, Heterodera glycines
  Promoter: Source sequence=SeqID_9838; Location=1135..1289; Strand=-; Gene=SeqID_72858
aattctatgtcagtatgctcctctaccataaaacccacagcgtcaacattctcttactgctctattaattctaattctctaatttactaaattaaatttaaaagtttttatataatttattttggaaatatatatatggtaatttgactaaaatg

SEQ ID NO: 107572 - DNA, 54 bp, Heterodera glycines
  Promoter: Source sequence=SeqID_32958; Location=1..54; Strand=+; Gene= SeqID_63170
gttttgacgagttaatcgcagtgggcaaaaagttgcgtcgaaagtggcccaatg

SEQ ID NO: 107573 - DNA, 190 bp, Heterodera glycines
  Promoter: Source sequence=SeqID_14535; Location=1..190; Strand=+; Gene=SeqID_78586
aaatcccaataattgccttactttaatccctttccatcgcattcggcatttccccagaatcagatattaacctcgatgtaaaggctttggaggaatgcatttaatgctttgaggtcgtctatgtaaataaaagtcacgttttataattacgttgatcaagcgaaaaccgtatgattctaattcagcaatg

SEQ ID NO: 107574 - DNA, 87 bp, Heterodera glycines
  Promoter: Source sequence=SeqID_26945; Location=368..454; Strand=-; Gene=SeqID_57689
ttgacaccctcctaatattttcatctggctcaattaattaattaatttgcccgcttctcgtcagcgcttcaacggcacccaaagatg

SEQ ID NO: 107575 - DNA, 1003 bp, Heterodera glycines
  Promoter: Source sequence=SeqID_2269; Location=474..1476; Strand=+; Gene=SeqID_78834
aacactggtaagaatggggtctgggtgagaaaagagaagggaattggtggagaaagagaaacttttgagtaaaaaaaattaacttatttattacatttacatcagttgttcaaattctaatgtggactagtggctgaccttctgactttcagcatttgtcacttcggatcaattccacaatgtaatatatactttttcctattttctttactaagtacattatttcaattgaaatttaattaataaatgatatttctacttaaaaattattagtttttctttttttaaacagcctagaaccacaaattaaccaaatatttagtcatttttaggcaaatatttttttgaatataagcaatttttcataacaaagtgcactcaaattttcaaatttttttcaaaaaaattttctcttgcgaaaagtcccggttattcccggtcccggtttttctcgcggtcccggacgaaaatcgaggtcccggtcccgacttttctggtcccggcaagtcccggtttttgtcaaaattcccggtcccgtgcaactctagtcagcggtattcgaggaacaaaaatgaaataaatcactgtggacggaaatgattaattttaattgccaccaacagacaaaagaattattgactcattaatcaggtaattaggagttgagcatttcgtaaagcgacactgtgaatgagtatttacttttgagtgtaatgttttcgctccaacggaactgaaaagggatgcgtagttattattgtttgacgcgcctctttcaattagtgggccattagtgttaattaattaattactcaccactctaccaattattattaatcgtcatttattagaagaaaaaaagcgcagtttttatttttctgaactaacttcctattaaatacgtaccattttttaaacaattaaaaaccgtatcaaattttatacagtacatttcttggttaattaaagcggtcattagagctcattaatttgactgacaatg

SEQ ID NO: 107576 - DNA, 69 bp, Heterodera glycines
  Promoter: Source sequence=SeqID_20221; Location=2611..2679; Strand=-; Gene=SeqID_85020
aaattcatcgatttaactatgattgaataaaataaaaaaattttcagatgcacatatacaaaaatcatg

SEQ ID NO: 107577 - DNA, 118 bp, Heterodera glycines
  Promoter: Source sequence=SeqID_19090; Location=1..118; Strand=+; Gene=SeqID_83837
tattaagatttgtaataaaaaattattttgtgatttaatggcaaaattaaagcgaaatataaaaagagaggcggtgaaacagcggtggaaaaagcaagaggagcgaaggaccaaaatg

SEQ ID NO: 107578 - DNA, 351 bp, Heterodera glycines
  Promoter: Source sequence=SeqID_28227; Location=1..351; Strand=+; Gene=SeqID_58868
aattatcttttcatttccctcactgcgacccctgtcctccccgtccactttgttttctcgttcgaactctgtttttgaattaaccccccccccctctccctctggcaattacccatacgccccattaatcgcattaattaggtgccgttttgcactgttcctgttggaccactcgtcgaattgtctcgcaaaaggagggcaaaaaagaccacgtgcgcgagaatccacagctcactttcaacgccaacacaaacattttggagcttggagacccaatgccaattgaggtgaagccctcattagattattaattacaaactttttaaccaaattaattctcagaaattgatg

SEQ ID NO: 107579 - DNA, 1003 bp, Heterodera glycines
  Promoter: Source sequence=SeqID_545; Location=475..1477; Strand=+; Gene=SeqID_55817
gtttacaaattatttttctaatttttcaataattttggcaaaaaactagggatatacgggatcgggaccggggcgggaattcccagtcctccgaggtcccggtcccggatttacaaaatctatttcccggccccggtagggcaaacgggaaccgggaaaaataagcactggtaagaatggtgggtctgagtgaaaaattagttacgaaaattggagttaaaggaaataaagttaaaaaaataattaatatattgtaacgctgcaaattgtgcgaatggcctagtggctaatcgtcttgactttcccttcttctttcccctggttcaatccctctacagaaattaaattattttgaattttctttttatatactcatggggttcctatcgacaaaatatgattgctcatttgtcagcgttgttttttataaaataaaatttgaattttttaaatttttttgaatttttaaaaattcccggttggtcccggtcccgaacaaaaaccgaggtcccagtccgggttctcaggtcgcggcaggtcccggtccctgttttggcaaaatttcccggtcccgtacaaccctacaaaaacctttaaaaaattttaaatttctggcagagaattcaatttgattaataaaaagaaattgaaattgttttatagaatataaaagcaagtgccttgctgagctaaaaacgtaagttatcatttattaaatgacttacaacaaaaaaggggattaatcaaattttaattaattttttctatttagctgctactctgtgtgtcgcggcattgacataaaggattgttacgaactgaagagaaactgctcggcaaattttaaatttatattaaaaagataacaaagctaaaacaaagaaggccaaaatttcggtgatttcgctcatttctttcaaacttttgagtggttatataatttataaaataaattaatttataagtgcgaaacaaatctttgcagaaacatttgtggaaaatg

SEQ ID NO: 107580 - DNA, 966 bp, Heterodera glycines
  Promoter: Source sequence=SeqID_16069; Location=1341..2306; Strand=-; Gene=SeqID_80429
tctgtcgcactggagttgggatgtcgccgcctttcaacagagggctgctgatcatacagccgaggtgtgtaggttcgatgttgcgctcacggctgtcagcaatagcctcgtcgatgcagtgttggaaaattccggccaacagtgcctcaggcgtgcttggcaaatccgtaatggtgaactttgacttgacttttacgtagtggaatttggccacgtgttcaatgctgttgtccaattttttaacgtagtccttggcctgttttgatgttccttcgccttgttgaacagatccaaggaagtggactacgcccaagagttcattgatcaggaagccttgtcggggccttttaggtgcggagagaatatggtcaatggaaaagttagaggatcgttttcagggatgattgtccatttttttaatctgagaaagggtgaggagtgagcaaaaatctcggtatttatatgcgagcgccggcatggaaaatggcgtaaaatggtgaatgaataataaatatttgggcatggaaaatagtcaaaaaatataaaccaactatggcctgaagagcagcacaccgccacccatgaagcacaagacgacagggcacctaaacgactcgggaaattagtcaagtcacgcgaacgacctcaagccctaaaaggcaaaatgctgccaggataaacggtgctttttgtaattatagctaccgccctggttaacagcaaaatattaattttaattatacggtcccgaaaattcccaattaaataatatggtccccataaagcaaaagataagtgagggaggagaggaaaacagcagatgtgcaaaaaaagatgaaaatttttaaaatgaatcgggaaaatgaccgggtgtacgatgtgtgcactttggccacgcccacttgcgcaccaaaattattcccaccaagaaatcgaaatcattctttattcaaattttggaaaatg

SEQ ID NO: 107581 - DNA, 752 bp, Heterodera glycines
  Promoter: Source sequence=SeqID_3879; Location=1..752; Strand=+; Gene= SeqID_52256
tttttctaaattttgcaggctaatagaggacagatagggctatcgaatgataccaagattgttggatttggttggcaaagaaaaaaattatagccaaaaccccgctggggcccaaacgtgccggggcccaactgaggtaaaccggaatgctatcccgacaaaggaaagtacttttctggagtcattttaggcgctgttgaagaatctggtgtcaaaaatctgtgattttgtctatgattttcattatgtacctttgttaatgatttttcaaaaagaaacaaaatgaacaaattatatatcaatcattttctttcgtcgaagaggaatcgattggtactaatttcagattatagcccaacaaatttggtgcaggaatggggcggaacactttattaagccggtaattagctttttggcaaaacaccgcacattcgactaacaataaagcggcccttattctttttgttgaaaaatcatgatgaaaaacataaaatgaatgatatatttttgctcttttgacgacaaattcttaaacagcgcataaagctactctagaatagaaaagtgcttccttgcccttgtcgggatcataacatttttatggggggggggggggcgacataatggataagagaacaattttgcgatttttaatatggatttttattggcgacgcaaggggaaatttgaaaaattattctgatttgtaacagattttcatctatttgactccccttctttgcgcagatatg

SEQ ID NO: 107582 - DNA, 237 bp, Heterodera glycines
  misc_feature (42)..(42): n is a, c, g, or t
  misc_feature (169)..(169): n is a, c, g, or t
  Promoter: Source sequence=SeqID_25219; Location=1293..1529; Strand=-; Gene=SeqID_55962
acgtatccaaaacaagattaaatgccaaacttgtttttaacntcatttaattttgataaaattaatataaaaatgcaagaattaaaagaataaaaaaaattaaaaaccatcacttcaagcattgaaatcctgattttccggttccgatttttaaattttggtcccatcnccgtgccatccatcaatgggtacttctaagttttgtcacccccctgaaattttttttctaataatatg

SEQ ID NO: 107583 - DNA, 158 bp, Heterodera glycines
  Promoter: Source sequence=SeqID_35784; Location=1..158; Strand=+; Gene=SeqID_65254
ctcgtgcagtgtcttcttcacttcgctttgactcatcaccaaaagttgttgaaaaagggggaaaaggaaaataaaaaataatctaaatttgtgggaaatttaatgagaagcataattcaagagtgacattgaaaaaatgataaatattttaaggaatg

SEQ ID NO: 107584 - DNA, 254 bp, Heterodera glycines
  Promoter: Source sequence=SeqID_41482; Location=1..254; Strand=+; Gene=SeqID_46663
ttttctcgcaatttttgtggccacaatttttcaagcttttagaggttgtcatttgcattttatggtcgttttaactgtaatagggtcgggtcgtacgaaggcattccatttcaacaaaagtccgtacataggtccaaaaaatttgttttttttaatttcaaaattttcaggttcaacagtttgtgtccttcacgcaggccaacgaacagacggcaattacatgtttgacggcctccaactggaacttggagatg

SEQ ID NO: 107585 - DNA, 120 bp, Heterodera glycines
  Promoter: Source sequence=SeqID_21368; Location=741..860; Strand=-; Gene=SeqID_45640
ttcttttttcagaatgtgctcaaattaccccaagcgcgtcgctttgttttctgcgagtttttctattcgggcgtcgatcagcagctgtttttggccgaaaatgaattttcgcagctgatg

SEQ ID NO: 107586 - DNA, 656 bp, Heterodera glycines
  Promoter: Source sequence=SeqID_34097; Location=1..656; Strand=+; Gene=SeqID_63973
ttccaaacattggggactcaacccaccaactttcaatgacattccaatctctggaactcaactcaccagcatttcaatctctgggactcaaccctccagcattctaaacaattgactcaaatctccggcattctaaacattgggactcaacccaccaacatttcaatgacattccaatctctggaactcaactcaccagcatttcaatctctgggactcaaccctccagcattctaaacaattgactcaaatctccggctttctaaacattgggactcaacccaccaactttcaatgacattccaatctctggaactcaactcaccagcatttcaatctctgggactcaaccctccagcattctaaacaattgactcaaatctccggcattctaaacattgggactcaacccaccaactttcaatgacattccaatctctggaactcaactcaccagcatttcaatctctgggactcaaccctccagcattctaaacaattgactcaaatctccggcattctaaacattgggactcaacccaccaacatttcaatgacattccaatcactgaaaatcatcccatcagcatttcaatctctgagactcaattctcaggctttccaaacattgggactcaacccaccaactttcaatg

SEQ ID NO: 107587 - DNA, 152 bp, Heterodera glycines
  Promoter: Source sequence=SeqID_39723; Location=632..783; Strand=-; Gene=SeqID_68224
cctatttctcgagtgagccccgatcaactccaataaccgtcaacagtgcaacgccgaactgaattagaacccccggagtgctctatttttcagccccactcgaaaggtctaattcagagggtgctaagtcatttcgcgaaaagcgcaaaatg

SEQ ID NO: 107588 - DNA, 217 bp, Heterodera glycines
  Promoter: Source sequence=SeqID_38036; Location=1..217; Strand=+; Gene=SeqID_66979
taaataaacacccagcttgtctacattttagtctaatcacaaaaaaactttattttttaaaaaatcaaaaaaataatttttaagaaataacattaatcaatgagtctataaaaagaatcaataaaatcattggttaatcacatatatatcatctatctatctatcaagtaaaagagaaaaaaaattgaagaatttttatatcgaaatattttaaatg

SEQ ID NO: 107589 - DNA, 144 bp, Heterodera glycines
  Promoter: Source sequence=SeqID_14942; Location=1284..1427; Strand=-; Gene=SeqID_79106
ttatatcaatttttttccaattccttccagcagaattggatccgtataaaaggggtcgtctttccctccgcttcacatttcttcttcttcttcttcaccacactccaaccaacgaaccgcttcagtgcgcaacgcaacgcaatg

SEQ ID NO: 107590 - DNA, 91 bp, Heterodera glycines; identical to SEQ ID NO: 100405
  Promoter: Source sequence=SeqID_45355; Location=1003..1093; Strand=+; Gene=SeqID_72664

SEQ ID NO: 107591 - DNA, 133 bp, Heterodera glycines
  Promoter: Source sequence=SeqID_29366; Location=1..133; Strand=+; Gene=SeqID_59871
taaattgtttcttttagtttttttatgaggtaatttaatacgatacgtccttcagagttcgagagtgctgtccagctccatttttggttgaagagagatgagatcactgcacaaataaagcgttgggctgatg

SEQ ID NO: 107592 - DNA, 57 bp, Heterodera glycines
  Promoter: Source sequence=SeqID_41625; Location=1..57; Strand=+; Gene= SeqID_69711
tttatgcttccaaataagtctattaatattgaacgctctttgttgcattaaaaaatg

SEQ ID NO: 107593 - DNA, 1003 bp, Heterodera glycines
  Promoter: Source sequence=SeqID_9376; Location=164..1166; Strand=+; Gene=SeqID_71163
ttatctgcatatttcgggatttttcttacatatttaggtacatattttgaccactttttgcatatatttttggcagccctatttattatatattgatagatccaaaagctgtgatcagaaagctcaaatacgcgtcattattctttttttgtggactattagttgggccaccattgtaaaaatgggatttttctcatttttattctgattttcgccaaattttcgtatatgaaggcattaattattatgtggcttaattgattgataagaatcggttgatttgtgccaaaaaaccgactttaatgccgatgccatcctcctcatccttgtgattcagcggttgcttttcctccccgaacatttccacggcatttggcacaaatgcacaatccacgacgccctccaatttggccaagtccgcttccaatgtgcgcggatagcgctcatagtcctcgtttgcgccaaattggagcggattcacaaaaatggagacgatcaccaggggcggagaggcgcactgatcagtggtgccattttgttccttgtatttgccatgacttttttggcatttatacaatgggatataaaaattagaggtcagatttcaggaatacacagtgtcagcctcaggatatacacggattttatcttggcaaactattgttaatcagacaaaattttcagtatttttcaaaatgaaaatttgaattaaaaaagtttcaatcggcattttgggtgggtttaaaaaattgaagttctgatttaattaaagtcagaaaactgggttctaatgcttcttaaaattttggatgaaattaaaaagttagtgaaaaaatagcagaaataaacattgacttttttgtcattattccattggcgtgcctggtgtgccagtcggagatggccttggtgaagggcacccattgtcggcaccaatgccacgcttaatgaaagggtacttttttcggttttgtacatacaccccaaaattttcaaaaatatg

SEQ ID NO: 107594 - DNA, 1003 bp, Heterodera glycines
  Promoter: Source sequence=SeqID_22210; Location=244..1246; Strand=-; Gene=SeqID_52881
aataaatcggatgtgtaaaaacggcggtaatagtaaagtttatccctccctccttttttcgaaaaaatcttttttttttgttttcaaaagttggctaaatatggtgttaaaaatcgggttttaagggcatattttagggatttttattgcatattataactctagtcttaagtagggctgggaattatatggatataaaatcgcaaaatatggccataaaatatggatcaaaattcgctaaatatggacctaaaattgcaaaaatatggacataaattttccgaattgaagtgtaaatttccaaattttcttcaaattaaataaatttactaaaatacatataaaactggctaatatggttttaaaaatcattttagaataaaaaaatatgataaagctaaaatttactaatttttagcgaaaaccaaacccgaaaagcgaaatttttgcttatttttgacataaatttaccaattttaagaaaatttgaagtttattcaatattctcgtgaaaattttgcaaaaaaatgatttttttggaaaattttctggtctttggggaatccaaaaggccaattagctgattggggccgtctaatagaggtaaatcacaaaatatggacataaaatttggacaaaaatgcgaaaatatggaaataaatcgcgaaatatggaaaatatggatatagaaatccatcctagaagcttcaaaccatgctaaaaacatgtttttcgtgtgtttcaggcgataaaaacccaactcgtactgttttttggcaaaaaatcgtcataacttttgttaaagtcaaccaaattaaacattcttggtatcattcaatagcccttcaaattctctatctacccactaagtttcaaaaagttttgtcatgtttgaaaaaagttatggatgaattttttttacgatttttggtcataactttcttttttgaaatgcaataaaattttcttgcattttaaaggctattgaatgataccaagaatg

SEQ ID NO: 107595 - DNA, 60 bp, Heterodera glycines
  Promoter: Source sequence=SeqID_19539; Location=1..60; Strand=+; Gene= SeqID_84271
gcactgtgctggcgactgtgcctgcagcagaacaaaaactgtggcacatcgtgccaaatg

SEQ ID NO: 107596 - DNA, 107 bp, Heterodera glycines
  Promoter: Source sequence=SeqID_26387; Location=1..107; Strand=+; Gene=SeqID_57120
gattagaagaggtacaccagttgattaaaacagttttttatgtgaattaaaaaaggtacaacagtgattagaagtggtacaaaaggattagaagaggtacaaaaatg

SEQ ID NO: 107597 - DNA, 893 bp, Heterodera glycines
  Promoter: Source sequence=SeqID_23058; Location=520..1412; Strand=+; Gene=SeqID_53764
taatgatgggcaaaggattgagattcgactaaagtggtattattttgatacaatatacataaatatttgaaattaaaaaaaggaaaaaagcattgttaaaatcaagaatgaaatgcaaatgcaccaattcccgaccaaacattacgccaagaaaaaaaaaaaagaactaacttgagaagacccactaattcttcgtcgagtgtatgacatgatctgctgacgaacttgtacagatattttcagacttcttaagaaaattaaatggttaaattcacaaaaagaattattttcttcgattaaaaaagaatggcacttcaaatgtgataataattagaacggtccggacccaaatccggtttttccgggagccttagcaagtaacccgtattttttcgaccgatgtctttttacgtactacaggtgctaacaatccttcgctcgctcgggcgcccctctatttgtgtcgtcatcgcatgcttgttattcgcccgaacaaaagttgaaagtaaattttcaactaagttcactttatgcaccaaaaaaggctatttttcgtgcaattttttaaacttacaatttcgaagctatctaacgcagccataaaattaaaaaaacaaagtgattgaagacacaattttatttattttgggtactaaattgaattttttttaaatgaatttttgaattttgtcaaagtccgggctcggagtttgaaatgagtgaaattggatgtctgaaaacgaatttttgcaaccccgaaaaccacattaaagttttttctctaaaatatggaaatttttgaaaaatctaaattttggcataatgttgtaaattttcgaaaaattttaaattttctctgaaatttattgcgttttatttttttgcgtaggatg

SEQ ID NO: 107598 - DNA, 457 bp, Heterodera glycines
  Promoter: Source sequence=SeqID_32092; Location=1283..1739; Strand=-; Gene=SeqID_62410
ttaatttccgcaaaaaccttaatatacacgggccattccagaaaaggaatgagggcgttagggtatggccagttcaacagacagtaacggaatttttttgggaagtatgaaaagggttgaacaattttgggtttaatatgactaataccaggaggacaacgagggtattgatcttattacagaagggacgactaccgtgtgcattcaatttagatcacctgtcccatcgggtgggatcaccctaatagccatgagtgaaatggactctattttgatattggataaaaatcgaacagtaatgaccgatacaaccatttaatgtatttaaagtgatttattatttatattttataatttttttaaaatgtttattttgtttgttttatttttaataaatttttcttcgagttataatagccctattctctaccctgaacgatccagggacatcgaaatg

SEQ ID NO: 107599 - DNA, 606 bp, Heterodera glycines
  Promoter: Source sequence=SeqID_14623; Location=1..606; Strand=+; Gene=SeqID_78705
tgctaattaatgggggctaaataattttttttaaatatttatttatgtacacgttcatcgaaactcttcattcagtcatggcaaactttgttatattgtcataacagtaaagaaaatttataatttggcaccatttgttagagcttttcatgtgtctaatgttttcagtaaataaacatttctttcatttaaaagggaagcaattagtaatcaaaaatatgccaataaatttcattcggctcattaagcataaattgtccctctcttatggcacgcaaaaaaataacaataatattttaaaagaaaatcaggcttattataggttaaataataaaaaataataattttagacaaaattttatttattagaaatacatatttaacgcgaaagtttaaatggacaaaaaataaaaaaataaatttcaaacaaaaatttgacttaattaattaaaaatttaagacttttatatttttcattaatactcaaatgttggctgtgattttcaacctttcccaatgattgaaagaaaaaaatccaatcctttaaataatatgtttaaaattgaaaatattgtttcgtttttcaaagagtcccccacagtgatg

SEQ ID NO: 107600 - DNA, 110 bp, Heterodera glycines
  Promoter: Source sequence=SeqID_12980; Location=293..402; Strand=+; Gene=SeqID_76739
ggtaaggccgactttgttattttattcattgcccaaaccaatttagcgaagatttgcaaaattacatcccaacgggtgtgctgctgaagtctgaattgcgcgacaaaatg

SEQ ID NO: 107601 - DNA, 1003 bp, Heterodera glycines
  Promoter: Source sequence=SeqID_4801; Location=82..1084; Strand=+; Gene=SeqID_55767
caaaaacacggtttttgagaagaattaaatttattttgttaaaaatgggattaaaatattttattgttgtttaattaaaaaatgattatcatatattaattaaattagccttgtaaaccaattaattaatatatgaattacatcgattgtgatttatttaaaaaccgttttggtaaattcttacttagtccatgagataaaaaaaatgaattaaaatttataattttaattcaattaatagttaggacaatatatattagtaaattattaggtaaaataaaataattaaaataaatgaataaaattttttattcagttacttcgagctatgaatattaattaaaatatcaaaaataaaaaattgccataataaatttaagaattttacaaatattatttgaataattaaggtttttattgaaataaaataaatatacgaaaatttatttgtcgttttttaagatgacagaaaatgagtcagaaatacataagaaaacaatgtgaaaaaaaagatgacgcattttttgctgcttcaaaaagtgatggcgaaacaggccaaaaagcaaacaaaacataaaaaatgaaggaacaaacggaaaaaaataagttgggccaaattgaaaaaattaactcacaaaaagcacaaaattaatcttattggcaaaaaaatttattaaaaaaatatagcaaatatttattaaattttttgaagtatttgtttttggggaaatgaaataaaaattttgcgaggaaaataattccaattttacatatttttgtggtaatccgacgatttagcgggggaagtaaaagctaatgaatgacattggccgattgattgattgattaggttggaattggaatatgattaacagaaattgcccgtttcgtgtgttaaagccccgagcataaaaatgggcgaatgctttgtgtttgtggccatatgattgctgatgggttgggtggactcataagcacgtgattttgttgaaagccaaaaatg

SEQ ID NO: 107602 - DNA, 272 bp, Heterodera glycines
  Promoter: Source sequence=SeqID_25541; Location=1095..1366; Strand=-; Gene=SeqID_56281
cctggaatgaattgaaaaaatcataaaagaattaattaaaaaataatttatgattaaaaattaatacattattttgcttaatacaatttttaaattgacggacaatctttaaaaagagtaatgaaaactgatgctatctatatttacaaatgatattggcaaatgcattaccgtatcagtgacccgggggcattcgacgatcgaaataatgcgaaggttttggttaaaactgaaaagagcgatttaactgaaaagttcgtgattaagaaatg

SEQ ID NO: 107603 - DNA, 97 bp, Heterodera glycines
  Promoter: Source sequence=SeqID_5811; Location=1..97; Strand=+; Gene =SeqID_59308
ccgtggatttggaaatttcattacttttgcggtgagtaattttttaacatatttacttaattggcatatctaattatggttaatcaaggaattgatg

SEQ ID NO: 107604 - DNA, 355 bp, Heterodera glycines
  Promoter: Source sequence=SeqID_30333; Location=1..355; Strand=+; Gene=SeqID_60754
tgaaagaccaaaaagccaacaaagcacaaagacggagcaacaaaaatgctggaggtgcggtcaaacgaaccatcaccacgcagcttgcccgcagaaaggctacaaatgccgaaagtgctcacaaaacggacacatcgagtcgcgttgtgaagcagtgcaggaatggcgcaaaaagaacgccaaaagttggctcaagaaaattgttggcaatgtccacatagtaacagtcaacattggcaccacagcaaaaccgacaacaaagtcaacattgctaagggtcaaggtctcctttcaaggcaaagtcatcgaatttgtcctcgacagcggtgcagaagttaatgtcataaacgaaatg

SEQ ID NO: 107605 - DNA, 533 bp, Heterodera glycines
  Promoter: Source sequence=SeqID_8927; Location=1..533; Strand=+; Gene= SeqID_69662
ctactgatcagcatcaattgattgattggcacaagaaaattgaccagcagttggtccaatcagtattgatcaaaagcagtagagtgtctgtttccatttagtgttctgtttgttttttttgataattgttgttggtattgtccaaatattgatcaatgctgatgacagctaaactgatctgtctgaaggtgatcagcaagtttgatcacaatcactcaactgataagggggggggggatcatcagtcaaaacggtcaaatcattgatctggtgatcatcagtgaatgaatgacaagggataaacttaatctcgtcggaaactcattcattagcactaaatgctcggagcgggacgggatcccgcgcgggatttttcgggattcccagcttgcaatcccctaattttttggaaattgcgggattaatcccatgagttccaatcccaaagcgggatctgcaaattaaaaacggtctctacgcccatttttaagtcgttcgcatcggccgaaaaacgccgttccttccccaccatg

SEQ ID NO: 107606 - DNA, 1003 bp, Heterodera glycines
  Promoter: Source sequence=SeqID_1231; Location=3683..4685; Strand=+; Gene=SeqID_70244
cgcgtgcgtggtgtgtgggagggagggagtggggaaaaagagagattaaatggaaaagtaaaagaaataagagaaaagaaatgaaagggagagaacaattgaaaatttgtctcacatctcttccttatttacatcccattttttattttaataaaagaaagggaaatgagagtttttttatttctgttttcgcttcagtgagaattttcctatcttcttatataataaagttgagtgtgtgtatgtgtgtgtccattgtttgaatttgtgtggcgttttgtttgagttttgcgttaaaaataattttgaaaaaaaagaaatgttggttttgtttttttcattttcgttttgtcagttttgcaaaaagcagtctttaaaaatgttttctcttcttttttaataaaaaataattttatatgtttattaataataattaaatcgcattgaatgctttcaattgcatttgttaagagaaaaaaataattagtttttgttattaataaaaagcatttggaaatgaatgctcttagtacttttgtaaacaaaaagaaaatgtttttgtaaatgaattcctttgttattggattaaaattgatttgattagttatgaattaatttatgttgtgagtattgtttttgattatggcaaactcgatggaaatgttattgtttttgatattgcattgaaaaagttttgattcaagaatttgttttgaactttgaaatgaaaataatttgaattctttttatttttgttttgtaaaaaatatttgtgtattcgttcattctcattttctttaaatgtttttacttttttggtattttgttgttaaaagaatacgtttatgtttttgatgcgatgtttggttatgattttttcattttgatttttctttttacgctgaaaaagaatttcgtgatattttcgtctttgtctttgctgtggttttttgtggtttttgttgggttacgtttagataagtcgactgcttttcacacaatg

SEQ ID NO: 107607 - DNA, 1003 bp, Heterodera glycines
  Promoter: Source sequence=SeqID_9689; Location=2317..3319; Strand=-; Gene=SeqID_72357
tgccttaaaattgctaaaaatagcttttaactctcaaaaaattgtgtaaaaattaataattgacattaaaaacactaaaacaagggctaaagagcactttatagacaattgcaaaaattttgaatttccaaattttaaaatttttattatatgctaaaacaaaattatattttttatataaataaatttttttcacaaagttcttacaaaaaagctaaaaaattttcgatttttaagggtgtatattttaaaaattccaaaaaagtcaatccttatgggttatttttcgctcatttttttgtgaaaattccaaaaaatcactaaaatatggcctaaaagatgcaaaatatgcatttattcttgaaaacccccaaaagcttttatatgcactaaaaaccttcagcaaatcaaaaaattttaacatagaaatgctatttttgagcccctttcttcatagcatatgcgcagaaaaaaatatgcaaaattatacaactttgaaccctagtcattaatatgttagttaagtattattttgtgaatatttaaatttgaattaccatttaatttcatttgattattatcacttattttagttgaatttggattaaaatgattattttattttctcttgtcgttttaattcattctgagttcatgctctttgttgcgggcaaacaaatcttttcctttataaacttatgataaatttttatatgtatattttcataatatttatcttttatagaaatgttacaatattcaatagttcaaaaatttaaaattttattataaatatcctcataaattagtcaaataatcctttttcgagcctcttgcgcctttgtgtcaatattccaaagactgtgagtttgacttttaatatatttttgttagccttcattatttaattacaccgaataaatctgaatatatttttttcaattataataataataatatttgttaatacgaaagcttttagcattcacattcgcttattatg

SEQ ID NO: 107608 - DNA, 396 bp, Heterodera glycines
  Promoter: Source sequence=SeqID_14506; Location=1631..2026; Strand=-; Gene=SeqID_78551
ttctgttgcttcattcagtccttgccttttcacatttgattcggagcacaaataaaagcttttggtgaatctccagtcagtttagcaaaaggtttttgggcgtccagcgccattttatacacattatacaaaccgtagaatagaaggtataataattacacattatacaaaccatagaatgtgacgccagaataggaagggcaaaatgaaaagaattctcactatttgattttcccattaagcctctcaaaactaattgaaattttgttaaattttaaatttgcaatttttgccacaaaaactatggccaaatgcccgcaaaaaatgctccatttcgtccccaatttattatttttattcattttcttctcggcacttttcttttggaaaaaaatg

SEQ ID NO: 107609 - DNA, 101 bp, Heterodera glycines
  Promoter: Source sequence=SeqID_805; Location=4136..4236; Strand=-; Gene=SeqID_61690
ttcgcgttttcaagtgagcgacgaactcttccgccgaaccatgcaagaagcctgtgcagaaatgccctccctcaagcggctacagctctatctctgccatg

SEQ ID NO: 107610 - DNA, 71 bp, Heterodera glycines
  Promoter: Source sequence=SeqID_24380; Location=1470..1540; Strand=-; Gene=SeqID_55111
tttttcaattgatcgtcaacatttttgtttttgtccgctttcagttggctgtccgtgcctttcttatgatg

SEQ ID NO: 107611 - DNA, 873 bp, Heterodera glycines
  Promoter: Source sequence=SeqID_5281; Location=362..1234; Strand=+; Gene=SeqID_57545
tccatctaattttttttcgtgctgcagggcgtttcttttcttaaattgccccagggacaataaaatatttaaaaactcgaaaaaacaaatttcaggtgactatgaattttttaaaatataaaaaaaaatttcaaattttattgcaaaaaattattaccatttgcttttctgaacatattaaccataagttttttaatcttgtgcatttttttcaacctttgtagacgaatagagaactcttagagctaccgaaatagcaagaatatttcatttggatgcttttagaaaagtcatggggcattaaatttgtcaaatattttatggtcgtgtctttttttttgtgtttgtgtaaactgcaatagagccgagatttgaatagctaaagaatattttaattatttaaaatttaatgatgaattcaatggtgctatgacgttagtcaaaaaccatcaaatgaaaatattttttcatataacttagttcaaaagcaaccaaatttttaatgcttaatatcattcgatagccataagtgatttcgatcatatcattaattccaagaaagttatgaccaaaaatgttcagaaaaacttggttttttgagtttctcaggtcataactttttaagaacttaaggaatttttttgaaattttgcagaataatagaaaacacttggtgctatcgaataatatcaagaatttaaaatttggttgatttatggcgatgttatgaataattttctgtcaaaaattttccatttgatggttttttgactaacgtcccagcaccaattcaatgaatattattttctaataacgattattttaaaaaatgaaagctcacctctatttttcacttgtttaggcttagcaatg

SEQ ID NO: 107612 - DNA, 298 bp, Heterodera glycines
  Promoter: Source sequence=SeqID_1857; Location=1..298; Strand=+; Gene= SeqID_76393
ttctgcaacatcaatcattgggcatgaggaatgccaaaacgtcgacacactcaaccaacggatcagcatcgtcagagaaaagaagctgtgcttcaaatgcatgaagccaaaccaccgcgcatcaaattgcgctcgaacatctaagtgatatcactgcaaacgtcggcatcccacggcactctgccgagatcagtacaaagccgagaatggcatcaacacgcctagcacctcttgcagtgaagagaagccaaatgccaacgatggcaagcgatcaacagtgatcgaacaacaacaaatg

SEQ ID NO: 107613 - DNA, 223 bp, Heterodera glycines
  Promoter: Source sequence=SeqID_12629; Location=453..675; Strand=-; Gene=SeqID_76297
tttgaccaattttttttcaatttaaacctgtattttccttggagtttttctcccgaaaattcaggcccaggtccaaaatggaacccaggtccaacttttttcaaaatgtcgatgtctaatgaaactaattttaaaaattattaaatttgcattttattattaacaccaaataattcattcttgctgaaaagacacaaaatttattgttattcatttttaaatg

SEQ ID NO: 107614 - DNA, 324 bp, Heterodera glycines
  Promoter: Source sequence=SeqID_10507; Location=2445..2768; Strand=-; Gene=SeqID_73732
tttatcgagttggttccaatttttgttacccgccccgcaataggtataaattttttgcctaatttatatttcgagttaagtctataaaagggaatgttaaagaaggtttaagtatttcaaagggattcagatctgttcggccataaattattttatgagccatgaacagatcagacagctttcgcctgctttcaagtgttggcagttgaaggtattctaatctttgttggtatggaatgggtggaaggctgcatttgaaaagaactcttttggtgaaatatttttgacatttttcaattttttaaatattttttagaagagatg

SEQ ID NO: 107615 - DNA, 66 bp, Heterodera glycines
  Promoter: Source sequence=SeqID_24808; Location=1427..1492; Strand=-; Gene=SeqID_55555
gtggtcgttgttgacccaatggtatggagcaatggcctggacagagtcatgccttacaaaaatatg

SEQ ID NO: 107616 - DNA, 165 bp, Heterodera glycines
  Promoter: Source sequence=SeqID_1347; Location=6861..7025; Strand=+; Gene=SeqID_72954
atcactgatcaccctttttaaaagccaataaaatttatgattagaatttcaaaaatgccaaggaatggaagtcggttgctttattccgaattttataaattgcattttatggattcaattcattggtgatgttcccttttttaaagcaatatttagccagaaatg

SEQ ID NO: 107617 - DNA, 787 bp, Heterodera glycines
  Promoter: Source sequence=SeqID_3762; Location=742..1528; Strand=+; Gene=SeqID_51772
tttcgaaacgtttggtctctattaattataaaacaacatattacattttttgaaaattactgttttatttttttaattataaattaaaaaaattattatataaaatatttggtggcaaaaaagaggcaattttgagaaattacatttcaaaaaataaattatatgcaataaaaaagtgaatttattcaaaaaatgatcataaatttatgattacttttttttcaaaacatctttttttcacggcgcgctttttctaaagacttttagggagaaagaggttagacactttatccgcttcttcttcttctcccgctggtggcgaaaatagcctaaaattaatgaactttattttccgacaaaatcaaatgctattgctgtgttcacccaatggatttatcgaaattccacagattaaatacgttaattaataaaaaatatttcaacttataaattattatttttttcttttttaaacagcataaaattgcaaatttaaccaaacatttggttattttttgacaaaatctgtaaacaaatcgaattatataaattacaaattttttcccccggcggcgcctatcggcaccgccagacctcttgttcgagaaatttacattgaaaaaacgcgacgcggaaaatttcaacgtatttttccctgattctttcttttttaatgtctttccaaagtaattttcgatagtcaattggaacagcgaaagtgggcggagcaaaacaatttagaaataataaaatttataattttattttagcgattttcttggcaatg

SEQ ID NO: 107618 - DNA, 58 bp, Heterodera glycines
  Promoter: Source sequence=SeqID_16405; Location=1..58; Strand=+; Gene= SeqID_80804
gcgccgccaccgccggatggattagtgatcaccggttatccctctgctaatccggatg

SEQ ID NO: 107619 - DNA, 489 bp, Heterodera glycines
  Promoter: Source sequence=SeqID_10066; Location=1820..2308; Strand=-; Gene=SeqID_73133
agaataaaactcaaaaaaaggcccttccgttgatttccttcgtccctagggacggccccagggttttggcttgtagagggcattggagatacaaatcctttccgactacaaaatttgcttattgtgtactgtagaattggtcaaattcccatttttctaaaattgaaaggtcttttaagggtggacgagtcgaacacgcgtcagcgggtggagcacgtgccgaggccggtgattgaccgccagcgcagttcgcgcagtgacttaaactcacttagcccgttggtttttaaagggaaaattttcgatctgtcggtttcaaaaaacggaaatcaacacatttgggacttttaaactaacaaattttaatttgcaatgagtcactttgggaacctgtttaaaagggaaatgaaactgtgacaaatccatgtgttcagtgccaacgatttgggaaggcacagtttggccaatttatccatctccggcccaatg

SEQ ID NO: 107620 - DNA, 195 bp, Heterodera glycines
  Promoter: Source sequence=SeqID_10115; Location=595..789; Strand=+; Gene=SeqID_73198
ttttccctgaaaattttttcaaaaattttccctttaatggtcactgctgccacaaaaaatgcttaactcttgtcatttaatgcaaaaaaaaaatttttcaaggacgaacagcaacaacatttggtggtcgctgaactgctcgacaaacggcccgacctggtcgatgttcacgcgaccaactttgacgcccaaatg

SEQ ID NO: 107621 - DNA, 246 bp, Heterodera glycines
  Promoter: Source sequence=SeqID_23264; Location=1..246; Strand=+; Gene=SeqID_53972
ttggaaaatgagaatggcattcccaattgatcatttttatgcagtgcgttgctatgtttgaccataaacacttcacgcccattatctggttcgtgccgaccaacacttttgtgcccgctgggcgtcaactttttgtgtgttacggtgcgcatgacaacgcccgacttggggtggaatatggctttacaataaaggtggggggacagtaattatggccaactaattaagctaattaattgcagaatg

SEQ ID NO: 107622 - DNA, 581 bp, Heterodera glycines
  Promoter: Source sequence=SeqID_2368; Location=1443..2023; Strand=-; Gene=SeqID_79356
ttttgaatgaattagaattttataatacacaaaattgggggggggggggtggaagcatttcggaacccttagaattttagacaatccaaaaaaatcccccccaggcattacttcgacgtcccatcagacggacactcggctgacttccctgcgacatcgcctccgcgccgtcacaaatccattcttcacacgtgacgagggctatttggccatcggacggaagttggacgagctcactgagcaccacaaaaaggcaatgtaaggcgacggaggggggagggagggaaatccaattaaaatttaattgacattaattaattaattcccccccccgcagagaaaacaacgcggaactccagcgggccattgccgcgcactcggagaatttgaagctgctcagccaaccgttgcccgaactgacccgacagatatgcggagactgtgcccaaaatccaggcaaattcattggcatttccgcactaattaataggccaatgttttttatcgtttgttgttttttcacaggaaattcgcccgagggcgctcagctgaagcggatcatcgacaaggtggacgagatg

SEQ ID NO: 107623 - DNA, 333 bp, Heterodera glycines
  Promoter: Source sequence=SeqID_40314; Location=1..333; Strand=+; Gene=SeqID_68685
ttttgtgcgatgctctacatcagcaaacgctatgcaattcctcattggtctcaagggaacgcctccacagaaaggacctttcgtacttttcacaacatattgtcaaagtacatctcaaaagaccaaccggactttgatgaacacttagaagcggcaaccttctgttataacactgctgttcatcaatcaacgggagaaacacctttctttctgatgtatggtagggacccaatattttgcgttgatcaaattttagacccaaggacagcagacccagttgcttttactgatttaacagaattcaaatatcgtctaatcaattctttaagaatg

SEQ ID NO: 107624 - DNA, 774 bp, Heterodera glycines
  Promoter: Source sequence=SeqID_7454; Location=2103..2876; Strand=-; Gene=SeqID_64866
ttgttgtgattacgccctcatcccccttataaagttgagccctccccccttccgcccccattgttttcaatgagtctgataatttggcaattacacatcctgcacatttgcggatgaatttttgtgatagatttttgacagaacaggccttacttaatgtacagtatccatacataaattattatctaaatttcatgtgccgaaaaattgttttttgcagacttaaatttaacaagcacaaattgttttcaaaattttttgtatggaaccatgaaaaaccggtgatgcttaatgttgctgttgttctttctgtttttcacctgtttgtcaccaattttcatcgtcaaatcgtcgtcgggtaagctgctggaaggcgccgggaactgacttaaaaaatggggaaaaataagaaaaaacggaaaatgaaatcaattagtgatcgggaggacccatcccaaaaatgcttcagtagaaaacgcgtcagtcgcatttagtttttcaaaaatatatggaaattctaattgactcaaattaaaaaaatcagttatttcgatcttattattaatcaatcacatttacttttttgtctcccgctttttgagaattcggataacaattgatgaatcattagcaatgttgtcgtaattaacttcactgcccttgttaagtgtatgggtctaaatgatttaattgattaatttatgcattttttaagtttgatcatttctttaaacctacactaatgatttgttgtgccccattttggtcccaatg

SEQ ID NO: 107625 - DNA, 741 bp, Heterodera glycines
  Promoter: Source sequence=SeqID_4559; Location=867..1607; Strand=+; Gene=SeqID_54896
aattttactattgttttttgaaaataaatggtgttgataaaaattccatttatccccccgggggataaatggagacggggggattatttttcaaagccctcagaaagggggggggggtaattggagccagctggtcaaagccctcagaaagggggggggggataattggagccagctggattaatggaaacggagggataaaaagagaaaacacggtaagtacctttttttctccgtactagtttcgatatattaagcataaataacacatttttcacttggtttgaggcttttacgtttacttttattatgcctttaatgccttttttgggattttcgtgcctttaatgccttttttggcttttttccgactaatagtgaattcttatggctatgcagcagaaaatgtgcaaatggttgaaaaattctttccttttatatgcattttctattgccactttttcagttggagatttgagtgtaaatataaaggcataaatttgagagaaacttcattcatcaaattcttcacaccacttcatggtatctgcactattacatctacctaatgtgtattttcaatcttttctaatcctaaaatttcatcgttttgaagcatatacattgtgcattcctgtacatacctgtacataatacctcctacattcctgtacataatacctccataatctctccctcctccaactcttcgatatttcattactccatcggacggacatg

SEQ ID NO: 107626 - DNA, 377 bp, Heterodera glycines
  Promoter: Source sequence=SeqID_26570; Location=2115..2491; Strand=-; Gene=SeqID_57309
ttttttcgagtgaggcaaccatatatgatcagcactatttattaaacaatgagatgatcatagaacaatcgaaaacataaacaatcaacatttattaccctgccatgttggtcaaaatttctaaaatctatgatttcaaaataaatgataaagtcaattattttgcaaattttgatatcatattcgtgatcagaagcactgaaaaccccgggttcatttttcacaagaaaatttttttttgggtggagcccagattctccagtattaccgcatacatatattatacttacctatttatgtatgtagtaatacaaggaattaaaataaaattttctatttcaagaggataatacaaacagtcgacgttaatcaagatg

SEQ ID NO: 107627 - DNA, 581 bp, Heterodera glycines
  Promoter: Source sequence=SeqID_10366; Location=946..1526; Strand=-; Gene=SeqID_73544
agaagggcggaggaaaacttcaagaaaccagacccagttcgacaatacgggcttcatgcacggtgaattgttggcattgaaaaagccattgaacatcataaatttgcaagcattggaagagaagctaaaaattaatttattaaattctgttttcaattggtgaaatttttaattttccaaaaatgcttaggacatttttgaattttataggcgtttttgtaacaaagtgcactcaaattgtctaaaattttcccggcggcgcctatcggcaccgccggacccaccaatttactttagttttttggaattttagccccaaaattgccaaaatttgacagtttttgacgcaaaaacggctacaagtccctattttttttttttgctctcgggttctgaatttttaatggaaaaattttttgcccgaagagcaaaaaaggtcttcaggttcccccccccaaaaaaaaatttttctggcttgggcttggtaacaattttaaagactgactttggcacccaaattcaatcgaataaattttaactaaattttcaatttaattttaaacatttccctctcagacatg

SEQ ID NO: 107628 - DNA, 495 bp, Heterodera glycines
  misc_feature (28)..(28): n is a, c, g, or t
  Promoter: Source sequence=SeqID_429; Location=1..495; Strand=+; Gene =SeqID_52361
cagaagggtctggcgaggaaagacgacncagcagccgcaagctcgccacttctcgccccccccagtgctgagcgaacacgtgaggcgccacattgatttcttccaacaactgaaggcagcacgcggatcgcctcccccgttgccaagcgctggtcgccggagccagcagcgagcagcttctctgccttgtggagagtgcactgaacattttacgcgcgcgtgtgcccatccaacggcgtcatctggcccgcctcagacagcgtgcgagcgagcgacgtccgcacactgagcagggtgcgtagcacacgctccgcccgtcgccttctgctcaacgcccacgtaccgtcaacagcgcaaactggtcgtggcataccgcctctggtcgggttgctcgccagcgtgctggtgcccgtgctcgtccaacgcgtattcgagacaaccagcaatagtagctgaaaggcacccacacgcacgcttgcccacgaagaaacaatg

SEQ ID NO: 107629 - DNA, 63 bp, Heterodera glycines
  Promoter: Source sequence=SeqID_398; Location=3292..3354; Strand=+; Gene=SeqID_51357
ttttgcattgcatataataaaaattttaaatgtccttgaatttcatgaattttccccactatg

SEQ ID NO: 107630 - DNA, 705 bp, Heterodera glycines
  Promoter: Source sequence=SeqID_25971; Location=1..705; Strand=+; Gene=SeqID_56727
tttttatttaggagtatgaagaatggctcaaagaattttcatgcttgtttttttgtgtgtcacttacatcaaatttgtttttggtttggctatgcttttctgcttatcacgacataaacacgtaaaacgaacttattcgattaggatggaaaatttaaaaaaccaacaaattttaaaaatctttaaatttgaaattgtgaaaaaaccgcaacaaattttacagtcttaacttttatgaaaccaattctgtcgtttgttagaattagagaacaatttaagctgtctaatagtgatgctcgagagtctcggtttcgagtctagacacgagaaaagtcccgtgttttttttgatctcggtttcgagttttaagtctaggtcttcaagactttcgagaccgagacttttttacaccccctaatggttggcttttggtaaacttaaatttttttttaatggttttaaagcgaataagaaacttttttgaaaaaagtcccggggttttcggtctcgggctcgagtctcggtctcgagtctcgtgaaatttttggtctcgagcatcactactgcctaatgacactaaatttgttgaatttttgtttccaagaaatgtcgacaatttttttccatttaaacacatttaaaaaagttataaatttgaacgaataattaaattaaattaatattattttttaaatgaaaagcatg

SEQ ID NO: 107631 - DNA, 379 bp, Heterodera glycines
  Promoter: Source sequence=SeqID_32550; Location=2057..2435; Strand=-; Gene=SeqID_62859
gcatagggaatgattgattatttattataccacggctcacgttgcgcgcgctgtggtgctgcgcatatatacagcgagctcacgcgggaaaggctcactttttcgcaaaaataaattaaatatattaataaataatgtcgtggaagaccacaattattgcggcgagttgggcggcaacgaaacgcccacaaagagaagaaggagaaatgacgatgatgatggggagcagaaatttcaaaaaaattgcatccgcactctaagcgccgacaaacagtacaaccaaaagttcaaagtgcagagtgtaaaatcgtcctttattattgaaaatttgcccgccaaccccgagtcaatgctgcgcgcattgttcgctcactgcatg

SEQ ID NO: 107632 - DNA, 444 bp, Heterodera glycines
  Promoter: Source sequence=SeqID_36518; Location=1..444; Strand=+; Gene=SeqID_65805
tgtttaactttgtagaatttatggattgttgcattttattagcagtttatcaattttagagtctaaaaatgagaaatgtgaaaattttgtattttcgacctttgttcgaattcgggttaggggtttgaaattggtcgaaatggatgtcagattcgtgatcagcgaccccaaaaacccccggaaaattgttttttatgccttttaacaaaaaaaaatttatggggcctaaactgtatatcctgtaaaaactagtataaaagcggttgctcttccaccgactgggcacacttgcaattaaacaaaaattttttttttttcttgagaatgttttacttaatgtcgcctctttttattttgttaaaatttaataaatttttgaggaaaaaaggcaattgaactgaaaagtgtcaaaaactttctttaacaatttgcgccaacaaaatg

SEQ ID NO: 107633 - DNA, 225 bp, Heterodera glycines
  Promoter: Source sequence=SeqID_38; Location=16170..16394; Strand=-; Gene=SeqID_53329
agcggtctgccgccttgcgaagagggctggactatgtcaaaggcggaaaaatgataggtcgcttgcaaaaagattgttatgaataaaattttcctttgaataatggtcacattgaaccgatttagttatcgaaacgaaaaatctattttgaattatattttgcaccaatccttgctctattttgggcgaagttattaagaaaatatacctgcaaaacacacgatg

SEQ ID NO: 107634 - DNA, 746 bp, Heterodera glycines
  Promoter: Source sequence=SeqID_22601; Location=927..1672; Strand=+; Gene=SeqID_53268
gcaaagcgtaaaactgataaactcgctctgccctatatataaaagttgttgattgctgcacgatttgtcataatttttgaaaatgttaaattctcaatcgttcagtaataaagatatttgtttcaaattgccttgcggtataattatttccgggccatcctcgtcgggcaaaacggaattcctactaaaatttattgctgagtgcaatgaactgatcgcacccagtcccatctcaattctgtactgttttggtgagatgaattcggcggtgccgctactacaaaaggcgggagttgaggtgtattcgggcgtaccttcggaggagctgattaggcgccttcccaaaccgatgctgctcattctcgacgatctgatgctgtcaatagaggagcgctatctgtccgatttgttcaccaaaaaatcccatcaccatcagtttacggtagtgttcatcactcagaatctgtttgagcggaagatcaaggtggctcgcctttcggcgcagtatttggtgctaatgcgcgcgcccaactcgctgctgtccattcgaaatattggagttcagctttttccgcgtcaactcgattttttccttgacgcctaccgcaaggcgaccgcccgcccctatggctatttgctaatcgatatgcacgcatcatctgatccggcgcttcgcctccgcaccaacatatttaaagaggagcaggaggaggacgagggaacagttgtgttcattcccaaaaatg

SEQ ID NO: 107635 - DNA, 1003 bp, Heterodera glycines
  Promoter: Source sequence=SeqID_4684; Location=268..1270; Strand=+; Gene=SeqID_55372
atactatttatgtgtttttataaaattttaattattttttccgtttgacgcacatccgaccaaactgacaaattattgtagaagatactagccgcaagaaataaaaaagttaagaaatttgtccgaattcgggttcgggattcgaaacatggatgttttgcacaaatccgaccaatttcagtcataaacaggtactcccgcgaaaacgtaccccacgcgaaaacggccacgcgaaaacgtaccccagccacgcgaaaacgtccccacgcgaaaacggccacgcgaaaatggccacgcgaaaagagtcggggtcgttttggcgcccacgttttggcgccgacgttttggcgccaaggtcgttttggcgccgacgttttggcgcccacgttttggcgccagggtcaggtttttaaattttgtctatgtttgaataaatgaaaatatgtattcgtcagttttctgagtcgctaatcacgaatattgtattcattttgacaattgcgaagcccggactcgatttaaatgaaatacaatttttgaacatattagatcaggccttctatctgttttgttttatcaaatgttttaatatggtgggtccaaatctgagaaaatgatttaccagattctgatttagggatagtgactattatttattaaatataccgttaaggttacctatgtttataatcactaactcttttgaaatttcaaccgaaaaaatttaagagtttaaaaatattcaaaatgttttgacattttttgaagcatagcgaagagaaaaatttgaaaaagttcttgctaagtcaatttttcatgttgaccaacaaaatgttcacagcaagttgatcatatcactccttcatgttgatctacactagagatcaacattttgaaaaaaccgtagttctacctgtttcaaaaaatggcctgtacctatttttttctgtacataagtacaggaaaataaatgtacaggaaaaatccaggttgccgaaaaatg

SEQ ID NO: 107636 - DNA, 128 bp, Heterodera glycines
  Promoter: Source sequence=SeqID_1103; Location=117..244; Strand=+; Gene=SeqID_67839
agttattgatatgaatggcattgtaaaagtttgtgaaactttttcagccgcgtcgtttagaaagaggtttgatcagaaatgatgaagagtggaaaagagctttagaagaagctgagagttttgagatg

SEQ ID NO: 107637 - DNA, 850 bp, Heterodera glycines
  Promoter: Source sequence=SeqID_44049; Location=1..850; Strand=+; Gene=SeqID_71596
agtgtccgtttgggggtactcaaacaattctgtgggagcaaaaatccaaagcagaattaaagtacaggctatagggaagctattcccgaaggattcggcctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaaagcagaattaaagtacaggctatagggaagctattcccgaaggattcggcctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctatttccgaaggattcggtctccccataaatctgggcgcatcgcttcggggggacggcccgagaagccaaaaaaaaaaaaaattattttgaaaaaaaattattataaggaaatg

SEQ ID NO: 107638 - DNA, 190 bp, Heterodera glycines
  Promoter: Source sequence=SeqID_18552; Location=809..998; Strand=+; Gene=SeqID_83182
tttgttcccgctgaacaacaaccgtggcctcttggacttggaggatgtgtacgccgccactgttttcgccgattcgtcggtggacggcagcgacaaagaggcaaaagtggtcagcaaattgcttatgatcctaatggctcggacaattaattcataggtttcgcccggctctgacggtacacagacaatg

SEQ ID NO: 107639 - DNA, 913 bp, Heterodera glycines
  Promoter: Source sequence=SeqID_26956; Location=799..1711; Strand=-; Gene=SeqID_57696
ttgtcctcatttatttctttattttaattttgtataaatttccttgtgcttaaataacctgagatttttcaaaggttcgaaaaaatatagaaatccatattttttctggactgtaggaggcctgaaacgcacgaaaaacatgtttttaacttggcttgacgcttctgccaaaaattagtattaaaatttgcttatttgctttgtgtttagcctaaaaacactatatgttatttgatcaattcacagcagggattgaaattccgcttaactgattttgtttttaatagtttttcagataatcttttctgctatttttaatttggtgtcattctaagacttcatgttttgaagctggcaaataacacaatttaagcgatttgacaacgtgatagaattgtcggtgccgtcgccgctgcgcgtctgtggagccgagcaaaaacataatggaaaaataaaattaatgtttaaagaaattgattgaatgtgatatttgccacccttttatacccccctcccatacaatcggtcaaatccgtgatggaagaaaaattctctgtgtcagtcattggatataaaagcagatgctttttcctttccctttcacattcgctactcccaagtgcccttttctcaaagcgtatcatccgctgtaatattttgtaagttttcttttttcagattttatttttttcccatttcacattttccttttttttttttgcagaatcggccttcgacaagcaacaaattcttcacaccaccaacgatgaaaagcgtcaacacaacgcctttccgtcgccgacctcttccgcttcgccttgtgtcgtcagcgctggtgctgctgctctgtacgcttgatgtgtcgctggcagcggagaagaacggcgaaagtgcaactgctgcatataatatg

SEQ ID NO: 107640 - DNA, 735 bp, Heterodera glycines
  Promoter: Source sequence=SeqID_13365; Location=1..735; Strand=+; Gene=SeqID_77239
agttcccccttccatttgaaagcccccctttcattagaaggcctccctccatttgatggctcccctgctcatttttgagcggagttcgctccattagaaggcatagaggaaatacgataatgtctaacaaattaaataatttaatttaatctgtattttgttagtcggtcatcgatgacagctgtaaagttaaagatggtaaacaaatatgtgacacccaactggagatcaatgctgatcagatggggcaactacgaagaatgcttgttagcacaaaaatgattgatcagagcattggaaatgacaatcgtcgaaaaacattggagggacagacaagtacataaaaagccattaagaaataatataattgggttatatttcacgaatttttatacgtccaatcgacgtttaccggtccaatcaaattaatttagtaatttcataatctattgcggaaatccccccttttgaattgcaagggataatccccgtctcatttcctccaaaaagtcaaagcgcagcttgttacaaatataaacgatctagtaaacgcataaaagtcgatcgattgtgtgcataaaagtcgatcaattggacgcataaaattgatcgattgggcgcataaaagtcgatcgattggacgcataaaagaggatcggacgaataaagtgaaatagaaccgaataaatttatattcattaaaatgtataggtattcgaaaaaaaattcacaatg

SEQ ID NO: 107641 - DNA, 1003 bp, Heterodera glycines
  Promoter: Source sequence=SeqID_2488; Location=4247..5249; Strand=-; Gene=SeqID_80013
attagggatgatatttatagttgctaaaaacttccgaatttaggggtgtaaaataacaaaattttattcaaaaataaacaatattaatccaaatcattattgagattcacgttgcaaataagtaacatgtcgagttgttcgggagatagacgtgagcgattatcagttaaaatagatttgtaaattgaaaagatcgttcgacatcacatttttatagttttttagttgctaaaaataaaaaactagaaaatagtttctaataactcaaaaagtagcttaacaacagccgaaaaaaacatgtttttcgtgcgtttcaggctatagggagctcaggaaaaaaatagtgaaataactatacatatcatccctgatgatgaagaaaaaataaattgtcatttttctggttggctttttaaaaagcagaaaatttttgtaatattcggaacatttttgtaatttaggacattttagaattctcagataattaacgaacaaccaaagaaataattttcaatttgataataaaaaaccggatcccaaaacagaaaagtcgctgaattggtagttccaaaatttacatttttatagaaattgggaaaacgccaaaaaagcgatttatctcactcacaaatcagtacggataaatgcaaaattcacaaaaaattacacacaaaaccattgaatgacctcgcagtttaaatttttaaataaatttttcattttgcaaataaattatcaatgaaattaaaatatttgttcgccggtcgggagtacgagcgtcattaattactttacgattttgaaaattttttctttgagatggcaattaagaaaaacaataatcaatcatgtttacgacacatttacttatcaacaaatgtgcaatatataaaaagaagctgaaaaatcattgcgtgatcagtttatttattggtatttatcattaattaattttgccgttaatttcctcattcttcactaattaactttaattggcaaaatg

SEQ ID NO: 107642 - DNA, 286 bp, Heterodera glycines
  Promoter: Source sequence=SeqID_45331; Location=1096..1381; Strand=+; Gene=SeqID_72646
ttttcattaatggccctcccaccatattattaggcgcgcaaaagtgcaacaaaacttttcacaaccataaacgaaaaaacatccaataacatggcatcaatttgcaatttcttactgtctgagaaaaatatcagtgaattcttttaaaaatatataatatttattgccatcccactgaggacaatctcgaattttctgataatttttgacaattttaattggaaaacatttcacgaaaaagaaaataattattttgtctattggagcaaaaaaaaaggttaaaatg

SEQ ID NO: 107643 - DNA, 55 bp, Heterodera glycines
  Promoter: Source sequence=SeqID_14008; Location=1..55; Strand=+; Gene= SeqID_77979
tgctaaaataaaacagaaaaatccaaaaatatataattttgattcttcaaagatg

SEQ ID NO: 107644 - DNA, 704 bp, Heterodera glycines
  misc_feature (465)..(465): n is a, c, g, or t
  misc_feature (490)..(490): n is a, c, g, or t
  misc_feature (497)..(497): n is a, c, g, or t
  misc_feature (500)..(502): n is a, c, g, or t
  misc_feature (505)..(505): n is a, c, g, or t
  misc_feature (511)..(511): n is a, c, g, or t
  misc_feature (513)..(513): n is a, c, g, or t
  misc_feature (518)..(519): n is a, c, g, or t
  misc_feature (522)..(522): n is a, c, g, or t
  misc_feature (524)..(524): n is a, c, g, or t
  misc_feature (526)..(526): n is a, c, g, or t
  misc_feature (539)..(539): n is a, c, g, or t
  misc_feature (553)..(553): n is a, c, g, or t
  misc_feature (583)..(583): n is a, c, g, or t
  misc_feature (588)..(588): n is a, c, g, or t
  Promoter: Source sequence=SeqID_12191; Location=1..704; Strand=+; Gene=SeqID_75766
gggaaaattgttaatttttaatgcgatttttaacagatttttgtccaaaaatgaccaaattttgccacaaattttatattttgtaaaacagtgacattatgcccaaaaatttcaaaattatgcgtagatttaggaaatcagaacaaaatttggtcactagcttcaaatcaaacatttctgataaatcagaacagatccgagccctggattaaaccccaaagtctcgaacaatttacaaaaaaaaagttcgatttgatcaaccttaaataccaacagttctgctgatcagtcctctttgggctgatcaacgcgatcttcaccggtgtgaaaagttttcacaaaggtttatttatttataaaaaatattaaatgttgctattttttgcaccttccctagaaaaggcgcagttccaaaaatttgtaacacaaggttctttgaaagaacgaataagcaggcgaaatggntaaatatatttcaattaaaaaactnttttatnatnnntcnaaaatnanaaaanncanananaaacattcctttntatttctccttttntatttcttcttttctctcatccttctcttncatanctcacttttagtgggtgggagggaaaggcacacaaaaaacaattcaaaactaaatttaaatttaattaatattttgcctttaagcacctgccatttttacgccagaaacaataatg

SEQ ID NO: 107645 - DNA, 528 bp, Heterodera glycines
  Promoter: Source sequence=SeqID_8759; Location=3236..3763; Strand=-; Gene=SeqID_69133
ttttttctgcaaaaaaaaactttttattcattcattgcacattttaggccatttaacattaaaagaggcattttacttttttttcgtcccttttccatggccaatttactagagtgccacgggaccgggaatttttgccaaaaccgggaccgggacttgccgggacctgagaagccgggaccgggacctcgattttttttcgggaccgggaccgggaccgcaagaaaaaccgggaaccgggacctcgtatgaccgggaattcccggcccggtcccggtcccggtcccgctctactctagttttttcatttcttaacgaattgccaaaatcttaaggagtgaatttaatcggttttctcatataataatgccaaattaagtgcggttttaaaattgaattttctttttataaaattaatcactaaattaaccatgattctcgagcggcacgaaattggatcaaataaaaattaaaattatattaaaatacaaactaataaatattcgttctgaaaaggcagtatatatg

SEQ ID NO: 107646 - DNA, 496 bp, Heterodera glycines
  Promoter: Source sequence=SeqID_2313; Location=1985..2480; Strand=-; Gene=SeqID_79054
ttttcgattttattttgttttagtaaattaatttttgaagtgattttccttcagaatttcctccttttatattgtcttggctcagcaaaaatcagctgagcttggggaattcatgtgaacattttcattttcgcaacttccctcccaaaatttattaaatttccaccgatttccgctgggttttcgttgttgaccaatttttgcacttttaattttgttgcacttttattttatagaaaaaaacaattatgaatgatttttatgcttaccctctttttctctttttttctcactctctctctctttttaactcgctgtctctcgcttctctctcacacacactatttctttctcctctctatctccctcctcattttactgctatttcgctgtacattttttatttatttggtttcttcccaaatattttcgtttgcttccgtcagagcataattgcgcatactgctgggccaaatcacatgaaaatttgccaatg

SEQ ID NO: 107647 - DNA, 487 bp, Heterodera glycines
  Promoter: Source sequence=SeqID_34513; Location=1..487; Strand=+; Gene=SeqID_64284
atgaagaaaaggagttgagtttgtgttggtttttttattaaggcacgattttacggcacacacctatataaaaaaaatgaagaatcacgttttggaacatcctcgaaaaaccggtgacacaaacacacactgacacagagaagttcacaaaatttgatggtgttgtgcctgtttatgaatggaggaggacgacaacatttttcgaaattttctggtaccctgagaagtctaaatttgatgtttgttggagaggagatgaggcttactaccatggtgccaaaagaggaagatgagagtggcgggcggtcccatggcggcacaataatttagtgccgacgaacacaaaaaaaatgtgttgtgtgccaccacatcccccacttgttgtgtttgctttaagcttgacgattactaccggttgcgcgacgcgctcaacgcgtttgacaagcgcaacccgcacttggcataccggggcagcggtgccgttatg

SEQ ID NO: 107648 - DNA, 228 bp, Heterodera glycines
  misc_feature (71)..(71): n is a, c, g, or t
  misc_feature (91)..(91): n is a, c, g, or t
  misc_feature (93)..(93): n is a, c, g, or t
  misc_feature (102)..(102): n is a, c, g, or t
  Promoter: Source sequence=SeqID_31830; Location=1..228; Strand=+; Gene=SeqID_62136
tttttgccttttcacaagagattttattaaaaaaggcaaaattcgccttaaattaataaggtgaaagttgnaaaatgtttattaaaaaatntnaaggatganatataattaaaataatcaaaaagaaaaaaaaatcatttattttttttaaataaataaaaaacattttcagaggcagtgcctcccgaaaaaaagacaaaaaattttcgaaaaaaagctaaaaaaatg

SEQ ID NO: 107649 - DNA, 179 bp, Heterodera glycines
  Promoter: Source sequence=SeqID_1981; Location=8081..8259; Strand=-; Gene=SeqID_77181
tcaatgaattttattaataaattagtcaaatttttcagaaatttcactcttttctgcttcctgcaacccccctcccctgtatttcatgtataataactaatttttatttgacagatcgattcactccctaaattctcaaaattctcaattttttaagcttggacaacaatgcatgaatg

SEQ ID NO: 107650 - DNA, 105 bp, Heterodera glycines
  Promoter: Source sequence=SeqID_19859; Location=1874..1978; Strand=-; Gene=SeqID_84617
ctaatatattaatataaaaagtgctttttttcttcctctctaccacattccattcattcattcattcttcctggattttccggtcattttgttgctacaaaaatg

SEQ ID NO: 107651 - DNA, 835 bp, Heterodera glycines
  misc_feature (177)..(177): n is a, c, g, or t
  Promoter: Source sequence=SeqID_5085; Location=1..835; Strand=+; Gene= SeqID_56846
gatgccatttcatcaacaaacgcaacacacagcaaaatgcaaatggaaatgccacaactgcctgcgtgttgggtctgcctttcgaggaaactgcgtccaaggcaatgacaacttttttgagacctgcttggggtgcaataaagtaaagttatttgagtttcgtttcaaagaattttnttgtttagacatttaaaagtcgtgaatgctatgaacaccatgccaaatgtacaaactacagggtcaagcgtgacaacgaacatgaaattgtgggaaaatcaatttgtaaaagctcgaagaaatgcgtcgactgtggcgtgatttaccaaattcgggttattataaaataaaatttttttattttattaattttctcttaagcatcaccaacaaaaagagcatgtttgcggtcaaaaattctgcaaaatttgtctcggcttccatgccccgcgagactgctacataccataccggcctaaagtcaagaaggagaagcgcttcgtcttctttgactttgagtgcactacggatttcaagcccgacccgcaactcatgcggttcaagcaccaggtaattattttttgaattcaaacacaatttaaaaaaaacaaaggtcaacttctgcttcgcccatgtgacatgcacccgttgtattgagaagggcatatgggtccaagagcttgaaagggcttgtgcgctctgcggccgtttccgaacttatgcctggtcaccctttgaattttggcacacggacgtggaatgccacaaggtcgtcgaggacccgcttgctgccttcaccaagtggttgttgaacttcgaaacggaagtcctcggcatg

SEQ ID NO: 107652 - DNA, 683 bp, Heterodera glycines
  Promoter: Source sequence=SeqID_27923; Location=813..1495; Strand=-; Gene=SeqID_58588
tcttaaatttgatccgagttggacaaattaagaagagtgcaacaatggcagcagttgtaaaggctggcaacggaccaggtccttacacatctgaaacatcatggacaatttgggaagaaacattcgaattcttcatcaaacttcgaggcatcaccgatttcgagaccaaaaaattgctcttcttttcggagattgggccaatctatgagagcttcgccaaatcgcgttgccagacgacgtccgcgacatgccaattgtgtagatcaaagcgctgatggaagaacgatttggtgagacgaagacgattgcggcaaaaaggtttgagctgttttcggccaaacagacatcaggactgtccattcgggactattcaatccaacttcggaccttaattgccaaggcagaatggcataaggattcagtggacatgtgcctgagcgctcttttcatcaacggccttaaaaaagattcaattcgggccgagttgataaagaagggagtgaacgaaatgaagttcaaagatgccgttgaaacggcagtgattctcgagcagtccgaattggatgcagagcaaatcggtgggcataagaaagccgaagtggctaaagtcttcgctccaaagggagaaagaaagagtagcacaccaacgcagcaaatgcaatgccatcgatgcgggaggaatg

SEQ ID NO: 107653 - DNA, 1003 bp, Heterodera glycines
  Promoter: Source sequence=SeqID_12883; Location=824..1826; Strand=+; Gene=SeqID_76616
ttattgcaaattttttgttggtgttattgtttcatttgttaaatgacatgttgttttcggagatgcgtaccacctatatttattgtatcttattgtaatattttaaatacattaatttatttggacaaataaattttaaagcaaatgaaaatgggactaaatcttcagaacccgaacgggcatacactttttgaaaaaccgaaaattcaatttttccgaaacaatgcttcacgggtagacatcagtttacaaaataattttgcaaatcaagaggtccccttttttgaatttgaattttgaatgggcgccatttttaaattagcgccaatatttgaatagaaaatgtttggtgatttcgcgtctaacgggaaaagagtcttttcagagacgctgcaatgaagccgctctctcttagggcagagacgcacatggtcatactcactggtcactcgctgcatcaggtcccagtgcagtgaatgttcactggtcacatacgtctctgccctatgagagagccgtaaatcattcactcgttttggtcaatttggtatcgatttgttttgtacatgctattccattccgatgctaagaaaatttcgaccatttctgttcccggaccctccaaaaaattgagacttcaaatttcattggtgactttcaatttgtttccatgtatttacataagccgtttgaaccaaaaatgtgttatttgaaaaattaaagtttctattttttttgttcaaattcggacctgggattgaattggcggatgaaattggtactgtattcgtgatcagcgatccctaaaacccttaaaaaaaatttccacatctttttaaaatttctaaaaatttaagggtggtttaccatcggcgtcattcttgcctttgtttttctaaaaaataatttaacaaggcttaatccaattttacatattgcacattttttttctcttctgttgtattacatattaacaattcttctacacataacccttgaaatg

SEQ ID NO: 107654 - DNA, 78 bp, Heterodera glycines
  Promoter: Source sequence=SeqID_29544; Location=517..594; Strand=-; Gene=SeqID_60033
atttgatgtttctgtttagtccattcttaatttgcaacaacaaagaaaagctttcattattctcatcagcaaaaaatg

SEQ ID NO: 107655 - DNA, 692 bp, Heterodera glycines
  Promoter: Source sequence=SeqID_21800; Location=692..1383; Strand=+; Gene=SeqID_52428
aagacgaggggaccgtctttcttagaggccggggatgtggtattagtgactttttgaccctttatttgattgtttgaatttgtttggcatagtgtttatttgaattgacctcaaatattttgtttttcttctagagtagttggtggattttagtggtcgtttgtgttaattttagccgttttattggtcgttgattgatttgtgtttaatttattttgtgttgactgaatttgttttaatttgaattgtctttttaatcatttgttggataaatttattttgttttggtgtttgtttttaaaagcaggttttgcctaatttcactgacatttatcccctcgtttacaaaatttggaagtgtaaaaagaagaaaccccgacaaattctccttcttttccaacaagacaagaaaaaagtcaatccgaaactcataacccaaattccttatattataaaaaaatatttatttgcctaggctcgtcgaaaaaaagaggaatttctctaatcaaaacagattttttctcgaacagagagccatgttaattacaaaaaatatttctcatctattttgactttagtgactataaaatctaagtttttttcttttagaaaagcatatattagtatttctgcattttgtgtgatcaatcaattggaaaaagggcaaagtgtgcttattgaaccaaaaaatg

SEQ ID NO: 107656 - DNA, 935 bp, Heterodera glycines
  Promoter: Source sequence=SeqID_1613; Location=1904..2838; Strand=-; Gene=SeqID_74836
ctgaacatgatgaatttgatgccgccaaaaaaatgaaaaaaaattttcaaaatttatttaaaattttccccaattttttgatgtcgtcgtcgttgtcgccctcgctttccgcccgcttttttcacatttgtgttatgtgttcgcttgtggaaataaacaatttgattgttattgcaaaatatttaaacatatttacgttttttgaaattcatatttaattagtcacgaaattttttttttgtgaaaaattaaacaaataaaataaaggatttagtaatataatttttaaagaaaaaattcataatccataatcataaagaagaaattcgactaataaaagaaatgaagtctcataaaaatttataggcaaattaaaaatttaaattaaacttttatgtgaaaataaaaattaaataaaaccaaaattaataaattattaattagaaattgtttaaaaaatatttatatttaaattaattatgcaaaatgaaatattttgagaaaaaattggaataatttttacctaggtgtgaaaaatggaaaatgtaaaaatttgccgacgaaatttggcctttttaaaaatatttttaaagttaatttacatacatttgtcacttctattgcagatttttttaaataaaaatcgaatcgctaatgaaaaatgaaaaaatttgactccctatacaaacaaaatattgacgttgtcgatttattggacaaaattggattagctttaatatatttttttgttattttttcgaataaatatattatctaattgtacatttttattatatatattttattttttgcaatgaattcaggaaaaactaaaaaaattttattaaattaaattttattttattaaaaaatatatttatttttttttattaaagaaattctgcaacaaaaaattaaatttttgtttaagaatg

SEQ ID NO: 107657 - DNA, 64 bp, Heterodera glycines
  Promoter: Source sequence=SeqID_11971; Location=1484..1547; Strand=+; Gene=SeqID_75490
agtacaaaaaatgggaaaaaggcagatgaaatgccgataaactgctgctaaatgtaattaaatg

SEQ ID NO: 107658 - DNA, 427 bp, Heterodera glycines
  misc_feature (7)..(7): n is a, c, g, or t
  Promoter: Source sequence=SeqID_2861; Location=1..427; Strand=+; Gene= SeqID_82020
ctcactntcattgctctttaaaatctaatattttttaaattgtagctggcgttaggttgggttttccttttcacaattatgaatgaattgttttttttaaataatgagttcccttttggcctgcgaattaattttaaaaaatgacataaaaacgactgtgaaacccataaaaaaaatttagattttacgtcattacacagcttttttcgcatttggtgaacttaacttcatccgattactaaaaaggtaaaatcatcaaaatgaaaacgacgaccaaaagtaatctctggattgcattactatattttgttgtccgcacctttcacccgctcacattcaactgttttttttatttagcccgtctccgaaggcgacttgtgacttttgttttttcgccgaatttctctccgcgaccattttctcgatg

SEQ ID NO: 107659 - DNA, 835 bp, Heterodera glycines
  Promoter: Source sequence=SeqID_18730; Location=1..835; Strand=+; Gene=SeqID_83401
agcctaataaattgcgtagtgaaattttaaaaaaatctccctcctaagctaatgtttaaataatttaactttttgaatgtgcccgaactttttcaataaatcttttggagaaagcgacgatccatcgactttttttgccaatttccgctgctttgtttggtcatcaatgttcttctgcttaaatcaaaaataaataatttaatcacaaatttttggccatttaatttattaaatattgaaaattcggaagactttaataaattattatatatttttaatattttatgcgctttattctgtgtaaaaccaaagaataattagtgcttagtttcatttcttcgataaaattgttattgtttttaatgtttcttccccattccaataatttttcaaaacaatccctcacggggaaaagagcatttcccaaattactaatcgtttatctcataaataatacatataaaagaataaaatttaaacaaattttcacattttaaggaaggagcaccaaaattcgtcataattccgagtttaatttatttgagtaattattcactaattaatggccaattttctctacggttttaaataacaaaaataaaaaattaattaatgctttattttgacgtcaaatcgattatcgttttgtgttcccgggagaaagaatttatttatttattttcgcccgttttcaaaagtcgtaattcaattttatgcatttcaatgctttcacatggcaaaaatggggctaaaaatagcaaatttaaaaagtaataattatttaattacatcactaaaatattataaaaatagtaattctatttttagaaaaatg

SEQ ID NO: 107660 - DNA, 113 bp, Heterodera glycines
  Promoter: Source sequence=SeqID_29782; Location=1440..1552; Strand=-; Gene=SeqID_60245
tttttcacaaaaaaatttctgaatttgggctgaaacagttgaattcatgacaaaaaaaatcgaattttcgaaaattttagcgctatcaaaatgacccgacattcgcagaaatg

SEQ ID NO: 107661 - DNA, 250 bp, Heterodera glycines
  Promoter: Source sequence=SeqID_22678; Location=1058..1307; Strand=-; Gene=SeqID_53364
tttaactgcccaaaacggactgccctccgtccacttgttccatgttagctcaatgctcaccaatttgttgaaggaaaggcgcgagaaaatggtaaacagaaagtttgggagttaataaaacgacggcttttaaaaaatagcctaatttttcttgaaatttaatatttaaatccgatttatgacactgggagttttgtcctgccaaatgttcaatattttgattctcgtaggtcggtccaatcaaaaaatg

SEQ ID NO: 107662 - DNA, 266 bp, Heterodera glycines
  Promoter: Source sequence=SeqID_6530; Location=760..1025; Strand=+; Gene=SeqID_61908
attgccgatttccgacatttttaatttggaatccgatttttgattgctaaattttttgagtcttcggaatcccaattccaaaattttgtaggccatcggaatgccgttttccgtttatcgaaaacatccctggtacatattcatagtttaattaattccacttttttcagattggtcgtattttttctgtgggaatttataggtgtcgtttataataattataaaaaagaatacttcaaaatatgtctattttttgcagtccaatg

SEQ ID NO: 107663 - DNA, 788 bp, Heterodera glycines
  Promoter: Source sequence=SeqID_120; Location=1..788; Strand=+; Gene =SeqID_72907
aaaattttgtatcttaggatcatgataaatttcagtacatattctatttagtgtatttttttcaagtgatatttgttttaatgctttaagtttctaatacgcaatttgttccattatcggaaataattaattgtgtcacttttcttcgcgtgatgtatgggcgaaatgctaaaagaatttattaggcaatgacattggtaagttattccaaatgaatttctcatacaaataagcaatggaaatattgctgaacaacatttgttaattaacatcaaaaatatttagggagaggggttcaatataatcaattacaacatgttgtaatgtatttttaccttttactgtaaaaagtggtagaggaggatttttaggataagtatatttattacttgaaaattttgatagaatggaacaattattattgatttataaaatttcgtaactcacccagttgcctggggggtacgtacccctcgtacgtcccccccccccctgggaccgtccctgtttttcgactataactcctttcataattgtccgaattgaatgtatttgatatcatccgataggcctaaaaatctttataaaccttgctaaagtttaaattgaaaaaatttccgtttttaaaaaagttgtgttcaaaaaatgtttggaaaaacaaatcctaagtcttttggcaataacttttttgaaattaaactaaatttttcaaaaatttacaaggaaattgagaactcttagggctatcgaatgatttcaaattcattcaattcgaacaggtatgaatg

SEQ ID NO: 107664 - DNA, 728 bp, Heterodera glycines
  Promoter: Source sequence=SeqID_17194; Location=1910..2637; Strand=-; Gene=SeqID_81655
gccgggtcagcagaaaaaaaggccgacaattcataaaagcaaatcgaccatgctcgacacgataaaaaaaaagcttttaaaatgatttgggtggtgacagttcgcaatgttcattgtaaattaaaaggatggtaatagattagtgaaatgagatggaaaatagctttaaacacattaaatgaacagcaaatcttttcttatatactattttaatttaatcagttaaaatttttttagactatatatttttctgttgcttatttaagccttctcatttttctttttcactcacatttttattgctttaaatttatctgtggggttcaagcggtttattttttacaataatcagtttgcatcaatgaattcactctttgattatggtagtttagtgaattttcattatttcaaaccattttaatagacatttataaggttttgttcgttctgcctgctttatcgttccatatggatggattgacggacatttattactgcgcatttggcttctttatttttaacatttttacagtgtatctgcggaaagggccgaaatacacttaggaatttcgtttctatagggcatttttggcaaattccgtactgacgaggcccgatttgccaaaaatgcaaatgactattgctaattctttgctttgttttcagtgtcaataattgctcttgtgccaacatttgcctttagcttttgcaaaacgtgggccagaatg

SEQ ID NO: 107665 - DNA, 205 bp, Heterodera glycines
  Promoter: Source sequence=SeqID_14254; Location=1399..1603; Strand=-; Gene=SeqID_78270
ttattttattaaattttttgaatgattttattttttttaattaattaagtttattaaaaataatttattttaaatattaaaaataataattctttctttctaatttagcccaaaaatctattgtttgaccttttttgtgcaaaatcatttaaaaatggagacaaattaataagttacctaaacataaaattataaatattttatg

SEQ ID NO: 107666 - DNA, 348 bp, Heterodera glycines
  Promoter: Source sequence=SeqID_3553; Location=2586..2933; Strand=-; Gene=SeqID_50846
tttagaaatacgctaaattaaatataattaattaaaatatgaagcttataaaactgtagaaagccaattggattgggaatgtggccttaaagcgttaaaaaaaatttgatttcttattttaggtttggcgcttggcatggcgcaaattggcatgaaaacattatgccatttaaatttaatatttaaaaaatccggcttcgttcttcggtttaagtcaaccagccagccttttactgttctactgctccatatccaatgtattttgaactgttttttaaatctttgttttatggctcattcattaattagctcaatccgttcattaaagaagttaattgtggcccaatg

SEQ ID NO: 107667 - DNA, 76 bp, Heterodera glycines
  Promoter: Source sequence=SeqID_16304; Location=1093..1168; Strand=-; Gene=SeqID_80692
tgcacggattcacgattcggcacgccttagttttgttagctaattcgcagatatgtagataagggatgcgcaaatg

SEQ ID NO: 107668 - DNA, 332 bp, Heterodera glycines
  Promoter: Source sequence=SeqID_25722; Location=250..581; Strand=+; Gene=SeqID_56465
tcgcacaaacaacacattttggatacggatgtgcagcaaggtcttcaaatcatctgccaaaatattacaacactcttgtaaaggtattaagaatttttatataacatatttataatttatattaataaaaggatgcgtcaaaatgtccgcattgctctgccttgctcttcgagagagaagcaacaggccatgctgctttttcaaaatgttgtgcaaaaggccgtgtctctttgaccgcaaaatacgacggattacaagaaaggcccgaatacctcgaagccttatttacaaacaaagacttggaaactttgaggcgacaaaaacatctgatg

SEQ ID NO: 107669 - DNA, 73 bp, Heterodera glycines
  Promoter: Source sequence=SeqID_5058; Location=4459..4531; Strand=-; Gene=SeqID_56757
tttttttcttttctgatattaacggatatacgaaggaaagggggaatctttcccccgttactttttaaaaatg

SEQ ID NO: 107670 - DNA, 437 bp, Heterodera glycines
  Promoter: Source sequence=SeqID_8422; Location=1..437; Strand=+; Gene= SeqID_68004
tgcaggtcactttttcgttacaccaaaattaaaaaaactgaccaggttttcagttttattgtattttgatgctcatttttcttttgtttaggctcgcgaaatttggaacaaattgcttgagggggaacagtcgccctttccttggcttgaggcaattgctctcgaacgttcttacggcgatatttgtggctattttattttgcgtgttattccgcattattctgagctttttagggtacgcacgtcgtctctttttcaaggcacttgacgccgtcacttatcgtcaggatgaaatatttggccgatttgtacaatttgaacgggaggaggggacgagggaacaattggacttggcattggcacgagtgaacgccaaagcgacggaatacaacgcatggatggaacagcagaagtacagcaaaaccaaaccgaaaatg

SEQ ID NO: 107671 - DNA, 109 bp, Heterodera glycines
  Promoter: Source sequence=SeqID_18956; Location=962..1070; Strand=-; Gene=SeqID_83686
catgtcgcacaaatttcggtggccgagggttcgttggcggacgagttcaggcaacggcaccaccaaaattcggaaacggttggccacgctgcgggccgagtcggagatg

SEQ ID NO: 107672 - DNA, 646 bp, Heterodera glycines
  Promoter: Source sequence=SeqID_16913; Location=727..1372; Strand=+; Gene=SeqID_81343
ttctttgtgaggtgaaaaaagaaaacgaaattcgaatttgagtaccgaatttttgcggagaatgtcagaaattcaaaaaattgactcaaaaattggaagtagcgtaaatttggtttgagttcttgccaaatgcataaaatgctttttgaaaataataattttattaagaaagatattttaagtaaaatatttcacataaataataataattaaatttaatatttctttcatgataatttttgtaacttcgtctctccacattattgagcatatatacatactagaaagattcttaatgccaaatgatcaattacaaaaaagaatttagaatgaaaatgtgagtggcatagtgaagatcaattacggcacagtgccaatgctcaaattgaaatttggtggctttgacgtggacatttctttcgtttcgataccggacaggaaaaatttgccaaatgttttgagcgaagaaacaatggaaaaatatttgaacaaattttattcggaagaaagtgctaaatttgacaagcaaatccgaattttgtcgagtaattttttgtgtaaatattcataaaatataaaaattaacgtttaagttattaatggaacccgggttttgaagcgtttgtttattttatttttgctaatg

SEQ ID NO: 107673 - DNA, 75 bp, Heterodera glycines
  Promoter: Source sequence=SeqID_27271; Location=1142..1216; Strand=-; Gene=SeqID_57956
tatagccctgggagctgtctgaataccggtcctgagtgttttagcccaacatttattagaaaaaataacatcatg

SEQ ID NO: 107674 - DNA, 250 bp, Heterodera glycines
  Promoter: Source sequence=SeqID_9863; Location=753..1002; Strand=-; Gene=SeqID_72891
ttgacaaataaggaaaaaaggcaaactaacagtcctccgaggctttagtttagccataaggcaaaaggcaaactaacagtcctccgaggctttagtttagccataaggcaaaaggcaaacaccttgtcctccgaggcaggtgtttagtcacaaaaggtccaggaccaaggccagactgatcccggaaaaagacacaaaacaacaagtgcaccacaacacacacacacgcacaaccaaactgcacgcaatg

SEQ ID NO: 107675 - DNA, 172 bp, Heterodera glycines
  Promoter: Source sequence=SeqID_23998; Location=1081..1252; Strand=-; Gene=SeqID_54700
aaatgtgaactcaaatgtttgattgtttttccacatttcataaatgaaaacacagcagacagaagattatacaatattagcattttaattcggttgttattttctaaatcataatttgtttttgaaaatagcagtttggactcatctttttttccttgtaatttttgggatg

SEQ ID NO: 107676 - DNA, 110 bp, Heterodera glycines
  Promoter: Source sequence=SeqID_3324; Location=789..898; Strand=-; Gene=SeqID_84221
ttttgacgtgtttcgcattgttgaaaggatagttttataaaattgttaacttttattgtttttgttgtaaaatattgtacattctttttttgttgaaattactgtaaatg

SEQ ID NO: 107677 - DNA, 121 bp, Heterodera glycines
  Promoter: Source sequence=SeqID_35623; Location=1..121; Strand=+; Gene=SeqID_65144
ataaataaattcaatttaaggtcaacatttatcgactgctctcaaagggtctgtggaagaagagatcgttgaaagggccaaacagaaattagtgctcgaccatttggtcatccaaagaatg

SEQ ID NO: 107678 - DNA, 937 bp, Heterodera glycines
  Promoter: Source sequence=SeqID_7977; Location=1644..2580; Strand=-; Gene=SeqID_46518
attccgtaagataccttaaatttttgtcttagcgaggttccttattgcccgggaatatcactgccaacacactcttctgatctttttgtctgacaattccacctgtttatgtttgattttatttaaatctgctgaataatcccccctcttttatgtttttttgcttgatcgggttgaatacaatttacttgattttgtctgtctgtatttgtttttaatttgattttgtcttgaaatcaactcgatcacgttctcctctcctcccttactcccagctttgcactccgtccatcttcaatatatgcttatatcataaacctatctttttcaattaaaagccttttatgattggatatgcacaaacttttgggaaatctttctacagtaacaaaagtaatttgatattcaaatacaaaatgatcgggtcggaatcgattctggcaattgttatggtcgaagctataaggcgaaaggaacaaataaaagcaaaagtgcttgacaattggcgatggtttagccattgctggcaattatttgtgaaatttgaccggacggccaatcaagccgtacatggcggccttccttcttgagttcagcgaccagatcaaagacattttcgtcccagaaatggtcagacatgaaaatacctaaaaattttcccttcaaaatgagtataaaatggttttgtttggtctattattgacaaagaaaagctaaaaaaaattcataaaaaatggtaaaacaaaatgtctatttttatgtttgtatttgttcttttggcgttctgtattcacaaaaaaaaatttttagcagtaacaaacggaactcaaatgtatgtatataaagaggcgttttcacacacttctgcctattccgttcttgtttcatcagcaacacatcgacgtgcccaacaaccgcaacaacagcgacaacaatg

SEQ ID NO: 107679 - DNA, 218 bp, Heterodera glycines
  Promoter: Source sequence=SeqID_16793; Location=1243..1460; Strand=-; Gene=SeqID_81212
atagagaaaatcgtgcgatagaaatgtttctagaaaattctcgccatcatttgaatgcgattaaaaaagggaagggaaggggggggagagattttgtatgctcatccaaagccatttctgctgctgggccatccctttccaagcacacaatttttattttatcgccattcaaaaaaggaagctcagcttaaaaatgcccttcataaacagccaaaatg

SEQ ID NO: 107680 - DNA, 511 bp, Heterodera glycines
  Promoter: Source sequence=SeqID_28238; Location=730..1240; Strand=-; Gene=SeqID_58878
tgaataaaatggagaaatgaaagggaatgaatggtggaggtggggggggcacaaaaaaaggcactttcgcacagcggacgaaaaacggccaaatcgcaacgtaagagcggaaaggagagaatatgccctcagggggaacggcccaatcagcagggacaaaggaagcgccgcgggacgaatgggcaaaaaagtaagaaatgtgccaatataaaaggggacacattctcgccttatcagcagccagcatttcttcattctcttaacaacatttcggtttttacttaaacataaattatatttctaaaatttatttatttgtttctaccgaaaaaataatttaatttttaaaaggaaccaaaaaattccattttactcatcaactcaaaatattttattccataaaatgcacatttcgatttatttatacaaaattgtatccaaccaaaaagcattttaaatttgaaaattttaactcaaaattgaaaattcgcaaaatttagcgtaaaatatg

SEQ ID NO: 107681 - DNA, 364 bp, Heterodera glycines
  Promoter: Source sequence=SeqID_12555; Location=723..1086; Strand=-; Gene=SeqID_76207
ttttctagaatttgaataaagaatgatttcgatttcttgctgggaatgatttggtgcgcaagtgggcgtggccaaagtgcacacatcgtatacccgatcattttcccgattcattttaaaaattttgcactttttttttgcacattgctgtttttctgcgctttatgggcaccgtattatttaattgggaatttagggaaccgtataattaaattttattaaaattatatgagcatgcttaaatgtttattcatcttccgtctttcacctccttttattcttcacactatttccatgctttgcgcatataaataccgaaattttgttcactcctcctcaatccctgcacagatttaaaaatatg

SEQ ID NO: 107682 - DNA, 262 bp, Heterodera glycines
  Promoter: Source sequence=SeqID_6704; Location=1196..1457; Strand=-; Gene=SeqID_62566
ttatggtgcctggttgaagcaactgaaagaaatggggagaattgtttaatcatatttataaaatatattttaatacataatttattttaattcgatttatcattttcattttaaattaaaacaattttggtttaattaggaaaagcatgtttgaatttttgatcaatttttaaggccgagctgtgtttgaccaagcttgccctgatgttttcaaccatctccgcaatgtctccggcggcaacactttatgcatttaagcatg

SEQ ID NO: 107683 - DNA, 464 bp, Heterodera glycines
  Promoter: Source sequence=SeqID_23033; Location=273..736; Strand=-; Gene=SeqID_53734
acgtttttttttgaaaaatttcaaatgttgataaaaaaatttcactatatgtcgtcactttttcatacatttttgtgaataatattcaatattaagcagttttataacaaattcatgtcattttttcgggtgggctgagtccaagtctagcctttaaattccatattcctggcggcgacggttaggcaccaaaaaaaagatgaaaatgaaaagatccgcgcgatggatttaggaaacgctaattatgtggctgaatttaggaactatcgcagcacgacgaatgctggccaaagccaagttttttttttaattcttcggttttgataaattttttaaaattttctcatcgagggaaccaccatctccgctccactggggtacaaaaactttttaacagaaaagctcagcattttttccactaaataaatattctatacttttaaggtgaaccctccactcagatg

SEQ ID NO: 107684 - DNA, 404 bp, Heterodera glycines
  misc_feature (105)..(105): n is a, c, g, or t
  Promoter: Source sequence=SeqID_4484; Location=1..404; Strand=+; Gene= SeqID_54625
aaataaaatttaattggtttgaatcaaggtaaaaaataagcaagtgattgaaaaaaaaatcagggacgtgtccaacagcgctcaaatgcccaaactaagctttanccaggctcttagcgccagttcagatttagttgtaggacccgtattacatttgtggaggattatggacttttttaaaataaaaaattaacaattttgtttttaattattgttcatcaagaatcaatgtgttttcacaaggttcatttaaaatggcaatgaccaatgacggggaggctaattaacgaaaaagcattcaattagtaatttatttttgtctttaaggagcgccgggctccagcaaatcaaaatttgcgcaaaatatcgccaaaaaatatgatggattcgtgttcatcagcatg

SEQ ID NO: 107685 - DNA, 1003 bp, Heterodera glycines
  misc_feature (30)..(30): n is a, c, g, or t
  misc_feature (52)..(52): n is a, c, g, or t
  misc_feature (62)..(62): n is a, c, g, or t
  Promoter: Source sequence=SeqID_8702; Location=33..1035; Strand=+; Gene=SeqID_68894
tactcttttcatgtcttcattttctttgtncatgtatttctttctctctgtntatgcttgcncaatacacactctttctttcatctaatttctctatagtgtctgtgttactctttttatgccttccaatttctctacactattttcctcaactttgtttctctatatcttcaattcttcacttcactgacaattaatagtatcgattgaccctggagacgaggttggcaagcattgctctatatttcgccacttgctcataattatttttcatttacaaattacttttttctaatttaccccccccccatttaatgattctaactgcagtcctaacatgtttattctagcatttatttaaaaatcgaattatcgaaataaatgattaatatgtagattaaaagaccaaaatctctttttaattttaagatttatcggaatgtggaattattgagattttttggctaaaaaatgctagggaacacgggcagacattgaaaatgtttttttaaatttaaaataaaaatctttaaaaatattttcattttgtgatttttaaaaatagctatttaacaaaggaattttatgcatcaaaaaatttcaaaaaacaaaataatacaattcaaacaaataagattaacatttttaaattggtgtagaaatcttgtacatacctaattgtttaggaattaattaattttaaattttatatgaaattgttttacttagattagaaattaaacttgcattaaatatttaaatacaattttaaatatatacagccacagcttaaatcaactatatgtattgtggcttcagttgaacaaatttaaaaatgattgcatctaatttaaaaatatccagaaacaaaattaagccaatcaaatgaaattgttttggaatttttcgttcccaattttgtcgtctacaaacattcaccataattattgatcaacagtaacaacacacacaaaaaaatacagtagtccatccattcataatg

SEQ ID NO: 107686 - DNA, 286 bp, Heterodera glycines
  Promoter: Source sequence=SeqID_3553; Location=941..1226; Strand=-; Gene=SeqID_45573
acaatggaaagattgggaagagagcgatgaaaatcggtcgaattcgcaccgaaattccctttttgttgagtacactttcctcttttcaccaggcccccctctccgttcccttaacgaagacgtcgtcggccctcctgagaaattgttccgacccgacaatgtttcatcgactgatttgacgatgtatcagaaccagaaacctgtgggcactcgaacgagcgcaaccatttcaccagcggaattaaaaaaacgagaaaaatttatgggttcgaattctgtcgaaatg

SEQ ID NO: 107687 - DNA, 69 bp, Heterodera glycines
  Promoter: Source sequence=SeqID_13986; Location=779..847; Strand=+; Gene=SeqID_77947
ttgtgtggacaaaggacgacagaagggtggagaacagtcgtaagcaaatttaccgtaattagttccatg

SEQ ID NO: 107688 - DNA, 949 bp, Heterodera glycines
  Promoter: Source sequence=SeqID_21105; Location=1599..2547; Strand=-; Gene=SeqID_51693
tgtccccatcactttctaattgctttgcattcaaatttcactctcttctttttaggagcgttcctcgtttattcagcatcgccattgctccaatttgttcccgggcttatttggacgcttctaaattaaagcacagcaaattacctatttcctttgtctattgcttctgtttttgttgctttaatgtgtgtattttacgatttctgtctgaaattttacgataaattgaattttaaaagcatttccaactcaaaatgcaatggcattcatttgttttgtaatcacattttggtttcttatttttactttttccattcgcatattattaattgcattttgtctttcgaatgcgactttttccttccaattcgtcccgttgccactttttgccactctttcgccgccacctttcgtccgatggtggcaaacccgcaacaaatgcgtcgcttgcatctgccaacatggtgttttatttaaattgtcgaatttgtaaatttgaaaatgcccatggattttattcccaatcttccgtcctttaagggccttttcggcaattttcttctccgttctccgcacggctttgaactgctcacgcgagcggtggacgcaaagtcaaacgaatttgtgaaggaaattgtgcaaagagcggccgaaagggcagccgacagagggaaaaaaatggcaaattttgcatttgtttgtacactactgattttatttacagaaaacgacagtgtctctggtggacgatctgtccaacgaaatttgttcggccgctgatttggtgattttttcatctgatggcggggggggaggaagaatttcggccctcgtccaattaaatgcctcaaacagagggccacggagctaaattcggcgcttagtttctgggagacgcatcataatcggagaattgttcccatattagacggattgcgtccgctgtatg

SEQ ID NO: 107689 - DNA, 167 bp, Heterodera glycines
  Promoter: Source sequence=SeqID_26221; Location=1594..1760; Strand=-; Gene=SeqID_56975
aaaagtccataaaatcaaaaatttgaatctccaatgttttcttcttcgactcggcttcggcttgggcatttgaaattggcttttcgaagcgaccccctctttaaataatgccgaaatttttttaaaataaaaaaaaaaaatttttttttgtaggtcgcacttggatg

SEQ ID NO: 107690 - DNA, 656 bp, Heterodera glycines
  Promoter: Source sequence=SeqID_748; Location=1247..1902; Strand=-; Gene=SeqID_60389
ggtttgtggccaccagtcggaacatttggttcgatgtgccatttgcgttgaagagaaggaactcggtgctaaattgcgtttccacgttacttgcgcaccgctggccgatgtcattttcgagcgccgcgaattccccggggcgttgcccatttgtgtctttcaccacagtgctcaattcgccggtgcttttggtaatatagcccattcaattttgctttccctcccaatcgcttctcgcacactcgggtttggaccgaaattgctaattgtgccatttggtccttttgtgtgtgtgccaaaatgaccgttgcgtctgaaacccatttgtgcattttgcaaaatgcacagagaaatgacgcaaacaaaggaaatgaaaaaaattggcattttgctacagctgttttatcaaccctcgttttttgtcagatccaacagactcgcgcgtgtttgaactcaaacagcgcgtggtcgtggacctgaacgaagagacgggcgacgacgacgaggaagaggaggagaagaaagacgagcgactgatcggatacgggctgatatactccatctcggaacatctgtacgccaccgtggatttcttggacggcacttcctcttccgaggtgttcccaagtgacatcgtcgactgcgagtgcaaaatg

SEQ ID NO: 107691 - DNA, 111 bp, Heterodera glycines
  Promoter: Source sequence=SeqID_36762; Location=1524..1634; Strand=-; Gene=SeqID_66005
actttaattctgcgttggatttttgctccccataaatgtttgagtaccccaaacggacacttgaaaaaatcgatttttttgtttcataaatatttttttcagaaagtcatg

SEQ ID NO: 107692 - DNA, 171 bp, Heterodera glycines
  Promoter: Source sequence=SeqID_6972; Location=4689..4859; Strand=-; Gene=SeqID_63445
attagagacacacttccatacaaaaaacaattttgtgtccaactcgtttgtctattcaatctttgcttttgccagactcagaatccgcgcaagagacggccccaaaatgccaatttggcattccaattaaactctggcccaatccttacaaatccctaggtgttccttatg

SEQ ID NO: 107693 - DNA, 662 bp, Heterodera glycines
  misc_feature (40)..(40): n is a, c, g, or t
  Promoter: Source sequence=SeqID_18433; Location=1155..1816; Strand=-; Gene=SeqID_83031
gtgctttttgatggccatagattctgggattaaactcacnagacgaatgaatttcacgaatggaaatttaaaaaaagccaaaaaaaatatataaaaccaaagggaaataggtaggaggaaaatcccccaaaaaaattgttacaaaatcacttaaaatttgataatttctttaaaaaaaaattttttttttaattcaaatttttttaaattctggagctactaattttaaaaaaacaattttccaaagattaggtctcagcttatctgcccagccttcttctgtttttatgttctctgttggcccaatggaggcgccgaaaaatccaagtgatcgtcacaatgggcgctctgttggccaatttaattttatttgtacggaagatattaattaaaagaaaaattaaaaattttattttaaattttacaaattagattcgatttttgtttaaaaaaaagataattaaaagaacaaaaatctttaacttttacaaatttatttaatatataaaagatttcataaaaattttccataaaaattccattttccgattaaaaaaaatatacatttaaaggaatgaaaattcattttcaattttatttaatttcttttcaattttaaaataatgattgtttaaataatatttttatttggattaattatg

SEQ ID NO: 107694 - DNA, 1003 bp, Heterodera glycines
  Promoter: Source sequence=SeqID_1490; Location=73..1075; Strand=+; Gene=SeqID_73906
gaaatttttgataaaaagtcggaaatttttttttttgaattttttttccaaaaatttaacaatttttgtacaatttctgttaataaattgcactgaaattttcaaaaaacttcaaaaagataccgagtttgaataaaaattgcaaaaaaacaaacaaaaaaccattataatttatcttcacagttttaaatactctaaaataaactttgcaggaacaacattttcctttcgttcgaatttaggtcatttcttaaaaaaacccgaaatattcgtgattttaaactaaaatttaagaatacaataaaaaaaataataattttgattttaaactcaatcgcggaacattctcatttcttttttctttgaactcgccatgtttcagaataatctgtttcataataccggtactctgtgaaaaattgggaccttactagccgactctgcgaaaaccatatcggtaccagttttttcttctttttttttggtttgtaacggtacgaattggtatttatccaaagtgaacattttttttgtttttttttaaatttttaagaattcaagttattctatttttctgcttaaaatcataacttgaatcaaatattcacaaaatcaaagaacgagacgaaataaaaaaaattttcaaaaccaccaaatgtgaaggtgtaacattgacctggaagatctttattttaaataaaattttcattttattgctgtaattaatttaattatattttgtttctttgctttttttacgtgtaacaatatgaacattcttcatttgcatgtgaatacataataggtaatttcaagggtgtttttaacaactatgttttccctcaccctccctatcccctccggcatattgcattgattttttgttgtttcttttttacggatttaaaaacttaattattttgcataaaaattattttttgagaattttttttgaagaaatttcaaatttaattaaattcagctacattatttaccgataatg

SEQ ID NO: 107695 - DNA, 1003 bp, Heterodera glycines
  Promoter: Source sequence=SeqID_2166; Location=1949..2951; Strand=-; Gene=SeqID_78213
attgatcggaatgcggacaccttgttcaaatcagaggcatttttgcaaattgaccagaaattattgttcaaaattctgtgccgggatcagttggttgtaagccaagaaattgccatatggaatgccgtaaatttttgcattttgtaaaaatttaaaattttgcttttttgggtcgattcttaggggtctattttttgaaaaaaaattttaggtcgattcttaggggtgtatttttcgtttttattgcatttttattataattttggacaaaaggcaaaaataggttctttcaaaaaatttttaggcttttaggctctaaaaataaaaacctagaaaataggctctaataactcgaaaagtagcttaacaacatcccaaaaaaccatgttttagtgcgtttcaggccacggggagctcaggaaaaaataggcttttgcctaaaaatcccagccctagtgaggaccgtggaaccaagctactttaagaccaattaattgttgctgtctgattgtgagatcgaaaaacccttggctttagagacttttttttgtatgaaaatgcggacgatttgatcaaatcggaggaatttttacaaattgaccaaaaaacattgtgtgaaattttgtcgcgtgacgaattgcaaatcaatggagaaatttcaatttggaacgctgaaattattttacaaataaattaaaactctaaattttattattcatttatttattttttaaattaaccattatttcctatttatttttcggcactccgttgggccgatgcaaaatgccatcaaaatggaattgaatgctcggcaaagaatcgtcgtgccgttctcggcccggcactgttcaaaattcgctttccgcttttctcaattgagaaattttcgaagaaaattggtaaaataactaatatcaaattattaattaaaattttttcaataattttaatttttatccattatggcattgattgttcagcagagaatcgccgtcaaatg

SEQ ID NO: 107696 - DNA, 109 bp, Heterodera glycines
  Promoter: Source sequence=SeqID_5379; Location=5236..5344; Strand=-; Gene=SeqID_57830
ttccttggtctgttggatcgggtcggggacacagctcgcaacccgcgaaccaccggcgggagtggaggcccgcgggcaggacaaacccaaaccggtggcaaatgccatg

SEQ ID NO: 107697 - DNA, 558 bp, Heterodera glycines
  Promoter: Source sequence=SeqID_17255; Location=1..558; Strand=+; Gene=SeqID_81723
aactaaaaatgctgtagtaaaggcaggaacaaaaaagaaacaagatacagtggcattgctgttatgggaaaatgatggatatgactagggctgggaattatattggatataaaatccaaaaatatgtccataaaatatggaccaaaaatcgcaaaatatgggcataaaattacaaaaatatgggtcataaattttccggattggagggaaaattttccaaaattttaaaattaattcaattttactaaatacatctaaaaatggctaatatggtattaaaatcagtttagaagaagaaaaaaaacatgttaaactcgggcaccaatttttagtttcgaaaaccgttaaacctaaacccacaaaaaagtatgctaaatttgatgatgcatatttggggatgccattttttaatacagattaaaaaaaaatcaattttgttacattgccgaaaccagctgttccattgagttttgcggaagagttcaaagtggtaaaatcaaattttgtgggcccccattgtggcgcgttaatttcacgttatataataatatccagatg

SEQ ID NO: 107698 - DNA, 1003 bp, Heterodera glycines
  Promoter: Source sequence=SeqID_4066; Location=2514..3516; Strand=-; Gene=SeqID_53041
gcaattgtgaagattattggtcccacaaaaaaaaggaataaaaattcaaaaaacacttttctaggggttatttggtgcgctgagaacgaatttgaccttcttttgacttaatttcgaaccccgaacccggattcgaacatttgaaaaaattcaattttcaatttttgcaaatattgctgatgcattgcttagtactgtaactacaatatgagtaaaggagaatcgattcgaaggggaaaacgcgcttcttcaaaaaatgaccccgccctgattgacactttctgccctttgtgtgttgggcaacgccattggcacccgtcaaacgtaaaggttggatttttgacttgagtcatacgccgcgggcatctatgccgaccacagatgggggcaatttgccgtaagagaccaaggtttcgcatgtatgcgattgtatgctcattggtttgaaattgtgaacaaatttcaaaaatatccattgctaaattgttagtaagctaatagtaaggttagatgaaaatgttctcattgtctcttttgatctggtcattattattgaccgcctattatgtcaatagtttgcctgatttcataattttttgtttacgacttcatccaactgactcgatccgtttgttattcaaagttattgattaacgtatgtaaatggcatcccaacaaagtgtccaagccacgaaatgtccatccacgaaatgtccaagccacgaaatgtccaagccacgaaatgtccaagccacgaattgtccaagccacgaaatgtccaaaagagtaaaaaaccacgaaatgtccaaaagtctaaaaagctcataaaaacccgaaaaacgggtctaatttagggttttcggggtcactgagtaagaatacgacctttaaataacccatttcctaatcctagacccacacgaataagaaaaaatctcaaaatttgtttaaaatttatgcttttttttactccagatttttctattcattgatcgaactaatg

SEQ ID NO: 107699 - DNA, 1003 bp, Heterodera glycines
  Promoter: Source sequence=SeqID_9396; Location=1766..2768; Strand=-; Gene=SeqID_71261
tttttaaatatgtatacttcctgcctgttatatgcacgccgaaatacagccttttagagcgaaaattcttcgattaacatcaatatacttcaaaatttaaaaatatataatttttcggcttttttacgattttgttaaatattttttgcattaatcaaagttaagtaatcataaaatgctaaaaaacgaaaaatacacccctatgaaatgccaaaaaaatgctctaaaatagaaattttcaaaatgtatccataaaaatgttatttttaatgatttttctttattttgtggctttcgaatgtgtaaataagatattaatttaattacgaaaaagttttcagctttaaaaaatttcttcgctttaaaaatttcaatatataagaaaattttgccattatttattattttcaccaaaagacaaatttttagttatctatctaatatattaattttgcaatgtatgtgtgtcacaaatatttcgaattttttattgacacgaaatctttttaaaaaaaaaagttttttgacacgaaataaaaatttcataagatatttatagggatgcgatttttaggcacaaaaaatcgcgaaatatgcacctaaaaaggcattaaataggcacaaaaaagcccgaataggcacaaaaataggcaaataaaattttttattaacgctttttaggtaacaaaacacgttaaaactttaaatatttcaattgtaaatgaaattattaatgttttaaagttttttttcgaatatgaacaaatttttaaaccaaaaaatttttattaagaaaaaaatattaaatttagggataatttttttgaaaaattttacaattcttagggtgtattttctgaaaatttttttgggtttttttgtttttattgcatttttgttaaggattttttcaaaaaccctaaaataggcactttaggcacaaaaaccccgaaataggcaaagttaggcattataaaagtcatcgtagacaccccaaaccatg

SEQ ID NO: 107700 - DNA, 187 bp, Heterodera glycines
  Promoter: Source sequence=SeqID_1273; Location=4332..4518; Strand=-; Gene=SeqID_71242
ggtaggaatatttaaaattatataaattaaactaactttgtatttttaagtgcgttcccggcaaaacatttgttggaatgacttttgccggctctgagccaaatttgccctctctgctgctgtactgtcatgatatttaaatttaaaattagaatttatttatttgataaaataattagagcaaatg

SEQ ID NO: 107701 - DNA, 610 bp, Heterodera glycines
  Promoter: Source sequence=SeqID_15822; Location=1619..2228; Strand=-; Gene=SeqID_80149
gctttgaagggttactgtagcgactgaaaatcgccattaaaaacaaaaatttcttttatggccttacagtatttagtagggttaagctccaacccctcgggaagaaattttggggtcacgggaaagggagaacagcagggatcggggagctcagggtcgaggcttattaaccccagtatttaggggtactaggtcgtttagtaaaatccgccattttagttagcgattttttcaacaaaacatggtataactttgcttaaaggcagtcaaatttcagattcttgttatcattcgatagccaagctttttctctattagcttgcgaatctttaaataaaattgtcaagcttaacatgagttatggaagaaatagtacttattttcatacaactttttctaatgtttaaccaaattttttaaattttgcatgctaattgagaaaaagcttggctatcgaatgataccaaaaatgtaaaattcgattgcatttaagcaatgttatgccatgttttgtcgaaaaaatcgctaaaatggcggattttaggaaacgacttagcacggtatttagggcaacaattagtatgtgttgtttattttcaggtccggtatg

SEQ ID NO: 107702 - DNA, 366 bp, Heterodera glycines
  Promoter: Source sequence=SeqID_2815; Location=4144..4509; Strand=+; Gene=SeqID_81762
cgttctttactcatatcagacaggtattttggcatttattgtaataatttggggaaattggtttggttttgtcagaagtgctcggtttggaggtgccggtttcgtcaatgattcgccagtcagtcagcggattcaactaagtccttttgaccatcccaaaaaagtgtctattggacacatgtcgacaaaatccgaagctgttgatccagaagtgcaggcccaacttgacctccttctggccacacttaatttcgaccctcaaggcattcgattgaaggagcatttaattatgaattttcgaaattctaaggtctcggcgctggtggaacgggcgttaccattgaaagggaattggaggaggaaatg

SEQ ID NO: 107703 - DNA, 864 bp, Heterodera glycines
  Promoter: Source sequence=SeqID_26398; Location=408..1271; Strand=+; Gene=SeqID_57129
ttgtgtaaatgagggggcgggtggggaatgccttgtccgtacgtctcttccgtctttcttttttctttccggcgccctttaaattttttaattaaatgcgcagagacgcaacagaagggcaaaaacactgaagggattggcacaaaacattcatttctttggcattaacagatgataagcttgtatagtttttttcgcttttaataacaaaaaaaataattaatttaaaatgaaaaatattttgaaacgcaaaaaaatgcaataaaaaagaagtaatttttggaaattctttaaacagagaattacttaaaaattgacaaatttacaatttaaaatgaattaggtatattttaaaacgcaaaaaaaaaatatgaaataaaaaaaataattttttggaaaaattttgacagaaatatttaaaaatacgagcggaaaaatgttttattactttttaaaggtaaatattttttgaaccaattatgataaattcactcctaaattcctttttttttggcttaaatggtcaaaaatatatttttttgaaaaaaagaaggcaacaaatttataagtagggctggaatttttttgcggcttagttatggcgagagaagtcccaaaaatagcattttctccgaacaatttttgatttagagcgacttataaaaacataaaaacacatattttggcgttttggcacataaaaacatatcgcacatatttgggctattttggattttttagcacatattttggcatttttgagaaaaatcgtaaaaaaatacaagaaaatctgaaaatgcaccctaaaaattgactactttacgtttcttaagcatttagaaaatttctttatatatttaaatg

SEQ ID NO: 107704 - DNA, 355 bp, Heterodera glycines
  Promoter: Source sequence=SeqID_11544; Location=1863..2217; Strand=+; Gene=SeqID_74982
ttctgatcaatcattatttccagcttggcattgattaaaattttgaatcgattattcccgatcaataccacttcaccgatcaatcaaatattttttagcttgcattgattaggttattaccggtcacttaatcaatcaacgtcaccatcctcatcaatcaaatatcgctcttatcaatcaatgtttccctctgatcactaatcaattatatcactacccttatcaatcgatatcgctctgaacaatcaatgtttccctctgatcacttcggcccatatgttatatatatatatatatcattttatcaattattatcaccgtcctaattaatcaatatcgctcttatcagctaatg

SEQ ID NO: 107705 - DNA, 1003 bp, Heterodera glycines
  Promoter: Source sequence=SeqID_6841; Location=2335..3337; Strand=+; Gene=SeqID_63073
tgataaatcaattttagtaggaaattgaaattgatataggtaatttaattgttactgcacgaaaatgagcgatatgattcattgggtttttaacgttaagccttgaagcttctagcttcaacttttaattaatgtatgatcactaaattacttgaagatttacttgaaaatacacattttcatttgtaatgggctgtgatataaaaggaaaagaaattttttgttttatattcgctttcttatcacaattttatgtggtggatttgccaaagtttagagagattgccttccctttctcacaaataaaaatgagttatgataagaaaaaaaaaaaagaattttttttggaggggtcgtctttcggcccgttgaacaaatgataaagtttaaatgtgagaattgttgtgtggtgtgtttgtgttatgttcagcagaatacttaaatacctatgtgatggaggaacggcacggaaaaacgatggcaaactaaaatgtgcaaaaagataatcggaaaaggggcatcacggtgatgtgatggacctggaccttggaccccacaaaaatcacatgatttgatttggacctcccccgccccgttttcccctctttcttataaagaaagtacgcacattctctttttggttttattcttattgcatgcaataacagttctctcttttttgggtgcggaaaaaaaaagtaattaattaattaattgtcggacatgaatggaaaatttttatttttatagacagagaaattattattagattttagtaaaattagtaaaaaataaataaataaaataaaataatgcatcttattcatttagaaatgtttaaaaatcgttatagaacattcgtcttattgttagagagtgttttaatgctgcaaaagtatattagcgatttttgacaaagaattggcatatttttttgatcattttgtggttcagtttgagtttgtttatttatacattgcaatgatcgctgacccacaaaatg

SEQ ID NO: 107706 - DNA, 294 bp, Heterodera glycines
  Promoter: Source sequence=SeqID_4829; Location=1948..2241; Strand=-; Gene=SeqID_55869
agccatccatttttggcaaagctcatcagctatgcctccttcgaattgcacaatgagcaactcattccagcaagaagcgctgaagaacgctcactcatcacgggctcagattttcttctgccggttcaagaatgtcctgtgggactaattaatgctttctcatcatttcgtgtggacccaaaaagcgattcgctcacagatgaccatcaaacagaagtggcatcgttcttggtacaagcacttttggaacattttggcaacgctttttcgtccagaattattgttctgtgtatg

SEQ ID NO: 107707 - DNA, 488 bp, Heterodera glycines
  misc_feature (103)..(103): n is a, c, g, or t
  Promoter: Source sequence=SeqID_25553; Location=1..488; Strand=+; Gene=SeqID_56294
aatctcgaaatctcattttcgagttcaaatttttgtccaatcccataccatccaatttttcgaaattttattttcgagttcaaatttttgtccaatccccatntagtctaaaatttcggaatctcatttccgagggtctaaaaattttttttttgtttgtgttttgttttgtttttttttttgttttgtttttgacccaaattgtccaaactatccgctcttgataaaatcagagtcttagctctgacagtgcgtggtaaaaaagtctcacaaatcgtgaatcgtgtacccttccccctttctggtttttgtttccccctttctggtttttgaattactgattctcaactcagaacgcagttcggttattgattaaattggagtctcagttccaaagttttaaattgttcggtcacagttcggttattgattattgaattggagtctcatctccgaattttcgaatttggtcattgatttgagcaatg

SEQ ID NO: 107708 - DNA, 357 bp, Heterodera glycines
  Promoter: Source sequence=SeqID_8946; Location=881..1237; Strand=-; Gene=SeqID_69764
tatcgttcaaatggtatctgaattgaggataaaaaaaattatgaaaaagcctaaaactttgggtttttctggcccttatggcgggaaaaagtacgtagaatatgggctgtccagaattattattttttttttctagacgcgaaacccaaaattgaccctaaaatacgaaaagtctaggcccaaatgtccaaaaaaccgtattttcatactttggctaagttaacaaaaaaaaaaatgtgccgtttaaaattttgccgttcaatttttggcaagccaaatatgattggcattttacaattttttaaatttaatataattaataactttttcatttccgcattatactccagccgcatg

SEQ ID NO: 107709 - DNA, 194 bp, Heterodera glycines
  Promoter: Source sequence=SeqID_14097; Location=729..922; Strand=-; Gene=SeqID_78082
tcattgacgaccattgatccgccgatgaattcaaacagtatccgagccacttcggcactttcgccgacaattctcaccgatctcgaccaattgaattcaatctattccggtgatttgttgcccgaggcgattggtgatgatgattttgatgggccaaatgcaacaatttctgctggccaaatgttgtcaaaatg

SEQ ID NO: 107710 - DNA, 99 bp, Heterodera glycines
  Promoter: Source sequence=SeqID_9711; Location=1..99; Strand=+; Gene =SeqID_72451
aaagggattataataaattaaatatttgaaattacaaaatggtctaataattgtttaattccatccaattaaattattttttacagccatccaaaaatg

SEQ ID NO: 107711 - DNA, 288 bp, Heterodera glycines
  Promoter: Source sequence=SeqID_28410; Location=858..1145; Strand=-; Gene=SeqID_59030
ggatgggatttttaggctctaaaaactgccaaaatagtttggctctaggctctaaaaaacctaaaaataggcactaaaaaatggaaaataggcactaaaaaaccttttatccctcaatcttgatatcatttgaaagcttttaacatgctctattagccttattaaaaacaaaaagattttctggcttttaaaaaagtttttaagaaaaatgtataacttttttggtaattgtctaatcgcaaagaaataacttagaaaaagcttctaaacaccttaagctttcgaatg

SEQ ID NO: 107712 - DNA, 267 bp, Heterodera glycines
  Promoter: Source sequence=SeqID_16727; Location=2382..2648; Strand=-; Gene=SeqID_81129
aaggacagtgaatccagtgaacccaaacaaagaagggagagaccaaagccacaatccaagcaaggccaaccaaacgcaactacaactcagcttcaatgttggagatgtgggaaaacgaaccacacccacagagaatgctcgcacaaatcggctaaatgtcccaaatgtcactacaccggccatttggagaaccaatgcgaaaaagtgcaagagtggcgccgcaaaaacttcaaagtgaagaaagttggaacacttagcattggaatg

SEQ ID NO: 107713 - DNA, 118 bp, Heterodera glycines
  Promoter: Source sequence=SeqID_30516; Location=1..118; Strand=+; Gene=SeqID_60924
tttttttgagaaattttttatcaaccaacgctctcggacaagaaacgaaatgggggggggcatgggcatttttatttttcaaataatttttatatttaatagatattccagaaaaatg

SEQ ID NO: 107714 - DNA, 108 bp, Heterodera glycines
  Promoter: Source sequence=SeqID_32246; Location=1..108; Strand=+; Gene=SeqID_62568
tcaattttcccctaggaacaaaaactttaacatgatacaaacttttttgggggaaaaatatttggtggatttttggagacaattctcagacgacaaatttaaaggatg

SEQ ID NO: 107715 - DNA, 968 bp, Heterodera glycines
  Promoter: Source sequence=SeqID_18255; Location=731..1698; Strand=+; Gene=SeqID_82847
agaaactgatgatgaacatcgattggacgattaaacctcaaaaccatttttcaatgaaaatctgttaaaaaacggttaaaatttctattttttctcccgcgacgcctatcggcacagccgagcccccaaaaactcttattttttcataaaaaattggctcaaaattataaaaaactagtcattttggtgaaaatatgttaacaaattgcactcaaatgttcaaaaaaaaagtgatcacatttgttcgtcacaattctgatttctccataaataattgtgttttgtagcataaattatttaaagatttacttcaatggatcgaaatagaaaatcataagcaaaatgtaaagaaatatgaaaatgctcttttataaattggattggtcgataaaagtaataaaatgcaataattatattattaatttttctatatcacagctaatagttacgggacattccggggctcgaaaaagctgggatttgggatgtcatggaacgtcctgctgctgtgtatcgagtgcggagcgaatgggacacggactaataaaagaagaagaaatttgtaaatttactaaaaactctgcagttgaaattttcaaattttacaaaaagttcaataaaattgaaaaaatacactcctaaaatcaatttttcatatttacaaaaagatttatttttatttcgaatgatgaaagatgccaaatcgaattgttcattaattggtcatttggatttacgaaattccttgctggaattattcaactgacaacttttctatttataaaataattttatcagaaaaatgaacagttttaccctcgaacacctccaaagcaaaatttcatcaaatacgtcaacatttcgctgttttggtttacttcagttgggccccacacatttgggctctaaataaatcaaagaatttttcaaagttccaaaaaatattttattgaaaataacaaaaaatg

SEQ ID NO: 107716 - DNA, 661 bp, Heterodera glycines
  Promoter: Source sequence=SeqID_36214; Location=1..661; Strand=+; Gene=SeqID_65592
tttatgaatcccaacggggtgggctgtctgtttaaattgggctggaaaaataaagaaattttttacctacaccggcttccctttaatataccaaaaaaagtaaatttttaaataaataaattattcaatttaatatatttctgattatttaaattgaaaattttagtttggaaattttcgaagcaatggttttatttttcaatttttaatttaattccctaaatgaaattgttaaatacattttgtctgagcaatttaataatgttgttttggcatgaaatggtgtaccaccacaatttgtccgcgacggtcattttatgtacatttttgcctaaattgcagtcaattctaatccatcatttcatgtttgcctttctcgccaagcatttatcatcatgcctttgtgttgagactctatttacacacaagtccaaccaaattgtggtccattaattcgaaaaaaaatatttttttttcctacaatcaatcgcaaattactgggaaaattcaacaaaaaaaaagaaaacaagttttcatcataaatgatcggagagaataaaattattttatgttaaaacaatgaaaatatatttcaaaaacaataaataatattaattatccattaatatgattgcgtaaattttttctattattttaaatg

SEQ ID NO: 107717 - DNA, 910 bp, Heterodera glycines
  Promoter: Source sequence=SeqID_1980; Location=2678..3587; Strand=-; Gene=SeqID_77146
gagagagagagagagattttgagagagatagagatttgagagagagagagaggggagagagagagagagatttagagagagagagatttagagagagtgagatttagagagagagagagagatttagagagagagagagagatttagagagagagagagatttagagagagatagagatttgagagagagagagagagagagagagaggggagagagagagagagatttagagagagaaagagatttagagagagtgagatttagagagagagagagagagatttagagagagatagagatttgagagagagagagaggggagagagagagagagatttagagagagagggagatttagagagagagagagatttagagagagatagagatttgagagagagagagaggggagagagagagagagatttagagagagagagagatttagagagagagagagatttagagaggggagagagagagagagaacgatcggattggcattttttatttaatcatcgaaactacttccaatgggattggcatttatatcgtttaaatgaaagaccgtctgctgattggattgaatttgataagttttcccattaggaacatgtcggcactgctccctatgatccaattttctttttgcaccacacttttattgattacgttggttttttattattttacataatcataaatgaaaacaaaaaacaattttattttaaattaattgtttccgatttatttaatttttacagatttgggagcagtggcgtttgcgcacacagcacagtttttctgagcgtgaaactgttttcccgccccaccatcaaattaaagcggtgtttagcaattaaataacaatggccatcatttttattccaaattaaaaaaataaaaatg

SEQ ID NO: 107718 - DNA, 88 bp, Heterodera glycines
  Promoter: Source sequence=SeqID_44060; Location=1..88; Strand=+; Gene= SeqID_71606
ttttctttccccgcagctaaggcaatgggttgagctgtcgtcggatgagcaggtgccgccctcactgttgttgttgacccgtgccatg

SEQ ID NO: 107719 - DNA, 137 bp, Heterodera glycines
  Promoter: Source sequence=SeqID_41912; Location=707..843; Strand=-; Gene=SeqID_69947
tttattgtccggtccgattttggaaattgtggttttccggttttttaatccatatatgaaaaaagacatcgatgctctggaaaatgtccaaaaaacatttttacgtattgtttttagacgtaataataataaggatg

SEQ ID NO: 107720 - DNA, 105 bp, Heterodera glycines
  Promoter: Source sequence=SeqID_23493; Location=1422..1526; Strand=-; Gene=SeqID_54189
tttttttttcattaataaaaaaaaaattataaaaaaataaattctttaatcgatttatatgccaaaaaatccccccaaaaaataaaagaacacttttagcacatg

SEQ ID NO: 107721 - DNA, 74 bp, Heterodera glycines
  Promoter: Source sequence=SeqID_15443; Location=1..74; Strand=+; Gene= SeqID_79705
acatcaactcaatttgcttgtttaatggcgtcttcttatgtgttctgcgcaatactttggcctcgactcaaatg

SEQ ID NO: 107722 - DNA, 208 bp, Heterodera glycines
  Promoter: Source sequence=SeqID_24819; Location=1218..1425; Strand=-; Gene=SeqID_55568
cgtgtcaatgagcacagtcgcctttggccagtgtgggaacggaaaaatgggaatatcagatggggtgcgctctttctaaaaattcctcttttcgtctacccatccctcccttttgtgcactatttcgtttcaaaattgaatcattttttttggctttttgaaataaattgtgaaaaatatacgaaaattattttagcttttaattatg

SEQ ID NO: 107723 - DNA, 73 bp, Heterodera glycines
  Promoter: Source sequence=SeqID_40153; Location=578..650; Strand=-; Gene=SeqID_68576
tttgttcctcaaaaataagtgtgaaattcccaaaattaaaatattacaataatatttttttttttgcaaaatg

SEQ ID NO: 107724 - DNA, 366 bp, Heterodera glycines
  Promoter: Source sequence=SeqID_26720; Location=1056..1421; Strand=-; Gene=SeqID_57480
tccgagcctgagagctagagattaggttaatctcaagaatggattaaaacatggcacagatgccgagaaaaagaagcgaaattgtgaaaaaaataatttaatggcacaaattcagagacaacatctctttaaattgcggggtcatcattgtttaaatagttaatttatacatgtgagaaaaagaattttttgtcaattagatgtcatattatgacttcgttttatgaatagaacagaaaagtgccaaaaaaagaatttttattaaaatttttagttaaaattaaaattttcttaaaaattttcgttctgagattttttattttgttagtgcaacgccaacgcgtcaccggctcgctggagggcatg

SEQ ID NO: 107725 - DNA, 67 bp, Heterodera glycines
  Promoter: Source sequence=SeqID_21616; Location=1917..1983; Strand=+; Gene=SeqID_52213
cgtgagtgcttttttcatcggaaggacacttttctcaataacaaatgcttttcagcaaggcattatg

SEQ ID NO: 107726 - DNA, 154 bp, Heterodera glycines
  Promoter: Source sequence=SeqID_7561; Location=3763..3916; Strand=-; Gene=SeqID_65224
acaggtggtcagttaaattcacgaacacgtttggaggggggggggggggggtttatcggggcccgttgtttggtgcgccaaggggatggacggagaaagggaccaaccatctcgcatttgattgaaagagaggggtggttttcttaagcggatg

SEQ ID NO: 107727 - DNA, 101 bp, Heterodera glycines
  Promoter: Source sequence=SeqID_12833; Location=1581..1681; Strand=-; Gene=SeqID_76559
ggtgaatcaatctgaaagcgttcatttttctttgcttttcgtctcttgaagatcctgaatttgaagaagcgcggccgtcttcccttggagaggaggaaatg

SEQ ID NO: 107728 - DNA, 554 bp, Heterodera glycines
  Promoter: Source sequence=SeqID_2815; Location=3483..4036; Strand=-; Gene=SeqID_81763
tctcaactcgaagagctttggatagacggtttggcagacactttggatgtctaaaatttgttccagtttttattattattttttaaggaaaatttgtaaaacgaattaggtaatgttaagtaattgattattatcagaacagacatcagtaattaagagaagtagcaaaactctcaagaatccgtaaagctggcgattcgtggcgtcaaaaatacaaaaaatgaaaaaggatggagtaattaatatttacaaagcttttcctctaaaatgttctgaggtgcaaatagatagcgaaattgactagtcgtatttgtgcagtgagaataaaacggaatgaatgaacttgacaaaaaggcagtacaaagccaacccgaaatccacatgggtatgacatggttatgttttctaaggtttccaatttttattttttatgaccagtgaatacctttgactcctcttcaatccgccagtcttgggttactaaatttgctatcttttcagatttgtgataaatttgatttttcctttcgtttcttcttcccgcttttctaatg

SEQ ID NO: 107729 - DNA, 102 bp, Heterodera glycines
  Promoter: Source sequence=SeqID_16953; Location=1444..1545; Strand=-; Gene=SeqID_81382
actaaaagcgcacaaaaagaaaagcacaattaaaaataagaagcggatgagacgacctgaatgtccaattgggctccttttcgggccaccatttcctcaatg

SEQ ID NO: 107730 - DNA, 1003 bp, Heterodera glycines
  Promoter: Source sequence=SeqID_24495; Location=216..1218; Strand=-; Gene=SeqID_55226
caaaaaattgacgacatcatcagagttcggcacagatatttatgcttaaaatggagtctcaaattattatttcggtaatttattgaaaaaaattaacatgtgtgaaatataagtaaggtatttttaccgaatcaaatattgcattttctcatttttattgataaataatttagtaattattcttgaatctccgcaattcggagcctgtttatacagtagcaatttcgtaaaaaatttaagttttttttttaaataatggttacttgggccgggaaataaattgtggaagattttgccggtagatcaagtctataggctaaagaacgctgaaccctaaattatgaatgatcccgcgtgagaagtaaatgattaatgaatcatacagtaattttttaacttttatttttgtgttaagccttggaaaagctaaattgtaattaaataaaaattatagaaattaaacgaacaatttgctaaaattacaagcgaaatttgccgaggtaattagtggcaatactaattatttaattaaattagtaatttaattgttcctttccaccacttttcgaactcgtaaatgacgatgagttgctccgccgtcttcaagcagaataatttgatgttgtacttgcgaactttacaaccagtgtccctcggcacttttccatcgaattggcgccaaaacaaaacttggcactttagcggtgccgttgtatcaaacggttgtccgtccctttggcatcccaacgctgagcagttacgtgacaaatgaggaatgtgccaacaaagggggaagacatttaattaattaatttaatcaatttggttaattataatttagaaaatagagaaggtctatttcgataatttcaatgttttcatatattcaattttaaaaatcataagaaaaaaaagtatcgtggacaattccagggatggcgcagtgatcgtttccttcggcacatttgccgatattaactcaatgaaaagggaaatgaaaatg

SEQ ID NO: 107731 - DNA, 57 bp, Heterodera glycines
  Promoter: Source sequence=SeqID_43923; Location=1072..1128; Strand=-; Gene=SeqID_71492
ttaattaaggcaatttaaaaaataatttctaaaattaaatcggatacattttagatg

SEQ ID NO: 107732 - DNA, 1003 bp, Heterodera glycines
  Promoter: Source sequence=SeqID_7480; Location=397..1399; Strand=-; Gene=SeqID_64952
cagcgcttcaaatccatcggcagggcattcggcttccaaaaggggcagtaagggtggacaatcagcagtggcacagaccaatatcataatttgacctgtaaaatgtgcggaaaaaacgaaaactacaattttgaacaggcctgatagcgtaacttgacgcagctttattcgtaattgtgccatcaacggctgacaattttcgttctgtgtcggctttcaacaacttcgtcgttggacctgttgagtcggccaattcctccccagccttcgaaaaaacaattgtcctcaattggccattccctttcggtgttttcactttgctgttgattctgttttctttggaattttcccttttcctcaatttttcaaatgcaacattcaacggatttcataatgccggcaatctcgagctgctactagccgtagagctgattcggcggctatgagttttagtcttcacattcgaaaacgcgttggcaacaaccaaaaatgaagcaaaaagaccagcaaaaattgttgaaacattggctgactctatcggtttctgcgacaaattgcgttcgtttcggccatcctttgctcgtttaggggcggagacttttgggaaaatttttgctctcggtaaattgtcggtcctaattctttggttctctttttgaaaattcatattgctgttattcacagcggcccaattttgggctcccagtacaattatgcttattttttatttagtaatcagaacgccaaaactttgcataactttaaattttcttgggattttcccttgtaaaaatagaagagccgatctcgagttaaaaaatatactttcaaaaaacaaaatagaattcgatagatggggccaaaaaatatgcctacgcaaaatttcaagaaaatctgaccctaggaaaatttttttgaccctagaaaatttcaataaatttctatcatttttcagctaaaaatggtcttgacacgcaaaaaaagcgaaaaattaaagaatatg

SEQ ID NO: 107733 - DNA, 660 bp, Heterodera glycines
  Promoter: Source sequence=SeqID_9974; Location=614..1273; Strand=+; Gene=SeqID_73017
aaaatgggcaaatgggccaattaatgtgtaattgatcactctttgcggtgggaagggatggaatttgtggggaaaagaagtgatcgaacggacaatgagcagggagtgatcagtcaaaaaaagatcatcagcccactatcctttattcaaaattggttctcttccctcttcccaaaagtgagttcatccggaacggcttcctcccccccccccgcccacccgcgcagcgcctttttcggtcattgcctttgctaaataaaaccttgaacttttcgtccccgtgccctcctccccttctctgtccgttttatttgattttcgttttcggcggtggtccgatttgatgtaatgaaaaggcaattttgttggtgccccaatcagccgaagaatgaggttgacacaggcaaacaaaaactgtgaactgccgagcggaaatatttgcattggttcgtcgtgggaagtgccgacaacggatatgggctaattggaaatgaattgggggaataatggggacagaatgaggggagatgaggaggagaaaggacggaagaggaggaagacgactaatttgacggaggaaaatgggaacgggggaagggaaccaacggatcatccgaaagggcgacttaccaatgaatgatcggaaaatgactagaaatg

SEQ ID NO: 107734 - DNA, 145 bp, Heterodera glycines
  Promoter: Source sequence=SeqID_977; Location=1373..1517; Strand=+; Gene=SeqID_65374
agtttttttttgaaacgaattttcattggtaaaacagagcgagaagaaacgctattgcctgctgagaaagtcggcggaggagtcacgcgtgttcattgaagtgtacaaacaagcattggcacaaccacagcaccaacagcaaatg

SEQ ID NO: 107735 - DNA, 122 bp, Heterodera glycines
  Promoter: Source sequence=SeqID_22413; Location=1..122; Strand=+; Gene=SeqID_53076
atccgatgagagtaaatttttagcacacacttctttctttgctagcgctagtttaggcaatttttatgattcccaccaaaccgccgccgacactaaaaatcccagaagaatggagcgaaatg

SEQ ID NO: 107736 - DNA, 1003 bp, Heterodera glycines
  Promoter: Source sequence=SeqID_25983; Location=118..1120; Strand=-; Gene=SeqID_56734
ttcgataactttgtcaaaaatgttaaaaattactttaaattttcatgatcaagtcaaggaagattgaaatttttcaatttctaaaatctttcatccgccggggccgattagcatcgcaaaaattttagaaaagacggggtttgctagggttgaaagcatcgaggtcgggtcccgaaaaattaccaaattttgcttttgagcaatttttctaagaaaaaaataggagttttggggtcccgcggtgcggaccagaaaaaacgcgccagctaaacttcgccgggcgaatgtttgtaccataccttttttccttctaaacgaccagacagaccagtatttaagcggttctttggactctcctcctctcactttttttttatctcatctcttctgcccccaactttgatttagccctttttacttaaatcccattttaacatttatttttattttaaattttcctttaaacaaactaacattttctaaaagcacgggttttcaattagtaaaacgccctaacaaataatgcaagacacaataacagttcgaacctgggctctattccagtttactcgtccaatcaatgaccatcttcagtttcttataccaaatcttttactactaggtcaaagtatacattcttgatatcgaaagagaaagcttagtctccggaattttaaataaaaaacgagcaaatactggtttattaattaatgttttgtctgtttttgagtatagaagtttgttaaatgaaacttctgtaatattctatagtttattccaacgtttttggcgaaaatttttaaatttaaaaagcatgttaacatgttttagggggggggggggggggagggggttcggttgtcgcaacgtcaaccatttccccgaattctgaaccccgggcccaaattcaaacatattttacatgactttaaaatatgagcgctaaaaaatggggaacaactaatatgtagtatatattaccaaaacttctagagatttcatg

SEQ ID NO: 107737 - DNA, 191 bp, Heterodera glycines
  Promoter: Source sequence=SeqID_20421; Location=1223..1413; Strand=+; Gene=SeqID_50957
aaaataataaaataaaaattattatttcaagtaataaaaatgaatgaaaatctttaaaattgttatttaaaataataaaaatgaatgaaaatttaagtttgtctttgtcgcaaacgagccattgcaccttttgatgacacagtgagttgccggagtgtacaatcttcttcgggctcgacgttttcggcatg

SEQ ID NO: 107738 - DNA, 606 bp, Heterodera glycines
  Promoter: Source sequence=SeqID_2597; Location=2010..2615; Strand=-; Gene=SeqID_80637
ttgatccggtataaatcacttgtcaacagtagtataaggccccgggggcgggggtccagacccctgccccgcttaaaaaaacacccattttttgttcttcatgattttgtcccaggtgccggggtccaaatccaggagaggattaattaaattaaattaattcagaggcagagggactcgaacccaagaggtcttaatccaaagcactaccactgggtcagcgatacagctatccgaaaaaggataattagcaattatatatatataatttaaaatcgattaaataattcaccaatgggagggggattcgaacccaaaaggccaaatccaacgcacaaccaattgaccgaggaacatagtcatccgaaaaaggatatttgtcagttatgtagtaaaaaaaaagtgtcgcaagagtcaaaaatggacgggagaggggatgcaggcgacattctcccttttgcctatataaagggatatttgtaagcaaaaaagcacaaagaaattttataaaaaatgttcaacgcaccgtttacattaattttatctggcgctacgggaagtggaaaaactcaatggctattgaaacttttaaaacattacagtatg

SEQ ID NO: 107739 - DNA, 160 bp, Heterodera glycines
  Promoter: Source sequence=SeqID_1148; Location=1699..1858; Strand=-; Gene=SeqID_68689
agacaccaccgatggacccctccccccaaatgccgtcctcaaggtcgtcgaaaaggcgccggacattttgatcggcatccgggaattttggcaattctttattggccgttcaacgcttcactccgggcttcacctcatccaaacaattttcggcccaatg

SEQ ID NO: 107740 - DNA, 258 bp, Heterodera glycines
  Promoter: Source sequence=SeqID_3802; Location=1810..2067; Strand=-; Gene=SeqID_51931
tcttttttctgtttttaaggctgtcgtccgtccttcgcgtcctccgggcccgaccaaaccactcaaatcaaccgcagtgagcacagcgcttttccataatttgcatttatttatttgcccccactttaagaccacgccggtgggccttccgcatccgaaaaagggcgttagcgcgggaatagtgagtttttgattttgctttttgttttgcgcttttctttttttcaatcaattcttgttgtcaatgtgttcaggatg

SEQ ID NO: 107741 - DNA, 223 bp, Heterodera glycines
  Promoter: Source sequence=SeqID_13385; Location=1084..1306; Strand=-; Gene=SeqID_77266
ttcattcgttcatttatttgtctcgggttcccttacccatcgcttccgctgcctttaggctccgcccgtggttggacttcctcgcagctcagatgcaatctttgggagcgaaaagggcttacacttatcaaaaacgaaatcccttgtcgttgcgggaaagggcttatgagtcgtgatgtcgagttttacaaggtaatttcacttgtgaaggcattataaaatg

SEQ ID NO: 107742 - DNA, 1003 bp, Heterodera glycines
  Promoter: Source sequence=SeqID_16424; Location=121..1123; Strand=+; Gene=SeqID_80829
attccaatctgcactttaggtcagttttgccgaaatttggactccgatcctgcaaaatttgggcgcaacattagtcggcattggtcctggtgaaccgtttgcctccaaatcgagcgctaaccttgaggaaaagatggaattctgttccaaaagtacacatttgagtgaattattgcaatttcttttggatttatttctacagttgagcctcacgtggatgtgctgctagcggagacggactgccaagccgaggtggctgttgtgtccaaagaacacaaatatttatcgacaataataaataataaaagtctgaggagagagagtgaatgaattaattgccgaaataaatttgccatttccgcttgacttgccatggtgatgatgtgaattgacagagatttcaaagagaaaaagatagaactttgtgtgaattgaatgaatgtgtgcaagtcagcggtgggcctttttggatgtttatttattgattgcacagtccgaggtcaatgatgatgaatgaatggagcgaatgatatggctttcaaccctcggcgaattttgaggaatgcgcagtggagtggctgcacgtattttggcttctcggtccacctcaacgcgttccaaaccactttaaactgtgcgggtgttcacagagctcgcagtgagatggaattccgcacagagtgttacgggaagggggccttgggttgtgccaaaaatggatgaaaatgaatgagaaaaatggcctaggactggcaaaatttagagcagaaatttaattgccttcgctgactgcgccaaaatgttgtgtccaaagaacacaaatatttatcgacaataataaataataaaagtctgaggagagagagtgaatgaagagaagagaaggcaaaaagcgaatgaatggggagagaacaaaatgtgtgtggaacagtcactatttatgcacttcgacgggcagagagaaaggaaaagacattgagggaaaagatagagaaaataaatg

SEQ ID NO: 107743 - DNA, 1003 bp, Heterodera glycines
  Promoter: Source sequence=SeqID_5658; Location=2795..3797; Strand=-; Gene=SeqID_58811
cccttttttgctcaccccactcaattaattgactatttaaaatgggacgaattgtaagccaataaaaacattatctttcccaataacttctgatcaaatcagacaaaatttctgatcaaatcgaaacaaaatttctgatcaaatcggacaaatattttttgttgcatttgcattttcggcattaacaatggcctttcagcaacatttggtcaacaaattctcgccgcttctgatttccggtcattattattcattgtttgagggatgatatttttggtttttgcctatttttttcctgagtattttatttttagagcctaaaagtcgagaaaattttgtaaaaaccctgttttaacctattttggcgttttgcataaaatttattaacaaaaatgtaataaaaacgaaaaatacacccctaatttgcgaggatcaactttttgggaattttttaaaaatgcacccctaataaacgaccccaaaatttcatttaatattattgatttggctaaaaaattttattgaaaaatattttattggtattcatgagtattctatgcatttgaatcgtttttagggacactaaaatagaattttggtgaaaaatgagttttagacttttgttcgaattcgggtccggggttcgaaattgatcgaaatggatgtcatatttcgtgatgattgaccccgaataccacggaaaataatttttatcattaaaaaatgcttatgggtgtaaactgtacaagtaccaattaattaattataaactgtacaagtaccaattaattaattataaactgtacaagtaccaattaattaattataaactgtacaagtaccaattaattaatttatttattaatctttttttgtctcttctctcattttttcctgttctttccgtgcagtgttttcgcctctccgccactgtgccaacatcgctgcgacaacgcaaaatgcggcgcactctccgccgccgcccttttcgctgaaaacgatg

SEQ ID NO: 107744 - DNA, 538 bp, Heterodera glycines
  Promoter: Source sequence=SeqID_8787; Location=1454..1991; Strand=+; Gene=SeqID_69224
ggtagtaaaattaataaataaaaatgtttataatagaaacttttaaggaagttgaaaaattgcttaattttatgtgccgaggactgagtgacgaatttgattatagaaaaagtgaaaattggcgaaaaattggccaacttgattataatgttgtgccgagagaaaaatttgccgattttatggactggcaaatttgctacgcatccattgaacattatttagagtattgcaaatacagtcatggtcataagtgttgtcccatcatgcttttaaaaaaaataattgccgtataaaattgtcattttccaatttcaacagataagtagcataccattggatagcattttttatgggctttccaatgatgccatatttgcttttgtgacataaacatttatttgatttattttaccatattcacaatttgatcaaaatataggtggtcaaaagtgttgtcccatttcatttttaaaatattgcttctctggatcagcattaaaaaaatctaaaaaaattcaggtaagcataactttggatg

SEQ ID NO: 107745 - DNA, 600 bp, Heterodera glycines
  Promoter: Source sequence=SeqID_30111; Location=1278..1877; Strand=-; Gene=SeqID_60553
ttaattctgcgttggatttttgctccccataattgtttcagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataaatgtttgagtaccccaaacggacacttgaaaaaatcgatttttttgtttcataaatatttttttcagaaagtcatg

SEQ ID NO: 107746 - DNA, 263 bp, Heterodera glycines
  Promoter: Source sequence=SeqID_43742; Location=83..345; Strand=-; Gene=SeqID_71347
gaatgacatttttttcacacattttcactttatttttgtgttgtatttgcaattattttccttaagttctcagataaagacatatattttaatttataaagtactttctattagtttgtacgtataatgttaaaagtgtccacatcaaatttaatacttaccaaaatgtctaaaatactgatttaaaggaaatattttatttgtgattttgtgtcttcgtaatttctcttgcttttttattagtggaaaaatgcatcgaaatg

SEQ ID NO: 107747 - DNA, 66 bp, Heterodera glycines
  Promoter: Source sequence=SeqID_31314; Location=664..729; Strand=+; Gene=SeqID_61684
ggtgcttttcagtttttgttttgcttttcaaatgatctaaggtggcttattcaattgaaacaaatg

SEQ ID NO: 107748 - DNA, 90 bp, Heterodera glycines
  misc_feature (44)..(44): n is a, c, g, or t
  Promoter: Source sequence=SeqID_12574; Location=1..90; Strand=+; Gene= SeqID_76235
gcagttgattttttatattttaatttaaaataaacaattttctnttctgtgctaattcataaataattcagagcgcgactttcgatgatg

SEQ ID NO: 107749 - DNA, 87 bp, Heterodera glycines
  Promoter: Source sequence=SeqID_19873; Location=1..87; Strand=+; Gene= SeqID_84632
tcatagaccaaggcgagaaagaggtgattattcctcgccaatttcaccgaaattactacaatacgggccaaattgcgtgccatgatg

SEQ ID NO: 107750 - DNA, 688 bp, Heterodera glycines
  misc_feature (26)..(26): n is a, c, g, or t
  Promoter: Source sequence=SeqID_10619; Location=1..688; Strand=+; Gene=SeqID_73850
acactaatttgaaatgattttatttnttgaaaaattattttaaatatcacttttttgggttcttctaaaattaatttattccttgtttttatccgctattttgaattatttttccattatgaacaccattttttacattttttctcaaattaatttgctattcgatttttagccattttgaataattattttaatttgaaattattttaaatttcatttttggattaatttgttttttttcgatttttagcaattttgaaccaacgaacatctgccgagaagggcagatggcagttgaatgtgtgcagcatcgaatttgtcaacaaaaaactacaagattaaagcaaccgacagaaatttgtgcagcgaatcgtacaaacaaaaaaaatgctagcacaaaattatggtaaaaataattaaatataattaaaatatttgaaatttaatacaaaaaccaatgctttagggtcaccttttttgtaacgacaattttatttctcattggagttaccattgttgatacggtattgggaaatattttaattttaaaatatttaataagtgaatataattaaatattctattgttacggtattggaaaatatttaattttgaaaatattaattcgaatttaaaataaaatattgcattttttttattttacagcaaactccatgcagcccttatg

SEQ ID NO: 107751 - DNA, 94 bp, Heterodera glycines; identical to SEQ ID NO: 97954
  Promoter: Source sequence=SeqID_25802; Location=562..655; Strand=-; Gene=SeqID_56564

SEQ ID NO: 107752 - DNA, 101 bp, Heterodera glycines
  Promoter: Source sequence=SeqID_38463; Location=1..101; Strand=+; Gene=SeqID_67266
tcctaaaaaagtatcaatgataatgaataattaaatttaataattgttaataaaaatattttgaaatatagatatcatttttcttttcattagtccgaatg

SEQ ID NO: 107753 - DNA, 995 bp, Heterodera glycines
  Promoter: Source sequence=SeqID_10996; Location=1102..2096; Strand=+; Gene=SeqID_74305
gtattgccgactggggccttattcccggttaagttaaccgcggttaacgccttaaccgtggtttatttaaccgcggtttatttttaaccaaaatatgtattctcgtctttaaccgtagttaagctaaccacggttaaataaaccacggttaagcacttaatttattaaataaataaatacaaaaaataaatttttattctaaaattcgtgagaattaattttcattgattaaaattaaaaaaatatatatctaggctaattactcagcaaataataggtataaaaatcgtaaataattttttttatttactattggtgaaaatcatataacaagttacagaataatttttaaaaaatttcacgagggcgactgcctgcatcgccggcctcctctccttgttctaaaaagtttttgaaaaaagggccgcataaaaagttgttgaaatcgataatgggaggtgtaaaatatttgatcgcataaatcagagtcccaaatttttttaaaataagacaaaatggctgaaaaactaagattcggaccccaaaaataagattttttataaaattaatagtagcgcgaaggaaacgcaataatattatattagcgtaaaacccaaggtttgccaactggaaattttctaaatcagcgtttagcagacaaaaaatcatcatttggggtcaaaaatcattagaaaatcttattcaaaatgaaaaaaaaatcaataaaaatgttttttccggcgcgctttttccaaaaaaaattttgggaacagtttccccgtcgggaacattttttgaaaatttggatgcaatttgttaacagattttcaccaaaaaagactagtttttgagcctaggtacactgccggaggaaaatagaaatgttaacatattggctaataacagttaaaatgtttaattaattttgaatatcaaataattttacaattaatcatttttaattgctataccaatgaccccccaaattaaaaatg

SEQ ID NO: 107754 - DNA, 804 bp, Heterodera glycines
  Promoter: Source sequence=SeqID_1655; Location=1..804; Strand=+; Gene= SeqID_75108
ttttcaaaattgggcttgtcaaacccccactagagctctaaagttgatagtcagtctaccaactactgtagagatctgagatttcctaataatgttctccatccctttgggatttgtttcgctgatattgttttccttctcttcattgcttccagttgggtgggggttaggaaatttttttctagaagacttgaatcggcttattagaaagagcattaaattcgattaaatgggatggaaaataattttctgaggtttttattttattggagtcgaaaaattgagccgcaaatatcatttttggctgtggccgcaaatgtcctaggcgcaaatgtccgaccgcatttgtcgggccgcaaatgtccgattttcagcaggccgcaaatgtccggaccgcaaatgtcctacaaccccccccccccccctagatacgggcctggtgccaaaataatattttgaacggagaagcaattttataaaaaaaattttgggaaagcgaaaaagaatgattgggaggggattttcaaggaaaaatgaagcttttaacaactattaattttatccccataattcaaagaaatatgaattgcaactccataacaatgcgtttttttccaaacataaatttttcatcatgtgataccgttttttcatttcgtattttcagcgatttttgaaaatctttgtaatacaccataaatttttcgaaaaatttttcttgtaattttctgtaaaaattctaagatttttttcttgcataattttttttggtaattttttttttttgaattttcgtgggaaatg

SEQ ID NO: 107755 - DNA, 133 bp, Heterodera glycines
  Promoter: Source sequence=SeqID_4373; Location=319..451; Strand=+; Gene=SeqID_45791
agtgaggaccagcggaactgggatgggatgggtatacgttaaattataatcgacaatcagaaagtgccatctctgactttcttgccctaatcacaatcattgccagattacccgccccaagtcaggtactatg

SEQ ID NO: 107756 - DNA, 371 bp, Heterodera glycines
  Promoter: Source sequence=SeqID_24920; Location=193..563; Strand=+; Gene=SeqID_55666
tcttcaacatcattcagaattttggtaataaaaagcaattatatcagcggcataaaacacccataacagtttaaacgtcctgtgatggatcatcataatcctattctgttattcaagcataattcagatctctttgataacattttaattccaatcgcggcttatatgcctcctaaataatcgttgcgtgccaaaactggcgctttttgctctctttttaaaaatttgggggggggggtgggttggcggcttcataggggtggtgtatttttcgttttattgcatttttattaaggatttctttgaaaaccctgaaaataaacgtaattaatagggatggtaaaaatatggatataaaatcgcgaaatatg

SEQ ID NO: 107757 - DNA, 451 bp, Heterodera glycines
  Promoter: Source sequence=SeqID_9505; Location=1382..1832; Strand=+; Gene=SeqID_71663
agtttgttgcggcgcctaatagaggggggaggtgtccttgactcttgtaaaaactggaatatcatgggataaggaccgaaatcctggaaaatccactagggtcaataatgtcttatccggattaacttatcaaattccaatttaaatttgtctttcattcataaatccgatccggggatttaaattttcaggctcgcttaaatgctatggatgtccccgggggcatatttttttaaattaacaaaacatgattaagctcttaaatgtttggccccatgcatgtttttcccatatgtggaaaaattttattcgaatattaaaataaaacaatttaggcctgcctataattccattaagtttttcattgccaaaatttggaatttgcgtcggctagaggagcctggattttgaaaaaatcctgactaattgtaaggcccggatttaggagatg

SEQ ID NO: 107758 - DNA, 520 bp, Heterodera glycines
  Promoter: Source sequence=SeqID_5262; Location=2842..3361; Strand=-; Gene=SeqID_57504
tcggagtatgtttaaaaattgatttattcataaattaagaaaatatttttaactgattattttgtctttccaatatttgatttgtatcaccttatatttccccacttttcgggccaatttttatgtgaatttgacctaaaatcgctttttagaaaatccaactgattgatcccttttccgacgttttgtcggaaaccctttccccttgttaaccctttggccctttactaatgaaacctaaaattgtccgcaaacttccggcagaattgaacaacgaattgcttcaatttgcccccgagcttttgtgtcgaagcgttttggctaactctaattttttgttttatgatttgattcggaggagtgaaagaggcaaaaaatggaaaaccaaagtatggaaaactgaaacaccatcacgttttttgcgtctttttatttagcaaatttaagcacatcaaattttaaaaatgggggttttttaagagctctaataattgtccccttcctatgacttagtgcaatg

SEQ ID NO: 107759 - DNA, 303 bp, Heterodera glycines
  Promoter: Source sequence=SeqID_6413; Location=7750..8052; Strand=-; Gene=SeqID_61467
tgtccaaagcctgtagcggaggtggtgcgtgccggctccccctggcctgttggccaccccccggtgtcccgtaccatcctctgacccccaatttatgatggggtgcaaaagcgtgcagagagaaattgcaacacgccgccctattttcgtttttgtatgttttctctgcattctctctacttgctttttccctcttttgctgctttttgcttctccccgtcccccccccctttcctcgtatatcaaggcctggctataaaattgcctcctcatgcgcttctaaatcattcactttcgcaaatg

SEQ ID NO: 107760 - DNA, 259 bp, Heterodera glycines
  Promoter: Source sequence=SeqID_24076; Location=1..259; Strand=+; Gene=SeqID_54771
ggaaaaacccatttatcacgtctaaaaagacacctccttaaagcgtgaaaacataggcttttactttgcgagaatagatattataagtttttccttctttataattgacaaaaaaaacatttgtaacagttatggacaaaaacagcttgccgtactaaaccgaccctcgtactaaaccggccgtactaaaccgaccctcgtactaaaacggccgtactaaaccggccgtactaaaccgaccccgaccgtcagaaacatg

SEQ ID NO: 107761 - DNA, 538 bp, Heterodera glycines
  Promoter: Source sequence=SeqID_7597; Location=887..1424; Strand=-; Gene=SeqID_65345
ttaaaaattaatctcgtcttaaaataaaagcaattgaaacaaattagtgagaaaaatatgaaggttttcagagtcgcggaacacgaattttcttcaaatgacgccgcaataaaaaaaaaaatcaaatttttgaaatttattgcaatttttgaatgaaaatccatcaaatcaaaagaaaaaaaaccgccaagaaaaaataagcacattcaaagagaaaatagcatcaaatcaagtccagttaggctacatgacatttcgcctactcgacatttcgcctactaagccaaaaacattcatttcgcctactaacccaaaaccggacatttcgcctactattcatttcgcctactattcatttcgcctactaagccagaaacattcatttcgcctattggaaatacataatgccaaagagaaaataaaaagagagaatatacaatatataatgtttttgcatcaaataaatcattcatttcatttttatgtcatttcaaattttcttcaaaaacaaagaaatttcagattctaataagaaatg

SEQ ID NO: 107762 - DNA, 87 bp, Heterodera glycines
  Promoter: Source sequence=SeqID_8447; Location=1..87; Strand=+; Gene =SeqID_68101
aatcgcatcattcgtcatgtcgaaatccaggaggaacaagaacgttcccgtttcggacaaaaggcactgacattggaggaagagatg

SEQ ID NO: 107763 - DNA, 958 bp, Heterodera glycines
  Promoter: Source sequence=SeqID_18975; Location=917..1874; Strand=+; Gene=SeqID_83708
ggtgtgaccaaacaatttttaaaataaagaacatcaatgacaaaataaggtttagggtcaaaaaagacaatcttgcaaaattggttcgaatcagttaatatataattttttcgataaaaaatgtattaaaatgttatgtttttcacatcctattatggattttaacaatttttggggaagaaattagcaactgctgaaaaaaaagattttcaaacgttttttttgcagtgtatttttttttacaagttgatgaatgggaagtgggtccggcggcgccgataggcgacgccgggaaaattttttgaaaatttgagtgctattttatagcagattttcaattaaaatcggtaaaaacatgattaaaaaatcggtaaaataaagtgcggtcatgcgggatcgaacattaatgcacagcacaaagcaaacctgctgttttcaccactaaactaaaatacttaaataataaaacttattatttctttccaaaaaagtcattcttaagggtgtaaatattttcgtctttttcgtaaaatattgctctgacgaaaacgaaaacgaaacgaaaatcctaaattttaaaaaccgaaaacgaaacacgaaacgaaaaataaaattttgaaaaccaaaaccgaaaacgaaacgaaaaaactttagcggacgaaaacgaaacacgaaaacgaaactcaaaaagtgccgaaaatgtaggacgaaacgaaaacgacacgaaatttcgtccagccctggggggggttccggcggtgccgataggcgccgccggaaaattttttgtaaatttcgttgatttattaacagattttcaccaaaaaaggtcaatttttgcaattaaaagccaagcgacgacttttttttttttacttttaaaaaggctgtatgacatttcgcggtcagggtcgttttcgcgtggccgtttcgcgtggtttaatttgctaaaggaatg

SEQ ID NO: 107764 - DNA, 522 bp, Heterodera glycines
  misc_feature (37)..(37): n is a, c, g, or t
  misc_feature (84)..(85): n is a, c, g, or t
  misc_feature (112)..(112): n is a, c, g, or t
  misc_feature (217)..(217): n is a, c, g, or t
  Promoter: Source sequence=SeqID_20710; Location=542..1063; Strand=-; Gene=SeqID_51269
accagcaaaatcaaggttctaggcagatttaaaattnaatgtaaaaactataaagaaaatagatgaagaaaccttaattacatnntagttccaaaaaatcacaaaaaattgnaattagcagattttacacctcacataaatggcggattttgatcatttttagcaaatttcaaaataattttgagttcgcttgtaccgacaagctccaatttttatntaaaacaaaaattctggcccgtttgtaatagaaattaaaaatgcattaattgtcaaatgtgtcaaaaagggagcaaaaggcaattagacttggatattggattttaaatttttaaacgaattttaagtgttattttttactttttttttattttgaattaattttattgtaacatttcttctttaaaaataaattttgagtggacattcgtgaagaaatatgtgaagaagactgcgtagaaaacataattgcaaaacttccaaaaatcaaaatcaaagaagtgactagaaagaacatacaaaatg

SEQ ID NO: 107765 - DNA, 258 bp, Heterodera glycines
  Promoter: Source sequence=SeqID_22614; Location=342..599; Strand=+; Gene=SeqID_53285
atgactcggcagagtgtgaattaattcctatcttttatacactagtagtttcttttatttttatatacacgctttaatagcaattttactttttaatttactataacatgcttgtgaataaaggacttaaactttgacgagggctacgatttatttaaatctcacgaagtgtgaaaaagcatttattttctttttcagtgtttgagcttggcactctgtttcgttcgtataactaaaaacttttcttgagaaggaatg

SEQ ID NO: 107766 - DNA, 890 bp, Heterodera glycines
  Promoter: Source sequence=SeqID_4093; Location=1031..1920; Strand=-; Gene=SeqID_53161
ttcttttaaattttgcgtcgaatttccgttttgtccaatgtccatttgcgcgttttgaagtgtttgtcaacgaaatagtcaaatttttgactgatcacgcaaggctaaggccaagatgagagcgtggaagcaaatcgaaaacattgagccaacagttgacagagatattttatgaaaaatgggtttttttcacatttgcggtccagtctgtcctaattaatacataggtgtcatgtcccctctcaattgtctatcgggccataaaacacacacagcgacaatattacttgctgcttatttattttattgttattttaatataagcctaaattttgtcaaaatataaaaggattactaataatcgtgctgacgcgtttcttaaattccgtcatgggggtaagaaaacaaaaatgaaatattgcatggtatccatccaatagctttaagtgttgcctatcagaatattaatttagattttttttacaaaattataaaaaagttatggtcacaaaatttcaaaagtcttgagtcagaatttgttggccataacttttttgaaactcaatgaaattttaaaaataaatagagaattctcagagctgtcgcggccgtaaaaaaacgaacccctacgaaaaattttctcaatgaaaaatagttttatgacgtgtcgttgattgatttgcaataaaacacattgtaacgtataatttggccggaaataaaaatggcaatttttataataataaagaaaatataaaacaaaatttttaatgataattttttatgttttataatattaaaaatttataataaattttctaaagaatatattttcaaaataattatttttaattataaaaaaataaaaatttatttttttaagaacaatg

SEQ ID NO: 107767 - DNA, 569 bp, Heterodera glycines
  Promoter: Source sequence=SeqID_15842; Location=2821..3389; Strand=-; Gene=SeqID_80173
ctagggctgccaaaaatatgcaaatgcatgtttttttcctggcttctccgtgctttaaatagtaggaaaaacactttttttgtgtttgcgtataaaaatcgggacttttatttgcatatttcgggtttttatgcatattttggatttttctgcatattttgccattttttgtgcatattctcagatttttatgcatattttgccatttttaactaaatatttttcgatttgaataaatcttagaaaaaaatttgattatgcttaaaattaaatcaaattttgaatggatgcgcgagtgggtcaacagtgaattccatgcgaaaaattgaaaaattttgatttgaaattgcaaaaacaaccgataaaatttatgaggaataaaaaatttttttttattaatttgcacgcctaatttttaagtttttttatgcatatttggtgcatattttgcgatttttgtgcatatttcacgactttatttgcatatttatgcgcatattttggccacttttcatgcatatttttggcagccctagttatagcatttcaaaatttgcggcgccgaaatg

SEQ ID NO: 107768 - DNA, 173 bp, Heterodera glycines
  Promoter: Source sequence=SeqID_24256; Location=1..173; Strand=+; Gene=SeqID_54973
aataaacgcgaaagtgaaccaaaaagtcgcgaagccttctaaaataaacttgcgtataattatgtccttgaataaatcaaccaaatatattttttaaacctctattttgctacaattttcaaatattagggtaaaaaataaattttcatagatcattgtagacttagtgcatg

SEQ ID NO: 107769 - DNA, 540 bp, Heterodera glycines
  Promoter: Source sequence=SeqID_45062; Location=1041..1580; Strand=-; Gene=SeqID_72454
ttttcatttgataatttcaaataaaatttaagatcagagcgtacttttttttattggcgggatcgaaattaattgcagtttcacccaatcatgcgggcaaattagtagcgctattcgagaccgaaaatttcgaggagctcgaaaagcaatgttaattagacaataatgaccacccacccaccacctgccccgccccatccatgtgtttgcatttttataacagcacaaaactttttaaaaataaacacgcgattgacaaaaaaaaaaaaaaatttttaatttatcagtcccctccgccggctttcgtgaagcgttccaaatttttttttttagattattgttctgaggcacatggctgctcaatgcagaagcgcccactattagcaacaattttgttcattccaaatggacatatactaaaattggaacaatacagagaagattagcatggcccctgcgcaaggatgacatgcaaattcgtgaagcgttccaaattttttttttcggtttaattacccaagtttgagattttcaaatatg

SEQ ID NO: 107770 - DNA, 562 bp, Heterodera glycines
  misc_feature (300)..(300): n is a, c, g, or t
  Promoter: Source sequence=SeqID_35634; Location=1..562; Strand=+; Gene=SeqID_65154
ttaacaaaaaacggaatttaatttttggaaaaataaacaaaagtattttaaagaaaccaagccatatacataggttaaacgcttttgtgcggcatgctttttccaaaaaacttttcgagtacagggggcagaacaggggtggcgctaatgcgatttgttagcagattttttcctaaaaatgacaaaatttacgtttttgagccaattttgcgggggaatgagtcgcgggggcgggggcggggctgaggccaaaaaacccgtcctgccccgggaacgcaggcgggggcggggccaaaaccnctaataaaaattttcagaaaattttcattaatttaaaaatattaccaggaaaaaaatttaaaaaattacccatgactttaatgaaacttatttgttagtgaattttttaaaatttatttatagagaacactttgagttattgaatgatagataattgggtttcttccttggcacttttacaaaacgatcagcactatttaacgaattttgttaaaataaaactttattaagtttatttgccgacagaacagaaatagaaatg

SEQ ID NO: 107771 - DNA, 75 bp, Heterodera glycines
  Promoter: Source sequence=SeqID_16811; Location=2364..2438; Strand=-; Gene=SeqID_47395
ttgatttcacaggccaaacaaaaaacggaaatccttgcatttccgcgagctttttacccgtggatcaaaggaatg

SEQ ID NO: 107772 - DNA, 286 bp, Heterodera glycines
  Promoter: Source sequence=SeqID_39602; Location=654..939; Strand=-; Gene=SeqID_68131
ttccgtgttctggtgaaatttcgcataatgaacccgttttcttgtcgttggacgaatttgaaattgccgtgtggtatataggcaaaaaacacgccgtttgggtgaaaggaacggacactgtgtcagttttgaagaagaaggtccaaggtgtgatgaacattgaccccgcacgtcaaaacttgtacaaattcgatcttgctgatttggaaagtgccattggagagaaaattaatgaacgagtactgcttgatgcgacgcacgagcaacaagaattgaagaaacaatg

SEQ ID NO: 107773 - DNA, 234 bp, Heterodera glycines
  misc_feature (28)..(28): n is a, c, g, or t
  misc_feature (76)..(76): n is a, c, g, or t
  misc_feature (103)..(103): n is a, c, g, or t
  Promoter: Source sequence=SeqID_10580; Location=1..234; Strand=+; Gene=SeqID_73815
taatttcaactattaaaaaaaaattacntatacataaattaccaccttttcttaaatatttataaaaatcttttantccacattaaactttctcctcattacnaaaattttttacctttttattttctcaataattccgaagaattgtatacaaaataaaaaatccgggcatatgtaaatataggtaagtccagggctcgcagatctgaggctttagcctttgcttgccgaatg

SEQ ID NO: 107774 - DNA, 573 bp, Heterodera glycines
  Promoter: Source sequence=SeqID_2342; Location=1..573; Strand=+; Gene= SeqID_47264
ctctaattacgccaaagaatctgattgtcgttgccttccacaattcgttttattagcactttattgctttatttttattccaccattccttcattaacaccaagcattttgtttatggattgaaaaacgaattatgtgaaccaaaatttattagtgaacataaaattaagtttcgaaacggattagtatttcatttctcatttgtttactccttttaaaaattatttgctgaattgaccttaacgttcttgggtattatttggtagccccaagaatcctctaaatagtctcaaaggctgaaaaatgcacccaatattatggcaaagattcagaaaatcaattttttgaagttttctggtcaaaactttttgaaacataacgaaatggtcatgtctctctcttttttatggtcgtgtaaactggaatagaacacaaacatttgcattgttattaaaaatccataaaaagaagatataaacagatagtaccacacaaaatttattaccttttatcactttataaaacggcagtctttttaatttgtcaatggtttaccgcttattttgacaaatg

SEQ ID NO: 107775 - DNA, 971 bp, Heterodera glycines
  Promoter: Source sequence=SeqID_10961; Location=2062..3032; Strand=-; Gene=SeqID_74270
tttttatatttgaatgttgcaagagcgtaataagtagggctgggaattttaggttttaactattttttttgctcttttcactatttcgacattttttgggaaattccttaacaaaaatgcaataaaaccaaaaaatacacccataagaatcgacctaaaaattttttcaaaaaatacactcctaagaatcgacaaaaaaatttcaaaaagcactcctaagaaatgaaaaaaattttctcaaaaaggtattttcgtggcaagaattttaattttaaaaattatttttttatgtacctattttgtttttttgcccttaaaaatcccagccctactcatttgcaatgcaatcagtgaataaaaattatttttgcttaatttttggctgaaaattatgtcactattctcactattttggactttttgccactattttgtcactattttggcatttttactcactattttagttaattatttcgagatttttcgtcactaaaagtcccagccctagtaataagaaaatgcaaattgttagaaaaattacagtaaccccaaccccgcgggatcccgctggattaccgaaatagtcggcgggagagagctcttttgcaggctaacagaacatattaagcaagcgtttttaaaaggagcaaactttacctaatttaattgtcaatgaggaaaaaagttatagtgcggcaaaaagcattctttaaatttcttaattatttttcaaattttcaaagaatttttgaaagaaatggttaattaataaatgctttttgaaaagaagttctctgaaaatatcatcttttaaggaatttttgatcggtacccaaaataaggataaatcttgaaaacgaggacattttaaattggtaagttttctattcttctcatcagaaacatcatttataaataaggacaaatcgaagccctgctgcttctttagtttgagaacttttacgatg

SEQ ID NO: 107776 - DNA, 397 bp, Heterodera glycines
  Promoter: Source sequence=SeqID_13700; Location=605..1001; Strand=+; Gene=SeqID_77617
ttgattcacattgttttaaataaatatattggttctaagcataaagacataaattctctattactcattatgctcgttattcattatgcgtccatccacttaaaaattttttggggtttgaactagagtgccacgggaccaggacctggaagcggacaactgagtaccaaggtcccggttttgactgggaccagtcccgggtttttcccagccaaaaattcccgggttttcaaaccgaaaaggtcccgggtttgcccaaaattcccggtcccgtggcactttagtttgaaccatagtaagggatgaaagtaaattaaaaatttgaaattttccatttctaattactaagacacctttttcaccatattttgcaccgttttggtccgaatttttaatg

SEQ ID NO: 107777 - DNA, 891 bp, Heterodera glycines
  Promoter: Source sequence=SeqID_18007; Location=1..891; Strand=+; Gene=SeqID_82575
aaatgggtcaaataaaaaattgaatatgcctatcccctccattaaagtcttggctttctagtgatgtataaattgtcagggtccgggtccgggaagtgccctaaaaagggagttcaagcacttttgatcaggattttttcaaaaaaagaaagaaagggaaaaggttattaaaagggatgtgagcaagtaacttggtggtcaagtggttagtgtgcctgcctttggtcatggggtgttgtgggttcgagtcccattaatttattggattttcccgtcaaatattatatttaaattatttggttttaaatttgtttttaatatttttcctataaaaaattttatgggtttataaaagagaaagacataataacaaaaatttggagcaaagtacttttggataaaaattgattactttcctttctttcctttttttatatgtaatgcacgctcgccagtggtctttgacctcgccttttcaataagcaaaaaatgtctcctccttttctttccccagttcattatcaattgtttccatttacatcatcggttttttactgctcctacttttattcaataaatatttccaactaaattattgctgttttaatagcataaatttttagtttttcctttggtggtggtgggcgacggctcgggtcccacctattctgggtgttttcatccattattttattacattttttgaatgattttatttttttaaaattaattaagtttattaaaataatttattttaaatattaaaaataataattctttcttcctaatttagcccaaaaatctattgtttgaccttttttgtgcaaaatcatttaaaaaatggagacaaattaataagttacctaaacataaaattataaatattttatg

SEQ ID NO: 107778 - DNA, 259 bp, Heterodera glycines
  Promoter: Source sequence=SeqID_10194; Location=1858..2116; Strand=-; Gene=SeqID_73305
ttttatttataataaaaaaatctccaaaaaatagataatttcctgcaagtttaatattgaaaaaattagattttttctcatttacaataggcccaattagattttttattttaaatatttatctaattctcatttactaattaaaccttcctaattccaacaatttactaaataagcagcagcttcaaagaactaaaaaagaaacaatttcctttttacagagtgaaacgaaaacagagcgaaacagcgacaacaaatg

SEQ ID NO: 107779 - DNA, 831 bp, Heterodera glycines
  Promoter: Source sequence=SeqID_4517; Location=1..831; Strand=+; Gene= SeqID_54742
ttgattataaattttgtacatgcaaattatatattaatatattaattcatgtgtgcaataattacgtaaaaaattaatttaaagtactgtcgaaatcaatcactgtcgaaaacacctggtacgatccatgttgtgtgtgtgtgcaggttgaactcagcccaataattagtgataccaccacaacaaaaggtcatctgctcaatccgctaaaaaataacgaattttgctcctatttctggactggaatgaaatcccggggatcccctccccattccggacccgagaaaaaaaacatgaattttttgttttctgcgtttttattgataaataatggtaccggaagaactaaaattaaaataaaaaaacaaaaatttgctaagaaaaactcaaaaaagttaaaacaatttttaagcgaataaaaaaattttttgaaaaaagttttgggtctcgggggttttttttgtgttttttgcttcctctatacatacaaagcaaaaattctcgaaaccttcgtttttcttcatattttttgatgggttttccctatcactttttccaaatttttttatcaattttctcgatttatcgtccttttcccaatgttttgccccatctaaaagacagaatttgttggtgctgctctttctttcctcctcttatcattatcagcaattcagctgctaaacccccctgcccattttatagacattttggccctcttccgttgctggaccctccccctccccgctctccaatttattgcaaaaatttggtaaaatttcggaaagcccaaaaactggtcgaaagcgaccaaatttcccagccaaaatg

SEQ ID NO: 107780 - DNA, 252 bp, Heterodera glycines
  Promoter: Source sequence=SeqID_22076; Location=793..1044; Strand=-; Gene=SeqID_52721
tggcaaagaaaatgtgagcacattttcgaccaatgatcccattgataagatgccaatgcctgtgggattagccaaagcaagggagggaaaagtgggccaagcccgagattagtaaattttggcaaaaaagtgtgtttatacgggaaattattcccttcaatccccaaaaaagattaactattaattctacaataaacccaaaacaaaattgtcgcagacacctcaatttattttaagattcaaaataaaatg

SEQ ID NO: 107781 - DNA, 101 bp, Heterodera glycines
  Promoter: Source sequence=SeqID_31523; Location=1..101; Strand=+; Gene=SeqID_61848
cgcaaacttggtaccaacattttccttctctagtctccgctctaccaaacactcacacgatatttgaaatgctaacgaaaaaaattcttgcccaaaaaatg

SEQ ID NO: 107782 - DNA, 244 bp, Heterodera glycines
  misc_feature (26)..(26): n is a, c, g, or t
  Promoter: Source sequence=SeqID_3588; Location=1900..2143; Strand=-; Gene=SeqID_45581
gggagctctaattcatggcggggttngtattatagggaatacggtattttttggatttcaaaatcgttcataaaattagtgatcacgaatgcctaaatgccttaacaataaatttttgttacgtttttccaagacttccaaaatttgaaatttttacattgggaaaataattgaaaaaatttaatttttaaatatatgaatttttgcatattttcatttttgtgttttaatgcttttggctatg

SEQ ID NO: 107783 - DNA, 543 bp, Heterodera glycines
  Promoter: Source sequence=SeqID_38882; Location=1..543; Strand=+; Gene=SeqID_67582
tgcaggtcaaatggcctggcccaaaaatcgcaattttacattcattttttgtaatgtatcctctaaaaatcactttaaaaaaaggaatattgaaaattacttttaaaatagctaaaaaagttatacagaatagttaggtcatttttcggcatttgtgccctatttcacgctttctaagaattttttgtcaaaaaaatcataataattttttttattttggtacatatttgagagtttttgtacatatttcttaaatttttcgtgccttttttcatattttatgtatatattttgcgattttgttaagaaattttgcgtcaaaaaaaatttttttatgaaatatttcgtatttttcccaaaagtgtccgctaatttccgtccgcatctgtccgtaaggcaccaatgatgacaatatttactgtgagctatatgacacggaaaattgaaagataaaaataaacaaaaaactaggcttcttacagattgaatgtgctacttcttaacaaaaaaattttacttaatgataagtattttaaaaatatg

SEQ ID NO: 107784 - DNA, 182 bp, Heterodera glycines
  Promoter: Source sequence=SeqID_17546; Location=1..182; Strand=+; Gene=SeqID_82052
ggcccttttattttcaaaataaattttatttttaaaagatatttccaaaaaaatgggctatctctttttttgagaaattttctatgcaacaaacgctctcgaacatgaaacgaagtgcggtgcgccatggccattttatttttcaaataatttttatatttaatagatattccagaaaaatg

SEQ ID NO: 107785 - DNA, 459 bp, Heterodera glycines
  Promoter: Source sequence=SeqID_7202; Location=2509..2967; Strand=-; Gene=SeqID_64125
ggataaatcggtggaatttttaaatttcatcgaaaacattttgaaaattattgtgcacatttgttcttgttttttagtataaaaagtgactcaaaacaaaacacctaattaatctttcgtttaaagaaaacattttttaatttttcaattttttaaatttatttcatagtgtcgcctttttgaataaattaaaaataatttatgaatatttttgcagatttatgcaaagggccaaaaaaccatgacatatttcacaaaatgcaaattgtattctctctcagcaaagcttcaaaaaccatacattttttacaattggtttcattccatcgatacttttcatgcaatatttacatttttattataatattattatcattaagtattaaacaaggtttatattcataggtaatattaataataaaaaaatatatttttaaatgtttaggaaactcaattatg

SEQ ID NO: 107786 - DNA, 163 bp, Heterodera glycines
  Promoter: Source sequence=SeqID_30212; Location=415..577; Strand=-; Gene=SeqID_60645
aacgctttttcttcgaatttaacttcttttcgttatttatgtttttattttatttttattgcttttatctttcactcgtattgaacgaaaagcggtttaatgctgctttatttttgattttaatttccatttacatttattttagctttctcttttcataatg

SEQ ID NO: 107787 - DNA, 1003 bp, Heterodera glycines
  Promoter: Source sequence=SeqID_9591; Location=2833..3835; Strand=+; Gene=SeqID_71990
gatagaatttatgaatttttcgtttccttacaaaaattttaaaacaccgaaatttggaattgctaaaaaaataaaaatcactaaaatattttaatatttttatggtttggctgtatttaaattagtaaaaatgactctctctctctgttttttttttcaccaccgactaatgagcctttttggtcagcaaaagcagcagtattccttttttttgccaaaataatgtccagcagcccatcagcagacggacactttcgtcgccgtcctcctcatatttataataaaaagggtcgaatgcttagggagggggtatattttgccaaaaataaatgtgtacaaatgggccaagtggggaacggctggcaaaatagtggccagcagacgatggccggccggcgccacccgttttagtgccaaaaacaacaaatggtggccggccattagtccggcttggtgcctcgttttacaatacgacattataaaaattgtcaattaattaatattttttaataaacagggtccatgtttttatgcacaaaaaatctttgaaaatacattttaaacccataaattggcaaaaacccacaacagaggcagtgcatgtgcctcatgacgccggcaaaaatatttgtgtgcaaatccgagttttttcgtggccatttttggccctaattgagatattttttacagaattaaataattctgaattcatatttatactaaggtaaaaatgtgtaaaaaataaataatgataataataatagaactataatttgtgaaaatgttcaaatgaaaaaattaacagacggacgacacctttccgtgccagccgcaaaatttaaacgtacaaattgggtgggaatgtttttttgtttgtgccagaaagcccacaaattaatattgtcaaaatgggcgagtgaatgaatggtcattagccattagccagggcaaacaaacggacacttttcggagtcaaccgaaaagtgaagtgtttgtggccatg

SEQ ID NO: 107788 - DNA, 136 bp, Heterodera glycines
  Promoter: Source sequence=SeqID_36954; Location=836..971; Strand=+; Gene=SeqID_66149
tgtgcgcggtggcctcgtcgatgagaataattcgcgggttggacaaagccaaccgaagcagcgaaatcagttgcctctccccaaaggacaaattccgtcccccttcggtgagttcggcgctcagaccaccaaaatg

SEQ ID NO: 107789 - DNA, 405 bp, Heterodera glycines
  Promoter: Source sequence=SeqID_5408; Location=3078..3482; Strand=-; Gene=SeqID_57923
acagccgacgaccgatgagccaccgccgaaggatgaagcggatggacggatcaatttttttaagggggaaggtgttaggccggtacccaaatgtccgcctcactttatttattttgtatgtttccctcgtcccccttatctctgtctctccctccgtccataaatagcccgctttttgaccttccctcgtcatttgtctcattcgcatcattttccccaattttgttatttctttttatttgctccataaatattgatttatttgtttgccactcaacggcataacagatagtaagtacccaaattaaaggaagaaacataccaataagttttcaaaaaattaccccccccccccttacggttttcattaaaaaacaccatccatttcacagaggaagtgcaatg

SEQ ID NO: 107790 - DNA, 93 bp, Heterodera glycines
  Promoter: Source sequence=SeqID_8879; Location=748..840; Strand=+; Gene=SeqID_69507
agtaacatcgcaagaaatgtttgttccccgctaataaaaatgcatttctatcagataaaattggtcgaatgaacgcgactttatgtgcgaatg

SEQ ID NO: 107791 - DNA, 929 bp, Heterodera glycines
  Promoter: Source sequence=SeqID_3365; Location=2248..3176; Strand=-; Gene=SeqID_47596
ggtaggggaagaaacgggaaccgcccacttcggcgccggccttttcggcgccgttgctaacaacttgatagctcttcagattctctattagcctgtaaaatttcaaaaaatttcgtcagtttacaaaaaagttatggccaaaaaacctcaaaaattgactttttcttggctttttcggcgtcgcgtggcataacttttttatttttgaatcattcatttctatttttacatgtaaatatagagcacacatagagctttcaaatgatgctagattggctaaagctaactgacaaataaaaaagttatagcatttcaaaatttgcggcgccgaaatggtccgcgccgaagtgaccccgacccattaccccggtctctagtcatttctgtctatttaaatggtgtctttcccggttcaagtacagtttatgcgttcaatcgactttatgcgtccaattaatttttacgcgtccattcaatttttatgcgtccaatgaattttttacgtcgacttgtatagcactgacaatatcccgccaagatttgctagtctagcattgggtttacccctccctagccatgtaaattaaatttgttgacagattttataaaaatgtctaacaataagtttgcgttaaataaaaagccgtggatacattttttgcatgacatttaatgcagcaatttgcatccatcggcgatttataactttttcgcgacccgcaaactgatcaatttgaaataaatcatgatgcgcaacttttttgcgctacatttactacccttttcttttagcataaaaaatttgctttttattttcatgaacgcccattttaatggtgccttcggttttaattttgggtttatgcacggggtaagtgctttagatgttaactattgcccccaaattgatttatatgctgtgttaaatg

SEQ ID NO: 107792 - DNA, 781 bp, Heterodera glycines
  Promoter: Source sequence=SeqID_14886; Location=1798..2578; Strand=+; Gene=SeqID_79047
actagaatttctttttaacactggcaaaataatgcaaaattttttactaaatttgaactaaataatttttgaaaattttatttaaaatttttttcattaaattgagattaaatacaaacccatccgtttttctaattataaatattttctttttagtcccctgaccctaattctgtgccggactctactgaaactgtgaaaatgtgcgacttcgccttcgctatttcagccattttcggtacgaataatttataattttaaatatcattaaattactaattgaaatctgatgatgataataattattcatttaagtgattatgactgtgcatttgctcattaatgctgcgtaatgaagtgaaaatgaattcagatgaaaaagaaagaatttttgttttgatcaaccaaaactaatatttatggttataaaaactgattataaaaaatgtaaagcacattttgtaaaatttattctgaatatttgtcaatatgacaaaaatgttgaaaaagttgtaataaatttaaaattccaattaaactgaaaagcagagatttttagacattttttggaaatttagttatcccgtaaaatatacaaaaagagaatgattttgtattaatctcgttgtttctgggcattgaaagaccagttttttgtctcgattggcacggcactttcacggcttttcatcttttgccgaacagactccaaaaactgccggagtctccgccggcaccgcgggcggccgacagccattgcctccgatgtcgcggagcgatg

SEQ ID NO: 107793 - DNA, 1003 bp, Heterodera glycines
  Promoter: Source sequence=SeqID_2849; Location=1585..2587; Strand=+; Gene=SeqID_81927
aaaacgccaaagaatttttttaattgcctaaaaggcgctaaaaaatagagatcggcatttctccattcatttggcagccgcagctgcactagcagtagtaaatatttcggcattggcgacggataaattccggtctctagttgaattgttagaataaaattaggtagttaacacttctaaaaatcatttttataatttgaattttatgcctaatgttctttaaaaaatgttagagcaagcaatggttttatgacgcgcttcctcaacacttaaatttagataaaaatgtctgtttctccttcagctaatcggtcggcctcaattggaatttctgcaacagaaacaacttcaaaccaatcttttttctctgaccaacaatctctttcagtgaatatgtccgctaatcaagtcagtcacataaaaaattgaatttattcattgtctcatcttgttatccgccgaaattagattttttcatagatattaggtaaaatagtatgctgatagatgaacacgaaaacgtgaattctggggtttttggagtcgccgatcacgatatggcattcttttgactaattctggaccactgggctgaattcgaaccaaagtcgaaaacaaatttttattcacattatgttcgaatctgaacagagtaactaagatttaatcgtgttatgttatatgactaatttttgctagtcttattatcaattttaaaaacaaaagtgcgaaattgaaaaaattctcggcgggagcaattcctagggattacctttttaccgacattaagttttaaattgggttttgaatagattaccaactcggaggaaaaaacacaacatttgcgacaaagcgaaggtgaaacaaataaagcaacttacaatgaacagcaaaaaaatggtattcttccaattaaattattattgcaaatcgatgccacttaaataaatatttgttttgaatagcaaactgtgaaatgtccacttttgcagcggcacaaatg

SEQ ID NO: 107794 - DNA, 593 bp, Heterodera glycines
  Promoter: Source sequence=SeqID_22233; Location=996..1588; Strand=-; Gene=SeqID_52904
tttttaaaaattaattcacttttacattttcgaattcaatccgatcccattgattgctctccctttacttcgctttcactctccccccccccccccttcagcccatctgtcctccgccaatccgtcctcctccgtcgtgtccgatgtttccccgtgtccctccccctctaaatcgtcctctctgtacggcatgtcgctgagttccattgtgccgctcacttccgacgcgagtccgttgccgcgtttcgtctacgatattatggaatggctcaagtgccgggcacacacttcggatggcatcttccgcaaaagtggtgcgtccgactcacaacatcgtcaacatttaatcgctctttttcgtgccatcaaatgccaccctccccaatctgtccgtcctcattttgtcaggtgccagcgtgcgcatcaaagagatcagcgaggcgtgctcggctctctcggctgatcagccaatcccggcccatctgttggccgactcgtcgccttacgacgttgcggatgcgctgaagcagtacttcgccagtttgtcaggcagtctgatgaccgaagaaatctcggaaatcgtcgtcaaaatg

SEQ ID NO: 107795 - DNA, 59 bp, Heterodera glycines
  Promoter: Source sequence=SeqID_7014; Location=1..59; Strand=+; Gene =SeqID_63568
ttactttttcttatgacagaaaaagcatcaaattgttaagcaatcgaaattaaaatatg

SEQ ID NO: 107796 - DNA, 129 bp, Heterodera glycines
  Promoter: Source sequence=SeqID_11559; Location=4424..4552; Strand=-; Gene=SeqID_75001
ttttgaatgttgattaaaccgcacccagcggaacttaacaccacccaggtgatcagtttttgtctatgagaaaccgcacccagcggaacttacaccacccaggtgatcagtttttgtcgatgtccgatg

SEQ ID NO: 107797 - DNA, 722 bp, Heterodera glycines
  Promoter: Source sequence=SeqID_2662; Location=3199..3920; Strand=-; Gene=SeqID_80956
tgttcaatgtttggtttttcatcagcttgtacaaaaatgcggcatcaattaccgaaatttgggctcctccgtcaatagcattgctttcgtcttttcgccaaggacgtcaacttggatgaccataacatttcccactgtgttattatttaaattagtgcgtaattgcttgtcgttttgaccatttattgatgtttgttttattcattctcattttcatgcaattatttctcccctcttaaagtttttgtcatgttttgctgttctccgtcattttggatttgattgattgttttgttccccctcgtcttctgaatttgtttgtgtttgattttaataaagtgaaagcttatttggtcattgggttgtgagtgttcttcgagtgcggtggaccaaaataatattacctggcgctcctgacattttgggtaagctcactgcaggttttcttgaattttaaatttggtaggagaccaaatttggcttttgtttttctacttcgactttcatatctgcggcgttgttagagcccgaagactgggaataaacgcagcagacggcattgcaaattgctcaaagattgagaaattgcacaaaatttttgctcaaagactgagaaagtgccgaaatttttaaattgttgaaagttgtcgaaaattgctcagagactgagaagattgtcgaatttgattttggaattgaaccaagacggttaaacgagaatg

SEQ ID NO: 107798 - DNA, 289 bp, Heterodera glycines
  Promoter: Source sequence=SeqID_10580; Location=1929..2217; Strand=-; Gene=SeqID_73816
ttttgaagcaatgattgatcaggaactgatcagttgtttgaattattaatgattggaggaagaaaaaaaaatggtgagactaaagattagcagtcccaacgcgaaattccttctaaaaaatggaatttaaagataagcattttggaaaagtaatgtatgtgctaacaaaaagtgaatttaatttgttataattcccaataaaattatctaaattaggtaactcaattttatttttaaatcatattttttaataaataaatgcgtaattaaaaacggaaattaaaaaatg

SEQ ID NO: 107799 - DNA, 108 bp, Heterodera glycines
  misc_feature (76)..(76): n is a, c, g, or t
  Promoter: Source sequence=SeqID_22938; Location=1..108; Strand=+; Gene=SeqID_53641
aaaaaaagtaaaaatttttaaaataaacaccattttagctactgcaaaaatgatgtcgatattttgatggctggtntaattgctttccgctctgaatttttggagatg

SEQ ID NO: 107800 - DNA, 299 bp, Heterodera glycines
  Promoter: Source sequence=SeqID_16477; Location=2396..2694; Strand=-; Gene=SeqID_80884
tttttcgggactatttctggtcaataccaattatgttctgatcgggttcccaccacacccatttggttaccaaacgtaacagaatgttcagtaccggagtaccaaaaagctgacgagagaaaagttacactttttttacctgttcgaatgccaaagcaattcccagtttataactgctatcagaaaatgatgaaaatttgtacgggaaatttttttttttctggaaagacataaaaagtcaggattcgtacgtgaagggagtaagtcaccgagcttgtcatggatttaaaaataacatg

SEQ ID NO: 107801 - DNA, 367 bp, Heterodera glycines
  Promoter: Source sequence=SeqID_31290; Location=407..773; Strand=-; Gene=SeqID_61656
aacattagcaattattcctgggcttaaaaaatcccaattagagcatgcatcttgaagaaaaattaaatcggaaaaaccgaaaattttaaaaatcccgggtttaaaccgttaaataatgtaataaaaaccaaaaaatctttaaatctataaagagttttacatgtattaatttgcaggccccttcatcattacctatggtgctgctcaaagttcaaaacaaaggcacacaatacgcaataaaattgtcaaattcaaagaaaatgccatttctgtggttttaaaagacacattcacgaatgaggacatcatacatatagctaaacctgatttagctttaattgaggtaataaaataccattaagaaatg

SEQ ID NO: 107802 - DNA, 118 bp, Heterodera glycines
  Promoter: Source sequence=SeqID_8969; Location=1..118; Strand=+; Gene= SeqID_69846
gaataatgattttatgataaagcaaagacaaagtgacatgcccatgatgtcataatgatgagaaccaaagtcgaaaattcactttgatcaacgcaaatcgactgggacaatttcgatg

SEQ ID NO: 107803 - DNA, 166 bp, Heterodera glycines
  Promoter: Source sequence=SeqID_18630; Location=1220..1385; Strand=-; Gene=SeqID_83285
ttttgtctttttttagtccatgcaaatacgagcttaataaaaattcaattctcaaatgtttatttaaacattttttctcacttgaaactttaattactaatttatcaaataaaaatcaattagcatttattttgtgttgtacaatactacagtatgcagaagcatg

SEQ ID NO: 107804 - DNA, 389 bp, Heterodera glycines
  Promoter: Source sequence=SeqID_42000; Location=79..467; Strand=+; Gene=SeqID_70015
tcttagagctgaaacatcgtttaagtcaaagcttaaagtgcaaatgctacaccgtccgagattcataataagaaaattattttagttaatgctgataaatttagttttgtgtttttgtatatgaactaatggaaaagggtaaaagcaaaggaagggaaaacgaattcagctgattaggcacatcataaataggcaattacatatatgcgttaatctaataattaattgttaaaaaaaataaataattttaatgaataaaaaaattaggtaatttaaaaaatttaaataaaaattattcgccaaagatcactttgacaaaagtcattttacaaattttaattaaatttaaaaaagcacttcgcttatttatgtttttacctgtattaatg

SEQ ID NO: 107805 - DNA, 281 bp, Heterodera glycines
  Promoter: Source sequence=SeqID_29531; Location=1..281; Strand=+; Gene=SeqID_60020
aaaaacttagtagttcatcataaaatttcgaaaaaatcgctgaaaatttttcttgaaatttttatactaagaattttcatacgagtttttttatgaaaaatttctaggtttgaaaatttttttaaaaaaattttcggggggaaacgacgtgggggggggaaatgaagtgcacccagggaaacaattggcttaaacgaaggcggggcaaaagcatgtcaatttgaattaaatttgaacttggcattactttagctttgctcctttttagtatcgaaaagatg

SEQ ID NO: 107806 - DNA, 64 bp, Heterodera glycines
  Promoter: Source sequence=SeqID_35806; Location=931..994; Strand=-; Gene=SeqID_65276
ggggactgccccgaaaacaaaaaaatcgatttttcaagtgtcgttggggtactcaacaattatg

SEQ ID NO: 107807 - DNA, 246 bp, Heterodera glycines
  Promoter: Source sequence=SeqID_16371; Location=2293..2538; Strand=+; Gene=SeqID_80761
tttgaccctgaacatcaaatgcaagtttggttttgttttttgacaatcaaaatttagttgttttttttaaattactcacaaaaaaacgaaaaaaacttttttcaaatgcatattttttcacgaaaaaaacaaaaacaaatttaatgtcactgagaagtgacggagcggggggggggggggtgaaaattcgaataatttttgggtctacaccaaaaaaccaggagccaggtcaagcagttggagatg

SEQ ID NO: 107808 - DNA, 372 bp, Heterodera glycines
  Promoter: Source sequence=SeqID_16176; Location=963..1334; Strand=+; Gene=SeqID_80538
tttaccatctggagtgcttccagtgcctggtgtgcaaagtgagttttttttttgaagcgagcgagccatcgggaatcgatctgatcattctggtctgatcaatggtctgatcaataaacgacaaatcagtttgatcaatttggcacctaaacgggcaacgatcactctgatcatttttgatcaatcgggaaacattgattattctgatctgatcgataggcaacaaattattctggtcactttgatcaaatgggtaaccgtcactctgatcaccttgataaatcgggcaatctgatcattcattgcccattgctcactgatcgatcatttgatcactttgactgatgccaactttgacaaatttcaaacatg

SEQ ID NO: 107809 - DNA, 80 bp, Heterodera glycines
  Promoter: Source sequence=SeqID_13311; Location=4353..4432; Strand=-; Gene=SeqID_47122
tcctcgttctgctgagcactcctttcccgtcttgtcttgacctctggctgacctgaccccggctttgtgtgaccacgatg

SEQ ID NO: 107810 - DNA, 77 bp, Heterodera glycines
  Promoter: Source sequence=SeqID_18545; Location=263..339; Strand=+; Gene=SeqID_83173
gaaaatctgtctacaataatgaccgattcccttatgcgagtgatggttacgaatcggcgcagcactagggtgccatg

SEQ ID NO: 107811 - DNA, 78 bp, Heterodera glycines
  Promoter: Source sequence=SeqID_11041; Location=2115..2192; Strand=+; Gene=SeqID_74374
cgtaaatgcacctattctgtcatgaaatttatgaaattttcaattttagcgttcagtatttcccaggcatccataatg

SEQ ID NO: 107812 - DNA, 186 bp, Heterodera glycines
  Promoter: Source sequence=SeqID_3837; Location=2186..2371; Strand=-; Gene=SeqID_52069
agctttgttaataaactaacaatgaccaatttgttgatttctgtaacaaattaaaaaaataaataggcgccgccgggaaaatgttgagaatttttggctaaattggtttaaagattttatcagaaaaaaggacttggatttttagtagatatattttgtaaaaatgaagcagttttcagtaaaatg

SEQ ID NO: 107813 - DNA, 232 bp, Heterodera glycines
  Promoter: Source sequence=SeqID_41099; Location=1..232; Strand=+; Gene=SeqID_69293
atataaaagggaaatttttctcaaattaaaaaatgtaatttgagaaaataataaaaattaagggataattggtttaaaattgtaattaactcatgtaatttcaaattgtaatcatataattaattaaaggaacctgtaattaattaaaggtacattgatttcttatttatgatggttttttaagtatcgcccaaatttcattatgatggttttttaagtatcgcccattatg

SEQ ID NO: 107814 - DNA, 795 bp, Heterodera glycines
  Promoter: Source sequence=SeqID_39; Location=2498..3292; Strand=+; Gene=SeqID_54449
attatgatcagttttggtgttgcattgtatggataaaatttagaaaaaaaatatttaagcctaattaagaacattaatgcctaagccataggatgttatgattatactttgggaattgggttttagtggcgaatttaaaagagcgatttttcgtaataaatttataattttgaccgcttttaaaattttttcgtttttgtcgatattctataagttattttttataaattcgcaacttaccaacataatatagatagaaatctaataattaataaggggtttattttttctacaattaaatttacatattcattcaacaactgtttggcatatgccccacccccgcatatgccaacaattgtttggcgtatgaaaaagcccccgcatatgccaacaattgtttggcatacgtcaaagcccccatttataataaaattatagaaaagatattatgtggtgccaacaaaatgtatgacatttgacacatatcattttcccctttttctctgccatactcttcatttaacatactgtctattctacattgtcttcgtatcttttccgctatcctttatacaaatactattttaatacctaccccatattctcatatgaatttccatattagaacagattgtgaatatgaaaaaattattattatttattgtaggggaatagtgactgagaacccattactaatgaaattttcatttttccattatttatcaaaaagtaggcctcgggttcccagtcaatttttttgtataaagattaaaaaattttttatagaaaatg

SEQ ID NO: 107815 - DNA, 790 bp, Heterodera glycines
  Promoter: Source sequence=SeqID_39340; Location=1..790; Strand=+; Gene=SeqID_67924
ttttatcatttttaaagaaaatccatacaattgagcatagtaatcccaaaaatcagtcatttttgttgaaaatctgttaacaaatcacactcaaattttcaaaattttccccggcggcgcctctcggcaccgccggacccccttcttccccaaaagttttttggaataaacgcgccgcaaaaaattgatgtgaaaagtaaatctgaattcaaataatattcgatcatagtccaaaatgattaattctttgaaataagtgaagaaaatttgtttgaaaattttcattaatttaatttagctttaacttttggatttattaaataaaaaacaaaataaaatttaattttgtgccattttctcttgaaataaattaaaatttgaattttttaaaatttttttgaatttttaaaatttcctggttggtcccggttcccggtcccgaacaaaaatcgaggtcccggtcccggcttctctcaggtcccggcaagtcccggtcccggttgtttcagccgagtttttgatacaaaaaaatggggggggggcggatggaagccgtaaatccgtaaatggaaagccgggagttatggggaagcgcaaatccgaaggctcattaaaaaagggacaaaaagtactagaataaaggggacgacagaatgttaattttaaaattttcatttttttaaaaaaaagcaaaaaaaaaaaaattttttttattgattttcttactgtagcagggagttgacctgtgttcgatttgaatttgtggatgaaatggtagaaggacagaatg

SEQ ID NO: 107816 - DNA, 55 bp, Heterodera glycines
  Promoter: Source sequence=SeqID_12854; Location=1412..1466; Strand=-; Gene=SeqID_76583
tttaattttttttttaatttgaattctcaattttttagccaaaaatgtgctgatg

SEQ ID NO: 107817 - DNA, 402 bp, Heterodera glycines
  Promoter: Source sequence=SeqID_10908; Location=1313..1714; Strand=+; Gene=SeqID_74189
aattagaaaaggaaacaaaaattcaaaagtgtaccatttggacagattcaaccaatgtacttgattttgttagaagtgaaatgaaatttgataaattattaaaaacagagtacaaaatatcaaaaaatggcatttaaaacatgtggacagcaaaaataatcctgctgacctagcatccagaggttcgtctgtggaagaattacaaaattctgaactttgctggaagggtccagaatttctttcaaaaatggaaatagattggcccaagacaattcgtgagcatgacccaatgaatccgcctgaggcaaaagaaaaacaaaatataatatactaaattaattcagcaattgaacaagaaatattttttaattctgaaaaattcttccaaagattttcaaaatg

SEQ ID NO: 107818 - DNA, 587 bp, Heterodera glycines
  Promoter: Source sequence=SeqID_24506; Location=1..587; Strand=+; Gene=SeqID_55236
ctttttttttggaaattaagtcaagggcacccgaacaaaacatttgtgggattaaaaaatgtgattacagactttggggtgatcagaagaacatattggtaaaaatattaagaaaaattaaacaaatttatttatataaatttatattgttttacatatctcttaaaaaatttaaattctctaaattcattttattaaactttaaaaagcttttatttaagaacttcaaaaaaactttatttaaaattcctattatattaatagaattgttttttatttaaatttattatttatttcaaaatttttaattagtttggaaatataacaaaatgatattgaaggaagtatttaaaactttttttaaaatattttcgaaatattaagattagttgaaaatatttgtggattttacaaaataatctatttctttatggcaaatcaaaaaacttgaaccatgttacagaacattacactaaaaagattttgtatatattaaatggggcataaaaatgctttacttttttaaacaattttaattaattttagcaaatccaaaaacggtggcatttgtgtcccattgtgggatg

SEQ ID NO: 107819 - DNA, 860 bp, Heterodera glycines
  Promoter: Source sequence=SeqID_16970; Location=1..860; Strand=+; Gene=SeqID_81395
acagaaaaagtataactacttttaaatgaaaataattttaagtgatgaaaattttaaaataacttcgtagtatccgctagtcaaatctattttgcattaaactcattattttgagcaggagggagtccgagatagaattacacaaaatatgtgaatatgttcttgtgtttaattaaggcctttaagcgaatcttttaaccctttaataatataagcgagttgaaaacagtctcactataaatatgtgcttattttaaaattatgaatacctcttttgaaaaatgcaagtatattttaattggtgagtaattttcaaaattattagctaatcaagaaaggccaaaaattgtcctctattagtgaaaagaaaaaattcctatttttactccgcagtattcaaagtcaaacagctgcagacagaaaaagtataactacttttaaatgaaaataattttaagagatgaaaattttaaaataacttcgtagtatccgctagtcaaatctattttgcattaaactcattattttgagcagtagggagtccgagatagaattacacaaaatatgtgaataggttcttgtgtttaattaaggcctttaagcgaatcttttaaccctttaataatataagcgagttgaaaacagtctcactataaatatgtgcttattttaaaattatgaatacctcttttgaaaaatgcaagtatattttaattggtgagtaattttcaaaattattagctaatcaagaaaggccaaaaattgtcttctattagtgaaaagaaaaaattcctatttttactccgcagtattcaaagtcaaacagctgcagacagaaaaagtataactacttttaaatg

SEQ ID NO: 107820 - DNA, 538 bp, Heterodera glycines
  Promoter: Source sequence=SeqID_30670; Location=1..538; Strand=+; Gene=SeqID_61078
atcaaatgaataattggagacagaaaattagtcataatctcgtctaaaatcgatcaaattttataatattgatatttttcgatagccctaagtgttttctattatcctgcaaattttaaaaaaaattctttaagtttaaaaaaagttatgacctgagaagctcaaaaaaccaagtttttttgaacatttttagtcataactttcttgaaacttaacgaaattttttgaaattttgtaggctaatagaaaacccttaggcctatcgaatgatatcaagaattaaaaatttagatgcttttgagcaaaattatatcaaaaaatattttcatttgatggttttttgactaacgcccattatgatggtttttgactaacgtcatagcaccgccaaaaatggctgtattacgatgcgttatatagatatgcaaaatttggtgtggatttaccaagtgaattccgtttttctctattaacagagataaagaaatagtacgccaaaatgagagatgtttttttctctacactctattgacacatg

SEQ ID NO: 107821 - DNA, 606 bp, Heterodera glycines
  Promoter: Source sequence=SeqID_12012; Location=1..606; Strand=+; Gene=SeqID_75538
ttgcccaaaatttgttaacaaaaatgcaataaaaaggaaaaatacaccctaagaatcgacccgaaaattttcaaaaacacaccccctgagaaatgaaaaatttttcaaaaaatcatctccaaaattaagttaattattttattgacgataatttttgattttgaaaattatgtatctcattaatggtttggcataatatttttgctttttgaagagaattttcgattttacagcccctaaattgccccacgcgaaaagaccccgaccccttaattggcgtccttcggaaaacggcaaattgtgctaattgccacaaacagatttaattgagtaattaaaatcaaacattatttggcattaaaatcattacctttttcagttacatttaccattccgtcgtcgcatttcttcgtttggcaaaggcatcaatttccatttaattgtgtcgtcacataacaacaacaacaacaattacaacaatgtccaccgaattttgaatgtttatgtctatgcaattttgcccattttgcgccaaacattcgccatttgatcctttccgatggtgttaatttggacaaattgcttcacctcacttcgccgaaaatg

SEQ ID NO: 107822 - DNA, 609 bp, Heterodera glycines
  Promoter: Source sequence=SeqID_4249; Location=1..609; Strand=+; Gene= SeqID_53757
gacattcacgtggttcggcaaaagcacagcgcaggtggacatggaagacaaaactttcaaataaaaaaacggcttaaaaccccaaaaatggcattttgaaaatcttaacaattcacacccaaaacttcaaatttttcccggcgcgcttatcggcaccgccggcttcctgttcccgaaaaatttttcgaaaaagcgcgttgcaaaaaaaagcatgaaaagcaaaaaatattttgtcaggggcgggcccgtgcccttggccctccgcccaaggcaacttaaattatggtcaacatttcctcctttctcatcgattgtcagagttcggccggtgaacacgtcggtctgctgtgtaagaatctatactatgatccaatttcgcgtggtttttggttgacaaagccgggaacagtgacgccaacgaacattttgaaagtttttaattcctttgaaaaattgtagtgtaaaataactgattaggtggaattcttcatgttgagcgaggcggacggcgggcggaggcagggcattcgtaacggattccaggaaacggtgttctgtactacttggaattcctgcgcaaaattatttttcgactcggaattggtcatg

SEQ ID NO: 107823 - DNA, 227 bp, Heterodera glycines
  Promoter: Source sequence=SeqID_33396; Location=289..515; Strand=-; Gene=SeqID_63467
aattattgggatgccaatgattgtcatgagaatctcgaaatcagtggcgacaaaaatttgactgtccattacaagaaaaatgattgtggtattttgaataatatatatacgacctaatctttttttcctcatcaaaaggttggtgttttgtctttggtgaatattcgattttattaaacaataactcgtccaacattttttattacgaaatttcggtcaaaaatatg

SEQ ID NO: 107824 - DNA, 140 bp, Heterodera glycines
  Promoter: Source sequence=SeqID_7920; Location=1223..1362; Strand=+; Gene=SeqID_66385
accttcacaacatggtaagcaaaaaatttagttccatatttaattaaaatttaattaaattgtttttcaaactttttggagtcgaaaaaattccattccaaattccttaaaataggccaagtttcaggcattggccaatg

SEQ ID NO: 107825 - DNA, 115 bp, Heterodera glycines
  Promoter: Source sequence=SeqID_25994; Location=337..451; Strand=+; Gene=SeqID_56747
tgtgagaggacatgttgcgacacaaactggcactttttttatttttaaaaatatatttttgttttttcaatttaacaaattaatttttcaattttaggaaagtcaaatacacatg

SEQ ID NO: 107826 - DNA, 208 bp, Heterodera glycines
  Promoter: Source sequence=SeqID_40927; Location=899..1106; Strand=-; Gene=SeqID_46640
ttcgctgaccaaagtccacaaacgctcgttcatttcgcccatttcattgcccattccctttctttgcctaaatatcgcttctttctcaaattagtcacccgtataatatttctttgttctcttggtcaaattgttgtacaattttcttgtttcagttattcaatacaaaataaattccaaaccaaacaccaacttttccctgctgatg

SEQ ID NO: 107827 - DNA, 168 bp, Heterodera glycines
  Promoter: Source sequence=SeqID_13752; Location=737..904; Strand=+; Gene=SeqID_77674
cgtgaagtgaaaatttgcctaaattacccgtaaatcacatgaatcggcctccttcagaaagaatagatttggaagagacaagactaagtgaaaaggcacagcgagaattttttagaccttatcgcacccccggagactcagaaagaaattgagagacaaattaaaatg

SEQ ID NO: 107828 - DNA, 298 bp, Heterodera glycines
  misc_feature (66)..(66): n is a, c, g, or t
  Promoter: Source sequence=SeqID_28665; Location=1227..1524; Strand=-; Gene=SeqID_59255
atattgatttaaaaatactcatattagtgtccaaacgacgactttttagttttaaaaatgctattngcggcgcgcttctaaaaaattttctggacggtgggtctggcgacgccgatagccgccgccgtgaaaaatttaatgcgatttcttaacgattttgttcaaacaatgacaaattttacgatttgagccactttttaaagagatttttccagtttttttcatgccttgacctggagctgggtttcctggacaaaaatccaggcccaggaaaaaaaatccaggttgccgaaaaatg

SEQ ID NO: 107829 - DNA, 66 bp, Heterodera glycines
  Promoter: Source sequence=SeqID_848; Location=583..648; Strand=+; Gene=SeqID_62627
ggttaattcgattgttggccattttagcatgaagtgattttctataaattacagaaaagaaaaatg

SEQ ID NO: 107830 - DNA, 367 bp, Heterodera glycines
  Promoter: Source sequence=SeqID_32257; Location=435..801; Strand=-; Gene=SeqID_62577
aataaggaatgcttaaagtcgcgggaattttacattttttggatgaaaaacactcagcaaatcttaaaatttgtttacttcccaaccatcccttcgctctttgttagggtcgtccgtttgcagtcgccttccctcgtctccccctcgtcgccccacgtgcgctatttggccgtcctctccacccaattcgacgccaccgagtcgcgcgaggctgcgctgctcggcttccatttcattgggccgtccacttccaccgcccctcgcagcgcgtacgaattgcaatttttggcaaaattatctgacgggttttgttctccccttttgcttaaaaacatactaaaattcaaagtttgacaaattttccatg

SEQ ID NO: 107831 - DNA, 160 bp, Heterodera glycines
  Promoter: Source sequence=SeqID_12283; Location=1..160; Strand=+; Gene=SeqID_75876
caaggggtggcaatgcgctgcagcggcagccaaacatttcccggaatattgtgactccgggaaactcggtgacaaaaaatgcgccgattgcggtgcacatctcttctcacatgaagacagtagcatttgctgccggaagggaagagttgtgctgccaatg

SEQ ID NO: 107832 - DNA, 207 bp, Heterodera glycines
  Promoter: Source sequence=SeqID_18078; Location=542..748; Strand=-; Gene=SeqID_82664
aattaatttaaaattattttttattttaatttttgtgtttgaagcgtttcatcttcttctgaaatagccaaaaagatgattgaagtgaataaacaagtttctcgaaatctcattttttaggttaattgagcacttttttgtactatttaaatataaattattcaatattttgttattaaatttacatttattatttaggcttctatg

SEQ ID NO: 107833 - DNA, 297 bp, Heterodera glycines
  Promoter: Source sequence=SeqID_18580; Location=379..675; Strand=-; Gene=SeqID_83211
acacggcgagtcaattttgggctcccagtgcaaataagtttattatttatttagtaatcaaaacgccaaaactttgcaaatcttaaaattttttttgggaatttcccttgtaaaaatgcaagagccgatctcgagatagaaaagaaacttttaaaaaacaaaagagaattcgatagagggggtcgaaatatgggcctatacaaaatttgaagaaattttaaaagctagaaaatttttttgaaagggacgaacatttaactcatttaccagaaattttattattgttttttaataatg

SEQ ID NO: 107834 - DNA, 211 bp, Heterodera glycines
  Promoter: Source sequence=SeqID_10124; Location=2298..2508; Strand=+; Gene=SeqID_73215
actgtaaaatttgacaccaacgcaatgaattacaccgtcagcggaggtgaaatagccaatgagtaccttttgaataatacgcgttatgctaattaattgtaaactaattaattaattgctttaattaattgattatttattgttttcactttcgtttgctcatcatttctctcaactttaatgttcaaaggttctttgtcattaaagtatg

SEQ ID NO: 107835 - DNA, 1003 bp, Heterodera glycines
  Promoter: Source sequence=SeqID_5832; Location=726..1728; Strand=+; Gene=SeqID_59371
taattaatacattaattatgtatgcattttgctgatgctattgcaatttacgggtcatttgtgttgtcactattaaattttttattcatttgtgtgagggcaacgttttatgtatcaacaacctttgtaaaaataataaatagcaagaaatatttatttgaacgaatttttaggtgctaaaaagcgagaaaaaatcgttgctaaaaaacagaaaaatgccaaaaaattggaaacatataaagtaaatggaattgcatcattctttatccattccgatcagggaagggcgaatctcggcttaattaattattcacatttttaatacattaattagctgaagttattgtgaattttacgggtcatttaacctatatttggacaaattgatgataatcaacattaagcaacccattggatatgctcaaaaatgcattaaatgatattaaaacattgtataaaattcgacaaaataaattaaaattgtataaaattaaaattgaaaaaaatataattacataaattactttcgctttataaaataatttgtaaaataattttaaatttattaaataattatttaataaaaattttagaaaagcaaaacaataaatgctcttgttcatcattaccaatttaaaacattttgctttttttgtaattaccgtacatcctctttttatcctccttgggggattatttttaaacctcctcagaaaggggaggcgggataattggagactgggggattaagatagagggattaattttcaaatgcttcatagactgggggataattggagactgggggattaagatagagggattaattttcaaacgcttcgtagactgggggataattggagattgggggattaatggagattggggggattacagctttctttttctttttaatttaattttttcatgcattttaatcatgaggatttttattaaaaaaaaaagtgttgaatatatgaaatttggccaaattttacagatg

SEQ ID NO: 107836 - DNA, 376 bp, Heterodera glycines
  Promoter: Source sequence=SeqID_26978; Location=83..458; Strand=-; Gene=SeqID_57714
aacaaagttcactccattatcgattggtcccaaacaccacactattcggtatcagggatgcgatttgagccctatttgttgatattttctcctaatttcagagagttttttaaacatttttacagggttaactatatcctagctttgggttttttgtaacttgtattttaaaggaaatcagcatcgccgaatctaaaagttccttgaaatttttcaaaacttggcgttaaatcctaagaaatagttagttttggacatttttgggaaaagaaagggccagagattccgttagggcctcggttaatcggaaaatattttgcttagactcaaacaaatatttaaaaaagttaattatttcccgaaatctcaggcaatg

SEQ ID NO: 107837 - DNA, 864 bp, Heterodera glycines
  Promoter: Source sequence=SeqID_2379; Location=1090..1953; Strand=-; Gene=SeqID_79439
aggaaaaagcgaaagagagcgaccgatggacacatttcgcgttaaatgtactcattcaaaaccccaatcaattcatctcttcaatattggcttatttttcgggaaagacttcatctttattctgcggtattattgtgtgtcattgtcttcagaaaatgtgttccttttgttcccagttttgttgtgatgtggtattattattgttgctcgttgaatacattttacgtaagaaattaaaaacatttaaatgcttaattcggtgcagtattttcttttgtccattttactactatgtataataaatataaaaataaccattaatctggcatcaggttgtttgttggaatgcatcctgccaaacacccatcttcggttaccgtcttgccaatgcgcttttatgccaattgggacgtcgatcgtacgtcttcgccaattgctgtacaaaggtgccgtctcgtttctccatgtgtttacaattgaatgtacattccccaagggttctgtccatggttttcacccgcctgcgtttgacaaaaagtttggcgataactgaaaatacgccgttcacaatagccatccgacttcaggtgggttttcgacaattctttttttgattggattttatgacagaacaacaaaaggacactgcgaaccaatgatttgaatgttccgccttcgaaattggacattccgcttgacatttcttttataatacaagtgcgaattgccccgtcaattaaatcaccttccaaatttaagtactgtcactttatcaagcgcaaaccgaacattctccaaattttgatacagcggcggaagagatacaaaaacagacaaattcccgggtttaaaacgctcgcaatg

SEQ ID NO: 107838 - DNA, 342 bp, Heterodera glycines
  Promoter: Source sequence=SeqID_6694; Location=523..864; Strand=+; Gene=SeqID_62518
aattttcaattggatgaaaaaaggaccaaaaaacattttgattttgacgatttgtacaacagcaattgaaggacggcttggattctcttaatgactttgtattgttttcatttgtttctcattttgatttgcttcttcttaatttaacaaaaataaaagtgtaaatgcctttggaaatgctctaattcgttttatgtcattaaaatatttattccacccatttgagtgcgtccgatcatccgattttatttgttccccgactcggtcgagggcagtcctaattttaatccttttaaaactcgattacactttttttgttgctatttcagaataatttaaatg

SEQ ID NO: 107839 - DNA, 679 bp, Heterodera glycines
  Promoter: Source sequence=SeqID_4815; Location=2775..3453; Strand=-; Gene=SeqID_55818
atcccgatcagtgcacccgaattttttatgaattttcaactaattctgatcatttaacacatccggaaaatgagagcctgtaccaaaaaagattcgcatgtgtgactcattttcagtagtttttcaaagatagaaaagggaatggctgatgagctttaagcccaccacaagacattaatatttttaaatattttgaaggccagccaaattgaacggtttggtatcaaatgaaagctctcaagaaggagaagctttttctaagcatctgataagcgattggatgcattataaaaaatatataggcgcttttcagctaatcctttttttggtcttaaaaaccctcagattttttttctctatcatatgcaaaatttgaagcgaattcaacgtgtagaaaaaaaatttaaacgtcacgaagtaaattcagtctttctctattaaaatggataaataaatagtacgccaaaatgagagatgcatttttctctgcactctctatttattggttcatctctcgtttttttgagtcggtgtgtaaacgaaaagtgatcaggacatttataatgcataaattaattggtgactattagttagaccaaatggacctatattttcttttaaactgggtttccgcattgcgcaggttgaaattgcctttgtcacgcccactgggcgaatg

SEQ ID NO: 107840 - DNA, 1003 bp, Heterodera glycines
  Promoter: Source sequence=SeqID_985; Location=2..1004; Strand=+; Gene= SeqID_65465
taaaaaaaataaatttagtttttttgttggttatttgcattttgccaaatttataaaacgcgcaaacccattttggcggatttataaaacgggactggcggatttataaaacgcgcctttccattttggcggatttataaaaacgcgactggcggttttataaaacgcgaattgttaggtggcggatttataaaacgcgactggcggatttataaaacgcgcctttccattttggcggatttataaaacgcgactggcggttttataaaacgcgaattgttaggtggcggatttataaaacgcgactggcggatttataaaacgcgactaggtggcggtttttataaaacgcgcaagcaccatccataggtactgtatctacccaccaaattttcattcggaaaccccacggacacccggggaccttcctttgttagtacttatatattcttctggagaaacttaaagctatcgaagcataaccaagaatgttaaatttagttgactttaaaaaatctgtgagtttattttttaattttaaaagacagaatttttgctgttttaagagaccataattttaatgtttgaatttatttatttttttccagaatgtcctttatccaaggattaatttattataacattatttaaaattgtatatttttctagagaaacttaaagctatcaaatcattaccacgaatgttaaatttagttgactttaaaaaacttatgagtttatttttaatttttaaaatgccaccttcacagatcactgaattttgctgttttaagagacctaattttttccttattagataatgctcgaatttatttatttttttccagaatgtccttgtatccaaggattaattacgcacacaatttgatcgattgccctccccccattttcagagtcccactttttttatttggctttcgaaaatgccgtctgcacagaatatgtgactgaaaaattttggaaggcgttacgaaatttgatg

SEQ ID NO: 107841 - DNA, 76 bp, Heterodera glycines
  Promoter: Source sequence=SeqID_8076; Location=1908..1983; Strand=-; Gene=SeqID_66912
ggtttgtcgataaattttgcattccgattttttttttgaaatttttcttggtattttaaggtctgctacaaacatg

SEQ ID NO: 107842 - DNA, 1003 bp, Heterodera glycines
  Promoter: Source sequence=SeqID_13163; Location=1308..2310; Strand=-; Gene=SeqID_76982
tagaaactattttggcagttttttagcaactattaggtacccatttcgggatttttagcatttaaaaatccgggccctgtttagaaattaaaaaaggcatggaaaggctctaaaaaatgcatttctcggtttaagttctcgataatcgcatagccttatgaaatataacgcaaataacagaaagtgaataactcaaatccctaaaaatgtaaaatgcaattaagaaattcggcattctatatagcaactatacaactatacaaaatataacatgcataaattgattaacaattttttattattattaaaaatttacaactcttctgcataagtagagtaaacacaacttatagcttttattgatatataaatattattaataaaaaaatattcatcattgtattatatgcgtattattacatattcactacagattctatagtttgtataagtattttaataaaaaatcatcattatattcacatgcttaaaattgtataatattcctctgctgatgctagagtttgtataaatattatataataaaatgttgatcattgtgtttgcatgctataatatttagtaatattatatttagagatcagatacgggccggaaccgtatacgaattttagcccgtaacccgtacccgtttccgtacagacggaaaattccattctctattctattttacgctgcaatttgtaaaaatattaaataatacgattcacatgcttaatgtttgtataatactttctgatgctgtagtgtgtatatatttgtctgtatttgctataaacgacgcttaatattctgctattaaacagaaattcgcaatataaaacaaaaaaaatatgaaattattatcactttacaatatttttttttcttattttttaacttatttttcctaaatttcacagcgttttcaggcaaacattaagttcacctaacaaataagcatagaacgggatcactgatcaactgtatacccaacaaaatg

SEQ ID NO: 107843 - DNA, 1003 bp, Heterodera glycines
  Promoter: Source sequence=SeqID_22700; Location=263..1265; Strand=+; Gene=SeqID_53386
tcatttttcgctttgtggggggaacatttattatcatttatcaaaattatcagagagaggctcagtttgctgtcaattaggattccaagatctcggattgtttgggtctctttaataatttttccattaaattggcagggaactttaaaattatccttgccaatgtacagagaagctgatttttctggtgaaaatggtagaccccacataaaaaatttttggaaaaatacacatgtatcttatttgtaaccgcaattagtgaataaaattgcttgtcttaattcgaaattacttttcatgtagaaaacagcaattttaaaaattatacccctaaatttggaactttttcgcccttatttacggccttattcatcaccccataactttaaaattggatagaaaataaataaataattcagaatttttttctctattacctaggtacctatatgcaaaatttgttgtggatttatgtaacaagcagaaaaaaaataatttatttttacataattaaaacaaagagatagtacaccaaagtgagagaaattacaaagaaaaaaagcaactacgagatagtatgtgttaggcttttctctgcacagtggagttgacccatagagcacacctctgaactaaaaaaaccttataaatatgtcgtctcttggggttaattttcattttgttgtatcccattgttttttcatttgtttgcattttttctgatttctcccacctttgaaaaccttttgcttctatctctataatatgtaaactcggccaaatttttcttttttcacaaaaaacaatgaaaagctctaaaactgtttccgaattggataagtattccccacaaagtccttgcttttgtgagtcgaccttttgacactttcattggttgggtccatcattttgtgggcttttcctaccaacaaaaaaaccccaatttctgctgatagaggcaataatttattccgtttaaattttcatgtctttatttgctatg

SEQ ID NO: 107844 - DNA, 720 bp, Heterodera glycines
  Promoter: Source sequence=SeqID_36546; Location=733..1452; Strand=+; Gene=SeqID_65832
accaggtcattcaaaaaacaaaaccaaaaacagtaattcattttagacaatagagaaaattaagaggtattttaggcatttgcctcttctttaaaaaaaaataattaaatgtaaaatgccattcctaaataattaccagccctagtaatgagcaataagtgtcggtgttttgcctttatgctattgattttgccgtttgtccactccgcttttctgcttctccttttcaatgtctcttctccctttcgttggcatttatctttccattctcccaacaacaataataataaatccatccattctctgtgccgttttaccaacatttttgatttttccatcactttcttagcttctttgaattaaattttattgcctattttttgtatcaaaatatctaggcaaatttatatgacaaaaaatcactaaaattattattttttatccgaatgtttagttaatttgagcattttaactgtgtaaaatttaacgaatgtcaaaaattacttgtaaatatttaaactcatcttggaaaaatttaattcatattattttgtcacattcctttatttttaaatattaaaaaatttaatttctttatcaatatgaaaaattaaaacttttttttaatattattttcggtgttttataataagattatgcacaaatatttaggggttgggtaccatgcataacattcatttccctctttaattagaaatg

SEQ ID NO: 107845 - DNA, 445 bp, Heterodera glycines
  Promoter: Source sequence=SeqID_14288; Location=1..445; Strand=+; Gene=SeqID_78311
atcgatttggtttttgatttcttcaaagtcaaaaaatggcccatatgtaggcggaaatggaattaaaaagcgtgaagttaaagaacaaaagttaaatttataattaatattaaaatattttattaaaaaaaattcatccatttgcattgagttggatatttttatggaaaatatgtttatggattataactccatcctagaggcttcaaaccaagatatgtgcagaatttattcattgaatgtttttcatatgtggacccacaaaagttggcattgtttttttttggtatttcaattcattttgcttaagttttgctttttcgaggatcaagcagaaatatttggaattggatgtatttattaataaaaaaaaatcaaattaaaattaaaatttaagggcaagggttgttttcaatcttacaaattctttgaaagtcgaaggatg

SEQ ID NO: 107846 - DNA, 254 bp, Heterodera glycines
  Promoter: Source sequence=SeqID_34678; Location=1..254; Strand=+; Gene=SeqID_64407
aaaatttagcctattaaaatatttagaaacttttttattatattttttattttttgaaaaatttccgatttccgacgtttttggggtcgaaattccgatttccgaaaattttttgatccccgaaattccgatttgcgaaaatttttggggcctcggaatgccatccctggtggctggggaagctccaatattttcataataattaaaaaaaaattattttgctaattttcaggtggttatacacttggccaatg

SEQ ID NO: 107847 - DNA, 455 bp, Heterodera glycines
  Promoter: Source sequence=SeqID_28117; Location=431..885; Strand=-; Gene=SeqID_58768
atgctgtccgcctcttcctccgcgcggtcggctacgcaaaagtgaaactgtgccgtcagttttttgaccggctgagggcacgcgaaaatttggggccggacggcgaagtgttctgtcggctggccacgaagagtttgatgcacattttcaagttagttgctttttcctattccaaaaatttatattttttaacgaatttttctaatttgcgattggatttgccgaatgttttgcagaagcgcggcccaatcgtccgtcggccccgtcccctcgtgctcacttgaggtaattctgatttaaaaattttaatttttgcccatttcaatatacattgtcctatatttccattttttaaaatttagttggacccccaatcggactttgcctacgtccatctccaatgtttgtccggcattcggcgctgttttgtgctgtcgttgcgtgagtatgccatg

SEQ ID NO: 107848 - DNA, 1003 bp, Heterodera glycines
  Promoter: Source sequence=SeqID_5363; Location=1140..2142; Strand=+; Gene=SeqID_57791
gtctcgactttagagaaaagcccggaattttttttttgtggtttctgtctttggctcgatccgcaaaatttttaattcaaatctcgactcaaaaatggctaaaaattatgtgttatacaaaatattatttatttatagtggcgaagaaaaaaaagagaaatttaaatttaatttcttcggcaaatttttgtcggttcgattggacagcaaaagtgccgaaaaatgattaagcgacgcatcaaaaggcgaacaccgacagtggtgatcatcacttgtacagtcagagtggtcagtgcctgaggggattgagttggggcacaattagggagggatatagaagcgattctcgacctcgaatttgtcgatttttgggaatctctggggtcacattggtctcgataaaaagtgttggcgatgagaaccaataaatctctctaatccccctcccccatttttattggataacaaaaaatggaagccgaaatttaaaaaatgtaaaaatgcaattttaaaataaaagtgaaattccgccgcccaatttttgtgctaaaatttggcatggatcagctcaattttgtgcgagttggccttttctttttgaatgtaaaaatgggataagaaataaaagaatttttgggattttaatttttttttggggatcaaatgacaacaaatttttgaatggatttcgagggggcggagaaaggctttttgtgttacttttggtgcacttttttgatcggaaatgggagaagggatggatcaaaatgggatttgggaagggattttgctgcttttcaatgggtcgggggccgaggttcaatttcaattttaaaacaaatcccgccaaaaaaaaaaacagatttcggtgccgtgtgccgccggtggtgcgcaaaagtcaacaaaagtggcggcggtggcggcaaaatgcgccgacgcccgggtggcggaaaatgaggcggcaacggcagatgaaaagcggcggcggctgcttcaaatgatg

SEQ ID NO: 107849 - DNA, 981 bp, Heterodera glycines
  Promoter: Source sequence=SeqID_14605; Location=1568..2548; Strand=+; Gene=SeqID_78685
ttttaaatttctgtccgggctagtcgaagactaaagggactttaaaaaagagaaaagatgtgagaaaatctgtccgggctagtcgtaaactaaagggacattaaaaacgaagagaaaataggtgagaacatttgtccgggctagcgaaaagctaaagggattttaaaaatgcaaaaaaaagaagaacgaaatttgcccgggctagtctaaatgctaaaggggctgactgcatcgaaaattgacaaatttgacaattatttgtaggagagagagagaataagaaaagagagtgaaggaagccaaaaataactaaaaaaaagtcctggtagcaaacgaataaggaccaatttataaaaatatctgaacgattgagaagcaaaaaaagagagagagagagagagaagaagtgagacaaaaaaaaatagaacaatttttttttgaggagagcaaaaaggcccgggctgataaccaatcaaggggcactattttagctaattaaaaagagggaccaattaaaaaaatgaaaattaggccctatcattttgcttacagtatgagatacagtttttacaagttccaaagttcattttatctctttgttttctctcgtttctcacgccataagaatattcacgtaatcacgtgccgccgcatttttcattgggcgagatcattcactttaaacatttttgcggcgcctgagaattgttaattgctcttgataggcggagtttaaacggagatggaacagataagcccattcctggaaggcgttcgcgtccattcgattacccgctatcattcattaattttttttctctctcaattaatgcataatgggattaccaaacaaatttttttttagcaaaataaaacaaaatcttattacgaactgaacgacttcgaatgtctacatcagggggctcgtcaaatgagttcccctttggtacatcccaagccttcgggcaggaaacaaagatg

SEQ ID NO: 107850 - DNA, 426 bp, Heterodera glycines
  Promoter: Source sequence=SeqID_15322; Location=580..1005; Strand=-; Gene=SeqID_79560
gaccttttgttaatattcaatagcaacacaatttccccttttacttctgtcccgtgaaacttttgtccggcatttgtccgaattccgaattttgccgggtccaacggggggtccgttctgttcacgcacgtttggctgggcaccgcccaaaaaatctgaggattgccaaagtgagggaattggggggacaaaggggggaaggggacatgcctcgaggggactgacggggtcgaattggagggtgaaaagcagaaatagggagatgaagaagcggagggataagcgggagaaaggaaaatggagggaaaaaggaaaaatggggtaaaagagagggccaacggaagaacgcatcggacggagcatcttcttgctgaaaacaaaacttagtacaaatggatgaaaagtagaaaaattgagcgggtgatg

SEQ ID NO: 107851 - DNA, 147 bp, Heterodera glycines
  Promoter: Source sequence=SeqID_21871; Location=1..147; Strand=+; Gene=SeqID_52510
ctgtattgttggcagttttttttaaacgagatgcaatttttattttaagatcaaaatctagctaaatcaattttaaacagtacctttcattcaaaaaactgtacttcattttggcccattttttctcacaattttcatctgataatg

SEQ ID NO: 107852 - DNA, 451 bp, Heterodera glycines
  Promoter: Source sequence=SeqID_6319; Location=719..1169; Strand=+; Gene=SeqID_61134
attggtagaaaaggctggattttttgataagagagagtccatgacaagagttttactgcgcatatgatactttaaagttgtgtttttcttgtataatcccaaacgatggaatttttctattgtagaaattttttcgaaaatgtctatttttcctaacaattttttttaaaaatgggaaccgacggggcagagggatgaaaacccatgtacgcccggtaggtgcactacataacccgcatatcgtttcccccggatttttaaaaaaattttaaacagtaatttaaaatttttaaacaatttttttgaaaaaatagtaattcactataaaattttgtaaaatttctattttgaaaattaaaaaaattcattgttcattgtcagatggcgaccacctcttctgccagcggcgccggtctttccttcgcctccgattgcccttaccccccaaatg

SEQ ID NO: 107853 - DNA, 652 bp, Heterodera glycines
  Promoter: Source sequence=SeqID_5992; Location=1..652; Strand=+; Gene= SeqID_59951
agagttggtcggtaatcggtaattgtaaaaaaaccggtaccggtactgaccggtactgcaagaaccggtaccggtactaaccttttccaccggtaccgctaaaaaccggtaattttgtaaagttaaaaatttttgaacaaaatttttaattttcgcgcgagtgactgtttttaaccaagtttttttttcaaattcaggtaaagaacactaaaaccagatttagactctaaaattaagattttttgtaaaacaagggggtcagcggtcaattttccaattttgcgaaggggtccgaggtgtaaaatgcaaaaaagggatctgatcggtggatgggaaaaaaatactttgattgaagattacttttgaaaaaatgttacttttaagtaataaacccgttgtaaatgtgcaaattgatcaacaaattttttgcggtgcatttttccaagaaattttggagaactggcgtaggtagtgagtccggcggtgccgataggcgccgccggggaaatttttaatgatatttgttaacagattttatccgaaaaatgaccaaattaggttaatttttggggtttttaggctgtaaaaaagaaaaaaataataattattaagtttaaatatttataattaattaatttcaattaaaataatg

SEQ ID NO: 107854 - DNA, 245 bp, Heterodera glycines
  Promoter: Source sequence=SeqID_11245; Location=1..245; Strand=+; Gene=SeqID_74605
attcctccaccagccgcggcctctccccccatcttttcccttcccttttccgcctccctttccggcaccgccttcgctttccatgcgcccgcccgtggaggcaattccgcctccctttttgatgagggccgcgatgatggcagcggcgccgcgggcatttcacgcgggcagcttttggcacaacgccaacacgtaatgatgagcaatcaagtgctaattatactaattgactatgtgtcaaaatg

SEQ ID NO: 107855 - DNA, 125 bp, Heterodera glycines
  Promoter: Source sequence=SeqID_1212; Location=1139..1263; Strand=-; Gene=SeqID_70031
ggagaaatgaatgttttgaaggaatcggtcgataaatgggaaatgggtggaagggaagtgccttttataggcgggaaagagtcgtctcattgtcagtctccgcgttgtttttcgtcggcggcatg

SEQ ID NO: 107856 - DNA, 69 bp, Heterodera glycines
  Promoter: Source sequence=SeqID_2771; Location=943..1011; Strand=-; Gene=SeqID_81496
ggttgccaaataattttaaatacttttttaaaattaaaaatattttgcttatattttcaggcaccaatg

SEQ ID NO: 107857 - DNA, 287 bp, Heterodera glycines
  Promoter: Source sequence=SeqID_32991; Location=1..287; Strand=+; Gene=SeqID_63195
atccttagggttagaggcaataaatccgtagtaaacctcactgggagatattaataatccttatttgtcagggttgccgttaaaaattccgtaaccccaaaaaaatccgtaacttttacggctagggggtgagggggaggggtaaaatttccataaatctttaggggttaggggctaaaagaattagctaatggtaaaattcataaattccccagttttgcccaaggctaaaattgtaaaataaaaattttgagctaaaaattttttgaaaaaattatttaaaaatg

SEQ ID NO: 107858 - DNA, 568 bp, Heterodera glycines
  Promoter: Source sequence=SeqID_3908; Location=1..568; Strand=+; Gene= SeqID_52379
tccaactcaaatccgccaaatcccggggtaattgccaaagagaaaccattgaatgatatttatattttaaaaagcgatatttacttaatcatattattagtgaatttatattagctgaacatggccaattttgccgtcccaattttcatcggacacggaacgaatgaccaaaatgtgccactttcattggcgtaagtttttattgtttattttttgcatgcgaaatttgacagattttcaatggcaaatgcccttcggaggtttgaccccaatgtgaatttgcgcatttaccaaatgggccacgaaaattgtgcagccgaacttaacgaagcaattcaatttataagggaaattgtgccattggcatgagataatgataaatcaaatgccttccattcgcaattttccattgccatggcaaccaatgaatgaattggcccactttttttttaatttttggccctttaaattgaattttttttttgttctcaacaaaggccaattagtcctctcaacgtgtttcgtctgactcaattaattgatcatttatccttgttcccccaaaatg

SEQ ID NO: 107859 - DNA, 67 bp, Heterodera glycines
  Promoter: Source sequence=SeqID_4128; Location=1..67; Strand=+; Gene =SeqID_53290
aatgagagagaaaaataaatgaaaaaaaggcatacagtaataaggaattgggaaacggtagaaaatg

SEQ ID NO: 107860 - DNA, 238 bp, Heterodera glycines
  Promoter: Source sequence=SeqID_21227; Location=1493..1730; Strand=-; Gene=SeqID_51819
ggtatgtttttttttactcattcactttatttgatgttctaattgggtgtattaggtgcttggacgcaatcaaacttatgaggaattcgtatgcaatgaatattttatcggagaccaccctgccataaatgatgattgcagaagcggcaaaaaagaaaacgacaagacggactggaagactgttttcgtaacagtgttttgggaaaaagcattcaagcagatgcaacgcagtacaatg

SEQ ID NO: 107861 - DNA, 268 bp, Heterodera glycines
  Promoter: Source sequence=SeqID_20345; Location=818..1085; Strand=-; Gene=SeqID_50866
ggtacatatactgtttttatacttaaataaatttaattctttttttgaatggaaaaaaacaaaaagaaaattacataaaaataaattattttttctaaattcttttaaattttttataaatcccagctcaatttttaattcaataaatttagaaactatttttaaaatgaaaaaaatataaatttttaatttcgaaataaatatttaattgaataattattttacgattaaaatagtgtttttaggtcatttcggtgctcacccgatg

SEQ ID NO: 107862 - DNA, 576 bp, Heterodera glycines
  Promoter: Source sequence=SeqID_24268; Location=1..576; Strand=+; Gene=SeqID_54982
ctacagaagtttggaaccctaacttaaaaaaagatatagataaacttgaacgcgttcaaaagtttttcacgagaaaagcacttagaaaatgtggctttgtgtacaaaaaatatggggaaagactaaaaatcactgatttacacaaattagaagaaagaagaaaaatcaatgatttaacaacagcttttaaaataattaaagggttcaccagccttgaggctgagcaaaattgctttttctcggaaaggcccaggaggcctttacttttgcgagtaaagcgccacacggccaaaactcaaaataattttttcaatagaatagtaaaaaactggaataatcttccactggtagcggtgcaaattaataaggcaaaggaattcaggggtttactaaaagcaatgagttctgagtaggattttccatgttgccatatttacactatatttttatcacctgtgaattcaacatttgattgaattattttattcatttttattacggtattcattttgtattttttatttgatcaaatttatttgtttgttttcatttttgcaccatgtaagagcactaatg

SEQ ID NO: 107863 - DNA, 114 bp, Heterodera glycines
  Promoter: Source sequence=SeqID_10602; Location=601..714; Strand=-; Gene=SeqID_73834
aaagcacgtcttaccgacgagcaaactcacgtaagaaattttttttattacttttgaaattctcaaatttagcgtttcaaaactgacgcagcctttgcacaattcgccaaaatg

SEQ ID NO: 107864 - DNA, 861 bp, Heterodera glycines
  Promoter: Source sequence=SeqID_8350; Location=1409..2269; Strand=-; Gene=SeqID_67767
ttttcctatacaattgcagctttctacgttttaaatcttttattttgtccggaaatttgtcattaataaccttttttaaaggtttagtgggaaaatatctgttaagcccaccagctaaaagacaaattaataatttatatttatcttcaatcccgaaacaatacgataattatattttactggtaaaattattgaaaattgtaaataaaactcaaaacaattatactctgacggaaaaatttttgaaaatgaaaaattatgagtaagaaaatgttgaagaaataatgcctccgtttaagagaaccgtaccaaaaaggttagagcaaaagttaacaagaagttggcccactggaacacaagcattaattattgcaaacaaaaagggaaaatttataaatgatttttccaccaaaaaaaggaaaataattttcttttgcattggaaaaaatttttggcgaggtgtgcttattcataggggagaggttgtttttttgttttatttgttgtagtgtatttgcaaaaaattttatgccttgccgcacatcatttcaatactcattagtctttattaatagagtatgtcaactttctggcataaatgcatgtattaatcgtccatatttccaaatgtccattcattcattcaccatcaggggcagggatggacgaaatttcgtttcgttttcgtttcgtcctacattttcggcactttttgagtttcgttttcgtgtttcgttttcgtctaccaaagttttttcgtttcgttttcggttttcaaaattttttttttcgtttcgtgtttcgttttcgtcagagcaaaattggacgaaaaagacgaaaatatttacacccttaagaatg

SEQ ID NO: 107865 - DNA, 260 bp, Heterodera glycines
  Promoter: Source sequence=SeqID_33958; Location=715..974; Strand=-; Gene=SeqID_63878
gtcccagcctaatgcatggaagaggtccctgcgtgcctacacttccactgcgtaccctttgcacaaaaatagttaaaagcacactcctttgcttcgctttttagtacggcctgtcctaacaaaagtaatgtgctcttttaattttgagttccattgcttaaataaatgttattttatatttttaatgttacctaaacctaactatgttttttttagtttaatattctattaatttattttgccattattttaaattaatg

SEQ ID NO: 107866 - DNA, 113 bp, Heterodera glycines
  Promoter: Source sequence=SeqID_12595; Location=575..687; Strand=-; Gene=SeqID_76255
atacagactcaaattccatgagtctgtctgtgttttttctttgtatgcgatacaacagcccattccattgttgcattgacaagcaagcaactaatgatctaatgtttgatatg

SEQ ID NO: 107867 - DNA, 1003 bp, Heterodera glycines
  Promoter: Source sequence=SeqID_16115; Location=76..1078; Strand=+; Gene=SeqID_80473
cttctaccgcatttattaagtcagtttttgttgaaaggattaaatctaggaaggattgctccctagttggttcattaatgcaagatgtcaaattatatttattaaagaaatcacaaaataaattaccaaaattacttaaagggaaaggttttttattttttatagttaaatctttagttccaaggttaaaatccccaagtatacagcagttttctgaaatgtaaaggtcaagaaatttgaaaagatttttggtattttttaaattagtagatggagggcgataaataagaatcaaattattttgacactgggtaaattcgacactttcctcaaaaattttgttattttatacccctaaattgaaactttaacacctattttgaggtttttagaaccgaaaatctaaatattttggtatttttgaatattggcaattttcgtaacaaagtgcacttaaatttaaattttcaattttttcaaaaaaaattttcacttgggaaaagtcccggttggtcccggtcccgggttttttcgctgtcccggtcccggtcaaaaaagtttgtcccggtcccgacttttctggtcccggtcctggtttttgtcaaatttcccggtcccgaccaactctagttataccaacctaaccttttaaaaagtacgaattagaaaatgaaataggaaaatttatcatacctaatactaacaccaaaatttcttattaatttttaaaaattctcaatagtgtcgaatttactcactgtcgaaatggtccagtgtcgaaaatgctggaaaacagtgaaagtttttgaatagttcagtgtcgaaatttctctatttcggttttcgggccctggaagccctacaaagcgcttttgaaatcaattgaaaattcgggaaaaaaattctcgatccaatttggaatccggagaccggataaagctggtaaaatagacaacattctattttaaaaatttttacttagagtaatgaaaaagtattaatg

SEQ ID NO: 107868 - DNA, 731 bp, Heterodera glycines
  Promoter: Source sequence=SeqID_35817; Location=295..1025; Strand=-; Gene=SeqID_65284
ttacttttttctagttcatttaaatgtgcgcacttgttgaatggcatttgctaattgccccattcattcgttaagatacaaatgctgaaaataaaaacaaataaatttccgtcctattttgattattttaaaaagagtagtgcaaaaacaaatatgacactttcacttaaatgatttttgaaatttataaaaaaagaattacgcgtttttagtttttcttaggtatttttcggcagaaaattaacaataaaaaaaatcacagtcaatttttggcacaaaataaaagttaaacaataaagaaatacagatgttgaaaaaaatttcaatataaaacttttaaaaaaatttaattaataaaattttacaaataatattgccttaaagattttcattaaataggtacaaatttaaattattagtgattttttggattgattattgcgtgtgccatttgaaaatatttttttcccggaggtgtcattgtggcattaaacgaaaatggaaattattacagaaataacacacgtcttactctaattaaattaccatttaaatgacttcatttaaccattattatccatttatcaaatgaaatatttttgaaaatgccctcctttttcattttcaaatttataatatttttaaattataaacgcttaaaatatgattttattaagaaaatgtcttccaccttttctaactcttcaattctgctgcttttcaccacaatg

SEQ ID NO: 107869 - DNA, 508 bp, Heterodera glycines
  Promoter: Source sequence=SeqID_41515; Location=1..508; Strand=+; Gene=SeqID_69608
atcaaaataattgtaatttgacatcgctgagcgtctcacaatcagcgaaaagcccatctttttaaataggaggttttcaatcctgtaaattgttagtatttttgaagcgagttcaaaaaatccagctgtcgttgggttttgcaattcaagcaattaaaaaatttgaatttaatttttaaataaacgcaatttggcttctcgaaacttcccgatcaaaactgaaccaactaacaaataagtccgtcgcgtttgcgttatttcatccctcttaccttcctttttttttgtttcgcttacatctgtttactgatctgttaatgaacgacctttttggatcaaggacagagacgtttggtggatctttcctttctcgcttcacttctctcttcgatcgcttaggattttcatctttcctttataatcatcttcggttgactcctcataaaattggctaattcttccaacaatttagattctgatttaaatttttttgatctccacaaatatg

SEQ ID NO: 107870 - DNA, 480 bp, Heterodera glycines
  Promoter: Source sequence=SeqID_16029; Location=2002..2481; Strand=-; Gene=SeqID_80388
aaattgatattttgaattacaagataaactctaccattttatctgcagaatagtatttcaaaaaaaaaattcttttaagttacaaaaaaaaagttttggcaaaaaaacaacaactatttttctcccttttatgccaccgtataacaacacaacttttttttgccacccaaatgaatcgttttgaattatttaaaaaatcgcaaaatgtcctttttgttgaatgaatgggaaaaaatgttattgcgccttaggcgatggcgaaatggcccactccgtagttgctgttattaaacttttctatcaattgtcttttcataggaaaatggtcgattattggtcaacacgacaattacggataaatcaatgatagaagaatgttttgagggaaataagaatttgatgaaaattgatttttaattgtgcgttttttgcacttatgtttgggtctcatcagataaatattttatccaagtgtaaatg

SEQ ID NO: 107871 - DNA, 1003 bp, Heterodera glycines
  Promoter: Source sequence=SeqID_18760; Location=179..1181; Strand=+; Gene=SeqID_83434
aattaccgagtctgcaataatataaaatatttgcgtactgtgctttgtacaacctctgaggttcctattaggaaaagccttcagattaagcctatatcctatacgagtatggcttttaaatgacaaaataaatatatgttaaattaaaatgctgacacaaaagacctatgttttgtagaaaatccctaatagtttcagctttggctagattttcagcgaatatttttgaacgaaacttttctgtatgttgaatttatccagaaattacagacacatttccatgaaatattgtgaacttgattataatccctagtgtaagtaaccgatattcatacaaataaaaacatctctttgacttaagcaaaataaataataattaagttattaattaccgagtctgcaataatataaaatatttgggtactgtgctttgtacaacctctgaggttcctattaggaaaagccttcagattaagcctatatcctatacgagtatggcttttaaatgacaaaataaatatatgttaaattaaaatgctgacacaaaagacctatgttttgtagaaaatccctaatagtttcagctttggctagattttcagcgaatatttttgaacgaaacttttgtcgcgactcacgtcacgagaaataaaatggaaatgataaattttataagcatgatgcaatttcattaaaaatgggaaaaaccttaatttaattggaaatgttccccctcttcgtcgttctattcaaaaaatatttgtttgtttacattcaattcttattcatttctcacacaaaaatgtattaatcagcgaatgacaccctatttaagtcgtggaattgttattgaaatcggttcagtcggaataaaacatcattcccctgcttgtctactgtttgtcccaatttctattttgccaaaatttttgccgggccgaatttgcatctgtttggtcccgacaagtggtgcaacggccgggaacctctgcactgatgaatg

SEQ ID NO: 107872 - DNA, 621 bp, Heterodera glycines
  Promoter: Source sequence=SeqID_930; Location=1178..1798; Strand=+; Gene=SeqID_64364
tggagactccagcctcaccctgtaactcgaacctaagtccaggcccctttctggtgttggctcgcactggttagggaacacgacagtctcgtataatcccacacgcaccgaaagccctagccctcgtaggcaaaggctgcgttgttggtttcagaactgtgagcaagtggggttcggatggccgagtgtaccaacctgcttgctaacaggtagcatagagtaatatgctagtaagcagggcacgagaaagggccgtaaaggctccggctatgaaggaccttgcgaccatgcgtgtgtctcccacgtgtggattcttgaagccagagtcttgcactgcgcgcaggatggagcctgtgcaactcctccctcgctgatcgcaggagtggaggatcaccactctttttaccttgctagcttggggtaccaccttgagctggggccggccttgctagcttggggtacgaccctttgagctggggctggccttactagcttggcgcgccacccttggagctggggtggcgcaaaatcacttgtatacggtctaaccaatacatttgaaaagcgatcaaaagcgaaatgatatcctgtgatttggaaagagaaaccttaacccaaatg

SEQ ID NO: 107873 - DNA, 1003 bp, Heterodera glycines
  Promoter: Source sequence=SeqID_14716; Location=1468..2470; Strand=-; Gene=SeqID_78843
ttttgggtttttagtccatattttggccattttttggaaattttcacaagaaaaatgaaaaaaaaacgaaaaatacacccctaaagatcaactttttggaaatttttaaaaattacaccccacaaaacacgaaaaatttgagttttcgtcgtcatttttgcattttcaataaatattttcgtcatttttttgcgaacatttcttttttttttaatgagaattttttcgaaatttggcaaacttggaggtgtttttgatacaacgaacaacaataaaaaatatgcatttttaagttttaaaccccattttttggttgtttattgtactttttaggtttatttaagcaaatattaaatatgcacaccttttttgggatttttgggggtttacaacatatattttggcattttttatccatattttggtccatatttggccatttttggcctttttagtccatatttcgggcttttttagtccatatttaatgtccatatttcgcgttttttagtccatataatttacaaccctactaattaaattaatgaaaattttcaaaccaaattttcttcaattatttcaaacaattaatcatttttggactaagtgatcgaatattattagaaattcagatttacgtttcacataacttttttcggcgcgctttttccaaaaaatttttgaggaagaaaggggtccggcggtgccgataggcgccgccgggggaaattttgaaaatttgagtgtaatttgttaacagattttcaacaaaaaaaggctggttttcgggattaataggctcaacaatttgtacggatttccatttaaaaatgataaaatgtgtcaattaaaataaaactatgaataatcatattttgtcgataggaaagccatgaatatacaaaaagaaaattcaaatcgaatcaattaatatctggcaaatctcttgggcaaacatttttaacagaaactgaagaccagactttacactctttgtccaatg

SEQ ID NO: 107874 - DNA, 123 bp, Heterodera glycines
  Promoter: Source sequence=SeqID_216; Location=1..123; Strand=+; Gene =SeqID_77991
cagctttcatttattcattaattttaaagtatttaacaggaaaaatgattaatcaccgcccgtctgaactgaaaatgtatataaatgacaaaggcaaattacaaattgcaaaaaataaaaatg

SEQ ID NO: 107875 - DNA, 157 bp, Heterodera glycines
  Promoter: Source sequence=SeqID_6588; Location=2051..2207; Strand=+; Gene=SeqID_62090
acatattttggttaaaaaaataggagcctgtgaccgtgacgtggagcatcatgtttccaacaacgtgcagtcacttgtccggattcacaaccccaacgaccggctctgccttgcgcgtgccattattttggggatgcatgaccgcgagacgcgaatg

SEQ ID NO: 107876 - DNA, 676 bp, Heterodera glycines
  Promoter: Source sequence=SeqID_7134; Location=1684..2359; Strand=-; Gene=SeqID_63931
tttcctcaaactttggtcaacattttgagcctgaccccaattcttaccatgtacttttggacccggacctaccgggtcgggtatcgggtattggattttccaaaaaccgggtccgggtagtgaaaaaatcgggtatccgggtctgggacccggtcgggtacccggacccggcctaccctacctaaaacctaaaaaaattcaaaaaactattatttattttggcgttttgcccaaattatttaaaaaatgcaataaaaaggaaaaatacacccctaagaatcgacctcaaaaatttctgaaaatacaccccctataaaatgaagaattgctcaaaaatttacaaaattatttatttaaatgacaagaattttggattttaaaaattatttatctcaatattaatttggattaattttgttactttttggttaagattttggattttaaataaatataagccatatttacagtcaagctcaaaatttattgagcaaaaaaaaaatttttttttaattagcttttctcaaaaatgaatggtggtttttgagaagccacgtttcggcaatttttgagggtctgcggaacttcctttgatacccacctatatatgtatgatgtaaaaattatttagatgttatctaagaaaattcctaacgaatgttgggtggctattatg

SEQ ID NO: 107877 - DNA, 134 bp, Heterodera glycines
  Promoter: Source sequence=SeqID_20099; Location=2737..2870; Strand=-; Gene=SeqID_84889
ccatcttccacaaattcctgccctgaatttcaattcgggaatattttatttacatcccgataaatcaaaaattaatgaattatataaatttttatgtttatttaaaatttaaatttttttaattttaaagaatg

SEQ ID NO: 107878 - DNA, 846 bp, Heterodera glycines
  Promoter: Source sequence=SeqID_34925; Location=288..1133; Strand=-; Gene=SeqID_64610
tttttagatttaaaaaaatgtgaaaatttgttttcgacttttggttcgaaatcaggtctggaattcggaattgggttgaaatggatatcagaatcggattctccgaccctgaaaacccctaaaatgacattatctctagaaaaaaaaaactggaaaagtggatctggctaccatcggcactattaccgtaatttttatttgactaactattagtagggatgataaaaatatggatataaaatcgcgaaatatggctataaaataatatggactaaaaatcgcgaaatatggacataaaatggtaaaagctcaaactatggacataaatggcaaaaacgtcaaaatatggatataaatttttcaaaattaagggtatactttctcaaaatttttaccgaaaaatcaacccgaaaagcgaaattttcgtttttttgcttatttttgacataaatttatcaattttaagaattgaaatttatcgaaaaaaataaggacataaaatatggataaaaatgccaaaatatggaaataaatcgcgaaatattaggctcttttgtacacagcggcccaattttgggctccaagtacaaataagtttattatttatttagtaatcagaacgccaaaactttgcaaaacttaaaattttccggggattttcccttgtaaaaatggaagagccgatctcgagttaaaaacataacttcgaaaaaataaacagggattcgatagagggggtcaaaatatgggcctatgcaaaattttaagaaaattggtcaataggaaaatttttttttcaaggacaacaaaatcaaatttatttgcaacatttttagcataaaaatg

SEQ ID NO: 107879 - DNA, 339 bp, Heterodera glycines
  Promoter: Source sequence=SeqID_3619; Location=3842..4180; Strand=-; Gene=SeqID_45591
cgtaaatattatcgttgttttaatttacatttcaaaattctccggcaagtcccgcctcggattttcccaatattcatgttccggagcaaatttacatcatatcttaaaactgataaaaaaacaaaaattattttcaaattataccattcttttgatatttttttttataaatctctttttactttccattcttttgctgcgaaacaaaaattatttaattttattgtgttcaattgcattataaaatgtgcaccttttaccatcccaaaatcttcgccgtttgtggcggacgcgcggggggggggggggggggaaaagcggaaaaatcttcgccggatg

SEQ ID NO: 107880 - DNA, 702 bp, Heterodera glycines
  Promoter: Source sequence=SeqID_9047; Location=379..1080; Strand=-; Gene=SeqID_70100
ggcatttttattaattaaaacggaaattttgtagtgataataatgtgtctcttggtctcgaattccccccccccccgccctatcatttaattttaatagccactcaatgccgcatatatccctagagaatgaatttaaaaaagcaaattgagattgactgttttcaaattctttttgaattattgtctcctcattcagattcattttgtcatctgtgctcaatgtgtgcctttttattgccattttgccgttagttaaacgtatgcacaacagcgattccacggagtctctaatccaacgcggatgaattgatttctttttattcacttccaatttgtataaaccttggccatagctgaagtgtgaaatcgagagtttcggtataggtgctattttttaagaatttgagaccaaaatgcctcaaatggtcatttcttccccggttatgtcctgacaaatcatttatcttttagacactttgattttgcttttgtattttgggctttatccattttgtattaaaggaaaaaaatataaatatacatatgaaattgataaaattacgtttcttttgttttttgttgtttcatgttgtaatatcaaaccattcggtttaactttattttatgtttgtaatgatataattattgaatgtgaaaaattctcaaagaatagttttgatcattgttagctaattggatg

SEQ ID NO: 107881 - DNA, 290 bp, Heterodera glycines
  Promoter: Source sequence=SeqID_17563; Location=2821..3110; Strand=-; Gene=SeqID_82074
aaaatggacagaagagaagagtgaatttgatgaattcaaacaaaaaaaatgagcaaaaaacttaaatttgtcctatttatacttttttaaaaatgactgacaaatttatgaaattttctgcgtatttaagcgatgaattccccacaaaaatcatccattcattcaattgcattcacccattgtttctttccatcggtcgaatcgtcttcctatacaataaataattcccgtcagttttttttctttaattttttaaaatgaactgaattttgtgcccttttttcaggatg

SEQ ID NO: 107882 - DNA, 695 bp, Heterodera glycines
  Promoter: Source sequence=SeqID_2326; Location=1701..2395; Strand=+; Gene=SeqID_79139
agtaattttaaaagcaaaatatgtaattaaaagacaaaattcttgttctgaaaagctaatttagtgaaattcatacacaaacaaaattatctgttcaaacaatgcataatacataggaaatattgtttttattgatcctttactcacccaatcaatatttagacatacattcacccctttttcgacggcaacgggcgctgtgctcgacttttatcgaattttgtattggcccgaaagggatttaaccctgtaatttttgatgcaaatatgcggtctgaatataatgacgcccttaccaatttcactaacaattaatttaatcattgtgtaatttcatttttgccttaattttgatcttattttttgtgttttttgcttgtttaataaaaaagtgattgaaaaacttgttcacattttgaatttgaaataaagttgcttaaatggaggaggaacgcgcaattgccaggtaaaaaagcccgtgacagcccccataaatggttggggatttgaaaaaattgggtcgtattcacgagaatcggttgcacttcatttcgccctcttctaaaaaccgtttttgtgcccataacttattactaaattatttctgctgttttttgtacagtaggcccacgtaaccagcggggaaattcccccccccccccccgcccccgaaatgaaaaaaatttcagaaaatg

SEQ ID NO: 107883 - DNA, 1003 bp, Heterodera glycines
  Promoter: Source sequence=SeqID_14993; Location=371..1373; Strand=-; Gene=SeqID_79148
atttttaattaattaaatttcaattgaaataatgtaaagaaaatatggtgctagcgcgtttgttaaaaactgccacccatgcgcgtttgttaaaactgccaatgggtttgaaaacaaaaaatgggtaaaataattaaattaatagcttggctcaaattcaaccaaattaatatttcgtggtatcattcaatagctttaattgttctctttcagaatataattttcttaaatttttaacttaagtataaaagaagttataaagcattgaacaggctatgttttttgcaatggtaatgcatatataataataaacatttaaaattttaaagtctttaaaatgaaatttaaccaaaattaatttatatttcgatagccctaagaattctctatttatatttaaaattttagaaaatttcattgagtttcaaaaaagttctgaacaaaaaatgctgacttaagattttttgcaattttgtgaccataactttttttatacttaagtaaaaatttttgaaaaatcatattctaatagagtacaattaaggctattgaatgataccacgaaatattaatttggttgaatttgagccaaactattaatttaattattttacccattttttgttttcaaacccattggcagttttaagaaacgcgccagcacgtttcaattgaatgtcccttgcttttagtttaaattgtttgcatttttacagttgggtggaggtaaattttgaaaaaggtagacaagcagagattttcaaggtcaattatcggctgacaacgattatttcacatccatatgtaaaaaataaaaaaatcagagccgagatatttttttatcatctatttttttcattttcctaatttgtagattaaaaatctgaaaaatgcaaaggacaaacgaacaaaattgataatggcagaaaagcttccatcgcttgtggttgaactgaatgaaatcgccaaaaaaattgtaaatacagacacttcggtgaacatg

SEQ ID NO: 107884 - DNA, 91 bp, Heterodera glycines; identical to SEQ ID NO: 100405
  Promoter: Source sequence=SeqID_39690; Location=434..524; Strand=+; Gene=SeqID_68201

SEQ ID NO: 107885 - DNA, 83 bp, Heterodera glycines
  Promoter: Source sequence=SeqID_2060; Location=1681..1763; Strand=-; Gene=SeqID_77587
aagaaaatgccacaaaatttgcctatttacccctccaaaggtgctattggcacgcctgtccacgctgcttccaagatgatatg

SEQ ID NO: 107886 - DNA, 142 bp, Heterodera glycines
  Promoter: Source sequence=SeqID_35097; Location=701..842; Strand=-; Gene=SeqID_64734
cctgagaccattttagtgacaaaaatttggctgtgaagtgcatgacggggcggaaaacagtgcaacaaaatgagaggtaatgagagaaggggtgaaaagcaaaatttgggatgaaaaatagtgctgtaaagtgggaggtatg

SEQ ID NO: 107887 - DNA, 542 bp, Heterodera glycines
  Promoter: Source sequence=SeqID_4128; Location=3421..3962; Strand=-; Gene=SeqID_53291
ggttagaattgaagacaatgtgaccaaaaatgggacagcgaaaccgccgatggccaacggaattgccgcgggaatctgaaatttttggcataaatttaaagaaattcacagcaataaaaagttcacacttttgataaattggcataatgttcgacaatcatttaataatttgggtttttaatatatcttctaatattttgaaaaagtctgcatctgtattttttttactacataggttcaatatcagcaaaacgaaaatttagaattaaatgtgccacaaaacacaaaatgcttattgctaaaaaactgctcaaattgatcatggacaatcaaaaatataacatttgaacaatttaagagtgttttgaatgaattttgtaaaaatgcggctttttgacctaaaatgaggcttttgaaaattttaatctgggagccctgattaaaatgcttaacgattgaaaaatcccgggtcatatttcagcattttaatttgttatctcgggagtttggacccgagcggatcaaattgggcttatggcatg

SEQ ID NO: 107888 - DNA, 908 bp, Heterodera glycines
  Promoter: Source sequence=SeqID_15857; Location=1..908; Strand=+; Gene=SeqID_80187
ttttgtaatttttttttcttatattagttgaatttctgttgacatcaataagtgtgcttagagttgcttttgcacttctcttttatatgcaaccacgcgaaaacgaccctcacgcgaaaacggccacgcgaaaacggccacgcgaaaacgtcctggcccgcccaaacgcgtgagtcccagttgacccatagtgagcattaagcataaaacaaaatgccaactatgtacataaattttaaaattttagtggagaataatttgctttgccaatttttttggattccttcaaatttggaaaagggttcggaattgattgaaagtattatccgcgaaaaattgttacatttcaagaaaaaaattatgaaaatttcgctcaatttggaaaattttaatgcattttttgagtataattggaagcatataaacattaaaaaaaagtgctaaacagttaaatctaaaaaattaatgctcaaaatcctttatttttctcaaaaaaatattttaatcgacgatcaattcaccgaagatactttaattaaaacagtgcaagagcattgattggaaacgcgataacaaacgaatactcaattcacaaccatcttaatgtttgtccacgtgaaagataaaagatacaaaggaaaaatggttccaccataaaaggctatctatttaagtctacgtggccatacattttctcataatttaaatatttaaaagctttttaatttctaaataaacttattcttgaatatactcgagaaaggatagaattcttgtttcctcattatatataatttctttaatgccagtttgcatgatttgacacctaatatgcatttttttttaatatagtcgcgctacaaaattacatttttagattggttttttttaattgaatcaacaaaatg

SEQ ID NO: 107889 - DNA, 160 bp, Heterodera glycines
  Promoter: Source sequence=SeqID_22245; Location=1726..1885; Strand=-; Gene=SeqID_52920
tttttaaaattttctcggtgatagggggtggaagaaactttagtgtgtcaaatgcatttatggttaatttactaaatttccaacatcggaaattcagaaaccggccgacgaaggagaaatttacaatggtgctggacagtgggcgtactgcgacattatg

SEQ ID NO: 107890 - DNA, 236 bp, Heterodera glycines
  Promoter: Source sequence=SeqID_27222; Location=800..1035; Strand=-; Gene=SeqID_57916
ttattattttcaaatttcttatataaattcgcatccctaataataacataatatatattttgaaaatgaactaattctatagaaatattcaatgaaattattgaatttgaaatttaaataaactgatttagactaaatctgattcaaataaaaattctgccgatgcaaacataaacggagcagtcaaaaagatccgttacaacccaaaatacccaatctccaaaattttggcaatg

SEQ ID NO: 107891 - DNA, 155 bp, Heterodera glycines
  Promoter: Source sequence=SeqID_11580; Location=294..448; Strand=+; Gene=SeqID_75021
tgccctccgcgctggaaatttgttagtttttttatagaaaattttcattaagcaaatttattgttttttctttgatggcaccccccgttaaaaaagcgaaaaatgtttcttctgacaaccgccccctcattagtgcaaatcaacagcaatcgatg

SEQ ID NO: 107892 - DNA, 330 bp, Heterodera glycines
  Promoter: Source sequence=SeqID_1815; Location=4272..4601; Strand=-; Gene=SeqID_76147
atcaaatttcatttttccaaacattttcaccatttcacatttccactatctgaatattatgttgaacacatcttttccgctttctataatattattaaataaagagtttagtcaattgaataaagtttattaatgttaattggtcttcaaaaaaggcagtaatcagtatatcttttgaattaacgcgcaaaaatttacgccaaatgcgctatttggcgttatgagcaattttgtctgacactggcgcgtacccatagtgctatttgctttattttcatttcttttttaatttattaatataattaaaacattacagcaatagtcaacatg

SEQ ID NO: 107893 - DNA, 183 bp, Heterodera glycines
  Promoter: Source sequence=SeqID_7530; Location=2223..2405; Strand=-; Gene=SeqID_65131
ttttgcaacaaatgcaaccggcaaggccacattgcgattgtctgccgtcagcgctcgtcgaacacggcacacaaatctcagaaccgatcatttcacacggtcgtggtcaagtcacattgtatggtgattggcacaacccaaggccgatggtggaagatcccggtcacaatcaatggcaagatg

SEQ ID NO: 107894 - DNA, 133 bp, Heterodera glycines
  Promoter: Source sequence=SeqID_16493; Location=1272..1404; Strand=-; Gene=SeqID_80897
ggtaaatttgtagggaaaccttttaaaaattaatttttaatatttacatgaaagttattattaatccctttaatcgtatatatgttttttctgttttttataaaattattatccgattacaggtttggccatg

SEQ ID NO: 107895 - DNA, 219 bp, Heterodera glycines
  misc_feature (96)..(96): n is a, c, g, or t
  misc_feature (149)..(149): n is a, c, g, or t
  Promoter: Source sequence=SeqID_29262; Location=1282..1500; Strand=-; Gene=SeqID_59792
gtaaaattaatacaataaattttatatggttaaataaaattataattagaaaaatgaataagactttttatttttatttttttgttatttcgattngagtattcgacctctaccaattccggtttgaaagaatttataaaaaatcacanagctatagaacttgtcaaaagctatcaaaataaagaaattaaaacattaaaaaaactccatgaacaaatg

SEQ ID NO: 107896 - DNA, 524 bp, Heterodera glycines
  Promoter: Source sequence=SeqID_15219; Location=1..524; Strand=+; Gene=SeqID_79421
aaacgaaatcgttttaaaatattcctttctggacttgacttggtttcttgatatcgaagctgttttctacgctatttctaaaacggttataccaaaccccagatttttgaatccggttttcagaaaaaatgccttgtggtgaaaacaatatttcacatttcactccataactttgtgagttcggcacggatcgagaccgggataagaccattggaaagagcagctcgagctctacaagaaggtatggaaagaaaaaatagttatttctgggactttttcagaaatcagaattaattctccaatgtggcccaaattttaggcccccagccacagccccttgcttctcccagttttaagtcttggatttgtcaaataaattcaagacttcaaattaataatcaaaaattctcttaaaatttttttgaacccaattcaaaaaaggaaaaaaatttgcagtcaaaaaattattcgaatttctccaattttgtttccataatttccgaaagttattcggtatcataatg

SEQ ID NO: 107897 - DNA, 239 bp, Heterodera glycines
  Promoter: Source sequence=SeqID_11442; Location=3107..3345; Strand=-; Gene=SeqID_74842
acgaagcattcagacatcattacaaaatcaaaaaacaacgtggaaagagagaagccagggcttgaagaaaccaaagactcaaaaaccgatgtagcaaagagggccgcagaacgcgccggtagatacgtagaaagacatttcaatcagatcaataatatctcgatttccatccaaacccaaataaacacactacgggaaacaaatcctcaaattttagaagagcctgatataaaaatatg

SEQ ID NO: 107898 - DNA, 223 bp, Heterodera glycines
  Promoter: Source sequence=SeqID_6143; Location=3871..4093; Strand=-; Gene=SeqID_60501
gcaaaaaacttgtggttgtgcatttgtggggagaaaagtgacgaaaaaaggaataatttgcaggagatgtcaatcaaaaaccgaaatgagaaggttattagtcaaatgagcagtagatttgtgtaaaaacttgtccttggtagtattttttggttttgacgtgtcgtttgtgcggttatttaaagcggttgaaagttgttgtgatcatcattcgagcaaaatg

SEQ ID NO: 107899 - DNA, 104 bp, Heterodera glycines
  misc_feature (56)..(56): n is a, c, g, or t
  Promoter: Source sequence=SeqID_27394; Location=1339..1442; Strand=-; Gene=SeqID_58089
gttttctgctgatccgttgtccaattgtgcgtgacgcggacaaatgggcgaaatgngaaaaggaggcgcttggctggcatattcgtgatcagtgcaatcaaatg

SEQ ID NO: 107900 - DNA, 98 bp, Heterodera glycines
  Promoter: Source sequence=SeqID_14129; Location=1..98; Strand=+; Gene= SeqID_78125
tgtccatcactccatcttgtcagttctggtaatgtttttccaatatttccggcggatgacagtgcaaatgcatcggtgggccaagtgttggccaaatg

SEQ ID NO: 107901 - DNA, 186 bp, Heterodera glycines; identical to SEQ ID NO: 105842
  Promoter: Source sequence=SeqID_24124; Location=614..799; Strand=+; Gene=SeqID_54826

SEQ ID NO: 107902 - DNA, 1003 bp, Heterodera glycines
  Promoter: Source sequence=SeqID_7706; Location=991..1993; Strand=-; Gene=SeqID_65687
catttctgtgtataaattaattttttttttttttaatatgtaaaagcttagatttttaggtgaacttttcaaaaaatcgcaattcgaattccctcacaaagtttttgggggttttgaattttcgagaccattttttaattaggcagatcaagctagataaatatatattaattaaaaaacagttaaataaattcacataaaattttttatgaatttatttataattataataaatttttaatgtatttaaaaaaattttacagatacatatttgaaaggggagggtatgaaatattgggaatttcccctcaaaaaaaaagtttttaagcataattttatgctttaagacatatgtaaattatacatttattattattattattattattgtagatttttaatttgaatagttattttttatatttaattattataaagaatcaattgcaacttaaaaaaatgttatattgccaatttctcgatttgaagaggcgcatttacgtgtgtaattttgacaattttctataatattaaatattacgcaattctacccatcgattaattgatggaaattaatgaaaaatattataaaataatttttgttaaagctgtttataaaaatgaatgtccaaatgaagacggaaattgccgaaccacagacattttggggcaaacaatttttttttaatattttctagtaaaaaaatatataaaatttttaatttcttttttgcgaatttgtacaaaattgcatcaattttaaagaataatttattaacgaaaacaaaagtttttatgcaattaacgtgttgttcaactatgcttttatcgggccaggacgttttcgtacgagtggatatgcaaaaaaaaattgcattcaaataatttgttaatttttttaattacttttaatgttttgacagttaagcttttattaactacaaaatgaaccagcagcaagtaattaaaacaaaactaaataatgataaattggtgcatgatg

SEQ ID NO: 107903 - DNA, 525 bp, Heterodera glycines
  Promoter: Source sequence=SeqID_9760; Location=921..1445; Strand=-; Gene=SeqID_72606
tttcgtacacatttaattttctgaaaatataaaagaacgttttaaagtttacaagttttttgttagaaattaaattttaaccctactgatttctgaatgaacaaattaatttcgtatagttaattaagaaaaggaaatcaaaaattaatttgaattatttttttttaaatcgcttatattcttatttttatgtgaaatgaaattgcataatttaaaaccctacaaaacagagtttatcacgtaattcacgaaaaattgaattcaagatttaaagttggcatatttagaaaatagaggcaaaaatgtaaaattctgccctaaaagtacaaaaacattttatttgaaaattattttttctcatttagaaaataaaactttcaaataattaaaaaaaattgagcattaactaaagtttttatgaattttcgagtcgaaaacaagtgaggttttacgaaataaatgaacataaaacttttcaagacaataatttttttaatcatttttttctgttccattctgtagatg

SEQ ID NO: 107904 - DNA, 196 bp, Heterodera glycines
  Promoter: Source sequence=SeqID_7186; Location=3174..3369; Strand=+; Gene=SeqID_64081
cgtatgggagaggcatttttgtgtattttttgtgtgtaaaattggatttgcatccaatttcagcacatcgtccgcctctggtgtccaaccgctgcttttgccgtcctcttcagccggcgccggtgttccttatcaccagtgcgtccgccacggctttgacagttatccttcgtctacgaacgaaacggtggcaatg

SEQ ID NO: 107905 - DNA, 396 bp, Heterodera glycines
  Promoter: Source sequence=SeqID_5758; Location=160..555; Strand=+; Gene=SeqID_59131
tttttgcagattggttgtttgactgtagagaattaaatgagcaaaagaagaagagtgaggaatagaatgaatgtgggcgctatttatgctaaaaaaaaatggcggctaaaatgtgcaggcacgcggagactcctttcgtgttgaaaaaaatccatttcaaaaagtgacgccgtcttactttccctctcacacactctctctcgtccatttctctctgctcccacaaggggtttgcattgtctgcctatgggatgggcgttccctccacattgtctacataaaagggctcacagtcgccccattccgcactttcattcgaaagcaagcggatcgattcacccagagcgttctcttcagcaaaaccttcacttttctccatattttgttaacaaaatg

SEQ ID NO: 107906 - DNA, 779 bp, Heterodera glycines
  Promoter: Source sequence=SeqID_12689; Location=1460..2238; Strand=-; Gene=SeqID_76367
ctttggaactcagcaaagtggatgtcaagttcctgatctagtggtcccatagaccctaaaaaacatttttacaggcaagtggatctgaacccatggcccaaaaaaaccatttgcttccatctatgatcccgaattccaaaatcagtttatttttgtacttttttcaaaagtcttataaaaatatagaataaacagaagcttatagaggaagaatttcgtgtttttcaaaaaaccttttcagaacagcgctattaattttttttctcaaaaaacgaatttttccaaaatttatgtaataacttcttcattttgaagatagaaaattctaaaaaagtataaaatgctccagatttttctctatttttaatgcttttttgcactttaattgattcatttagaagtgaattatgaattttcaaacattcgcctaaatttccaagggccaaaaaatgaaaaatcttttcaattcaaaaatttagattaagatttaaattgtaccattatgcagaaagcaaaaaattttaagaatttatatagggaaagaggttgaacaataaaagccccccctcgattggaagcccccccctcgaatataagccccctttggaggggggttgaacaatagacgccccggggcttataatcgaggaaatacggtagatgaagcaaaggttttaaaggggaggcgcgaacgccgtccccagcactcaaaaatttagctgtgggcctatcccagttcgggaccgccctgcgggtcagccccgaccgaaagtgcaatg

SEQ ID NO: 107907 - DNA, 355 bp, Heterodera glycines
  Promoter: Source sequence=SeqID_19945; Location=1..355; Strand=+; Gene=SeqID_84711
cagcaaaagacggaggacggagccaagccgacgagggtttgtattttgagaatgaaattggcattggcactcaaatttggattcaaacgcaaaatcttctggcatttcattcgcttttcttatctcaacacagaatgccgcgcctcgccgtgtccgtctgtttttccatcgtgccgacgatgacgatgacgaccattctggcggcggcagtggtggttgttcgcattgcctcaatcgatggcacaccgacaacagaaacagcgtccgctcctgtcgctgtaccggcaccgaccaccacttctctctgctcaaccgtcccgttgggctgcaggacgcacacgcggacgagcgaatg

SEQ ID NO: 107908 - DNA, 100 bp, Heterodera glycines
  Promoter: Source sequence=SeqID_39937; Location=157..256; Strand=+; Gene=SeqID_68390
tcgctacggtaccgtttccccgttttagacctccacagtaataattgactacgatacctcccccccccccccccgttaagcgtactgtaagccattcatg

SEQ ID NO: 107909 - DNA, 926 bp, Heterodera glycines
  Promoter: Source sequence=SeqID_19117; Location=687..1612; Strand=+; Gene=SeqID_83857
ataccaaaaaataattttattttgttttttaataattctaattcgttaaagaatcaaataaatttttatttgtctccaacggattattatggtaaaactttaagaaattgttaggcattttgataataaattggttggatttgtgggttgggaggcgttctttatgaatttcttatccttacgaatataatgaatgcattttgcaagaaatagatgataattgtgacatttttcaaagtttttatcagtttattttatttgtttcttttatttctttaggagattcagttaaatttcggaatttaaattcattaatttttggtgttaaattgaaaatagtaaaaaaagaataaaatatttaattgattaaaagatatgacttataaaaatgcccaaagttttctcttttgaatggtaatgcaattaacacacaaatattgagccttttaaaaaaaattaacagacaaaaaaatttctctggtcaataggtttttttaggaaatgaataaataattgcatctttttcttaacaatgtttattcgttgttgaatttgaccatttcaatggaattgagctcactgtgtcgctttgtccagtcacgcaataaataaaacaaatgacacaattaactcattttgaggggttcacttgccttttttgaataaatttatttttttcaccggtttttatttttagaaccattattaaaaaaaattcaactttaatttaattaaaaatgccaaatttgtataaatttcaaaattaaaaacaccaaaacagtggctaaaaatataggtgtttttaagaatcccaaatatttttggtttttgacaaaaaatccttccagaaaactcaaacttttttgaacattgttgtatagttttttgaaattttaaaaagtcatctttagtgggtgaaaaaaatg

SEQ ID NO: 107910 - DNA, 114 bp, Heterodera glycines
  Promoter: Source sequence=SeqID_12103; Location=1..114; Strand=+; Gene=SeqID_75663
gaaattcgccccctccaacttctccccccccccccacctcttacgatcgacaagagagcccccccccctatctatccccttgcacaggtatggcgtaaattgcagaaacaaatg

SEQ ID NO: 107911 - DNA, 253 bp, Heterodera glycines
  Promoter: Source sequence=SeqID_41110; Location=1..253; Strand=+; Gene=SeqID_69305
aaaaggcaatattatgaataaataaaagataaaaaggaaaaaattacgaatattcaaatattttattatcttttgcccatcgcattttctcccatttttggtcatcgttttgccgtaaattttttactttttggcctataaatatgtgcacaattcagtcactgcaatagaactgaccatcatttgttctttctttttttctaaattcattaaataaattaaaactgaaaattttagatttaaaattaaaatg

SEQ ID NO: 107912 - DNA, 149 bp, Heterodera glycines
  Promoter: Source sequence=SeqID_11707; Location=1..149; Strand=+; Gene=SeqID_75196
atcttcaaagcataaccgatcattgttttatttttgatcatttttctattggttatccgatgattcagtgatcaatgaaaatgatcactcatcactgaatttccaattcattcgattctttatttgttcaggtggtggtcgagcggatg

SEQ ID NO: 107913 - DNA, 717 bp, Heterodera glycines
  misc_feature (55)..(55): n is a, c, g, or t
  misc_feature (85)..(85): n is a, c, g, or t
  Promoter: Source sequence=SeqID_18171; Location=1..717; Strand=+; Gene=SeqID_82753
accgttgtcagcttgaaattgtgtgagaagtgcacgaccgacaactgttgtgcanccgatatttcttgtcattcaagccaaaganatagaccaagtgatggaagtcgaaaatacgatctttgattttttaataataatgataagttcgataattataatgataaattcggtatttcaatatttgtaatgataatttcgataattataatgataatttcgatattaattgtatgcagctaattgataaatgttttttttataaaatcttttttatttggtcatctcgcaacttctcgcccctaatctccattacctcccaaaccccctaaaaaaaaggcaaaattttgttttgtttgcatagcaacaaaaaaaatgccgagcgcggaagcaatttgaccttttgctcattccttacttgatttaacggctccgcactgcaagggatgtgcttattcattgccttgttggggtaattggcggtagcctaaaagaaattgcccttccaacagttcaagcactttaatcgtcccaatattcccccctaaatgcacaacggagaaatatgagatgtggcgtaaaatgttatggactgttggtgggcgggattaagatcgtcatttattctgtgagccccttttggcatcttcctttttccctttttttacctgctttatattttttaatttttttagcaataaaattaattctgaaaacatg

SEQ ID NO: 107914 - DNA, 188 bp, Heterodera glycines
  Promoter: Source sequence=SeqID_27537; Location=1..188; Strand=+; Gene=SeqID_58235
tccctcatgaagaggaggccgatcggaatcggacaaagccgttaggctctccaccgccacggaagagagacagaagagatgtgaacaacaccactcctccccaatcccccgtgctgtttgatgagcacggaaagcgactcgggtctcccccgttgtacgatccgaatgctggcgaagagcaacacatg

SEQ ID NO: 107915 - DNA, 67 bp, Heterodera glycines
  Promoter: Source sequence=SeqID_21641; Location=1..67; Strand=+; Gene= SeqID_52239
ctttcttcggaaaagatttctgattgttgtggactcatattcgaagtacccggaggtattcgaaatg

SEQ ID NO: 107916 - DNA, 1003 bp, Heterodera glycines
  Promoter: Source sequence=SeqID_14383; Location=111..1113; Strand=+; Gene=SeqID_78418
aaagaaatgattattagttgacaagaagtcagttggcgaaatgtaggcgaaatgaatgtttttggcttagttagcgaaatgtagttgtgccgtcgttctcgcacgaaaataggcaaaaaaagaagcatttttcggcactttttaactttcaacttattattctcaattcaccatcaattcgaattcgactttcttttagattattctagagtgcaacgagaccgggaatttttgcaaaaaccgggaccgggacttgccgggaccaaccgggaatttaaaaattcaaaaaaattcaaaaattttttaaaaattcaaattttaatttttttcaactgaaaataatacaaaattaaatttttattttgttttttatttaataaaatccaaaagttaaagctaaattaaattaatgaaaattttcaaacacatttctttaattatttcaaacaattaatcattttttaactcaaatgatcgaatattattagaaattcagatttgcttttcacatcactttttttcggcgcgctttttccgaaaaacttttcgtgaagaagggggtccggcggtgccgatagtcgttgccgggggaaattttgaaatttgggtgtaatttgttaacagattttcaacaaaaaaggttggtttttgggattattaagctcaattggtaggattttcatttagaaaaatgataaaatatgtatcaatttaaaaaaactatgaggaatcatattttgtcgataggaaacccatgagtatacaaaaacaaaattcaaaatatcttaatttctgtagagggactgaaccaggggaaagaagaacccaaaaatccgagaaaattcagtaatggtaatcggatttcagagaccgaaaaaaccggaaatccggtaaaataaggataaatacacattccaaaattaaaaaagaatgccattgtaatcaaatctgctgcattcaggtgctgcaatttcgccgccgtcgtcggcgtcgcaagcgaatg

SEQ ID NO: 107917 - DNA, 75 bp, Heterodera glycines
  Promoter: Source sequence=SeqID_12875; Location=1..75; Strand=+; Gene= SeqID_76609
attaaaaaaaaaataataataataataaataattgtggtgaaaattaatatggaaatgggcaggaacgtgttatg

SEQ ID NO: 107918 - DNA, 856 bp, Heterodera glycines
  Promoter: Source sequence=SeqID_12034; Location=1219..2074; Strand=-; Gene=SeqID_75562
tttttggaacttttgataatttggacttttttctaattctgcgttcaaaattagggtataaaaattgttgaatttgagcacttattctatcctcccccccccccccccttcagagtgccgtcctcactcagcaaaatcggtgggccaatttcgccactttcgcctcgcgcggcagagggcgtcagggcatttgatgagagcgacggaagagagagaaagagaccaaatttataaccatttttttgaatttgttttgttgtgtcttctctatttttctttttgcttaaaacacacacacagcgtcatgacggaacgccacaacatttacaatttggggtgaatttttcacttggaaaactctggatttaggggcgtgggtgtttctcgaaacttccccaattaaaattgttttcacgaagctttgaagcaccaactggacgtaaagatgatgggcactttcgtctaaccctccctccctttttgtgcactatttcgttcaaaattggaccacatttttttttttttttttttttaattaaaatgtaaacaaatatacagtcatggtcatatgtttaggaacacctcttttttttgaataaattctttgaaaatattgcttctctggattgaaagaaaaataatcaataatctttttaatgcattttgtagcattttttctgggctatccattggtaccacacattcctcgtttgctttattcctttttgtaaaaatttgtgttttcttccatatagtcaaatttcggggtggtcatatgtttaggaacactacccatattttttttcatcagcattaaaaaaatctaaaaaaattcaggtaagcataactttggatg

SEQ ID NO: 107919 - DNA, 598 bp, Heterodera glycines
  Promoter: Source sequence=SeqID_21264; Location=854..1451; Strand=-; Gene=SeqID_51859
ggggggggaaggagggaagggataggtgaacggaggagagaatgggcagaaaaggggagaaatggattggtgaatgggaagagaaattgttcattctgctcattctattcatcgcctgttaaccagtcgatcaaccaaagcagagcgatcgcaagacagtgcatgagtaagtcagtcaatcagcaccaccctcatcattcacatccattcattccttcttcattcatgaattccccatcaataaatgcatggactgagaaggggtgaaaagggaggggcggcgggggggggcggaggaggaagagaagattctttggggcaacaaattaattaatgtgtattgtatactgaggttggaatttaatgtcgaaaaaaccagattacctaccttatgcttatgtttgtacatatgtgtgagctatgaaattgataacccgttaacaattaggtgaaataatacgcgacagaagaaaaagagaagggaaagcgaaattaaaaggaaaaatggatgagaaattattaagttcattacaatttagagcaaaatgaatgtgaaaataatgagttccgtttaggtaatttgtttgattcaacgatg

SEQ ID NO: 107920 - DNA, 145 bp, Heterodera glycines
  Promoter: Source sequence=SeqID_27709; Location=1064..1208; Strand=-; Gene=SeqID_58376
caaatttacccctttttgctcagttattgttttttctcttgttgattttaccagaggaaaattatgataaggccgtggtccgagggtcatcgatgtgtgccattgcctcctgacgtccaagccacgggcatcctaccaaaggatg

SEQ ID NO: 107921 - DNA, 1003 bp, Heterodera glycines
  Promoter: Source sequence=SeqID_1974; Location=3944..4946; Strand=-; Gene=SeqID_77118
aaataaaatatttataagattactaaatttttacgagtattatgacaaaattcccacaacttttatcataaattttttgatttaaattattttggcaaatgccaaaaactcaccatcctgcttcccagggacaagcctaagtgcaatacataatcataaattaacggcacacttttaaggggcaaaaaataacgatcagaaaagcggttaaaaatactaataaatcataattaaacaatgcataggtattatttacaatttttagggatgacattttaggtaaattcctaagatttgtgttcggcttgtaaaacgtgattttagtttggttttattgattgagaaattttctcaaaaattcatcccaaaatgttttttttggtttgaccaaaaatttttaaaaattgtccttattaaaaaaaatcttctaaatattaaatactttatttacaattataactaaattaagtttatgtgtgtttttgcaaccaaaaagttttcataaaaattttgctttttatgtcaattcaaagatttttgtgcctatttaatgttttgtgactttttttttttgcctttttaggtgccttttttgcattttttatgcctaaaatgtcatctttatttacattatcaatgattaatttatttttgctccaaaacattaatatttccgggggcatctatctttggcactttttaaaattttcctatagcgaacagcaaaaaaagggactccacttttggctctatccgaattttatcagctgtgatcagcattattagttccattgattacatctgtttgttcttgtgatattccgtgctcatccacttcggtatgtgctgattgcccaaatagttggcggtcagcaaaccggcacaaaattaagggcgacatacagcagatgcaatttctgcttttattcgtgaaagcttgaacgaatttaaaatttcggaggacaaaatctcagcaataacacgcgacactgaaaatacaatg

SEQ ID NO: 107922 - DNA, 209 bp, Heterodera glycines
  Promoter: Source sequence=SeqID_1057; Location=574..782; Strand=+; Gene=SeqID_67027
tttttgtagtggcggatggaaattacgcccctttcaatttgtacgacggcggcgaattccaacctccgccgctgccggtgccctttcagccgagtgggtttcttttttgcattgaattcggttgcttcgcttcttcagacgttccgccgcctttcgcttttccgccgaacgatccgcgcttttaccgacaccacggcggatataatatg

SEQ ID NO: 107923 - DNA, 1003 bp, Heterodera glycines
  Promoter: Source sequence=SeqID_11918; Location=2081..3083; Strand=+; Gene=SeqID_75430
ttcaaaaaagttgaccaagttcgaacaattatgtaccattcgttacgtacagacatcatataagcattttctattcactttatgccagaaaaaagtcattaaacacaaaatttttgtgggcaaaaaaatacgaaaatctgagtaaattcgaaaaaaaatccctagtgggctggaaaaaatttttcgtagaagtagggccattttgtagagaattttgtgctctttctgaccatcatatttgtcttctacgaaaaatttttacggctgatatggaaatggctggtatggaaacggcggtatggaaatggcggtatggaaacggcggtatggaaatggcggtatggaaacggcagtatggaaatgggtcgatcccaaaatagtgattactagtgatgaatagtggcgttaaaacgaagaatttccgagctaaaaatgttttcgtgcatttcagtcgaaacaaagccgcagaaaaaataattaaaaaactaaaaatccgttccctactaatcacactgtaaggccgcgaatggaaagactgattcttgagaccgttttgttttcatgactttcgaacaaaacttttctcccaaaaaagtggggagcataggcagtatttttcgacttcagggtttgaaattggtgcaaatgaatgtcaattcgtgatcagcagctatcctgaaaacccttgagggtaatactatcgatggtgccccccccatttttggaagaatttttttttgttctgaaatgtcgtggaaacatatttacggggggttttcagggtcgatcgatgatcgcgaatctgacatccattttgccctatttcaaagaaaattcaaaattttgaaaattcacttttagttcaccctctaaatccactccctagttcactaagttattgctcatgaactgtacataaatgttgaagaattttttaagtcattgaattcacagcctttcttccatctctcttttattatttcgcgaatttttgtgtgaaatg

SEQ ID NO: 107924 - DNA, 246 bp, Heterodera glycines
  Promoter: Source sequence=SeqID_551; Location=1..246; Strand=+; Gene =SeqID_56035
acatagcacccatattagggttgcgacccggccccgaccccgaaccccgacttttttggccattttcggggtaaaccccgacccccgacgcttccaaccccgaacccgaattttccaaccccgacgtcggggtcgcaaccctaatacatatgatccaaaaaatgatgacaatttgttttttgttttaccaattttgtttatttgttagtcattttccgtgccaccacttccgtcagttacaatatg

SEQ ID NO: 107925 - DNA, 161 bp, Heterodera glycines
  Promoter: Source sequence=SeqID_5621; Location=1008..1168; Strand=+; Gene=SeqID_58672
ttgggcttttgccaatttagtcagtcattgtgccaatgattcagttcccaatttggttccattgccctcgaccaaatttggcatccgtcgaattgtctctgtgttcccacggcggcggattgactggcgtatcgcctctgtcccttcaacttccaacaatg

SEQ ID NO: 107926 - DNA, 176 bp, Heterodera glycines
  Promoter: Source sequence=SeqID_5394; Location=3600..3775; Strand=+; Gene=SeqID_57876
aatttttttttaatttgacattggcctccactactttctctaaattttgtgaagaatttgcagttttcagtcttattttgtaattttaaaatttgtgtatgtaaagtattttgttggacgcaaatgtggaatacctacctggaaaagaataccgtttcaacacctaggcacaaatg

SEQ ID NO: 107927 - DNA, 550 bp, Heterodera glycines
  Promoter: Source sequence=SeqID_10712; Location=684..1233; Strand=-; Gene=SeqID_73964
ttgattccaggtcagaaactcaaaaaaaagttcatcccttctctctgaattacccctttaaaattgggggagcagcaatcctgatgatttttgagcaccttttgatcattttactagaattaaggtgtgccaaatttttccaaaaagctaactactaattgataaaattgaaaataaaaacttagggaaaacttttcggtgctttaattgcgaaaaaatgacttttccaatcaaaagcgtttcttattttcaaaatgtgtcctggtttttcatgtttgtcctggggcaaagcatttcaatttcattattttgttgtaattaatgaaattttctgcctgtccaaattttttatatttgtacagatatttgtaatcgatccgaaggcaataattttctgaatttcttcattttatacaacaaaaatttgttccgtaatcaaattgtataaattaaaagagtttttattgttcaattgaaaatgaaattatgtcttttattatttttaattattttaattgccgaaaaaattggaacagaaaagaaaaaaatg

SEQ ID NO: 107928 - DNA, 908 bp, Heterodera glycines
  Promoter: Source sequence=SeqID_3492; Location=519..1426; Strand=-; Gene=SeqID_84887
acatgaaaaagtatcggcaaaatggaaagaaaaagaaatacaagatttccatcgctccatatccgtttcgccgattcaaaaaatcgcaatgcgaaccccgcagatcccgcacaaaacagatttgcggataccactacgggatcgaaactcaaaatttttcgcggaactcggatctcgcgggattaatcccgcaatttccaaaaatgcgtggtaatagtgccgactttacattaaaaaaaattcaagaatttgtttctcgaaataaagtctttaggggttttcagagtcggagaatccgattctgataaccatttcgacccaattcagaaccccggacccgatttcgaacaaagtcgaaatttcaaatttttcgagcttctcatcataaagccctttatgatgttttttaaataacgacatagcacccattgaaatcacttataagtagcgaaagagaaagagattaaaagagagagagagagggtggggaagagaaaaagttgaacatttaaaaaagtttttttgacaattctgaattaatttttggtctttaggaatgtgtttcttgaaaattttgctctttggatttttcgaattttcttgtgacaagccgaaatatgtatgaataaaaagtgacagatggaaaatacggaaaatatggaaatccatttcaaatccaatctccaataaatcgaaaaaaattggccaaaaaataaatgttctctcgtcacgggtgacgacaacaacaatttaatactaaaattgatttttcttataaaatgcaatttccttgccatctttaataatttttttattactaatgcaaaggaatattatgtaaatatattaattaataattttatttaaataatttatattttccgattttcttttaggtcacagagatg

SEQ ID NO: 107929 - DNA, 949 bp, Heterodera glycines
  Promoter: Source sequence=SeqID_13772; Location=1922..2870; Strand=-; Gene=SeqID_77697
ccttttaacactttcaattttcccatttaaagaaaggaattttttatatttctaagttttccagggaaaaccaaagatcagtggggcagatcaaagaacacccgccgctgatcatgatcattgaattgagcaaatgtatgatcaaaaatttcaaactcctttttaaaatatagcccgattgaaattttctaaagctaatttagccaaatgaaatcgtttagtagtgatctgatcaatgaattttgatcattcttgaacccaaaaataggccactgattggacgcctaaattggaacatagccaaaaattttccctataccctgatcattgatcaaacgctgatccggcattttcctatttttagagactgaatttgtcaggcaccaatttgtccattatatttttattgccttaaaatgtgaccaaaaattaaaacaaatatttgtggggggggggggggggggagagggactccccgccgccgccggagggattccccgaaatgaattctccgatttttgtctcttttgtgataagagcggaaaaacaaaatttggctgaacatattggacagaattttataaaaatgcagcaaaatttttgcatctttggtcattttagcaaatgcaaacaaagaaattggaaaaggaagaaaataaaacaaatatttgaaattaaagtaattctcaacatgaaataccgtatattattttaagagattcaatgaaagtttaaaataaccctctatggcattatgttcttatgacaaataaatttttaaaaataaaccaaagaaaaaaaataaattttgcgttggctctttggctttaacacttttacttaattgatgcttttgttggcttatttatgatttatacgcttaaaagtttgcttattttattacttaaaattaatttttattaattccacattttagctttaatgtatg

SEQ ID NO: 107930 - DNA, 166 bp, Heterodera glycines
  Promoter: Source sequence=SeqID_6874; Location=1613..1778; Strand=-; Gene=SeqID_63173
agcggaaatgaggcaaaacaaaaacaaacattaattaattaaggaaaattaattaattagggggtggaattttttacgtctcaggcgcaatttcagcaaaaattgctggacgcaattcggcaggtggactttgccgatttggcagaacatccggtggtgaaaaatg

SEQ ID NO: 107931 - DNA, 396 bp, Heterodera glycines
  Promoter: Source sequence=SeqID_5758; Location=158..553; Strand=-; Gene=SeqID_59132
ttttgttaacaaaatatggagaaaagtgaaggttttgctgaagagaacgctctgggtgaatcgatccgcttgctttcgaatgaaagtgcggaatggggcgactgtgagcccttttatgtagacaatgtggagggaacgcccatcccataggcagacaatgcaaaccccttgtgggagcagagagaaatggacgagagagagtgtgtgagagggaaagtaagacggcgtcactttttgaaatggatttttttcaacacgaaaggagtctccgcgtgcctgcacattttagccgccatttttttttagcataaatagcgcccacattcattctattcctcactcttcttcttttgctcatttaattctctacagtcaaacaaccaatctgcaaaaatg

SEQ ID NO: 107932 - DNA, 98 bp, Heterodera glycines
  Promoter: Source sequence=SeqID_18594; Location=1..98; Strand=+; Gene= SeqID_83227
atgctcctcttcacgatttttttgaatgccaaagaatcgtttaaatccaaatttacaggacaaaaaaaatcaatatcctacccctgtctctaataatg

SEQ ID NO: 107933 - DNA, 836 bp, Heterodera glycines
  misc_feature (99)..(99): n is a, c, g, or t
  Promoter: Source sequence=SeqID_20357; Location=1269..2104; Strand=-; Gene=SeqID_50879
gcatagctaactcagatttccaatcttccatcggacgcgaagaagaaaccgcagctgacattcaggtcgaaattgaataaaaaacaaatagaattcctntaaaactcatttttatattcaaaggacttgcagacttgtttttaaatacttgaaaatgaattgaaagtatccaatattcacactcaatttgcttattgtttaatagtttagaggataaataaagatgtggccaattcttattcttatattgatatatgacgtctcgatgcggagtgatatatacaatttaaaggggccggcgagctatagacccgggactgaagtgaccaagaataggagtaagctagaacctataaacgaagaaaaggcgaggacggtactggacaaaaattttcgtcccttccccttttggacacgttcaataatgatttttaatagagcattttttaaaattcgatacaatgacaccagatttaaaaaaggaaattatgcatcgaaaaagttttctataaatagaaaacgaagggataaatattttagagatataaaaaaaaaaagggaagtgtgtctcattttttatataaaaataaaaataaaacgccatgccaaactatggaaagaaaagttcttcaaatatatttcaaattctcgaaaaatgtttatttacctaattgtaagttaagtatttttctcgcctataaaaataatttattaaaaaagaatttgtaagctgaaaattttttttccgaaatacatcctagaaggtccaaaccaagttaaaatattatttacttgatttttacgccgaaataagtgtgcgttctagatgaaaaatg

SEQ ID NO: 107934 - DNA, 397 bp, Heterodera glycines
  Promoter: Source sequence=SeqID_10085; Location=3276..3672; Strand=+; Gene=SeqID_73152
atgggcgatttcgtcaatagcattcaagcggcgacaagcaatatgcaatagcaaaaaaagcgcaaaactcgctctgccctatatataaaagttgttgattgctgcacgatttgtcataatttttgaaaatgttaaattctcaatcgttcagtaataaagatatttgtttcaaattgccttgcggtataattatttccgggccatcctcgtcgggcaaaacggaattcctactaaaatttattgctgagtgcaatgaactgatcgcacccagtcccatctcaattctgtactgttttggtgaaatgaattcggcggttccgctactgcaaaagcgggagttgaggtgtattcgggcgtgccctcggaggagctgattaggcgccttcccaaaccgatg

SEQ ID NO: 107935 - DNA, 554 bp, Heterodera glycines
  Promoter: Source sequence=SeqID_6256; Location=872..1425; Strand=-; Gene=SeqID_46216
ttttctgaaaaacatttagaggacaataaccaatcaaaatataatcatataaagttgaaaatgaaagtaagaaaccaactataaggaatttaaaagttcgaaccataaacacccgaaatttcgaacaataaccgaaattctaaaaaaacagtgcaccgaacgcgtttttttcaaacaatgacaaatgaaagtaggaaattaatggcgtcaaagaaaatacagtatccttagacagtcacttgtaaggaaatcacaagaaaaatgaaaatagcgaaggaaaaacatgaaaataaaggagaaaatagtgtgaagaaaagaaagaaacattttagaaatgcgcatcttttcaagcgctattttaaaaaaattacaaaatccctaaacctaatataatatttcatactgtaattgtggtttttattcggtaaaataataccgcgtgttaagctcaattacgttcaaattgtaaatactattccttcctttgtgtttattttatgcatttctactattgtcatttaattaggtagattttctgtcttttctttccgatg

SEQ ID NO: 107936 - DNA, 403 bp, Heterodera glycines
  Promoter: Source sequence=SeqID_1577; Location=3975..4377; Strand=-; Gene=SeqID_74587
atgtatttaaagtgatttattatttatattttataattttttaaaatgtttattctatatactttatttttgataaatttttcttcgagttataatagccctattctctaccctgaacgatccagggacaccgaaatgactgacatttattataaaatagcctcctttgaccattcctacttgaataaaattaatcaatctgaattattctcaatgattgatgaaattgttgaaaagtttcaactttgtaatgttgaagaaacgaggtcattatcgagatgggtatactgtatgcttttggttttgttgtggatagctattgttatgacaggaattttcctctattttaattcattaattagaaatttatgtaagcttatgcatatatgtagagacgaaaatg

SEQ ID NO: 107937 - DNA, 218 bp, Heterodera glycines
  Promoter: Source sequence=SeqID_2425; Location=1..218; Strand=+; Gene= SeqID_79661
cccccccccccccctcccaagggaatttttggacttttttgaaaaaggcttagaataaaaatagtctaagccttaaattgtcattttaagccctttcaaaatctttttttgctgatgttgctttaattttaattttttgttttattgtgctgacgagttcctttttctgccaattaattcctttctcgtgccatttacagattctgcatatttctatg

SEQ ID NO: 107938 - DNA, 1003 bp, Heterodera glycines
  Promoter: Source sequence=SeqID_2669; Location=3122..4124; Strand=-; Gene=SeqID_80974
ttcttcaacgacacagaattctaagaacgaaaatgagaaattcagcctattaaagtgcttttcttatgaatttgtcattaaaaacaggtgttacgaaaaattctcgacattttggcttttttaaatctatattatctatgcaaaattgatatgatgatacaatgcaattgctccaacaaattgcaggatttacgcttgctttttcgttgctctcatagtgtgcattgaaaaggattattttttgtttagtaatcatcatttttatttctgagtgcgtctcaatttcaataaaatttttgtaaggtcccaaatgcttaatgcgcaatttaatccccgaccattggctttacatccatttcagcaagaaaaaaaattaactgtcattaattttgtgagaaatgcgtcaacagcactttgcctcgttctgaaaattttgtgacaaatttcattaacgcaatttgtctgagtttaatcatcactttcatcgttattatcatcccttcctctgttcattagggcaaattggcaccgccgcttcatctttttctgaaagccttcggctgtctgtcctcatttaagcagaaatttttctttaacgagtgccatttatccttccattctgtctcaaatccctccccactccctcccccgggtgctttgcccttcagcggattatctcctcttctcccgaagagaaaaatcatgtgagtgtgccaatgtaatataaaaaaatatactttatagtgcacacaaggatttcagttgattgaatgttggcattctgtgggaacttggcacattgcattccccgccccctccctctatcagtccgcatgaaatttaagcccgccagggaatataagccacggaaaattgtcctttttggcataacgttttttcttgcaactaaaactaatttttggccacattttcagctccctacaaaagtttttcctactccgacatttatctttttaaaaagcatttggccaaattcaaaatg

SEQ ID NO: 107939 - DNA, 199 bp, Heterodera glycines
  misc_feature (18)..(18): n is a, c, g, or t
  Promoter: Source sequence=SeqID_10664; Location=1..199; Strand=+; Gene=SeqID_73905
catcattctctgactgtncattcccttgtctcctctcattttcccaccctctctcgccgtctctctttttctatctactcctcgcaccgttaatgggactaatgaaataccttcaaacttttaattgagtcttttgccactttactttattggcattgatggattttgttgaatgcttacaatttcaggtttccaaatg

SEQ ID NO: 107940 - DNA, 723 bp, Heterodera glycines
  Promoter: Source sequence=SeqID_19899; Location=1509..2231; Strand=-; Gene=SeqID_84660
attccctgaaaagtccgatcaccactctttgtccgatttttcgagcacaaaatcactgtctgacgcttttcctatatacttttttttgcttcttttcgcctttacctcgcaatgctttttctgttctttctacgctttgctaattatttaaatttttaaattttcgcatttaattcctataatttttttaaaaaatgagaaaatccttttttctttttgtataatcgtgcacttttttgtgtcacattttcacagaattttccttcccgccgctcaaactttcaatttttccctttctttttcctatacaaaaagctgttgttgtttctgttttttttgttgtattttcagataggattatggtattttgttcatccgatggattactgtgcattcacaaaattcaaatagtcgcattattttaaaaaaatatataaatttaatttatgaagatatttaattgtcctaccttttcaaaatatcactcaactaatataatattctcttctgtttttgtacgcataaattgagaattgaaaatatatttatttattttatgggcgaataaatgcgaattttttttgtgtgcctaaatttttctttccttaaatataaaatggtaactaacaaattcaaatattcttatttcttactgtttaaatatttaataattttttaaaaataaaacaatttttcggttttgcaaattaaattctgccgatg

SEQ ID NO: 107941 - DNA, 405 bp, Heterodera glycines
  Promoter: Source sequence=SeqID_8103; Location=1..405; Strand=+; Gene= SeqID_66986
ttaaatacggtaatggttagagcccggacataaactgcattttctttcgtcctaaggttcttgtttttgcccgcgcttacatttatttcttagccattattttagaggaattcgttcgtttaattaaaattttaaacccctttgatgaaacttcgtccttttcattgtgtttgcttgatcaataaaatgaaatttgctatataaatgcacatttaatttgcttttatctcgcgtttatttttcgctcaattcctttattggatttgtatatttacgtctttcaaattcaatatttttaaggctaattggccatttgttgtattttggacagttttttgatttttacttcagaaaagtgctgaatcatatcacttgaagctcataccgaatttttgctcacaaatg

SEQ ID NO: 107942 - DNA, 91 bp, Heterodera glycines
  Promoter: Source sequence=SeqID_44183; Location=757..847; Strand=+; Gene=SeqID_71713
ttgcttgtgggtgaattaattggaattaaatggtatcatgggtttagaccccggcccctgaggctgggtaattttaaattacagatatatg

SEQ ID NO: 107943 - DNA, 80 bp, Heterodera glycines
  Promoter: Source sequence=SeqID_10932; Location=1..80; Strand=+; Gene= SeqID_74239
cggcggctgccgaacagcaccagcgtttggccaccgactttcgcgagttggccgaggaccggggacgcattgaacagatg

SEQ ID NO: 107944 - DNA, 630 bp, Heterodera glycines
  Promoter: Source sequence=SeqID_15639; Location=1..630; Strand=+; Gene=SeqID_79937
ccaactcatccacagcttgtttcttatacgataattagtgacattttcgtgcatggacaaattaagaatggatgatgagttttctatttattatatggatatatttggttttgatggatttatgctacataattaaattttaccataaaatctgatgagtcatcatgcggatttagacaatacacaaaatataacaaacgtttcacagagcaaacaaagaaagaaccgagaatgttattaaattaagtttggtttcagccaattctaataagagtgcaatttatcaaatcttagtataagaaaaagacagtggtaaacaaactgatcgcttttgcggattactacaaatatttaattttagcccaaaaatacaaaattattcaaaaaatcccaacaaattaataaatctggaattaattttggataggaacgaattataatacagcgttcatattttggcttaactttcgagttattcttacgatgtatttactgatcaattcgatttttcgggatcagcagggctcactttagatgaattttaatatatttaacgctcagtccataattttttttattgatttataatattaatttttacgattaaatattggaaatataccgaaaatg

SEQ ID NO: 107945 - DNA, 664 bp, Heterodera glycines
  Promoter: Source sequence=SeqID_260; Location=1..664; Strand=+; Gene =SeqID_80139
ttgtcattttccaatttcaacagataagtagcataccatcgtatagcattttttatgggctttccaatgataccatatttgcatttgtgacataaacatttatttgatttattttaccatattcacaatttgatcaaaatataggtggtcaaaagtgttgtcccatttcatttttaaaatattgcttctctggatcagcatttcaaagcatgatgggacaacacttatgaccatgactgtatctgatttactgcgatgttttgagcagattttattttattaaaagattattagtcaatttaaaaattaattattattcttttgcttttttttactctgaaagtttcatttgtttttccttaatttatttaattttctttttcaaatttatgcaaccatttctcgagaatatttgcaatttatttataacgaatccgagcattggaaatgatgataaattaatttattgcaaattaaaaattatttggacgaattttttgctggaatttttaaatgaaaatgaatgggggagaagggacgacggggcaatgggagaaggggcaattaacggacaaaaagcacaaaagtcaattaaaatgaatgcggaatgaccgcccaaatgaattttttgaaatttaattttgcagatggcgtaaataaaatg

SEQ ID NO: 107946 - DNA, 71 bp, Heterodera glycines
  misc_feature (21)..(21): n is a, c, g, or t
  Promoter: Source sequence=SeqID_43359; Location=1..71; Strand=+; Gene= SeqID_71047
aagaaaccgtgaaggaccaantgtcattcaatgcaaaacgaagggcgcgcacaagcggagagtgggcaatg

SEQ ID NO: 107947 - DNA, 185 bp, Heterodera glycines
  Promoter: Source sequence=SeqID_3651; Location=214..398; Strand=+; Gene=SeqID_51296
agtaaataaaagcaaaaaattgtttgaaatcgggttagggattcgaaataggtcgaaatgaatgttcggcacatatccgacccgaccaaattcagtcttaaataggcactcacgcgaaaacgtactccacgcgaaaacgaaggaaatcagtacattttcctagccatagacagtttttcaaaatg

SEQ ID NO: 107948 - DNA, 70 bp, Heterodera glycines
  Promoter: Source sequence=SeqID_24099; Location=485..554; Strand=-; Gene=SeqID_54799
tttccctagaaataattttgtaatttaaaatgagatcacttttttcaggaaatttttttacaagcttatg

SEQ ID NO: 107949 - DNA, 421 bp, Heterodera glycines
  Promoter: Source sequence=SeqID_12377; Location=2876..3296; Strand=-; Gene=SeqID_75984
ggtcgaccccccccccttcgtccgcaaagtgccccaaaatgggggaccccttcgcatcgaggggggccggtgtaaaagaggtggaggggggggagggggcaataagcttctgaaaaattgggttgaatttttgaaaaaattcatatatccataattttttttgtcaaaaaaagaaaaataatctatttattacatgatttatagtgtttgataaatgaggtatcctatttattctttactaaaaattgaagttagaaggtgactttagtaaaatttttacaagaattttgctgatgaaaaatttttgtcgcaatttttggaaattttcccaaaaatttttctattttagagagtattttccaaaagttttccatctttagggatgtatttttcgaattttttgtgaaaatgccgaaatatg

SEQ ID NO: 107950 - DNA, 180 bp, Heterodera glycines
  Promoter: Source sequence=SeqID_1546; Location=1..180; Strand=+; Gene= SeqID_74365
agaaaattgtgggaaggtgggaatgggaattctcgcaaatcggattatggagggggaggaattcaagaaattcggaaaatttttgactctcgtcagcactaaattatacccaaatataaattgacagtcaaatcattgatctaattatattaagcattgacaacgccatttacagacatg

SEQ ID NO: 107951 - DNA, 1003 bp, Heterodera glycines
  Promoter: Source sequence=SeqID_8490; Location=2332..3334; Strand=+; Gene=SeqID_68266
atgtaaataaatccgtttaaaattaaaaaaaattattataatatattttattagaaattttcatcagtcggagaaaccacaatagattagtcagatagtgtatgataattattcaattgttttaattattatgttatctaattaggttgaataaattaaataaccataaatttttcttcttctaatttttgatcttaatcactgaatttattcaaatgattaataaaattcactttatcatctgttaatggatattttatgtacacaaactatataataatattttttcattattctgtttttaattaattttatctttttaaaggtaaatttcttttcggttaaatatattttgttgcttacatggtaataatggtgattaatattaatttttaaaaggatataaaaggtatgattgtaaaatttcaaagtcttaagtcagatattttttatccataacttttttgaaattcaataaaattattttttttttgatttaaatcttccaaataaatatttctcaaaaatttttttttaatttttttactttattaattgcaatataattttagttgattgtcgcattttaaaaaattaaataatttttaaattattccagaaaattcaattgctcatcacataactcttttttaacttatcacattttaattggattaataagactttataaataataattaatttaaatgattattaaggtcttcaaatggttttttatgaattaataaattggaacaaaagaaattgaatgtctatggttttccacgtaaatatttagattataatgaaagtgcgaaaatcacgctaacgaattgataagaagaaataattagcttggaaattggctcaacaaatcgagaacgggtgaattaaaaaaatttttactgaaaattagcaaaaattataatcaaaatgaatacaaaaaacaaatacattttataataataatttaaattatttactaatattgtcgtttagcatg

SEQ ID NO: 107952 - DNA, 721 bp, Heterodera glycines
  misc_feature (72)..(72): n is a, c, g, or t
  misc_feature (79)..(80): n is a, c, g, or t
  misc_feature (93)..(93): n is a, c, g, or t
  misc_feature (95)..(95): n is a, c, g, or t
  Promoter: Source sequence=SeqID_9120; Location=968..1688; Strand=-; Gene=SeqID_70311
attagggatccggccccgatcatttttccaaaatcttcttgatcaatcgggatcgggattcggtcgggatcncactcannggatccctccgancnttagtcagtgtctggtctctagtcagtactcaattcgtcgttatcattcaaacacaaaaataaataaaaaatattttggaggaaatgcgtcgcaactatcttattttttgataattatttcctatttataaatgcctgttttgtaattaattaatccaattggatgggacccgtaaaaccgactaaaattgtatagaatagtcatttgcctgctcaaatgttctttcctcttcccaactcggcgcactgcgcggcgtgtacaattccttggcgtccaaaatggtcgcctcgcgaaggcgcagaaagccgcagctgaacagcgcggtcagaagaatgggaccaactgaaaagagaacactttggaaaagtgaaaagcaattcgaaaaatttgggaaaattataaattaatttaaataaattaaataataattaaatgaatagagagagaccaatgaatgcgcggtgccaatccaccagcaaatggcgcgtgtacgcgccgaacattcgctgcaacagacggtcaaaggtcggcaacagttgaacgcgtcgacgggggcctgcgccagaagcggaacaccgacggcacaaagggggtcgatgcctgcgggcacaattagggcaaaatg

SEQ ID NO: 107953 - DNA, 217 bp, Heterodera glycines
  Promoter: Source sequence=SeqID_647; Location=2635..2851; Strand=-; Gene=SeqID_58008
ggtgaggggaaagtgtacgagacaaagtgtacaagggaaaagcatgccaagacaaagcgtaacatggcatacaggaaaaagccactcaaaaacttaggaaaaatgtgttttggaaaagaccgtaatttaaatggcatttattgccaagggcaaactttcttaaattcttttccctattttaacgttggtttgccctctttttcagctccattcgatg

SEQ ID NO: 107954 - DNA, 1003 bp, Heterodera glycines
  Promoter: Source sequence=SeqID_20742; Location=1650..2652; Strand=-; Gene=SeqID_51309
agtggtcatttgaccaggtcatttggcaatggttatttgacccggtcataactccccaaacatgagaaaaatggcaacaaaaaatggttgtaatttctgtagtatttaaaaaagaaaaataaaatgccaatttcattagttttatgatttgatcttgcaaataagtagattatattattaaattgtacattttcttcaattttgataatgattttgtatttttattaccatttatttcataagatttgtactaattgtaatgaataatcatttatttattcaaaattttaaaatattatttttttaaatctttttttactattttaatatcatgttcacatgtcggttttttccttttcttcattgggccactttgatttattaattagagaattcaaatttaattttgttgcaaaatattttcgtctttttgccgaccagttgaatgaatttttgtttataaaatttttttttataaatgatttcttttacttaataattatacgaaaattaaaaatttaatttttcgtttattatgaatttataaaaatttgaatttgaattacttaaactctattacttggattatcatttattttttcaaatttattttttggcttctatgagtgggcgccacgccgattttgttgatattcgtacgtaatttttttgcaattcgtaaaatagcccggttttcaccgggaaatttcgtaaaatccatttgagataaataacattcattcactaaaatagttaaaaggatgaaaagaaaaaattaatataaaattaataatattttggtttacaatattttttcaataaaaataatcaatgttatcttgttgcttttcttgtgacctcgagacaatacaataggctttttactttgctttaagcctttcttttattattatcagtaaaattgttataatttatttctatcattatttaatttaattttcatgctcagttctgggcttctgattccggcctgtcgagaatg

SEQ ID NO: 107955 - DNA, 360 bp, Heterodera glycines
  Promoter: Source sequence=SeqID_20067; Location=1606..1965; Strand=-; Gene=SeqID_84851
ggtcatttttcgacaacctggatttttcctggatttttgtccaggaaatccaggtccaggtcaatttgaaaatccaggtccaggtccaagcacaaaaaacctggatttcctggataaattttttttcggttttttatggcgaaatgtattaaaattggtataaaatgtgccaaaattttcactccgccccctaaaaattcttatcctcttaaaaaattggctcaaaatcgaaaaaatttgtcattttttgaacaaactcgttaacaaatcgcattaaaaatacaaaattttccagcggcgcctatcggcaccgccgggctctcttccctcacacatcctaaaaatttttttgaaaaaatg

SEQ ID NO: 107956 - DNA, 70 bp, Heterodera glycines
  Promoter: Source sequence=SeqID_253; Location=2412..2481; Strand=+; Gene=SeqID_79769
tgtattccgaatttacgtaataaacatggggaaaaaaacaacattttcaggctgaaagaacgtgagaatg

SEQ ID NO: 107957 - DNA, 284 bp, Heterodera glycines
  Promoter: Source sequence=SeqID_31717; Location=182..465; Strand=+; Gene=SeqID_62022
atcagtttataaaaaaaaagttaagcctaaaatctttcgcaaatttaaaaagcaattaaaaatttttagattttttattcatctccctttttgatagtgaaagcatcagagagccttatttaacttttaattaacatttggtgcgtttcagagcacgttctaaaaaatatttatgaattaattttgcaaaataataaataattaatgaaaaagtcagaatttcgaaaaattttaaaaacaacaagcgttggcattttttcaggttaagttagtcctttacaatg

SEQ ID NO: 107958 - DNA, 1003 bp, Heterodera glycines
  Promoter: Source sequence=SeqID_10788; Location=1606..2608; Strand=+; Gene=SeqID_74046
actcttctaatcactgttgtacctctttaaatcacatttgtacctcttctaatctctgttgtacctcttctaatcacttttgtacctcttttatcactggtgtacctctttaaatcacatttgtacctcttcatcaaatttgtacctcttctaatcgcttttgtacttcttctaatcacttttgtacctcttttaatcacttttgtacctctttaaatcacatttgtacctcttcatcaaatttgtacctcttctaatcgcttttgtacttcttctaatcacttttgtacctcttttaatcacttttgtacctcttttaatctctttttacctcttctaatctctgtaaggccaacaaaatttgaaaaactggcgcgaggcgcccgactgaggccgcgatcggcccaacaagctaaaaaatgggcgcgaagcgcccgtttgaggtcaacaaaattgaataacgggcgcgaagcgcccgtccaaggccaacaaatttaaaaacgggcgcgaagcgcccgtcttgatcctcgatgtggactaaaaacccctaataattttttaaaaattcaaaaaaacctctccaaccaattcgatccgaagctcaagaagtaaaaaacgggcgcgaagcgcccgtctgaggccgcgaagcggccttaatagcccaacaaatttagaaacgggtgcgaagcgcccgtataagcccaacaaaatttaaaaaacgggcgcgaagcgcccgttcgaggccgcgaagcggcctaaaagtcccagataatttttaaaaaattccaaatctccacaaccagagctaaaaaaaccgtagttgtacctcttctgatcacaattgtaccttcccacccgtggttgtacctcttcccccgtaacagtctaggtagcgaagctcccaaagcgcgaagcgcttttccacagctaaatagccgacggttcacgcacccgctagtgtattttattacagggacatttgtttggtgattgcggaatcatg

SEQ ID NO: 107959 - DNA, 805 bp, Heterodera glycines
  Promoter: Source sequence=SeqID_6799; Location=3607..4411; Strand=-; Gene=SeqID_62945
tgacgggctccgagtgaatggatcaagaaccggacccggccagggagatagtccttgaaaaaactgaacaaaaaattgttcttaaccgggccggtccggattccggatcaggcacttttggtgccccgaaagtggtgcgataggcttttggaaaatgaccaatcaaccactgagttttttgtggaacgcccacactgagcttttttgtggaacgactcaccacgggagggaacgaccggcggagatgcgatgatcagaaagagagtgatttacgaggaaaagcgccatttgggagtgactgattaatggggcattattggacaaaaactgtaattattgggttttgcctttattgccgaaaattgcatttgccgttgatttgtctgttgtcctcttccgtcatcgttcattttcttaggctttcgctttcgaaaaccgcgttggcccctctccaatttgcgttcttcggctgtctccgcaacggcactgacaaaacgctcttccaaccaaatcccccaaaacttccgatggcatctttcttcaccaattcgaacattggaaaagtcagcggaagatcaaaaagtaaggcacaatattaaattatgagttaatgaactgaaactttattaaatccaaattaatagaagcaaaacgaatgctgcgaaatttcaccgccaaacgccacaaaaaatgagggagaagaactactgtacgacgacagaatgtgggcacataataccataagaaaaacaagtcaaagttttggaattactgtaatttaagcaaagaatggatttatccgatg

SEQ ID NO: 107960 - DNA, 68 bp, Heterodera glycines
  Promoter: Source sequence=SeqID_15954; Location=1041..1108; Strand=+; Gene=SeqID_80306
tgttagtctggcacaggcacagccactgccccgccgccggtggctccgctgcttacatcggcgccatg

SEQ ID NO: 107961 - DNA, 219 bp, Heterodera glycines
  misc_feature (13)..(13): n is a, c, g, or t
  Promoter: Source sequence=SeqID_11536; Location=586..804; Strand=-; Gene=SeqID_74974
cgaattttttccncgaataatgtgaacactgcccgggctttgaactttcgctttcacagtgtaaagctctcctatatgaatctgacttttttaagtttataaaatatatttgccttcagtcgggatgtcctgctcgttcagcatcctttgcacactgatacattcgcccggatactcggttcctcttcgattgatttttagcggagcttctcggtgatg

SEQ ID NO: 107962 - DNA, 194 bp, Heterodera glycines
  Promoter: Source sequence=SeqID_7769; Location=5260..5453; Strand=-; Gene=SeqID_65890
tctagagtcacaaagggaggggcggagacggaagtaatgagggcaacaaagagaaagtgaagcaagaccatgaggaaaggaaaggggagaagaagaaggaaaggaagagaacggtggagaagaggaagaaattttccaaatttgaaagcagtccggaggaggaggaggatgaagaggaagaggagtcatttatg

SEQ ID NO: 107963 - DNA, 155 bp, Heterodera glycines
  Promoter: Source sequence=SeqID_25088; Location=869..1023; Strand=-; Gene=SeqID_55824
gctgaaaaatcgcttttaagcatcccaaacggatttggatgaaaaagacaaagatgatcggatctgatcagaatttctgattgacctcatttacccccgcccctccccaaaaatttaaaaaactgacaaaaatgctcaaaaggttggccaacatg

SEQ ID NO: 107964 - DNA, 913 bp, Heterodera glycines
  Promoter: Source sequence=SeqID_30825; Location=722..1634; Strand=+; Gene=SeqID_61223
gttttttcccgcccaaaaaaaccccccccccgtttttttttaaaaaaaagaaaaaatttccccggggggaaaaaaaaaaaaaaaacaagaaaaggaatttttttttcaaaaaaaaaaaaaaaaagggtttttttttttttttttaataaaaaagggggttaaaaaccgggggccgaaaaaaaataattttttttttttttattttaaaaaaaaaacttttttttttttttttaaaaaaaaatttttttttttttttaaaaaaagtttttaaaaaaaaaaaaaatttttttttttttttttttttccccccccccccccccccctttttttttttttttttttttttttttttttttttttttttttttttttttttttttttttaaaaaaaacaaaaaatatttttttttttttttttaaaaaaaaagagtttttcttctttttgtttttccccccccttttttttttttttttttacccccccttctcaaaagcccccccccccttttttatccaaaaccgggggaaaaaatccccctttccggggttgtttttttgtgggttttgggttttgggcctaaaaaaaaaaaaaaaaacaaaaggggggcccccccccccccaatttttattttttttttttccctttttcccctttccaaattcgccctttccctttagggttttgtttctttttttttttggggaggcaaatttttgcttccccattttgaccattttccttcctttcacccaaacaaattattaatctgttttctttttcaaccatttgcatattcgtaatttggatttgttcatttcttagatctaaattttagtgcataatgcttaatgcacttccgcgtttttttaaatttttttacttatttagttaaaaattttgaattttaaaatg

SEQ ID NO: 107965 - DNA, 721 bp, Heterodera glycines
  Promoter: Source sequence=SeqID_3988; Location=2444..3164; Strand=+; Gene=SeqID_52715
attgcacaattaacgaatgtgccatttgtttgttttttcactcatttttattgacacttttttccccgaaaatgggatgggatggtgtgaactatgaattcatcctcaaactgtgatgatttatcacacatttggcgtgtgatggaacgacggggacataaaaaacaaaaaatcgtttctgttttttcaacgccaaacttttggtgggggctcatcaatcacaactttcgtcatcatcatcgtcgtttcgttccacattacctaattttatttgtgcattttttatattaattatataacaaataatccaaaatccgatcgaattgaatcggatcggaaaattccccggcgccctttcccatcgcccatttcaatctttcccgcccccctcccgccgtcgttctgttcgtcattctttttcatcatttactccctctcccctcttccccgcgcagagattggctatgttccgtcctgcaccgcatccatccaacgtagcggtggcgatctccatcatcatcaacagttggcgctgtttgatttggatttacggcgtcgccaattgctgctcggcgttggcggcagcaaagacagcgacgacgacggtgggccgtttgttggagcagtaccagtaacagcagaaaatgatccgcaaccgcagcaacaacgacagctgatgcggacaatgataatgaagatgaacaccaacagcaacaacatg

SEQ ID NO: 107966 - DNA, 262 bp, Heterodera glycines
  Promoter: Source sequence=SeqID_10629; Location=1753..2014; Strand=-; Gene=SeqID_73864
aaatttttaacaataaagtttttagaaatgagagcattttcatttaaacaaagcaactcgtacaaaaaagttgaaaacccaataaatttattttttttccaaaggcaattagtcccaagaaaaataatggacgaaaatttcattttttaatataaaaaaggctgacggaaataataaaatttaaattgattttcaataaaatggtttttttttattgtacgaatcgttgttatgattttgttaagcttgataagaattaatg

SEQ ID NO: 107967 - DNA, 287 bp, Heterodera glycines
  Promoter: Source sequence=SeqID_30139; Location=658..944; Strand=+; Gene=SeqID_60575
tttttaatgcatcttatttatttgacctatttatattttcatagggaacatgtttcgcgcatttggggcatagccagaaattatcaaaaaatgatgtaccgaaatgcaaaagactgtgctttttacatctgttacaaatctcgtaatgacagggacagtaatgacaacacttaattttatgtggacagttcatttttcaatttaattttatttttggttgctatttatagaaggggtatataaagggagtggaaggaccatttgattggtaaattgtatcaaaaatg

SEQ ID NO: 107968 - DNA, 729 bp, Heterodera glycines
  Promoter: Source sequence=SeqID_20275; Location=1334..2062; Strand=-; Gene=SeqID_85077
attatcaaactgctgattcatcctcatccgttttccattccccaatccttttcactatgttcgacaaatgcataaaaatattccaaaacaattttgatatcacacggaaaaacactttcaaatgtaaaataaataaataaaaattaaccatggggcgaaatcactctctttatccctttatcccacactgccacataggcacaagggggaagagtgccgcatttatcacaccaaccatggaccaaatgaaaccgtagtgaataaattttgggtacctaattaaattatatattaactccccagggaaattcgattgaaaaagaatgtgtgcaaaatatgccaaaggatggcaacaaaaatggcacaatcatttggcgcgccattaaattcgcacagtgccaaagcaaacgaaaaatgacaaaggaaaagtcatcattttggagtcatcaattgcctctaagaaattgtttgaattttttttattaacgttaagcaaagtaaattaaatctttgaattttttaattttaaaattatttatagcaaaaaaaaattataatacaaaattggaaattatttaagttatccgttgggtgcagaacaacacaaattttttgtgctttttgctttgaatcaaactgctgagccattcactcgcttttcatcggtggaaaatggtgaaaatattaatttatatattttaaattggcattctcggctttcccaacatg

SEQ ID NO: 107969 - DNA, 984 bp, Heterodera glycines
  Promoter: Source sequence=SeqID_1856; Location=3110..4093; Strand=+; Gene=SeqID_76392
aattttaatgggaatcaaaattcaaacaattcccggtggaaccaacaaaatagaaatagggagccaaaccagttggaacataaaacggagagattagaagggatgattgaagacttagctgtacaaattcatgagatgagaatgagtaggaattttgcttcggcagaccaacagaatgttaaatcgctccaccccatggaaatgtcagaaggggagagtcaaccaaaatcagagtccatcaaatctgaacccaaacgaattaaaagttgggagaccaagggtaagggcttgagctcagcaacctcaattctttcaagtctcatggttgtgtcgttattttgttcagttaattgcgtgaacaaggcattagttccttctaagccaatgatttgccaaacacagaaacaggcaatgatttgggagcttccaaaaatgccaagttgtctgcctctcagtctagtagctgagcacactcctgtggctcaggacagagaattgtttatttcaaacagcatcgaattctctactaaagcttggacttgtagaaaaattaagaaaaatgctaggaagtacacaacaatttcgggagtgccagtagaagagaagttagactcagaaaatttggacataagcattgatgagtgtcaacaaattattaaacatagaagttgtagcttaggcgttctcaaaaatcaaactaatttttggcaaactgaaaatagcattgacctaactccaagaatgtggctatttgggtcctttggttggaaaaatgtgtcaaatgaaaattgttttctatttgaaagtcgaattgactcacacttcggtggttcttcaattgttactccgcttgggtcaccaaatgagtgtccttatgagaaggggagttgtattttggatgacaaaacggtacttatttggaaagtggataatgccaagaaatgcaactttatttcaataggaatcaaaacgggaaaaacaatg

SEQ ID NO: 107970 - DNA, 400 bp, Heterodera glycines
  Promoter: Source sequence=SeqID_33969; Location=557..956; Strand=-; Gene=SeqID_63886
tcaggtcacaacatcatccttatttttttaaatcgacagatcacttaacttggctattttatgaacaaattctgttaacaaatttgtcgaaatttcctatttaacttttggtttttatgaaatgaaaaacaaaagaaggtttaatattataataattttcacttgaaaaaagtaataagaatttttttttgtgtttttttaaaggaaattatcggggttttccccaaaattcccggtcccgctttacattagatttttagtttcgaaattatatttactaatcactctcacccgtttagcgtaaaatctgatcgttttggttaagattcagatgaacatcggtgcaattggcggatacggtagggcaacgcgtgccacaaatctgcatcgccgaaccatg

SEQ ID NO: 107971 - DNA, 555 bp, Heterodera glycines
  Promoter: Source sequence=SeqID_6779; Location=3656..4210; Strand=+; Gene=SeqID_62879
ggtaggtcgtccgtcaatacaatattttaaataatatttattttaaaattcctatttttgtcagtgccatccggcgtgttgaccagtgacgagttggtcggcgtcttcctgacccacgcccacgcggaccgtcgtgccaactccgagttgtaccccaaccaatttcccacccaccatcgatcgcactctgctcagcgcttttttcaacgaaaaattgattagtcgataaagctattttgcaaattgttctgatttttaaccaaaaaattcattaaatttatatcttttctttcttttgtcgctttaagttttgacttttgaaattaacaacaatgaaagatcgaactttttttggcattttttgcgatttaaatttgatttttgacaattttattgcacatcaacattatttaatgtgcaagaaaaatttacgcatttttcccctgaacatttcggcgacgggatcgaaagtttaaaattaactttttttttcagtatatcatacatatactgtacccaaagcaaagtagtttttgaaaatttttcaggcaaatg

SEQ ID NO: 107972 - DNA, 304 bp, Heterodera glycines
  Promoter: Source sequence=SeqID_17332; Location=914..1217; Strand=-; Gene=SeqID_81812
ttttcttttcggcctcccattttcgaaatgcccacgcggcccttcgccattccctcgcgggaaatttctcgtccccaacagattcggatgatctcagcttttttgacattgaaccgattgttggggcagtggtcggagtgcagcagcgctatcagctcaatttgggaatgcaacgagggaatttcaggcaatttgaggggcaaaaaagcattgaatatttgaaatttaataattaataatgaatgattaaaaaggtataagtttattatttggataaattgccaattcatttacttcaaggatg

SEQ ID NO: 107973 - DNA, 179 bp, Heterodera glycines
  Promoter: Source sequence=SeqID_4010; Location=1..179; Strand=+; Gene= SeqID_52792
ggtggtggcacaaaggtcaagctaaaagcctttgtcgggcgaaaagccctgacaaatctctttaagactgcgataatgacctctcagagaattcttagggacctattaatacatgaaaattctatatttgggctgttattaagataaatttttgcgtgtgcaggacctaattattaatg

SEQ ID NO: 107974 - DNA, 1003 bp, Heterodera glycines
  Promoter: Source sequence=SeqID_20924; Location=535..1537; Strand=-; Gene=SeqID_51505
tccctcaaattttctcgcaactgtaaacattatgggacgcgtttaagaaaaactaagtaattttaattaatttttaggtaaaatttttaataataaagatatattagtgtttgaccccccaaactttgtcaagttctatttttccagggttgccgctcatcccgaaaccggacattttctcgtcccgaattccgacccgactttttttttgttattattcgccatttctccctgccctcctctttattaaagcattggaaataattcgatcaaacggaacaaaataatttacgcttttaccgcttgtgctgaaaaatcgatgcaaagtacgcactcaaattgagcaccaatccctccgcccattctcataaattctccgtccttttccccaccactctcttcttctttatattggtgaagattggtggtttgaaatttttaaatttcatttttcttaagaattatttctattttcaattaatttataattcgtttcattaaatatttatttaatttatttgattcgtcaaatgcttctcgtttccctttcttttcatataaatgactcataatgcgaaatgtgaacgttcaaaagaatttaatgacaaaaccaatttgtaaatacatttattcattcttttaaaatatttatataattttttttcattttgctaaaatatcaattcaacaaacttcaaatttttaaaatttaaaccattagaataataactatgacatttctaactttgtatctttatgcattttttgaaaaacctgagctcagatccgtccgtgatcagaataaatactttttacccttgaaaaacaaaaagaaatgttttttgcttttacactagaaaccaaattaccagcacttttaacacctaaaaacagattcctatgaattatttttgtcgctttttgttattttttgaattatttctcgctcttatattttggttttatttttctattagctttttaaattttaatttcaataatg

SEQ ID NO: 107975 - DNA, 1003 bp, Heterodera glycines
  Promoter: Source sequence=SeqID_6175; Location=893..1895; Strand=-; Gene=SeqID_60594
aaaaacatattttgtgcttttggcgaataaaaacatattttgggcttttggtagtttttggcacatattttggcgatttttgaaattttttgaattttttttacaaaagttctttttttttgcaatcaaattcttggcaaaatgttcccaaaaatgttcaattttttaattaatttttgacgcttttcaactaaaaggtggccgctcatttcgtcactgatcgtttcgttactgttcagttcgtcactgagaattttttttttaaagtttggcacattgcttaaaaaacaacaaaaaattctttaataaacaattgttagccaaaaaataaataaaattgttaaaagttttaaatgccttgattgtgagatttgaaaggaatctcttctctgaaataaacgagattagtttagcttctcatctttaattttaacttccaaatgtgtttatttctgaaattcgaggcccccgcaccaggggtgggcgaaactgcgagcttcgaaagcttcggttttttttttggaccgaacttcgtgcttcgaaaaaaattgggctttgcctttggcttcgagtgctaagccgagcttcgcccatctctgcccgcactagtgctgcttgagacagaaaatttcccgagactctcgagcgaggaatacaatatacttttaaaatccattgtaatgtttaagcctattgaattgtttttggcccggattaaaatgtaaaatggtcaaaatggggactcctaagcttttagaacggtcaaacccgtaaaatattcttaaaacaaattgataggtctaagtgttttcgatttgccagaaaatttcaaaaaattataaaaccacaaagaaacaaaactgcgtaaaaacgccgacttttccctccccgaattgctatgcaaatatttttagtataaaaatgcacttttttcttttcctcctcctcattccattctctcattattttccctctattttccggtcattctgttccgcaaatg

SEQ ID NO: 107976 - DNA, 1003 bp, Heterodera glycines
  Promoter: Source sequence=SeqID_2991; Location=1576..2578; Strand=+; Gene=SeqID_82668
ggtggtcaatgtcttttcaaggacgtcctaaatttggaggacaccaaaaaataccaaaacaacctaagctaataataatgtgtggagaggggggaaaaagtgaagttttttggcacaaaaaatattccgctgggatccaattagcagatatttttattgtgccttaatttgcgcgccaaaaaaatcacttattgatagagaccggcgggaacgggagtcccgtgggagtttacgggagtcccgctcccgactcccgtacttttttgtcgggcgggatttttacgggagcgtgatttttacgggattcccgctcccgctcccggaaatttgacccaaaaaacgggagtaaaaatgcactggtaagaattgagttttttggtaaaataataattttttgttcggatgagcctatttgaattattatggcgatctgtccattcaaattccacgccatttttgttgttgtcacttgtccataaatagacgatcatttcctccctcctggtcttttccctcattcattttattttgttatattcctccgaccaaattgtcttcgctctttatttattgttcgtcaataaacatttatttattgattgtcttccttaaaccctcggaccgaacaattggcgcagtcacaaaaatttggactttgctcacatcttcgggattaaaagcaaaagccgagacggcacaacaaattcaccgaaaagccgggattggctgtgaattttgattttaaagctgagttggcaaaattcttcaacaaagcagtcaaagaaactgctcagtcgtcaaaagcctggtcggcaaattcttcaatttaagcagtcaaagaaactgctcttctaaagccgggacggctcgacatttcttctaaagccgagtcggcacgccaaattcgtcaaaagccgggttggctaaatattaaattgacacctattggtgcaatactacaacgtttattgatttcgggtcgaaacaataatcgtctacaatg

SEQ ID NO: 107977 - DNA, 745 bp, Heterodera glycines
  Promoter: Source sequence=SeqID_11747; Location=851..1595; Strand=+; Gene=SeqID_75239
aaaatttgaacaaaatcgttgaattataaaattttgtccaaaaatttggacctcagaaaattatcgatttttctgataccagctgaaaatgttggtaccggtgccggtttttgcagtgtcggtcagtaccggccggtaccgatgaaagcgaaatttaccgatacctttctactctcatttaaataattgaaattttaaaattattaaggggattcatttttctaaattttctatttttcatttaattttctcctgacttactaaaagcacggaaaaagaagcaaatttgtataatttttaaaccactaaaatattcatttattcattcattaatttttgattatatcacaatttattcaaatatttgttatgcaattatttcttatttcaatgtaatcatttccaaataaacctttatacgaaatgtgaaagaaaatcccataaaatattttgaaagatatcaaataaattttgggaaatataaaatgagaaaatttccacaaaaataaatcacatataaaaacacaaacattctttaaaaaatgcgtttttattattcttgcatttttgtggttgttcttttgatggcattcgtcgacaaaggaattttggaaaaagttttaaattaaagaataaatattaaaaaataaaacaaaaaacattatatttgcgataaataaattttacaaataaaaattcaatttaaatggtgaataaaagaaatttgctgttcagagtctcaatg

SEQ ID NO: 107978 - DNA, 294 bp, Heterodera glycines
  Promoter: Source sequence=SeqID_16404; Location=855..1148; Strand=+; Gene=SeqID_80803
aagtgataaaaagagccgggttttcacgcatttatttttaatgagtatttaatttcgattaattcgaattttattttctgctttaattatttaaatttaacaattaattgttttttcagcaaccatgtacaaaattgaaccttagctttctttttttagttttttggtttttaatggaaaattaataaatattttattagacgccacctggtcaacaaaaaatgcgtcgtagaatagaaatgaacaaacccatcactgctgttcagcatcgtggtggtggtggtggcggccatg

SEQ ID NO: 107979 - DNA, 378 bp, Heterodera glycines
  Promoter: Source sequence=SeqID_146; Location=4938..5315; Strand=+; Gene=SeqID_74916
ggtgagaagtaacataggatattggagttaaccaaaacttatcaagttaaagcttgatgataataaggacttatcctttggaatcgtgattaaaggacctgctctttcgtgagatttgtggttcgcattgtatatcgatgagttcattgatcaataatgataactctgcactcaatgcccttagggcagatgggatatgtgagccctggctgattgattgcagcggcttcactgtggcgataaggaatatacaccatttttatttcacactatttcaatgtatttgataaatatttgatttacgtgtggcttatcggtagtaattcctaaatattttgccacatgcacacatcatctcctcatttttgttttcagatg

SEQ ID NO: 107980 - DNA, 819 bp, Heterodera glycines
  Promoter: Source sequence=SeqID_1665; Location=711..1529; Strand=+; Gene=SeqID_75186
ttttgttcactcttctaaaaacatggaaaaattatttaaatttaaatataaattattttattttaattttattttatttacaatagaataattaattcaattaattgtttttttactaattttgtcatattattgaaatgatttaacatttttaaaattcgttttctgtcgatcactatgtgaaaaaaatgaaatggatagatagaagatgattcagcagaatttgatgaataatcaccgcaaaaatgcaatgaattaaaaattgaaaattaattaaatttaaaaaataaaaaaaagtaaaattttttactttttccatcaattttactattgcttcttcataattttccaatataattttaaatctttgccttgcaaattttaaattttgaagatgtataacagtgcggcatattgacaaaatttgggcgggggcggagatttgacggattaatttggcggttttttgaatttattagggtcattaattcataatatagtaaattgctgcaagaattatttacacattttcattaattattccttaaatttattggtcatgtgagttcattaatttttcaaacttatggaatataaatttaccatttctttaaaaatttaaataattatttataagattttaaaacaatatttggctttagttttgagaaataacagataaatcacgaaactggctcagaactatagacaatattatagttctttaattatgccttcccccccccccccaaaaaaaaagacccaaatttcccactcgagactctcgaccagtcattactagtaattatagcaaatatg

SEQ ID NO: 107981 - DNA, 62 bp, Heterodera glycines
  misc_feature (38)..(38): n is a, c, g, or t
  Promoter: Source sequence=SeqID_29238; Location=1202..1263; Strand=-; Gene=SeqID_59761
ctctgattcataaaaaaatgctttcgatttgcttcaantgaaaaaaatcatttttgtagatg

SEQ ID NO: 107982 - DNA, 128 bp, Heterodera glycines
  Promoter: Source sequence=SeqID_6005; Location=1824..1951; Strand=+; Gene=SeqID_59992
agttcctttcccttctcttttcggccctctaattttggctaatttagagcgtttcttcgactctttcgtcctccgtcgatgtctttttcagcaatggtttgatggtcctcggctccttggtgctcatg

SEQ ID NO: 107983 - DNA, 187 bp, Heterodera glycines
  Promoter: Source sequence=SeqID_34936; Location=444..630; Strand=-; Gene=SeqID_64620
taatggtttttcacgaaaaattttttccacccccctagggtttttttttgtgaaaatttcgcggtttcaagccattttaggattttcagatcactatgaaggagtgatctgatcaatttgttgcaaattactttttcgatcagtacaaaaaactaagcttaaatgaattttttcagattttttaatg

SEQ ID NO: 107984 - DNA, 149 bp, Heterodera glycines
  Promoter: Source sequence=SeqID_6655; Location=312..460; Strand=+; Gene=SeqID_62346
actgagaaaaatttgaaattaaaaaatttcgcggatttctccaaaattaaatttttttttgttggtctagcatatatttcagtcaaaaaatttttaatttttaaattgatcagtacaaatcttaaaaaaaaataaatacaggaagcatg

SEQ ID NO: 107985 - DNA, 80 bp, Heterodera glycines
  Promoter: Source sequence=SeqID_31964; Location=1477..1556; Strand=-; Gene=SeqID_62282
ctctattatgttcaatgtacatatttctctttttttcggctgttttttaattttcaattattacaataaaattagaaatg

SEQ ID NO: 107986 - DNA, 61 bp, Heterodera glycines
  Promoter: Source sequence=SeqID_44641; Location=860..920; Strand=-; Gene=SeqID_72104
ggcaattaaaaacaaataaataaaattaaacagtttttcacttttgtattattacagtatg

SEQ ID NO: 107987 - DNA, 190 bp, Heterodera glycines
  Promoter: Source sequence=SeqID_7125; Location=1..190; Strand=+; Gene= SeqID_63906
tgccatttgatctgatcaacgaatttactcatgaacaattgacgcttaaaagaactttcaataacagtcgttttttgttggtccgttgtccaattgcgcgagacgcgagcaaatggacaaaatgggaagaggaagtgattcactggcaaatttataaccaatggaatcgaattgacatttatttatgatg

SEQ ID NO: 107988 - DNA, 300 bp, Heterodera glycines
  Promoter: Source sequence=SeqID_638; Location=3492..3791; Strand=+; Gene=SeqID_57913
tatttttcaacattggcaagcgaattgcgcctgaaatggcacaaccccacaaaccctcagctgggatagttttgcgcgttgcgcttccgcctcggcttcgctggcacgtcgtgcctgctcaatggcctcctgctcggagagacgcgcccgttccgcgatcaacatttgcgtctcctcggcacttctgatcacattctgccaaattaagggggggggggagaaagcctttaaatttggctcctaaatttttaaattttagtgctcgatcacctgcatggcgctcaactgttccgacagatg

SEQ ID NO: 107989 - DNA, 92 bp, Heterodera glycines
  Promoter: Source sequence=SeqID_15009; Location=910..1001; Strand=-; Gene=SeqID_79163
agtaaattgtatttcgaaaaataaaatataaaaaataattaaaacataatttggttcgggtgttcaattaggaaattaattaggatgaaatg

SEQ ID NO: 107990 - DNA, 56 bp, Heterodera glycines
  Promoter: Source sequence=SeqID_23179; Location=1897..1952; Strand=-; Gene=SeqID_53885
cgtgaaaaaggcaacaaacgcctcaattccaattgttttacttaagcgaaacgatg

SEQ ID NO: 107991 - DNA, 110 bp, Heterodera glycines
  Promoter: Source sequence=SeqID_31140; Location=180..289; Strand=+; Gene=SeqID_61518
ggtgaacgtaataaagaaaccaaccagcattgacttgtgcaatccgactcgttaaaataaaatgatctttaaaataattgcataaatttatagggacagtatatataatg

SEQ ID NO: 107992 - DNA, 460 bp, Heterodera glycines
  Promoter: Source sequence=SeqID_8926; Location=796..1255; Strand=+; Gene=SeqID_69661
atcagaatggcattgagagagagaatagaggtagagagagagggagagagagagagggaggagagagagaatagaggtagagagagagggagagagagagagggaggagagagagaggagagagagagagggaggagagagagaggagagagagagagggaggagaaagaggggagagagagagagaggaacaacctaattatctgatcagccaatgtagtaatgtttcacaaataccccactagcccaatgattaattttccatttatcagttaccattatcaatttatattatctcattgatcagtcaaccccagtgatcagtttttctattgatcattggatcagttacccttcgataagtaacccctttgatcagtgtcccattgatcgtcattgatcagttaccccattgatcagttaactctgcgctccgtttttccaggactaccacagcatg

SEQ ID NO: 107993 - DNA, 134 bp, Heterodera glycines
  Promoter: Source sequence=SeqID_428; Location=2638..2771; Strand=-; Gene=SeqID_52359
ttttcccttcttcggttttttgtgtccctctgtatttgcacacacacacacacacacacacacacacatatatatataaatatgtagataaaaaatttcttcctctattctactaaaccctcacccccaaaatg

SEQ ID NO: 107994 - DNA, 213 bp, Heterodera glycines
  misc_feature (61)..(61): n is a, c, g, or t
  Promoter: Source sequence=SeqID_17300; Location=1091..1303; Strand=-; Gene=SeqID_47432
ctcaatcagcacagaataaaattaaactttcggatattgcattaaatggctggcataattntggaatatattaagaaagcttcccaggcgaaattccatttcaccggataacattccttacattttattaaaaaattgtgctgagccaattacaaaaatattagctgacatatttcgacttgctttggattccggtcaaattccggaaatatg

SEQ ID NO: 107995 - DNA, 292 bp, Heterodera glycines
  Promoter: Source sequence=SeqID_29095; Location=203..494; Strand=-; Gene=SeqID_59652
tatgcaacaaaatattacgactatcaggtgggcggaggagggacaggctaacaaagaagaagcccggcttttgatcaaaattggaattgttcaccacagattgccgttgtttttgccattttactcggcggtcttttactcctcgcgttggtagtcacagccatttattacatttgtgtggtcaatgtgagtgtaccaatttggcctcaataagtcaaaggttaagatgcggggcaaaaagggcggcattacgcgcgttccttccggcagaagtacagtaaggacgaggatg

SEQ ID NO: 107996 - DNA, 538 bp, Heterodera glycines
  misc_feature (62)..(63): n is a, c, g, or t
  Promoter: Source sequence=SeqID_13859; Location=644..1181; Strand=-; Gene=SeqID_77806
aggcacaaaatgtcatcataaaatgacctaaataggtttagaatcacattttaacatttaannaattaatttttgctagttttaggagtacattttctaaaaaagtttttttatttcagaagaaatttctataaatttgcaaaaattctcagaatacgtatgtaaaaaaatgaaaaatttgccgaaatttttgattttttttaaggaattttaaaaattcccgtaaaaaatcctcaaaatatgtaccaaatatgtataaaatcccgaaatatgtaaataaaagtcccgatttttgtacgcaaacacagaaaagaaagtgttttccctactatttagagcatggggaatcaaggaaaaaaaatatgtatttacattaaattgacatccctagtgattttcgttaaaaaagattgttttccgctttgtttctcattatataaaaataaagtttccaacgcaattacctaattattctgctatatatttgtgtgacatcattcgaaattcaacagcaaattgtgctaattgccaaaaaatg

SEQ ID NO: 107997 - DNA, 76 bp, Heterodera glycines
  Promoter: Source sequence=SeqID_20967; Location=3435..3510; Strand=-; Gene=SeqID_51545
ttcttttttgggctctgccgacggaccctttcctttccctttggttttctctgccaactcaaccgcttcatcaatg

SEQ ID NO: 107998 - DNA, 351 bp, Heterodera glycines
  Promoter: Source sequence=SeqID_16508; Location=1..351; Strand=+; Gene=SeqID_80913
catttctctgtcgctatttggaagtgaataaacgaacttttatggactggacaatacacaaatgctcaaattggagccactctttaacaaaaagtcaacaaaaataggaaaataaacaaaggaaaaatttaaaaggaaaaaggtagagtagagcgctttggcgaatacaaattgtcacccgacattcaccgccacccaaggacgtggactgatggagggataaaaagggatcggattttgaaagtgccgtttttggacaaattttcacgtgacaaatttctttttaatttccgtaatgctgtgaaaaaattgcccaatgtgccccaacatatcaaagtccgaagggatatg

SEQ ID NO: 107999 - DNA, 592 bp, Heterodera glycines
  Promoter: Source sequence=SeqID_1414; Location=1..592; Strand=+; Gene= SeqID_73382
gatgagggcagactctttttaaggggggagatgttgggaagggtactgatttgtcccgcttaattattatttaattcctttctttctcttcccctcccactctctctctgttgcctcctccataaatacccccgtccctttgaccatcgttcattccctcattttatttgtttgtgtccaccatttccctcaatcgatatttgcccccactttctcttatttaattgtgtcttctccaaattggaataaataaatatttattcattggacaagtgcaaaggcacaacaaattggcgacgcccgtggcagatttcgacatatgaatttctgcaaaagaaattgcgtctgtttttttggttttttgcattgcttttagcatcaacaattttcgccaaacttaatctgagtgtacttcagccagtcggcatttgacattgccaattgttcgtcatcgctactgattagcttttagcaatcagtagaagttagcgctgctgataatttgtctaggcgacatttattagctcatccacgcgcacccactcagtttgtatctaggcgctgcaaacaagagtggtgaacgacaaaaatg

SEQ ID NO: 108000 - DNA, 54 bp, Heterodera glycines
  Promoter: Source sequence=SeqID_1102; Location=1210..1263; Strand=+; Gene=SeqID_67838
agaactgcttatgaagtgattagaaatgtgaatccgtttgctgaagcatatatg

SEQ ID NO: 108001 - DNA, 415 bp, Heterodera glycines
  Promoter: Source sequence=SeqID_23340; Location=1571..1985; Strand=-; Gene=SeqID_54049
aagaatatttttgaattaaaacttttgcaggctaacaaatctctccttagttttaaaattgtgtgaataaatattttagcctattaaattttgggattatttttctagatgaaattgaagaataaaattgacaaatttttggagagatttgtccgtattaaatttttatttattttaaaaaaatttttaagcatgcggacccgaacaaaactgcgccgtgtttttacaaattcacaaattttgtaaaagattggctttcttgtgttaatgcgaaattggtcaaacaattaagttaatttttaatattttttaaattttaatgctttaatttttagttgtttgcccacaaaattatatgttaaaataacatcgaatgatttcttggaaatattcgtaaaaagtgtcggcgaaaatg

SEQ ID NO: 108002 - DNA, 794 bp, Heterodera glycines
  misc_feature (538)..(538): n is a, c, g, or t
  Promoter: Source sequence=SeqID_9352; Location=1..794; Strand=+; Gene= SeqID_71096
ccttgcaaaatatggtgcgaatctgatcagtttaattaaaaatagttaagcgtaaattgtatggcatgtttaaaaagaatcaggttcgaggaagtattggtaagccaaaaaacatttcaaacatttcaaaatctataaacaatttaaaaatgagaattcatgtgagattttctggaaataagcttaatagggcctagttaagctgtaaaaaaaatgtggggcgatttgaaagagaatagaaagaacccggttcgatgaagtgctggtatagccaaaacacatgcaaacatctaaaaatgtattataaatttaaaaatgagaattcacgcgagattttcaagaaataagctcaataggtcctagttaagctgtaaaaataattcgcaacgcattgaaagagaatagaaagacactggttagaacaagtttcagcaagacaaaaaaaatccacccatttacacatatattcagaaaataaaacactaaacttttaacaactaataacaatttttaaacaaacagccccccccccctgccncacgcccttgcccagcaggtgtctgtgggatttccgaataaaatttggttgatggaaaagtgtttatttcccgagtgccaagttatgacgtgccaaagtttttagttaccattgcttattttcccctgttcccggtttccacacattctttttatcagaaaatcaaaaattctttccagtactcttcaaagtaaacagatagtgttcaggattagtttaaaacccgatctatttaagaagcaatcagattgagatg

SEQ ID NO: 108003 - DNA, 1003 bp, Heterodera glycines
  Promoter: Source sequence=SeqID_14150; Location=173..1175; Strand=+; Gene=SeqID_78151
aaaattggcacttaaaaacttgaaagtacttaaacataaaatttttcatatatttcagaccaagggaatctcagaaaaaaaattgaaaaaagcaaaaaaatatgagcccaaccaacctatcaatagcaaaattgcacaacgaagtgaaaatatattcaaaaaaatttttgcattgaaatgaaatgcccaaaaatttaaaaaaatatttttttccttttctccgctggtttccaaaaaaaacaatcttttgtttaccaacttagtttattgttatgtatgtattgctggtgccagatagtttttccttatttccgccactttggataatttatcgacaaaaattcttataactttgctaataataaccatataattgcattcttacttttattcaatagcttaaagtttatttatattttcaaaaaatttcatttcataatattttaaaaaattttataaagaaaaaaaaatttttttgaacattttttgtcaaatcattttgaaaaatgactgttaaactacaccaagttattttaaattatttatttctgtaaaaaaggaacacttaaattaagtttcgttccttaggtctttcgtaaaaacttattttattcgataatttattttaaataataatctatttatttttttaaaaaatcaataccatgccttccaacaaaaacgaatttccttcgagcgaaaacaactttaaatatgtaatttaaatattttatttaaatttaataaatgtgatttttcaaatctattattaatttcaatttgattcaaagctttagttgcgtccgtacgaatggctttgtgttccaaaaaatgccacactcgcgctgatcaaaaaaaactacaaaacacttgccattgccacacacccggacaaaaacaatcaatgcagcggcaaattgtttacggtttgggttactgtacaatttaatttaatattttagcaagatatataaagaaaattatattcagctcattagcaatg

SEQ ID NO: 108004 - DNA, 425 bp, Heterodera glycines
  Promoter: Source sequence=SeqID_2585; Location=1..425; Strand=+; Gene= SeqID_80542
ataaatatttcaataagaataggagcaatcttgttttatgcacattcattcattatcattttatacaaactgtatacatattgacgtgcatattcatattcatattctcactaaattttacgccttttattttgtaataaaattttattaaaaaaatatatataatacatatatatattaatgtttatacaaaaggaaattattaattttactttaaaatttaaaagccaatttttatgagttccaacaacgtctagcaaaatttttttaaaagactcaaaaagcttcagaaaaaattccaaaaagtcaacgcctcttacatattatgattttatttccgaaaaatataaatttattaaaataatttttatttaaaagtaaatttaaataaatattcattaagtaagtgtgtgttaaaatccatg

SEQ ID NO: 108005 - DNA, 487 bp, Heterodera glycines
  Promoter: Source sequence=SeqID_6549; Location=7904..8390; Strand=-; Gene=SeqID_61978
ataatttacataatttttatttaatatttgttaaactgagaatattgtataaacaataaaatagagatgccgaaaaaagaattaaaaataaatttatgaaaattttttaccagtattatgattatttacttgcaaatcatttgcgtactaaatttatattagaaatgaatataaattttcaaatttaattgttagtagaaactgcaactttctttgcaccataactttggtgaatgataaaataattagagaaatctgaccagaaataacacataaaaaaacaattcaatatcacagtcattcaatttattcgataagttaaaagaccaatattaattaatacaaattaaatacataaaacaatatattatagtctataaactcaaactaataaattataatctcacataatatacatagttgactcttctgtagtccttaagatcgcaaaaaaacaacaaattttctttcctaattaatcgacatg

SEQ ID NO: 108006 - DNA, 189 bp, Heterodera glycines
  Promoter: Source sequence=SeqID_28449; Location=998..1186; Strand=-; Gene=SeqID_59066
tcccttttttcatgtatgtttttgattgaaaaaaaatatacatttaatcattttatttaattaaatttttaaaattagcaaaattctgcaaaaattttggaaataatattttaaaatacaaaaaccgccaaaatcataaaggataattaaaatttaattcgttgaaatcaaatcgacagtctccaaatg

SEQ ID NO: 108007 - DNA, 727 bp, Heterodera glycines
  Promoter: Source sequence=SeqID_7730; Location=686..1412; Strand=+; Gene=SeqID_65766
agaagttgaggctggtcaaatgcagaataaatttcgaaagaatattccaacaatgtcaaaatgtggcactttgaaattttaaattatggaaattaaaaaaaacatggctctgaggggggggggggggaaggggaagtgtcggtttgtcacgggagaagggggaggaaaggcgttggaaaatgtttgtcggtcatacggcgacccattggccgggaaatgccattcttttgcttctttcaaaggctgcttgtgatccggggcaacaaaagtcttcgcgagctgcacaaagcctccttctcagccatcggaaatgagcagtcgctttccattcaaattgcggacaatgccatcgaacggattcgctcctttgctttcaagtgccattcctcttttatgtacaatttcgacataaatttgtatcataaatgctcaaaatctgcgcgaactgtcaattgaagagcgctgcttcgaattggaaggctgtgccctcggggctatttcgcgtttggactttgtcactttgcacggggtaaggcacggctttttcctttcccttcaatttgatttggtgccctgcttaatcaattattgttaagcttcttccatttgattttcctccttccccccttttcggtgtgttctttggaaccgttcgccttccaaaacagcacattgatccatcagctgaacatcgccgcctcttcgctgaacaaattgccacggaatg

SEQ ID NO: 108008 - DNA, 202 bp, Heterodera glycines
  misc_feature (104)..(104): n is a, c, g, or t
  Promoter: Source sequence=SeqID_16214; Location=307..508; Strand=-; Gene=SeqID_80580
ttttcagtatcaaaaatagtttaagacccatttttaaatgctaaaaaataaattgaataggtttcaaaccaatattcggctatttaatagcttaaaaattaganaattttctgggtccaattcatttttcttaaaaaaattggaacaaaaatgccaaaagcagttaaaactatggcattttctgtgaactggtaaaactatg

SEQ ID NO: 108009 - DNA, 287 bp, Heterodera glycines
  Promoter: Source sequence=SeqID_26579; Location=891..1177; Strand=-; Gene=SeqID_57312
tctcatcaattatcaaattttatcgatttagatttaaaatctcttatttttaatatatggaaaccattttcgctaaaaaaatcggccaatcggcagatcaattggtacttatttagtttaggaggtacttttaatatacatttttaacaaaaaaaaatttttgttttaataagtgatgaaagtctagtttttgcaaagggttaataaattttgaatattaaagtcttttaaaatatccatgcttaaaaattatataaaatgaatacatttataggcatctgaaaatg

SEQ ID NO: 108010 - DNA, 297 bp, Heterodera glycines
  Promoter: Source sequence=SeqID_42808; Location=1..297; Strand=+; Gene=SeqID_70612
atcattattggcaatttatgttatctgattcaaaaatcagatcgttaccatcaggattttttcgcatttctactaaaatctgtgatatttgttcccgaaaagaaacattagaaataacgaaaactaattaagcttctgtaaaacacaagaaaagaacaattataatagatacattgtcagatggccacttaaacaagaaaaaccggaaattccaacaaattttggtttatgttttggtcgattaaaaggagaacttaaacaattactaaacgagattttacaaaaccaataaaaatg

SEQ ID NO: 108011 - DNA, 227 bp, Heterodera glycines
  Promoter: Source sequence=SeqID_1800; Location=6099..6325; Strand=-; Gene=SeqID_76031
acagatctccccccccccccccccccctcctttagagccatcccactccaataaatcctcccaccctcagagaagggtagaaaaatagagtcccccgggactataatagaatgacatattataggagcagaattttgcgtatttttgacgggaaggaagaatacatgatattaaaattctttaaaaaaatttagtttttttttcagaaattaaaaggatcaaaaatg

SEQ ID NO: 108012 - DNA, 212 bp, Heterodera glycines
  Promoter: Source sequence=SeqID_6284; Location=1..212; Strand=+; Gene= SeqID_61003
gggccaaaatgaaaaaataaaaaagggaaatggggaaaaagcggaaatttgcgaaactgaaaaatgcgaaatgaaaaaaaagcgaaatgggaaaacgcaaaatatgggaaaagcgaaatgcgaaatttttttttaaaaattctaccaatgcttttgaggttgtgatgcaaaaaaaaatcttccggttcgatctttttctcagataaaaaatg

SEQ ID NO: 108013 - DNA, 105 bp, Heterodera glycines
  Promoter: Source sequence=SeqID_3132; Location=4610..4714; Strand=-; Gene=SeqID_83335
attaacattcgctcattttttaaattttacttattccaaatcctattattttttaatagttaaccaatttgatgtacattctgatttggacatttttcagaaatg

SEQ ID NO: 108014 - DNA, 473 bp, Heterodera glycines
  Promoter: Source sequence=SeqID_15717; Location=529..1001; Strand=-; Gene=SeqID_80037
ttattaattaaaaattcaaaaatttattactttatttatatttacctcaataattgcaaattttttgaatccccaacagtttaacaattcaacaacaacaagaaaacattcatatcatcctttcgaattaaatatttttcataatctgttcatgaaacaatgcttaatctgtaggccactcggctagtccaagcgaaatctgaaaattatgtgtgtttttaatgtttcattttctcggcagtgcctcgttctcatttaaaaattagaaattagaaaaaggaatgaagctgatttataaaataacaaattgaatttattttaaatttgagaaaattgctgaaaaatatcgaatgctgatcgagtgcttaggctctcgagtcttaaataatgaaaaaatttggggttttttgagattcatattgtcccgaagtcaggtcttatatctctaggtcgactcttagtgtttgaatatg

SEQ ID NO: 108015 - DNA, 298 bp, Heterodera glycines
  misc_feature (51)..(51): n is a, c, g, or t
  Promoter: Source sequence=SeqID_9668; Location=2084..2381; Strand=-; Gene=SeqID_72265
aaatctgaactgaaaaccttgtttactcacaatacctcacttggcagaggnactaacaattaatcgattgcttctcctaagcaaactaatcaaaaatgaagagaaagaaaaacctacacatatacctatgtacattgcgccaatttaaaaaaacggttagggttaggtttaagttcgaacttttcgacaatttattcgccattgctttgtgtacctctgcattaatatccattaacaaatctaatgtgtataatctttcatcctttttttagctggcttcgcaaattaggacctcatg

SEQ ID NO: 108016 - DNA, 555 bp, Heterodera glycines
  misc_feature (30)..(30): n is a, c, g, or t
  Promoter: Source sequence=SeqID_18188; Location=3030..3584; Strand=-; Gene=SeqID_82776
ctccaatttccattttgtgtccaatttacncgggagccggcggggactacagaaaattaaaattgaattatgaaaaattcatttcaataatttcagcgaggcatggaagtttttgacactttttactttatgccccccaccccccgaaaaaccaaagggggacaatattttcaaaaactttagtccataattggttttgatgacgttgattaagattctgatatttaattccgaatgcttttcccaatttgaaaaaaaacaaccaaaattcacataaattttagtttttcactttttttgagttttggttagggatttgtcaaaattagtatcagctttatgattagcgcccccgaaaacccctataaaaatttttttcgtggagtctaaagtaaaagcatcgtgggttttaaaattaaaatgtgccgaattttttttaaaaaaaatattaattcatttttcttactttttaaaatatgttttcaatttttactttgcattttttgaaaggaatgtttggagaatgcaattcgtctccattttgtgcccgaaatg

SEQ ID NO: 108017 - DNA, 686 bp, Heterodera glycines
  Promoter: Source sequence=SeqID_119; Location=1928..2613; Strand=-; Gene=SeqID_46827
tccctcaaattgttggcacgaatttgtaaaatgctaaaattagtaaataagtcgtatgacaaaatccaaatttcttaaaatcatttaaatcaaaaattttcaagaatttctgattgtacctttattttttcatacaaattaataaaaaaaacggagttatagaaaaattttaactaatctttgggcctatacatcaattttaaaacgaaaaaagccaattcaatcgccaaaatccaatgaaagagaagtatcaaagaatcaaagatcaaaaaaagttcttttgaaatttgaaaacaaaatgccataaaaattgccaaaaaaattttgaaattttatttttattcgaactcgaagtaaaaggtaaaaacgcaccgaaccaaccctaacttaaaacaataaaactggcaatctttcggaattgcggtcccgaaaaaaattttttttttaaatttgtaacactttttctaggcttaaaaatacgctaatcactgaactcggattttgaaaaatctgacatccatttttgaccaattcgaatccttaactcaaacaacaaaatagaatttcgactttttgattcaagttttagaacagcgctaaattttgaaaattatcagtttttaaattaaaatttttttttcattattccccctcaaaaaaaaaaatccgaaaattcagtggtcatg

SEQ ID NO: 108018 - DNA, 1003 bp, Heterodera glycines
  Promoter: Source sequence=SeqID_6; Location=11157..12159; Strand=-; Gene=SeqID_50788
acaattgcgccgcggaaatttgcgccgcgccatatgggatacgagacttgaattaatcattataatttctatgagatagaagctgacatgatatcaagattagaatcaacattttagagtgataacatgaagagatgcgaagaggacatagaatacagatgttggggaaatgctcttattttcaactttgtagcaaatagtaatttcgctcaatttccatttgcgtgtcttgaaatgttcgtccacgtaaatgtcaaagcagcggttgatcaatgcaatttcggggccaaattgggaaggcgtaagaaaatcaaacaccaaaagccaacaatcggcgcagataaagctgaaaaattgaagaaatatttaaaattttttgttgaatttttacatttcttttttgttggggcgtcgtcgttttttgacatggccaaaaaataaccaaagagtgatggcacaatcgaccaacagcagaaaagtgcagcaacaaaatgagaaaaatttagggagaacgaatgaaatgaggaggaggaaacgaaaaaagggaccacataaaagcaagcaaataaataaattaattgtctcttatgtatgtcatgggaatttttttttgggggggggggggggggaaccactttaactactaccaaattctttagacaatctttcaattatcctaaaccaattggccaacaaaaaaaatcgagaaaaataaatgagtatgtatattatagaaggaatgaattaacaagcatttctgagagaaaataagcacaacaattgagatcgatcatttctcaaatacaataatattcatttccatacacttaatcagacgacatctttgttgcttctatccgcttcttcttttcttccatcactttttcttctgctgctcaccgcactaaaaaaagaaatgcgtatttttgtttaaggtatagtgagtaaacatacgcggctggagcggtccttctggcgttcaacgtaatccgattttgccatg

SEQ ID NO: 108019 - DNA, 69 bp, Heterodera glycines
  Promoter: Source sequence=SeqID_21379; Location=866..934; Strand=+; Gene=SeqID_51986
tgtacgttttgcatatttgttcacttaaccctttacttctcattttttagtctattcgttgtgccaatg

SEQ ID NO: 108020 - DNA, 326 bp, Heterodera glycines
  Promoter: Source sequence=SeqID_2094; Location=963..1288; Strand=-; Gene=SeqID_77817
tccacccaacaatttttaattggttttaaatttaattattttattacttttaattcttaatttctttttagcgaaaagcatttaattagtgatctttcttcaattcatcaccaacaaaaaaaaagggacatcagcagcgaacagtcaaacatcagacggaattgctttggtggacattcaacagacccaccagcagcatcgtcagtccttcggcacttttttggcttcaagcaacggcacagtgcttcggcggactaaaattgtgaaggaagtccgactgagggccgacaatttgaataggtatttcggttggttcgaatttaatg

SEQ ID NO: 108021 - DNA, 1003 bp, Heterodera glycines
  Promoter: Source sequence=SeqID_43775; Location=255..1257; Strand=+; Gene=SeqID_71369
attgaaaaattacaagtttgagaattaaaaaaatttcttattttttttccttcagtgttcttcttctaaatcgccgtcgggaaaaaactttattttttttttgtaaatttttaaattttcagttgccattaaaattttttatttgggtagaaaatgtgcgcagggcggaagaaatgtatttaaaaatgtaaaaaaatatttatttaattcaactaaaattcaaaaagattggaagaggggtaattgaagcttgcttgcttgtttcccaaaaaataaaaataaaataaaattccattttctaattatttaaatttggaaacgcacttcagcaaggccaaagttggccgtgcccgcctcctccagcccgtacttgtccagcgtggcgcgcacaacctgctccgcggtgtcggtggcgttcaccaacagagtcacatagggccgatgcgggaacagttcgactccgtaaattttcaaactcccacctgttcagcagggtaaacaaattaattcaattaaaaatgggtaattaaaattaaaaaaaaaattaatcagtgcccaactacaataattaattattgtaatttacaaatccgttaaagattttaatatatttttaaaatcctttctaacattaaaaatttttgaaaaagtataaaaaaaatttaaaaccatttttttgaatagttaaagcaaaacagcgaaaagaacttgaactcacaaataaaccaaaactcactatttgtatttcaaaaaattttattgttagaaaaaaaaatttacaagaaaattcaagaaaaaaaaacttagtaattcataataaaatttaaaaaatcgctaggaaattgtttaaattttttttcttgaaattttcttatatttaaatgtttttattttactttctctctctattactctctccccctcctctatctctattactctctctctccccctttcctctcactctctctattactctctcttccactgaccgctgttcatg

SEQ ID NO: 108022 - DNA, 101 bp, Heterodera glycines
  Promoter: Source sequence=SeqID_28306; Location=1142..1242; Strand=+; Gene=SeqID_58931
ttcccccgtaggctttgcgtgttgcgccttggtcatcctccgcgtacgtcgtccgcgcctgctgggccctgtttctgctgtacgaatgctacaagaccatg

SEQ ID NO: 108023 - DNA, 666 bp, Heterodera glycines
  Promoter: Source sequence=SeqID_24528; Location=503..1168; Strand=-; Gene=SeqID_55253
tttttcgagtttttgcgacttttttcgagattttttttactttttgaggcaaaatttgaattttagcgaataaaatttctatcgataaaaaggcaatgaaacctggagaattttttcttaattgttggaagaatctcttttttatgcctattttaggacctatttataaaataagtgcctaaaaatacgatcaaaatgttattctataaattattaaaaattggatttttttaactttcgcctaatttttcaggacttttttgcatttttacgtgtttttttggattttttgtgactttttggctattttttcaggacttttttcaatttttcgtgacttttttgccttttttatgactttttggcgattttttatgacttttttagtagactttttgaagatttttagtgacttaaatttccagccctagtgatgaaggaaggcttatatatttgtatttctggcaatttcttttttctctttttttattctgatcaattagcgtggctgtcacaaggtcttttaatttggcaattgcgcacttcacttacaaccattcacgctttgtatgcgtgccaatgccttaacacacgtgtgccttttggcattttaaaatgccattttggggtggactttagtacttcttattatatcagcttttgatg

SEQ ID NO: 108024 - DNA, 199 bp, Heterodera glycines
  Promoter: Source sequence=SeqID_25835; Location=1..199; Strand=+; Gene=SeqID_56600
ttaattaattaaaattgaaatcccatttttaaaaggggtaggaactgtttttgatggagaacggctggagaaaagtgagaaaagttgcgtttgaagctgcctttctgttagccaaacgtatgaaaaatttcaccagaggaaaattttttattcaaaaaataaaattgaaaataaaattgaaattttaaacaaattgatg

SEQ ID NO: 108025 - DNA, 339 bp, Heterodera glycines
  Promoter: Source sequence=SeqID_23378; Location=2498..2836; Strand=-; Gene=SeqID_54088
ttttttaaaaatttttgggcattttaatttccaccaagatttttcaggtggattttccttcagcaagatgaccgctaatgatcaccaggagatgaaagtgccaaagagaaatttgctttttttcatggcaaaaaaaattggtccaccgcaacgttcatttaattgccatcggagagcaaatacattcgttccaaagatttgatccattcaaagattgggtccgtttcaaagattaggagtttacggtagtcgaaaggaaatggaaaattatttggacattttttggcaatgaaccgtcctcttccgtgacggcaccgctaattggttccatcaaaaatg

SEQ ID NO: 108026 - DNA, 1003 bp, Heterodera glycines
  Promoter: Source sequence=SeqID_12053; Location=517..1519; Strand=-; Gene=SeqID_75581
actatttcttttgtctttttctttctcttaactatttcttttgtctttttctttctcttaactatttcttttgtctttttctttctcttaactatttcttttgtctttttctttctcttaactatttctttttcttttgacaacttttttacttccaattaggtcatttacatgctttgtgtttgcacttttgacctgtttaactgacctccctcctccacattccttccttatcattagggatcggatttttagtggcaaaaaatcccaaaataattaactaaatagtgagaaaaaaatccaaaatagtggcaaaaatagtggcgaaaaagttccaaatttaggggtgtaattttttaaatagctatttttaattttaaaacaatttaaaattaaggaaaaagattttattcactgattgcagttacaaaatattttcttagaaaatattgaacaagaaaaaaaaatttgggggaagaatttttgtgaaatttttccaattcttaggggtatatttttgaaaatttttaggtcgattcttaggggtgtatttttgaaaattttttaggtcgattctattttttgggaaattttccaaaaaatgccaaaatagtggcaaaaataatgacgaaacgccaaactagtggcaaaaaattattttagtggctaacttccgaaatagttttttttagtggcgaagctccaaatagtgattcctagtgatgaatagtggcactaaaaacgaaaaatttcgaaaaagaatgtgtttttcgtgcatttctcgtcgagttaaagccgcagaaaaaatagttaaaaaactaagaatccgatccctactggtgatgccgatgcaaatttacataatttaatattttctattgtttctttggaattttataaatttttagtttccgtggacctttaggttaaatttaaattatcattataaaaaatactaaaataaatcaatttaaaaattaatttagaatataatattctaatg

SEQ ID NO: 108027 - DNA, 151 bp, Heterodera glycines
  Promoter: Source sequence=SeqID_3504; Location=5840..5990; Strand=-; Gene=SeqID_84945
ttgttgttgatgaaattttgcaagactgatttgattgtgcgagaaaatcttggcttaaatagttttaaaaagtgggcgtggcctaattttccggggagtataaaagcccccggcaatttgtcagctatgtctcatttgttctgctacaatg

SEQ ID NO: 108028 - DNA, 66 bp, Heterodera glycines
  Promoter: Source sequence=SeqID_4314; Location=2082..2147; Strand=+; Gene=SeqID_54005
gccaattcttttttttgctgtagggcagaagcactcgacaatatagaaaaaaaatattcaaaaatg

SEQ ID NO: 108029 - DNA, 628 bp, Heterodera glycines
  Promoter: Source sequence=SeqID_27405; Location=1066..1693; Strand=-; Gene=SeqID_58099
agcattttaacaatcttaagggaacacgttgtcttggtgctgtcctacaaagtgtctggagtcagtgcgctttttgctgactttccccaaatctgttccaacataaagcttttgctgtgtttcctgcgtaaatatattgatgagcaattcccggacgaagagttggaataagaaattaagggaaaaaatttttttacttaaatattaccggaaaatattgctttgtgtcccgtcatttgttgattttgcatattaatatgtctattttatgctttctgtagcacaaaagtaaagattaattgggacttattttatgatgcgaattgctttaaattactgttaaaatctttttttgttaataaattaattaatcatcaaaagatcacattaaactaatagaacattttggaaaatataatgcttcacaactttatgagaactcaaaaatagattcttttttgattccatttttcatttattggtattatttgattgctcgaatcgacaacaattgctaccctaattttaggcatagaaatacgaattcgccagggcaccaccgaccaactgccttccggtcgctgcgtttgtcacctcgtacggtcgacttcatctttacgactacatg

SEQ ID NO: 108030 - DNA, 220 bp, Heterodera glycines
  Promoter: Source sequence=SeqID_10736; Location=912..1131; Strand=-; Gene=SeqID_73984
ttattttgggctcgaaaccaactttaatggattttcgagggtgctgattacgaatcttaactcgaatttacccaattccgaaccccggaccctaattcaaacaaaaagttgaaacttttttccaagaattaaatttttgcttgtagtaaaagcttctaattcatttagcaactattttttgatgtaaaacaatactttaattgttaattggataaaaatg

SEQ ID NO: 108031 - DNA, 119 bp, Heterodera glycines
  Promoter: Source sequence=SeqID_7976; Location=2264..2382; Strand=+; Gene=SeqID_66558
tctgaaaaattaggtaaatgtttaaatttatttgggagtcgaacaaaaaaaaaactcactaaaaaaagggcaatagctttgccggcaagcgcaccacaaacgacgtccacgttgtgatg

SEQ ID NO: 108032 - DNA, 369 bp, Heterodera glycines
  Promoter: Source sequence=SeqID_2585; Location=1112..1480; Strand=+; Gene=SeqID_80543
ggcaaaaaaccaagggcatagcttagccagacacttggcttcgggaggggaggctaatccccgcccgagattgttctttggccttatattttttagactcgattttttaaaaattttttttgtatggtaggatacagtagatctagatccgaaatgcgcctgcctggaaaattttggaattttgccgattttttaactgattttcaccaaaattgcgttttttatgttaagttttaaattataatgaaaactcgcaacaaaactttgtatttttcaaaaattatttattttcattaaaaattttcattttttagtttccggaggggggggggaagggaattcgcaaaaatttaattggattcattcatg

SEQ ID NO: 108033 - DNA, 83 bp, Heterodera glycines
  Promoter: Source sequence=SeqID_17442; Location=1..83; Strand=+; Gene= SeqID_81928
tcacaaccgtaaacggtggggagtgcaatggcaatgtcaacggggccgaaacggtgccaacattgttgactgccactgaaatg

SEQ ID NO: 108034 - DNA, 271 bp, Heterodera glycines
  Promoter: Source sequence=SeqID_32279; Location=672..942; Strand=-; Gene=SeqID_62589
atctaagttttagattctaaagccctttcttacattcacgaaccaattatcaaaacgtgacgaatcgatttcatcagttattcctgtctacaaatgctttcaaaattatctccgtgttaatggcgaagaaaatgagcccattctgcgtttaaaaaatgttataaaagatggattagaatcccgtatgcgagaacaccaatctaaaatgtaaattttggattttttttgttgtcatatttgctaattataatgcttaagctttttgcgcatg

SEQ ID NO: 108035 - DNA, 586 bp, Heterodera glycines
  Promoter: Source sequence=SeqID_34385; Location=1..586; Strand=+; Gene=SeqID_64194
aaataatgcgcataaaatatgcaccaaaaatcgtgaaatcccttcataaaaagtgaaaaatatgcacataaaattttccaattcgagggtgtaatttctcaaaatttcttcaaatttgttaaacataaagtaaaatcttcaaaaatggctaaatgtggtattaaaaatcattttaggagaaaaaaacacgatacagcttaaaatttactcattttagcgaaaaatcaacctgaaaagcaaaattttgcttatttttgacataaattaaccattttttgagaaaatttatttattcaatatttttcgtgaaaattttgctaaaaaattatttttttggaaaattttccggtttttgaggtcaaaaaggccaatttgtctgttgggggccgatctattgaggttttttggaaaaacgccaaaatatgcacataaaatatgcacgaaatgccaaaatatgcacataaatcgcgaaatatgcacaaatatgcaaaatatgcatatggaaatccatcctagaagcttcaagccatgctaaaaacatgtttttcatgcgtttcaggcctcccacagtccaggaaaaaatatg

SEQ ID NO: 108036 - DNA, 202 bp, Heterodera glycines
  Promoter: Source sequence=SeqID_6904; Location=899..1100; Strand=-; Gene=SeqID_63247
tcttgattaacacgccgcgtcacgttgacacttcatggacacaaagcacacgaataatttatttcccaattatgaagcagacacggaatctaaggccacatagaagtacaataaataaaaaataaataaactaatttaagattcaacctttgcttcatagttataacatgcaaaataagcctttttctcagcacggtaaatg

SEQ ID NO: 108037 - DNA, 328 bp, Heterodera glycines
  Promoter: Source sequence=SeqID_7791; Location=1380..1707; Strand=-; Gene=SeqID_65982
tctaaacggaataattaattagtgaattataccaattatatgtagtcaactagctattacacggagtaatttctggttaattagcttgcaaattggttaattaatgagctattacatattttaagaaaagtaattattattagttaattaggtgtaaaaaaatgatgcatctgcaattatttaattagaccaattatataatcaattaataattagatggattatatttgttttagcggttacacctacatctaattgggttaattaattaatcagctattacaaaaattaattaattataattacaaataaattagacgtaaaaatg

SEQ ID NO: 108038 - DNA, 176 bp, Heterodera glycines
  Promoter: Source sequence=SeqID_10346; Location=487..662; Strand=+; Gene=SeqID_73525
aacctttgcaagtgcaccgacgcacttttcacaactttacgtcattttggcgcggtacttttttgtcaattttgttttacattcgtttttcaccaaatttcagtcgtggtgactgggtgtttccggtccttcactgcctgctgacgtgcaagtcgtagtccacgtacgaaaagatg

SEQ ID NO: 108039 - DNA, 110 bp, Heterodera glycines
  misc_feature (25)..(25): n is a, c, g, or t
  Promoter: Source sequence=SeqID_20371; Location=1..110; Strand=+; Gene=SeqID_50894
taattatttatagataaagaattcnatagtcattacatttacatattatatgcattattattaacaaagacaactttacatctcgaatattattcccttcctgagaaatg

SEQ ID NO: 108040 - DNA, 1003 bp, Heterodera glycines
  Promoter: Source sequence=SeqID_5745; Location=94..1096; Strand=+; Gene=SeqID_59103
tggaattgagaaaagacaagaattggtggcccgttttacctaattctttgttattttcatatatattttgtctctcaaatactctttttattagattttgactaattttggttaaaagtgattttttaaataatatcacatgtctctattttagggaaattaattacagttcataaaaaaaattttttttttaaattttgagttggccctaaaaaatcaaaattgatcattgagaaaaattattttataactgtttttaattggttttttgttagtttagcctaaattatttatcatacaaaaattttttggttggattttgactacttttgctaaaatggattttttatatacttatcattaggttaaaaattttattttggtatcagatgaaagagcacacttcaatcaataagaaacttatttttgtttatttttatctcacaattttccgtgtcaaaaggctcatggtaaatattgcaaccatgggtatgatggtggtagcttttctaaccaccaactcccgtcaaatgaccacgaactaccttcttattctacgggttaaaaagagggtcatggtcatggttaaatgaccaccaacttcatggtcatttgcccaaagttcgtggtagctcttattctgcgggttttaccaccaacttcgtggtcatttaaccataaccacgttcttattctacgggcccagacggcgaacgaaaaggcagccaaaatgaggttttcggattgctttccttttcctgagtcacacattcatttcggtgtacagacatttcgccaactgacatctcgccaacatttatttcgccaacttaaccaaaatctgacatttcgccaactgacatttcgccaagtagtcaaaaaagtaatgaaaaaaagtaaaaagacgaaagaattgcatcaatcaaagcttaagtattcctttcatttttataagttcttttctaaccaaacaaaaaggtaattcagattttagtaagaaatg

SEQ ID NO: 108041 - DNA, 344 bp, Heterodera glycines
  Promoter: Source sequence=SeqID_15384; Location=259..602; Strand=+; Gene=SeqID_79646
tgtgagtcgtgaggaaaataactttccttttgtcgtatttcagataactttcagccacttttgcttctcggacccgcagaggtgtgttaaaatctaaactaaacaaattaatgttccgcatggctacggccgcttaaattacgacacaacggctacggccacctaaaaatctcaaaattgtggaaggcgtggcgatttctgatgaatttaagttcagatctaaaacaaataaaattctgatggactccgtcgccgtgccttttcttttggacaacgtcccgtctttcaagtttttctccaggagatttgtcctttccaatcacttcgtccacactttcaacatg

SEQ ID NO: 108042 - DNA, 299 bp, Heterodera glycines
  Promoter: Source sequence=SeqID_2466; Location=1219..1517; Strand=-; Gene=SeqID_79862
tctggagtgacaatcattgaaatggggtttaaaaatgctgattttgggccagaattagtggaaaattggattgggagaagatcaaaacaagtttgaagctcagttgccttaaattggtagctagagctgtttattggtacgcagggccatattttgattgagtcaattgttaattgtttggcaaaaaggtagggatttgagaaaatactgcgtgctagagcagttggatttgagaggagggcagaagaggtccagtgtttattttcatcaataaagttacatagctgggtgagggaatg

SEQ ID NO: 108043 - DNA, 406 bp, Heterodera glycines
  Promoter: Source sequence=SeqID_11432; Location=597..1002; Strand=+; Gene=SeqID_74827
aaccatgactattccttttattaggtcgtttcaaaaaatataaattctcgcacttttcttgacataattggtgtaattctatggcctaataggtcggtattttgatcacataatttgaaaattcatttcttcaaattttattaattttttggaactttactaaagtactattttaagccaaacttaatttaaattatatttatgtaggacattattaaaaagaacgacccaataaatgacaaactcatttccagtccaatcgcatttacctttactttatgttttgtttagcgagtctttgttggtgtggcgtggactgtttgtgttcagcaaacaaggcttctttaactgtacatgcacagctgtgagcggcggtcttgccgtgttcaaggcgagccgtgagatg

SEQ ID NO: 108044 - DNA, 64 bp, Heterodera glycines
  Promoter: Source sequence=SeqID_37214; Location=153..216; Strand=+; Gene=SeqID_66338
ggtcaaaaaaataaacaaaaaaactctgtctaaattatttaacaaaaaaaagtatcgggaaatg

SEQ ID NO: 108045 - DNA, 90 bp, Heterodera glycines
  Promoter: Source sequence=SeqID_43956; Location=668..757; Strand=+; Gene=SeqID_71516
tttttatctgcaagtttcgttcatttcatacaaaaactttgttcataattaggtaataattaacagttcagttaaaatttaactctaatg

SEQ ID NO: 108046 - DNA, 383 bp, Heterodera glycines
  Promoter: Source sequence=SeqID_7173; Location=3064..3446; Strand=-; Gene=SeqID_64042
aaaacattaagaattaattttaaaacaaataattgacaattacacctttttgttgcgctattttttttagcgattttgggcaatcttcaagaaaattaaggatttttaaggtccggtttaattattattgttgagttttttttgtggatcgactcatttgtcagcacggatgaaaaggaaggaataaaggccaatgaaaggggaagtcatcgctgaaggcaatgggcggggataagcaattacaataggaataaatgcagaagaatgggagaaaaattgtagagaaaatagtaggcaaaggaaatgatgaaatgagagagaaaacgtatgagaaaaacaaaatagtagaatattatggatgaaaaaataagataaaggtgatg

SEQ ID NO: 108047 - DNA, 579 bp, Heterodera glycines
  Promoter: Source sequence=SeqID_27967; Location=1..579; Strand=+; Gene=SeqID_58626
tgccaaaaaacctatagttttccaggtgcgccatcaaggtacgaatgggtggtgcaaattcaccccctagctattcccgggaggcaatgcaaattcaattaggttacataaaaaaatttacattttatatttcctcattaatatttccactttccaaattattctttttgcaaaaatatataaaaaatttttttgcaaaatttattcaacacatgttctttgtataatccataataataaattatgtaattatgtaaccatctcatcatcatcaccatttttgccagcttacaaaacaatcgaaataaatggaaataatttgtccattttatttttatttgataatttacattttatttctcataatcgctcgaattgtagttttaaatttggttagcttttgaattttttaataaatactcatgttttttcgaaatgcttaatgcttaagtgtaaattttacttctttatcaaaatcatgcctcgaattatacgcattacttttgtttgttttttgaataacatgtaatattttaattttttttttaattttggcattcatttttcattataaaaatg

SEQ ID NO: 108048 - DNA, 867 bp, Heterodera glycines
  misc_feature (626)..(626): n is a, c, g, or t
  misc_feature (635)..(635): n is a, c, g, or t
  Promoter: Source sequence=SeqID_8127; Location=1270..2136; Strand=-; Gene=SeqID_67062
aaaaacattgaggagataaaatatcttttcatttattctttttttcacgataaataacatttattttctttttacatttttaggaaaaaaatttatttcgcgaatttttataatttttatttatcttaaaaattattttaaaaaatagatttctattagagcccggatagaacatgatcttgtcatgatttgcattcactcaactttttgcttcgctcctaatccaaggccttgtcttcatatttgttttttaatccctatattgtatagccttacatatttttgatttttcttaagataattaagattaaaaaaaggtaacataggccaaaagaatcattggaacttgacacgggaccgccttttgcgttgaagtacagcagacagatgcattttatgaagcaatattggaacagcctaagaacgcaaactaaatacacgcctaagaatcgatcccaacaattttcagaaaatatacccctatgaaataaaaaatgtcaataagtttgatagtttttgagtaacgacccggcaccataattatattcataaaatttcctatttttggtaggtttaatggaatatgataagaaaatttgcccatttttccttgaaaaatcgcaatntaatatttntaaggaattttcttaaatgccaataaaccgaaatttattttaatatataatttgtgttcttttctcctatttatttaggcttttgaagaattttttgtcaaaaaacataaacgattttttatttaactatttttgtacaacagtttttgtagatatttttacatatttcgtaatttttttttttttttgcttttttttcatacatatataattaatatttccagccctaatg

SEQ ID NO: 108049 - DNA, 332 bp, Heterodera glycines
  Promoter: Source sequence=SeqID_10955; Location=921..1252; Strand=-; Gene=SeqID_74261
atttgtaaaacgattatttcgtgggtccatttcccccgcggggagattgattttgcgattttaaattaaaaaataatatttaaaaatttttggggtttttttggtaaaataagggcaatgtattgaaaataaaattttgcacaaaaactcatattttgaaaatttaaattgataaaaaaaatttaaaacaaaaagccggaaaatgggtccccgatcattaagccaaatagcattacaaattcctcttaatttttttacatttattttttaggaaagtattattttagtaaattttccaaaataataattttgaagaaacgccgccggcaatg

SEQ ID NO: 108050 - DNA, 206 bp, Heterodera glycines
  Promoter: Source sequence=SeqID_20544; Location=1..206; Strand=+; Gene=SeqID_51081
tccattcccatttgatcagttcgccggtcatgtgcactcctaaaaaatttatttgttttaattgaaattattaaataaataattataaaactgaattttatgaaatgaaaagcattaaattagtcaactctatgaatagggtttgaattacaaaaaatcctgttttacccaaattttaattgttggtcctaataatctttaaaatg

SEQ ID NO: 108051 - DNA, 507 bp, Heterodera glycines
  Promoter: Source sequence=SeqID_2276; Location=2876..3382; Strand=-; Gene=SeqID_78858
tcacttcttatttccttttcattattatttgttgtgtgtgaaaataaagtgtttacaaagacacaacaaaatggcgcagtcagcctaggtttttaatatcatcaaaaagcaattggcagcaagtcgaatattctgtaattctaattttattcgaacactcatttcgcccttccttttcccgtaacacatccttactgatcgttaagtcgacaagtagaccgcttacgtaaacagttaaggagaaggctttcttgaaatcgcaagccgtaaaaagcctctgtgatcactcttggaagtaaagtcggaattgggaacacacaagtcaaagcgaccgctgtgtgcagctcaaattcgcaacttcccaattcaagggcttgtctttttcctattcacatatcaatcaccgtcatccttatcaccgaacttgcctgccaattaaccacaaatcaaatttaaatctctgacggccaaatcactctcatttaatttcaaattctctctgtcatg

SEQ ID NO: 108052 - DNA, 646 bp, Heterodera glycines
  Promoter: Source sequence=SeqID_9576; Location=440..1085; Strand=-; Gene=SeqID_71947
tttttgttctgattattttatttttctaaattaaagacaaacattttatttttattagaggaaaagaaatgcaaaattttcatcatcccttaactttaaaataggatagaaattcattaaatccttatagaacattcgatgcaaaatttttttgtctatcgatttggaaaatttaaagaaaatctgtaaggcgaaaaaaaagttctatagagcgaagtgaatgttgtttttttacatgattaaaaccggagagatagtacgccaaagtgagagaaattacaaagaaaaagaaaacgacgagatagtactaggcttttctctgcacagtggagttgacccatagtgatgctggacaatgaattaatcgattacattaattgtccactgaattttctaaaagacgcaaccttcaattatatttcaccggccattgatggcattgaacttttatgatttaatgaattatttctagcaaattcaaggggtagggcccagcggcgccgtaagcgcgacccgagaaattttttgagattttattcgattcgtggcagaacctttttctttaatcaaaaatggcaatttgtctcatttaaaattttcttgtttttcagtaaaaaattaatttttcttttacaatttttacatg

SEQ ID NO: 108053 - DNA, 221 bp, Heterodera glycines
  Promoter: Source sequence=SeqID_14328; Location=1..221; Strand=+; Gene=SeqID_78356
gggtgcatttttcgtttttattgcatttttgttaataatcaattttcaaattgcatcaaattttcaaaattttccacgcggaccccccccccattttctctgtccacgtcccacccctgtgaggtgtagatattcttcaattttaccaatcctagctctgtttatgaacagtctgtatctttgttaggttcattttttagttctacaatattgtcttaatg

SEQ ID NO: 108054 - DNA, 922 bp, Heterodera glycines
  Promoter: Source sequence=SeqID_12397; Location=931..1852; Strand=+; Gene=SeqID_76007
actttttggaatcaaacacactttcctgtttaaattttagatagttttgcggttaagcattaacggcaaaagcaataaataaatgggtttaactgttaataaataatagagttgcatattgtttttgtatatttgagccaattaagaaaataaaaaacggataagtgggaattggtgtttattgtaacaaaaaagaattgatagaataagttagaagtttgtatatccgtacaaaaaatgattaaaggaaaacaacaataaatgcagttttttggggatttgaagaaaataattaagccttctgaatggaaaacgaaaaaatggaacaaataacagaaaatgaccaagaaatgaaaaaaagactgaaaaattcaaaaaggtaaattaggcatttcagaatgattgtgccgattaaaaaatttgaatgatggcatttttatttttaattctcatttcgggccaaatacaaaatgacaaaagtattgttgcgcgggttttgaaaaggaagggccgtttcagtccaaaaattattcgaatatttaaattaattgatttaattagtagggctggcaaaaatatgtacaaaaagtggtaaaatatgtacataaatatgtaaaaaaaatcctgaaatatgtaagaaaaataccaaaatatgtaaaaaaaaattttaatggtaatttttggaaaaaaaattcttagtaaagggtgaaataggcacaaaatgccataaaaatgacctaaataggcttagaatcacatttttgtatatttaaatattaatttttggtatctcctttgttgaaaaaaaccaatttttaggggtacatattcaaaaaattttatttttttcacaagaaatttttataaattttcaaaatttctcaaaaaaatttagaaaaaatgctaaaaagtccaaaatatg

SEQ ID NO: 108055 - DNA, 102 bp, Heterodera glycines
  Promoter: Source sequence=SeqID_10310; Location=1..102; Strand=+; Gene=SeqID_73489
aaaaatccaggtccaggcctggatccagggctcgaggagcctggatttttcctggacccggattttcctggatttttgtctaggaaatccaggtccaacatg

SEQ ID NO: 108056 - DNA, 612 bp, Heterodera glycines
  Promoter: Source sequence=SeqID_1290; Location=2029..2640; Strand=+; Gene=SeqID_71736
accaattgccttcgccggccaccctacagtatcctgcggcactcattgtgaaccgtgacccccatcacaaaggcggctcccattggtgtgccatttacgccagggacttggacgcgccagtgatttattttgatagccttgcccttcccataccaccaagtatttcatcatcctttttaaataaatttcccaaaggtttacacaaaaacattgaagcctaccagtccccattgacatcaacatgtgccccccattgtattgtgtttgtttaccacatgtcccacggaaaatcattcgataaatttatacatattctcaaaacttgttcaaaccctgacatgtattcattaataatgttaaataaaatgttgaacagttaaattatattttcaattttaattttttcaaaattgtgtcttccacctactaattatgcattattctacctaaaagttacattttccaacgcttaattattttcgtaatttattttccattcattaattatgcatgcaataaaataaaaaggggcggagcttatccatttgagttggaacaccggtataaaagccgctcgaatttcttcattcagacataaaaaaatctgaaatg

SEQ ID NO: 108057 - DNA, 583 bp, Heterodera glycines
  Promoter: Source sequence=SeqID_20079; Location=1..583; Strand=+; Gene=SeqID_84867
atgtatatgttatgaaatacataattgccttagcatttactctagaacatatttcttataatggcctttttacgaaacgccctggcacttttacgaaacgcccaaaatggcctttttacgaaacgccctggcacttttacgaaactacaaaaatggcccttttacgaaacgccctggcacttttacgaaacgcccaaagtggcactttttacgaaacgacctagcaccactttttgctagtattcatgttgcaacttttttataagttgttcaatcgcagagaaataccttatcaaaagcttccaaaggtgtaggtagagctttcgaatgatgccaaccaaatatataaaatttggccaactgaaaaaaaagttatgatgttttaaacaagtctgggacggaactgaccccctaccgcctgctgctgctggtgatcaaatgtctggccctcaaatataaagcaaaaataaaaaataaataaaataaaataaaaaaatgattcgcgaaagcaaaaaaaaaaattagattgcttttcttcttacagcctctaaatcttatattttaagatgatgaacgaaaaatg

SEQ ID NO: 108058 - DNA, 493 bp, Heterodera glycines
  Promoter: Source sequence=SeqID_8945; Location=1258..1750; Strand=-; Gene=SeqID_69763
ttcagaattttttttagttgataaaaactttctaacaatttttttaataggtattccggtttgaaatttaaaggaatttcccgagtctgagcattgaattatttttgaaatacccaaacacgcgtaagtcgatcattcagaattaacgccgtaagtggttgaccgaatttcaaaaaacacataaaactttctcatttttgaaattcgaattcgaaatttctatcaagaatcactccgagagaccaaggaatttacaccgagagttcgattcgaatcaaaaaactcgaataactcaatactgtagtaccatatattttgtaccgaataattaagatcttacaatttcgtgtgatcgacgacatcgacgctctcttcgtcctgtaccgctgataggtcccaccgccgttggagcagcaactgctactgcttgtgctgcccgtgcccgtgccgttgccgttatgagtgccgttgttttgttgttgtgccaacaatg

SEQ ID NO: 108059 - DNA, 473 bp, Heterodera glycines
  Promoter: Source sequence=SeqID_93; Location=4244..4716; Strand=+; Gene=SeqID_65286
gctgcatgaatttgttgtggtgaaagcagtttgtacgcggcgcgtacacattctttaggaatgcgacgtgaacacgttggcgtcttattggggtggggggtttacatttataggtaaatgtgggtttaggctaccgtttgcaaaacatcgcacaacggttgaggcgccggggcatcatcgagcgggacaatttggagtgccggaggcgcaaattgatgctgctgctgctggtgttgcagatacggttggaaagtgaactgtagcggaggaagtaccaaaggcattgtgaatggtgggaagacgggcagtggtggcatgcgcatttgcaaagtgctgatcgcctgttggacggcagctgaaagcatcggcgacggttgttggtgctgtgttgccgggacgcaatgtgtcaattgttggtattgctggtgctgctcctcctcgacatgttgctgctgctgctcctcctcgacatg

SEQ ID NO: 108060 - DNA, 195 bp, Heterodera glycines
  Promoter: Source sequence=SeqID_42231; Location=987..1181; Strand=-; Gene=SeqID_70177
ggtacaaaagggatcaaagtgatacaaaagtgattagaagaggtgcaacagtgattagaagaggtacaacagagattgaagaggtacaaatttgataagaggtacaaaagtgataaaagaggtacaaccgtgattaaagaggtacaactcgtgattaaaagaggtacaacagtgatcagaagaggtgcaacaatg

SEQ ID NO: 108061 - DNA, 109 bp, Heterodera glycines
  Promoter: Source sequence=SeqID_8385; Location=4825..4933; Strand=-; Gene=SeqID_67888
ttctataattttgaggtctgtattttttgggcaattttgctcaatgtgccagcgcgcttgcgccgcatcgagcgccttcgtccgcgtcgtccgcctgtttccaacaatg

SEQ ID NO: 108062 - DNA, 143 bp, Heterodera glycines
  Promoter: Source sequence=SeqID_25688; Location=119..261; Strand=-; Gene=SeqID_56433
taacaacttaaaaaagcaaaagacaattcaattctctgatcaattgtttatagtaattgtccacattttcaactaaaattccgtcgttgccatggcaatccgaagcgaattattatttttaagttgtttatttttaattgatg

SEQ ID NO: 108063 - DNA, 330 bp, Heterodera glycines
  Promoter: Source sequence=SeqID_15894; Location=768..1097; Strand=-; Gene=SeqID_80232
atttacctaaaaatgttattcaaaacttggattttttaaagaaattggtaaaaacaaagtcttttaaaaagagacaacaaatatttaaagaagcgactagtgagcaaattggattattaattgaaattagttataatatattaaaggggtactttccgctcacgaagagacaaaaatatagacttttaccatacgcaaattttgtaagaaaattagcaaaagttagaactgagacgggtgcaaagaaagtttttcaacaaaacggtggtggttttttcgttaatttgactcctttattattaccagtacttattgccgcgctaaaatatg

SEQ ID NO: 108064 - DNA, 565 bp, Heterodera glycines
  Promoter: Source sequence=SeqID_14096; Location=1155..1719; Strand=+; Gene=SeqID_78081
acattaatttttataaaataaaaaaaggctctctattatattaagatggtcgctgatcaagaccgtgaaacgccaaccatttttattttaaactcttcaaatcactttgaagtgatacttgaaccaactcgaatttgaatgctaattataaaatcttatatcgatcacacaatcatgtatttgtaagagtaaactatgcttatgaatattatttctctcttaaaaatgtaatttgattgggaaatattaaataataacgaaattataattatggccagcaatataattaatagattaaaatagttatattattaattaattaaaatattattcggtactgaaatgacccgcctcttctgatcaccactcatttgcctttttgtcacttcgcccacatttgcctttttgtcacttcgcccacatttgcctttttgtcacttcgcccacatttgcctttttgtcacttcgactcaccacgaaaatgacctaattcatcagtgatcaaatgcattttatgaagaaaaacctctcaatttccggtaaataaaaaaattgcataaaaatg

SEQ ID NO: 108065 - DNA, 1003 bp, Heterodera glycines
  Promoter: Source sequence=SeqID_25100; Location=361..1363; Strand=-; Gene=SeqID_55835
ttggagattaattgagtgctaatgatatttaaatttaatcaacccaactgaaacaaaagcaaataaacgaaggacaatgaataaattattaatttttatttaaatttaaaaataataattgtgaatttaaatatagagtttttggacaacaaaatgattaaaattacttttgacgaataaaagaaattacaaactgatgaaatgggaaagggcgaaaaatgcgaacggaatgaatgattgattcgttttcgttctgttccgactaaatcaaacgcttcccgtcaatcttgttttaaaaaaattagaagaattgatagttattcggccatttgttttcattaaaaattgctcgacaatttgacgaaatgtgattttcggggtcgctgatcacgaatataataaccatttcgaccttctaatcccggacccgaattcaatttattatagaactcggtaatactatagatggtggaccccattttttgcaaaaaatttttgttctaaaaagtcgtgaaatgtatatttgggtttcctgggtcggggaactcgaatccagcattctttgaccaatttcgaatcccatttgaacaaaaagtagaaaattcaaaattcattgttatgttcgtatctatacatattgaccattttatgatgttgcaatgctttttgattaaatttagcttattttgatcaattagaaaccagagtgagaactttgaattgaaaattttgttcgactttttgttcgaattcgggtcagggattcgaaattggtcaaaatgaatgttgtattcgggttctccgaccctgaaaacccacataaacatgtttgcgactttttagaacaaaaagaaattttttcaaaaaagagggcccaccatctaaagtattgcccccggctcccctgacgtgtcatttgcgatttcacataacgagcataaatgaacgaataatttcggtttactcagcagtttcaaaaaatttccagatgagctgataaatg

SEQ ID NO: 108066 - DNA, 165 bp, Heterodera glycines
  Promoter: Source sequence=SeqID_35667; Location=1..165; Strand=+; Gene=SeqID_65168
aaccaaaggggagcaattggaagcgcaaaatcatttttggcgaagatcgtcaaccaaagtttcagtttttagttcttttactattacgttttcgttttagagttcactgaaaatttggggtcgactcgcattgaacgtgggagagagttggcgaacacggaaatg

SEQ ID NO: 108067 - DNA, 218 bp, Heterodera glycines
  Promoter: Source sequence=SeqID_30836; Location=1..218; Strand=+; Gene=SeqID_61235
cagacttttggaaaatatatttgcaatttatcctcctttttgagaagtgagttagaaatgataaacttcacgattcaaaccagttttcggtgctctaattaaccgcgataaaaacattcgaatcaattaaatagcttctgagataataaggtttatcataaaatttcaattaaaaataaaccctcaattattggtatgaacgatactttccaaacatg

SEQ ID NO: 108068 - DNA, 527 bp, Heterodera glycines
  Promoter: Source sequence=SeqID_10653; Location=1106..1632; Strand=-; Gene=SeqID_73895
catcagcacgctttaacatccccttttatagatttaacacaaaatacaaactgggcaaaaaattcattccctttgctgggagggtaacaaaattgtggaatcaactcgataaagaactaataaaaacaaattctttaaatcaatttaaaataaaacttaaaagttcactagggtaatctgtaagaccgggaaagttagaatgtaacaaatttctaagtgatttggtatttcgacctcattgactttgacctcaatttatttattatttattttcacatattttgtctttttttaattcctgtgatcatccatatattttgtcacttactctacgacatttatctgatagtcgtcagagtaagtggttctcgcccttctgatgacttttttattttttatgaataaacaaaataaatttaaaaaaagcaattagaataaaacatttttactcgcaatttgatcacaaaaagtttgatctttttaaagagattgacagtatctattagcctacaaaattacgaaaaatg

SEQ ID NO: 108069 - DNA, 384 bp, Heterodera glycines
  Promoter: Source sequence=SeqID_2466; Location=1..384; Strand=+; Gene= SeqID_79863
acctatgattcccttcccccagactcattccaaaatcttttaatgtctgataatggtccccacccttcatttaacacacttacattctctgaccaagtccaacaacccgttactgcctcaccatctcaaatcaaagaacagctcgtgtgctctggctcagctgataagcaaccaaatctcacggatgctttaaaatccgaaccaaagcctgtttcccccactcctattgtcacaaattgggaaccacacccgcgcagctcaaatttttcaatagctccctttctaactcgttttaattttatcttgtgtatcattactctttctctaagtgcttctttggtatcatcctctcacagtcaatcatccttaaaagtcctccctatg

SEQ ID NO: 108070 - DNA, 275 bp, Heterodera glycines
  Promoter: Source sequence=SeqID_20288; Location=1..275; Strand=+; Gene=SeqID_85087
ttttcgaattattagatatctccgacagcacacactgattttcatcccccgaattaccgaaattttttcccataaggagggctacgaatatatattttttaatatataggtaatatgtataataattacaataatattttaaatattttattatattttagaatcaatatttgtattgcaaaaaagtgaatctttttgagagtgcaaccgcatgattatgacaatttttcgattttataaggaataatgcgtcattacactgaaaattgagcatg

SEQ ID NO: 108071 - DNA, 289 bp, Heterodera glycines
  Promoter: Source sequence=SeqID_21922; Location=1485..1773; Strand=+; Gene=SeqID_52558
agtgcattagcaaatcaccaactgagttaagtggggatgcttttggaaaaataatttttagagaatttttacaagccttaaatggggagcgagcggataagcaaaaaacaaacttaaaaagtcgaattagccatcaaaagccattactcatagcaggtgtcattaacaagaaaaaaatgaataaattagtctctcagggcatggggaaaataaaaataaaaaaaattaagggaagtaaaacaattcaaaaaagaaaaataatccaaaatcaaatttcaggtttataatg

SEQ ID NO: 108072 - DNA, 153 bp, Heterodera glycines
  Promoter: Source sequence=SeqID_1979; Location=4088..4240; Strand=+; Gene=SeqID_77144
tatgctaaaagtgcgttttaattttatttattcgtaaaatttggaaattttggcgaaattaaccataaaatgtaaattaaaaccctaattaattacaatttggtggccttcttctgccaaatatttggccaagtttaaaccgaatccaaaatg

SEQ ID NO: 108073 - DNA, 526 bp, Heterodera glycines
  Promoter: Source sequence=SeqID_3199; Location=2616..3141; Strand=+; Gene=SeqID_83644
aatcatttaattcgcttaattttcacgtcaatccacattagattttcatactgtagtgatctttttagtttttttttctttgttattgatatgcaatatttctcgcattgcattaattagaataaaatcattagttttaagacattcccagtgaaaacggctcttttaacactaaatttcatagatgacaataaataaataaattactttaactcattaaagtaaatacaaataattcgcttcccgaaccccgaaaaatcttcatgggagtgtctacacatccatgatgtgcatacttatcatataaaatgcatatattaattgcatttttttttaccaatatccacgccattgaccccaacgaaataaatgaataattaacattaattaaaattaaatgtttattgaaaattcaaaaaacccggtgctgcctatcggcatcgccgcaccacaaacttaccttttattaaaaagttgcttaaaaaagcaaaaattgatctttttggtgaaaatctgttacctaatg

SEQ ID NO: 108074 - DNA, 931 bp, Heterodera glycines
  Promoter: Source sequence=SeqID_747; Location=1601..2531; Strand=+; Gene=SeqID_46183
caaaatggaggaaaagactcaaatggggggaattatcattttcagtttacgcaccatttttgttggagtttagaccaagaaataattgtaattttagaataatttaaggggtgtttctgaaaggataaattttggaaataaattttattttttatttatttttggcttggggcagaatgatgtgtaattggcagaataaacgagcagagagcagcaaacagcggtggttaaaagggaaaatatgaaaacaaacaaacggacaaacaaacaaaacgagagaatgaaattttgcgggacgacgggggaaagtaaaggaattattgcatttatacatagtggttgagaaatactttcagctcggcgtatataaccacacaaatatctaatgaaagaagttttatctttgtttttctgtttgcaatatatgtacctaattaacaatgagtcaccgctttttgtttttgttgccacataaaaaacgatcaaaaatttatttgagaataataaaaaaggacaaaacgcaaaatgggacatattttgagcgctaatcaaaaacacaaaattagataccaaatttattcagtttagttgggaatgaagcgagttatgtctgatcaaaataaaaaatacaaaaaaggtatttaccagtgtaaattttgaattagcgcgcaaaaattacgccaattacgcttttggcgttatgtgcaattttgtctaacattgggcttgacccatagtgagatagttgtctttggtaaaaacctatgtaaataaatgaaattttttggcagtaatagtctttttgagagatttcaaaagagaggcacgcccataaaaaatatacctgatcaaatatgtgttaatataacacaaattgttcttccgtttccgaaataattctgtttagctgttaataaaagcatagaaaatg

SEQ ID NO: 108075 - DNA, 67 bp, Heterodera glycines
  Promoter: Source sequence=SeqID_3028; Location=3679..3745; Strand=+; Gene=SeqID_82838
tttttaattacatttagatttaaaactctatatataacttttaattctgttaatttaaaaaaaaatg

SEQ ID NO: 108076 - DNA, 266 bp, Heterodera glycines
  Promoter: Source sequence=SeqID_31008; Location=1..266; Strand=+; Gene=SeqID_61364
tatgagttttgcctttgtattttaatcagtttccccatcatttatacattgttctaatacgtaaacatatttaattcatagctttaggatagtttcaaaatcaacatagtatatgcaattaattcacatttgtttggactgccggcgaagaaatcgcacccagtatgtcctggacggtgaactcctccaattgtgttgattcgccgcccgactggagcggtcgtcgcagtagcagccgtgtgggggaacatcaactgctgaaaatg

SEQ ID NO: 108077 - DNA, 181 bp, Heterodera glycines
  Promoter: Source sequence=SeqID_30073; Location=675..855; Strand=-; Gene=SeqID_60518
tgcgcgccgcaaatgtaacgccgcaaatgtcggcgccgcacggccaatcgggcagctctaccatttagctaccgaggcaccccaccctttctttttatatgtcttcttataaaccccccactttccgtattttaaccacccagccagcttcattcttacattaataatcatttagaatatg

SEQ ID NO: 108078 - DNA, 55 bp, Heterodera glycines
  Promoter: Source sequence=SeqID_13620; Location=1..55; Strand=+; Gene= SeqID_77529
gctgacgaagatcgaagcagagaatagtcaaatgaaaacgaaaattgagaaaatg

SEQ ID NO: 108079 - DNA, 558 bp, Heterodera glycines
  Promoter: Source sequence=SeqID_2406; Location=2291..2848; Strand=+; Gene=SeqID_79566
gttttttaatgcttacaattaatgcaccaattgtttcatcaaaatttttttttcaaaattgctcaaatatcaacaaaaaaaaaactgagttagatggtaccataatcattcgaattcggtcttttgaaactgaaaataaaaaatttaataggcaatttttgtaacaaatagcactcaaatttccaaaaaattttcccggcggcgcctatcggcaccgccggacctccattttccactatttttacaagttttttgccttaaaacggccaaaattgggtcattttttacccagcagtggaaaaaaagttattggttaaatagcaaaaaaaaagtcttcaggtcgggtcccccccccccccccgaaaaatgtttctagatacgcccctgcgtcaaatgatgaaaaatttggcctataatcaccaaaagttgccattgtatttttttaaattctactttcaaaccaacttttaggatacattctctacactcattaccatgttcaagtcgttggtccagcaattgtcttcttcttcgccgcccccctcatccgacacaatg

SEQ ID NO: 108080 - DNA, 318 bp, Heterodera glycines
  Promoter: Source sequence=SeqID_17598; Location=1958..2275; Strand=-; Gene=SeqID_82103
tcggtttgaaacgttacggcgaaagcataaccctcggacgccaagcaaaccgagaagacttgcggcaacgttcaagccataaaaagcctctgaacgcactgttgtaaggaaagacacatttgggaaagtacaagtcactgcgaccgctgtgctcacctcattacaacttccacatcaacaaaggtcgtttattgattttattgactgtgcgtggcgaactctcccaatatttgctggcgataaacattcactctcatttactcattttcattcacacaaacattggtccgactgaaaagcacttaactgatcaaaatg

SEQ ID NO: 108081 - DNA, 1003 bp, Heterodera glycines
  Promoter: Source sequence=SeqID_227; Location=2791..3793; Strand=+; Gene=SeqID_78604
ctttttgccttgtcagtcataagcctcatcatctatcaatttcgctcaatactttggttaaagcttacgttaacagaaaggcgtagtaagacgaatggacagcacgcaaattaccaaaattttaatgtcgtccgagaaaacgggtccgaggttccttggatgcttcccatgcgatcaattacctgacccaatgttcataaaattcccgtcatcgttgattgttaacttagacccccaccaattttccggctcgcattggattgcaatgtttgtttatggattaaataagaaagcaatttattttgatagtctagcgctaccgataaatgcattaattgttagctcttttctcaattcctttcccggagtaatgtttaaccaaaaagccgttcagtcattttcatccaattcatgtgcacatttttgtatttgttttgtttattttatatcttctgggtttactttcgaacagtttcttcaaaaatttgataatttacataatcccgaattatatgttaaatattttattcgcaatttcccaataaaattgtaaagaaattgcatttattttcattgtgtacttaggtctctcaaaaacgaaagcaatgaaaggtaaagtaaacacaatgtaccgtctagtgtcaggcaccaatgaatgaccactgaaccttgcccttcttcaacgacccgtcggacgctgattggctgagagcatattccgcgcctttatttatatgacatttcctccgcagaagagaggggagagtcgtgattggttgaaaggttaatcccctcctcagtgagcagtcaaccaaatgagtaaatatgaccgacaaaaatcattccttcttcggcaaacggaaggaattttcttgagagaaaaacattaaaaaaaactgcttagaaaattgataaaaatttaaaataaagtgtaaaaattgattaccatagtcttaaatacagaaaaaaaagaaattttgttcatttaaatttaaagaaaatg

SEQ ID NO: 108082 - DNA, 371 bp, Heterodera glycines
  Promoter: Source sequence=SeqID_8524; Location=1134..1504; Strand=+; Gene=SeqID_68393
ggtaaggaaagaattccgaaaaggtgccaatttccccattgaaaaaggtgctattggcatggatgcccaagctgcttccccgacgatgcggcaattgtgggcggaggagaaacagccggtgccctcagggcccgtgatgccaagcgaacccgggacattgcgcgggagttcgaggtggaaatcatctgggagtgccacctgaacgcaatgctggaggacaacccagccatgaaggcgtacttcgacaactgcccggactccggaccaatttggccgagtcctgcgccatgtcgaaagcgctggaggggagttcaaattcggcaactacagcttggacgggatgatggagcgccctgatgaggacaaaaatg

SEQ ID NO: 108083 - DNA, 564 bp, Heterodera glycines
  Promoter: Source sequence=SeqID_6683; Location=1..564; Strand=+; Gene= SeqID_62472
ttcctccgtgccatttccttcaataccgtaattcaactatttgcataatttaaggttttttttgtattctatacttacttaatgacgtaaactttgatacaccaaaaaaaggtgcgagtaaatttttcaacattaattgtcaaataatcaaccaaaaaattttaattgctctgtcattgtccaaaatatttgtaaaaaaagacaaaaattttgcataaacgaggcaaggctcaaaagaaaaatgcttaatgaggtagaaaatattcagacatatttttttgtgatttaatttgagtacttaccttttgtgtgtttttcttaccgaaaagtattttcatataccaatgaataatttccaaattaagtcaaaagcacagatatatttatatacaatggcaaatggaaaagcaacaaaaataaattacaaaaactgattttctaatataaattattcttcttttttctgccttcaaacgaattcatttaaatctttttaaatttaataaattattataatttttatcaaaaacaataaaaattttatttatttattttttgataatg

SEQ ID NO: 108084 - DNA, 663 bp, Heterodera glycines
  Promoter: Source sequence=SeqID_31975; Location=1..663; Strand=+; Gene=SeqID_62289
aaatttagaaaatcacgcctaaattttattaaattaaattttcattttgttattatagatataaaaacatcaaatttacaaataacaatttaaatgtccaatttctggggcttaaataattcagttcaaaaaagtctgaactcggtactttcagcaaaaacatcgctttggtatgtcctgttataatgtgcaaaaattggttctattggactttaggcgtccaatcagtgactatcccttttcttaagccataactttttttttacttgatcaaagccaacattcttaatatgattttttcgtaataatatttgctcaatttgtatttaataatttccgatactttaagctttagtttgataccaagaatgtaagccgaaaatatgtttaacgagaatccaactttaaatatgttagagtcaatttttacatttatataaaaaaccgtactaaaataacccgggaaattggatatcatttgcagctaatttttatgtaaatacttttgtaacattctgtagaaaaaaattgaccaattcagaatcggttaccttttataccagagacatattggaaaatcaatttccgacattttcggagcttggaattcaggttctcgattagcgcaattttttgagccgtaaaaatttgccgatactaatg

SEQ ID NO: 108085 - DNA, 356 bp, Heterodera glycines
  Promoter: Source sequence=SeqID_7154; Location=1819..2174; Strand=-; Gene=SeqID_63988
taattggaaaaacaaatcctaagaaatgaaaaatttatctccaaaatttatttatttatttcttgacaagaatttattttaaaatttttttagctcaatactgatttgacctaatttttttacttttttgaataaattttgtcttttacacccctaaattcggaactttttggcacctattttgggggttttttagaacctaaaacttacctattttggcagtttttagcacctataaatatcatccctagtgacaacgtttttctttgtcagttaaacagcaaatctggcatcataaagaaagcgattataaattttagataattgtttggccacgatttatgtttccaattatg

SEQ ID NO: 108086 - DNA, 1003 bp, Heterodera glycines
  Promoter: Source sequence=SeqID_15027; Location=1449..2451; Strand=+; Gene=SeqID_79190
ttatctgtttttgtaattcaaaataaaaattctatttaaaatcgaacgagtttgaaggctaaaattaatacaagtaaaaattcttcatttattttatttaaatatttatagaaaattaaataaaaattaatataataaaaatgatttctgccaaaattaatacagaaaaaaaaattcttttttatattgaccttaaaatgaagaaattgaagattgtaattcattcagcaaattatttataagaaaaaacataaatacaatataaaacaaataaaataataatataatttataaaattattttttatataaaacccagacaatcctaagaaaaatactttcgcttattcaccaaaatcgcattatcagagcacatttcatcaaccaaattggatgtcaaaaaagggaaacaatggtagggataaagcggaagacgggttttgctaaatccgtgtcgcccccgcaggctaattgggatgtctttttggctggttttgtgctcattgtttattgtttggcccgtgtgacccgctgatgaagaaacagtaaagtggccgtatttaatgggagtttcactaaagcattttgcaaccccaaaaatttggcttaattgttttagctagtttatcatcttttgtgtaatttaattccattcttcaaatgttttccaatttttgtattttaaattaaataaataaatttttgtattttaattcaaatttctcccatatttttttttattttaataaaactttttccaatatttcagtccaatttactaaaaacaaaatgtttgccattcggccatttccgttgcacaacaattgcatgttgctgaactgcttgatcttcatgctgatgacagtgatggtgctgctgcccatctctgacgctttcctgttcggtggtggcggtggctgctgctgcccgccgccatgtccgcctccgccggtgcgttgcgcaccgctttgcccaccgccatcatgctgtgagcaaccgcaatg

SEQ ID NO: 108087 - DNA, 707 bp, Heterodera glycines
  misc_feature (12)..(12): n is a, c, g, or t
  Promoter: Source sequence=SeqID_2135; Location=809..1515; Strand=-; Gene=SeqID_78031
cttcaaaagcanttatttggatactataaaaaaatataagaaatttttttttgtacatttttatttattaaaaataaagttttttctttaaaaaattttgagctttttttacgtaggtttaggcccattttcattttttttaaacctgggtttgaatccataaaataagagttttcaacaaaagccttataatttttttaaaagaggccgacatgtggaagaattgaacctgagaaagaagtaacagaatcaaaaagtcgggtccgggtaccgagtccgggtcttgaaaaagccgggtatccgggtctggacccggttgggtatccggacccgcgtaaccttattttatgcgaatatttttgggtttatgttcattacactttgccaaactgttattaaaattcgaaataatcataaattcaaaaatattggggggtcgttgtggtaccctaggtcaaaaacgggaaccaaaatataaaaaatttatcttccaaaatttgacatatttgatagctgtattagatataatataatttaattatattaatatatgtaattgatgcatcatattatgatataaatgactaaatgtggttaataattgatcgaataatctagccatatgaaaaaatgaataattacaaaattcatttataaaatattattgttataaatcttttcattttatttttacaaaaaaaataatg

SEQ ID NO: 108088 - DNA, 360 bp, Heterodera glycines
  Promoter: Source sequence=SeqID_472; Location=2695..3054; Strand=+; Gene=SeqID_53691
atcagacttttaagagagggaggtgttgtgtgggcaatcatggacctattatttatatttgtatgcattcctttttcctcttccaaacattgtactctgtacccaatcaataatgccctccacagaccaagtgcataaatacccttcgcttctcctctccctcgtctcttctcccattcattattcaaactcattcctcttccgacttctctcatcacttcttattcccttttcatttattatttgttgtgtgtgaaaataaagtttttacaaagacacaacaaaacacatcccctcccgacagtaaattctttaaactaaatttaacgattttaaatatgtacaattaattattagatg

SEQ ID NO: 108089 - DNA, 499 bp, Heterodera glycines
  Promoter: Source sequence=SeqID_22267; Location=570..1068; Strand=+; Gene=SeqID_52935
ttccgaggccccaaaaattttcagaaatcggaattccgtgccatccctgctacatacatacatagtttcctttttttcggtgctgttggtcgtaactcaaaaacatgggcgtggtgtactcaaaaaatcacaaatcagaatattttttgatataactttgctcgaaagcaaccaaatttttagttcttttgcatggatagccccaagtgtcttcgacggcattccgtcctgcaaaaattttgaatttcaatcccgctgcgggattgcacatgtgaaatttccgtactctaatattaaccagttaattactccttttatttatgtgttttcccaaaaggaattatcccccccccctccctccacctctacacatcatttaatttctacaaatatttgtcttttctatgataacacaacaatccccttttacattctaccaattaaattagattattaatatttattgtttaattgttattttaatatttatcaaaacatg

SEQ ID NO: 108090 - DNA, 190 bp, Heterodera glycines
  Promoter: Source sequence=SeqID_11149; Location=911..1100; Strand=-; Gene=SeqID_74499
tatgttgtactcatagatctgaaaggtaccaagaaatggtggattttagttgccctagtttttttatgggtactgtatgttaatttttaaggtcggatacatcttttaacgcctaattctgtatacccgcggtgtgtttgcgttgttcataaactttgtaaaattatatgtactcaattttccagtcatg

SEQ ID NO: 108091 - DNA, 708 bp, Heterodera glycines
  Promoter: Source sequence=SeqID_13881; Location=925..1632; Strand=-; Gene=SeqID_77826
ttcataatcctataatacaatcgtactacctagcgggggatgcgccgaaggcgctgaccccgctagttgtgcaaaaaggcctttatcagtgtaatttttgaattagcgcgctaaaataacgccaatttagctatttggcgtttcgagcattgttcaaacattgggcttgacctatagtgctgatttatcatcatttgctaatttcaagggatttgctaatttcaagagatcaacgtgatgattttttttggatactaattttttgagaaatttgctgatttttgaaaaaaaaatcctcaataatgctcatttttatgtattttaccaaaaatttaacaaaattcgttgaaaatttcaaataaaaatttcctggcggagcctgtcgctactgcttggctacaatattttattttttcataaaaaattgacacaaaatcgcaaaaacttttcatttttaaagtctgttaatgctaattttttgtcggcaaaatgctgattttgaaaattttaggttgggagccctggtttaaaagattttttggtggccccaagcgtaaaagtgccgaatttaccaacatttaaaattaattacctgtgcaaaaaactgaacatttggtactcattttctttttagaagcaattcaattttctttttttaaatacctcaaaatttcgtctgcaataatccgaaggcttttttcgtcgatg

SEQ ID NO: 108092 - DNA, 309 bp, Heterodera glycines
  Promoter: Source sequence=SeqID_32942; Location=1..309; Strand=+; Gene=SeqID_63161
gtttgtcctacttactgctattttgtgaccccgaaccccacacaatttgttcgaaagtcggaaattttgggagcagaacccaaaagtgagcaaaaatgtcgggatatttgcggacaaaaatcgcaatagagctaaaggctcttgaaaaggcgaaaactgcaaccgaattgtatgctgagccggacaaaactctgacctcattggaaaatgaaattctcctggaaagcgcggcagagagaataaagtcagatgtggaggcagtgaatgccaaaatcgagcaaatttggataaccgcaagcaaatggcatg

SEQ ID NO: 108093 - DNA, 636 bp, Heterodera glycines
  Promoter: Source sequence=SeqID_16523; Location=2447..3082; Strand=-; Gene=SeqID_80929
cctaattaatgaaaaaaagggattattaatttatataaataatgatggtttttttctcctccatcattttgccgttatttaatttcccatgcctaaccttaactcatattgaaataaaatattttttttctcatttttaacttttttatgttttaaattacatccaaaaatgtttttcgtgtcattcaataaatttcataaacataaaaatttaactcgatatcattcgattgcttttaaaggtttgaaaagtcatcgctgtccaattaatttcttttctcaaatattatttttaaataaataataattagagaccgggtttttagtttttaaactattttttttttgcggcttagttgtggcgagagaaacccaaaaatagcattttctccgaatagttttcgatttagagcgactttttagcaattattttcaactattttggcctttttcgaatttttagcaactatttttctgagttttaaaaaataaactttctgagtcgattatttttatggggggtagaaaaacccacaattacctgcttttaattagttgatcgttaaaaaaaaaaagttttattaaacgaaatgtattaccataattgtttttattagagtaaatttggtttaaatg

SEQ ID NO: 108094 - DNA, 485 bp, Heterodera glycines
  Promoter: Source sequence=SeqID_12648; Location=1888..2372; Strand=+; Gene=SeqID_76322
agttatgcgctgataatttaatagcagatagctgattaaagtggctctactcgaaatttcctaatatccgagattaagagacgaaaaatgatctcttttttcttggcacgatgtcgtgacgtgattctcgagcaccctagatgtccaattgaaacccactgatcattctttcccccggcgggtcatttaaattttgcatctgatcagttttctgcccaggctctctcattgggtcttttgatcagtcatcactttctttggtcactcccctccacgaccgataattagctagtttctcactagcaaaatattttaatcaattatgttttgatcttttaaaacttgtcgcttggcctttataccaattcctaaaatctgatcaaaggacgtgccacgcttgaaagtgttgccgccggtgttggcattcccaaatttggtgcgtgccgagttcacctatgcgcaccattgttgcttcttcaaatatg

SEQ ID NO: 108095 - DNA, 375 bp, Heterodera glycines
  Promoter: Source sequence=SeqID_1460; Location=1..375; Strand=+; Gene= SeqID_73667
tttattgggttgaattgcatataagatacatttccaaattcttagctgaaaaactcattcgattgtcggcaaatttaaatttattcaatatttttcgtgaaaattttgctaaaaaattatttttttgcatttttccaaaaaacctctattagaacggccccagcagctaaattggcctttttgaacccaaaaaaccggaaaattttccaaaaaaatcattttttcgccaaatttctcgagaatattgaataaatttaaattttcataaaaaaataataaatttatgtcaaaaataagcaaaaaagcgaaaatttcgcttttgtgggtgattttgatctaaaaattaataaatttcattttttttcttctaaaatg

SEQ ID NO: 108096 - DNA, 157 bp, Heterodera glycines
  Promoter: Source sequence=SeqID_3474; Location=1340..1496; Strand=+; Gene=SeqID_84810
taggcaaagggccaagtgccaacggtggctaacaacgacacctcagatgccgtcgcccttttggtgccatcagccgatgctccacccccacgcgccgcctccccccttttactattccgccgccactttgccccatccgccgccgcctccgccgatg

SEQ ID NO: 108097 - DNA, 493 bp, Heterodera glycines
  Promoter: Source sequence=SeqID_1147; Location=1435..1927; Strand=+; Gene=SeqID_68688
atggacaaaccgattctttttgatggaggaggtgttaggacgggtcatatttaaattgtatttggcattctgtcccctttgccacgtcatcattttgaccccattccaattgtccttaaatatcctcccatttctctcccctcgttgttcatcaccactcattcattttttttgtcatttcccttcacttgaccccaatcaatattatttgtgtgccttgtcctatttaatttggaataaatatttattatttattctctcggactcatcggcataacattggcgacgcccgtcgacgactttacaattgttttgtcttcaaattgtgcggcttttccgctgtttttgttgtgtgattgttcaacaacattcgccactcaatcattttgttgtttgatttttttttttcaacaacaaattttcgtcgactcaatttgaattttgtttgtgaacaaaatttcttcaacttcaattttgttttctcaaacaaatg

SEQ ID NO: 108098 - DNA, 146 bp, Heterodera glycines
  Promoter: Source sequence=SeqID_11484; Location=199..344; Strand=-; Gene=SeqID_74895
ttaaagggcaggtcagcagtaatatagctagtcgaaacatagcaaccggagttaaccattttttaattaattcgagcatccaagtaaatatgtaatagtttcgtttattccgaattccgttatttttcgcgtcccggatcccgatg

SEQ ID NO: 108099 - DNA, 102 bp, Heterodera glycines
  misc_feature (19)..(20): n is a, c, g, or t
  Promoter: Source sequence=SeqID_27416; Location=850..951; Strand=-; Gene=SeqID_58110
cgtatgatgaccgacgaannacaccatttcaatgttggttccctccaggagactgggtctgttgcgataaccattcggaatgtcgagtcaataatccgaatg

SEQ ID NO: 108100 - DNA, 67 bp, Heterodera glycines
  Promoter: Source sequence=SeqID_3028; Location=3677..3743; Strand=-; Gene=SeqID_82839
tttttttttaaattaacagaattaaaagttatatatagagttttaaatctaaatgtaattaaaaatg

SEQ ID NO: 108101 - DNA, 148 bp, Heterodera glycines
  Promoter: Source sequence=SeqID_2616; Location=2529..2676; Strand=-; Gene=SeqID_80737
agatgaacatcgactcgtccaccagcgaggagggcgtccgtcactgatggagtcgggccggtaccactacgcctcgttctcgttggccgccgtgctgttccagcgccagtgcagcggactgttcagccacgacccggtgcccgaaatg

SEQ ID NO: 108102 - DNA, 53 bp, Heterodera glycines
  Promoter: Source sequence=SeqID_5015; Location=2109..2161; Strand=-; Gene=SeqID_56577
cgctcgcccgccacttccatccgcgacatttggaagcggtgcttcttttcatg

SEQ ID NO: 108103 - DNA, 318 bp, Heterodera glycines
  Promoter: Source sequence=SeqID_5817; Location=1..318; Strand=+; Gene= SeqID_59320
gaaatagggagaaatggaaaaaatgaaatggatttacatatgtaatgtaataatttggtcatgattcgctacatatttttggtggcatttatttgctttagaatggcattataaaaatattttattcactgcaataaatacaataaggaagtatttagtatttattatcgatattaaccaaatgcaattcaatttattcaaattaattgaaaaatatttaattttcattttatgaaataaatattttttaaaaaatttttaataaaaaatctgaatttcttttttttatagcaaaatcaaagatttattgttaaaatg

SEQ ID NO: 108104 - DNA, 66 bp, Heterodera glycines
  Promoter: Source sequence=SeqID_12096; Location=2461..2526; Strand=+; Gene=SeqID_75657
accatcgacgacacatacttcgatgaccgcactttggagtcgatttggcacaacatttggcccatg

SEQ ID NO: 108105 - DNA, 673 bp, Heterodera glycines
  misc_feature (5)..(6): n is a, c, g, or t
  Promoter: Source sequence=SeqID_3167; Location=1..673; Strand=+; Gene= SeqID_83501
attannggctgggccaaaatcaccaagaacgaacaaattggttgcattatgctaattggccaaataagccataaatttaaaagatgcttgcttatgtaacacaattcgccggttttcagccagggttagaaagtgccatatttatgtatatgtatgacttttcccagtggcaccacttgactcaaagcttcttaaaaattttcaaacaaaaaatttgtacatatttggaccaaccagtaaaatgagtttaaatcttcaaaaatttcagtcgtcgcctttttatctcaagagttagcctattatttttcatgaattaaaattcgaactcacagattgaatacatcattttaatttaccaattagaaaatgaaaatgagaaaattataaaatagttaatttttggcaaaatttttatctacaaaaaattcgctgaaagccaattcatgtgttggttggcaatgatttataacggagccaaaaagggaaaattcgaaaaaagcgatgagtgatgtttgataaatgatattattattgtataatagtaatattaataaagaaagtttcaatgaattataatgagtgattagcttttatcattgaatgttcccttcgcccaaattaactcattccaattgtcaaattgatacgcttttgtgttaatttgcctgaaatg

SEQ ID NO: 108106 - DNA, 604 bp, Heterodera glycines
  Promoter: Source sequence=SeqID_41927; Location=428..1031; Strand=-; Gene=SeqID_69960
atcgccatgtatatatgatttgcttgtcatgctcggatatttgctgctctgattgtacatattgtattactgtgcctaacaacattaatactcgataaataaactgcttgtccacgtgtctacaaaattcccgtttggttttaaaaacacatactcgtaagattctgtcgaaaaataaccaacttttgcatcaaactaaaatttttagataatatcaactgacattatgccataagtttcaaaattaagaatatttaaaaaaaatctgaacaccaaaatcagtctcaggtttcgaccctccaaatcagaacgtttctgagaaatcagaacaatccaatccctggtttatttagagacaaagcgagttttatgactttttgaattaaataaatctgacttggcgtttgacacttgtctgagtatgttttattttaatttaatttgtttgtcaaaaaacatccattaatcatggtctaaattctgaatggtggccaagtttgtagggggtcaatggtttcggagttggaatttccataaaaaacaaataactcattttttcccagatcaggaaaacgacattcattttccttccacctgaaaaatg

SEQ ID NO: 108107 - DNA, 428 bp, Heterodera glycines
  Promoter: Source sequence=SeqID_11751; Location=322..749; Strand=-; Gene=SeqID_75244
atgacgcagtaatggcacttatttgttcggcatcattgtctctctcttttgttgaagaccaagccttgaaaaatttattgtcaattttagctccaatgtacaaaataaggtctaaaacaaaaatggtctttaaatctttaaaattttagaagtcgtcggcattttacaagtgatgtcctgaggaatttgtatgtgaatgtgaagctcgcgtaaaagaggacattcggaaaacagacttcatttctcttacaatcgatggctggagttctcacgaaggaaaacattcgttattaagtgtcacagttcattacattggcagtaatatggaaccgacttttcgcgtgatggaagccaattaaggttcggttaaggggtttttacttaaaaattttgcagacatttagggcagtcatactggcgaaaaaatg

SEQ ID NO: 108108 - DNA, 375 bp, Heterodera glycines
  Promoter: Source sequence=SeqID_4906; Location=1134..1508; Strand=+; Gene=SeqID_56160
tttattagcccctcttactgttgaattgagtttaatttttttttggaaaatgtgccaaataaattattaaaaaattatattttcccccctggcagattaatggagactggcatataaaaagagtatatacggtatataaaaatgctaaacactgccggaccaccctgttctgaaaaagcgtgccacaaaaatgatatgaaaagcaaatttaaatatctatttttttcgcaattctcaaaatctgcgtgtgatcctacaaatttaaatgcatttacaatttaaagtgcttttcatttatttaatatactttattaaaaatttattacattttaattatagctctttcaattttgtttttatttgacttcaaaaatg

SEQ ID NO: 108109 - DNA, 1003 bp, Heterodera glycines
  Promoter: Source sequence=SeqID_18922; Location=1..1003; Strand=+; Gene=SeqID_83647
attggtgtcttctttaataatgcctttttaacatttgtaagtatctattccatccgttgttgacattcttggttatcagcactaaaaatcttgcaatgataaagtgattacaaatcatttatctttttttgtttactttactaatatccaaaataaaataaaaacacagaacaaaagaaataattattttattttatttgctaaatcatgtaaaaaataataattttttttaaattggatgtggaaaaacctgcagcttaaaacccaaagaaagaataatgggatacgaccagcagaagcggggggcaggggcttaacaaaacaaagcgccccttctgactttgactgatcagcggggcagtgattagtcattaaaaaacaacaaaaagtgtgccccgggcatattaatttcgatgcgcagcagcaggataattaccattgtgttattgtcgtttgggggcgactcgccgccctcgggcgataaaaatggaaatggggaggcgcactgatcagcaaaagaaaataatgggcaaaaaaaatgccgaaattgccgtcgccgccaaacccaccaaaaacttgactttgctgccgattagcagcagaagcgaaattcgtataaaagagtcggagaaaacatgggaacacattataacgtgctctgttctcacaaagctataagtttctgataaatttcgctgatcaaacgactaaatcagtgatcacaacagttgttttttggggggaggaggacgctaaaaaaagcgaacccatcacactaattaattaatttactaacacatagacgtgttttgagtcttcatttgtgtaagataaacaaatttatctaattaatttttttaattttccgagtcagtcggttttgccatatttcaggctcaaatgtatttttcagtgactaatgcctaaaaattgtgataaaaattacgccctttaagaataatttccccctgaccttttaagcatttgctttgcttttaaaatg

SEQ ID NO: 108110 - DNA, 243 bp, Heterodera glycines
  Promoter: Source sequence=SeqID_6573; Location=1..243; Strand=+; Gene= SeqID_62058
taattctgcacatcatcaagccaaatcaaggcatatttgcaaaatcttgaagccaaatcaaggcataattctgcaagcctaattttggcacttcaaaagcctgggcggctttcatcggacatcgacaaaaactgatcacctgggtggtgtaagttccgctgggtgcggtttctcatcaacaaaaactgatcacctggggggtgtaaagttccgctgggtgcggtttaatcaacaatcaaaatg

SEQ ID NO: 108111 - DNA, 591 bp, Heterodera glycines
  Promoter: Source sequence=SeqID_25603; Location=1028..1618; Strand=-; Gene=SeqID_56349
ttaccgggatagagtcattaatttcatagaatatagataatagatatttatttaattattttgcattaatttattaatatggtgcaattttaatttaaataagactttcccatatggtacttattgaaaatgttgtaaaaggcataatacatgattttaaaatttggtgtttatttatgctttttctagaatttactatcaacgaagttatataataaattgattttcttttttatatctaaaacaattttatctttgaattttttccatagaatttaacttttaatttttcttataaaattttaataacatttattttttgctataattcttgtttttaatcgtataattctcgctcgactcattggagttcataatttcttttttttcaaaagcttcattcttcttttttatatttctcttgcaaagccaaattatgtataagtagtcatttatgttttagtaagaaaactactaagcattaattaatggttgttcaactagactactggagtaatagtttaattcaatataggtaattacaaataaataaatttttaaaaaataatatattaaatttatagatatatg

SEQ ID NO: 108112 - DNA, 1003 bp, Heterodera glycines
  Promoter: Source sequence=SeqID_3768; Location=20..1022; Strand=+; Gene=SeqID_51785
tgatgatgccggccgtgcatatattatgcaggcaaagaacaaaatgagagaagagaataaaagagagggagaggcagacagtggaaaataagagagagtgtgagagggagagagaataaatgaaagagagaggcagagataaatgagagagagagaggcagacagtggaaaataagagagagtgtgagagggagagagatggagagtgcgaaagggaggggaagagatgagacagcagacaggcagagaaaattggggaggagtgggtcggagagagatggagagtgtgaaagagaggggaagagatgagaatagcagacagacagagaaaattgggggagcgaaaatgccgataagcgaatgagggggggggggggggcgtccaccctttgccatagcaaggggaaatgttgcaaataataaccaaaaacatttaggttaaggggaggggggcataaagtcagcaaattatacgaaaaatgggggggggggtatcccaaaaacttgtcaatttgttgatccagcaacattatgatgttgttgatgggcaaagaaaaggacagcaaattatgataaaaagttgaaaatagatcaaaacgggtagagggggggggggggaggagaattggatcacttcacattattttgccattcagtggtttcccttcatctgcagtgaatgtgaaccggggctggtatgctaccatcccggtaactaccgtaaacccatcctctgtttacattccagtattaacaacctaaccgagtttttgagggagggcaagactgaaacgacatgtccaaccgagacaacagcaacggtcagcagccctatcatctgtcctccgcctccactaacgacaactcacagcattctactgttgttcatcacttctctgcttcttttggtctttttcgcgcaggtccaccccccccccccctcccccgtctaatcattaattattttttaaatttttttttcaatttacaggctttcaaaatg

SEQ ID NO: 108113 - DNA, 395 bp, Heterodera glycines
  Promoter: Source sequence=SeqID_13502; Location=1..395; Strand=+; Gene=SeqID_77399
cccccccccccccccccccaatacccagagaatacattttaagattttttatgataaatttttgtaagtgctgccccccccacacctctttggtttttaaatgattttcaaaaaatgccaataaaacttgggcattttggccacccatccagcaaaaattcaaaattttttaccaacataaacatttaagattttctaaaaaaaaataattgattcagctagaatataaataatgcttatttgaagatcgacatttaaaaattcgatctaacctaatagagtatactaattagggctgtgaaatgcgggaatggggcttcttagtcctaaacatttttttaacttattacggttataccgtatatacatttttttaccgtactcaggcacaaatg

SEQ ID NO: 108114 - DNA, 106 bp, Heterodera glycines
  Promoter: Source sequence=SeqID_9067; Location=1091..1196; Strand=+; Gene=SeqID_70145
tattttatggccatatttcgcgattttatatccatataattacactccctagtcatagatatttgaattattgtcatgtcaatttttgtatttcaggtttaatatg

SEQ ID NO: 108115 - DNA, 1003 bp, Heterodera glycines
  Promoter: Source sequence=SeqID_19515; Location=121..1123; Strand=-; Gene=SeqID_84245
ggaagggtgaggagaaagacagagaaaggaaaaaataagacaaagagagaaagagagagagaaaaataagaaagaaagaccaaagaataagtcgcagcaccaaaggaacagctaaaaaggagcatttcctttgggttgggtcacttcgccacggctaactcaccacggccaattcggtacggcgagtttgcgagtttggctgagataaagccgcaacgaaaattcgcgccgagttggcctcggcgagttgggcggttccctttcctttcgtaacgccgcggggcgccccttttaaggcgacggacgcaaaaggaaaggataaaaagagaaaaaaaacaaaggaaaaatattgtattaaacagcgacataatttaacaattgcgagattcattaattatatatcttaataaaatgagaaattttaaaattgattaaagttttcgaattcgaccggagaaccaaaaaaataataataaaataaattaaagaaatttttttaaattaacaaactcttttattagacttttctcagaaattgaatctcgaataaaataaatatcttttgcacttctaatctgtgagtcaccaaagaacacttaacaaatatcctaatttgcttcaccttaatttaacatattgtaaaaaatatatatttaataaaaccaatttattattgcatttataatcaaaagaaaagtaaaaagaaaatattttcaaatattttcaatattatttatttatttttattattttatattaatgtgaagtgtatgatatgagcatgatcagtagtctatgttcatggttctaagtaaataaaaaaaataccaaataaaaatttaaagaattcggaatgtgtaaacattaaactctttcttgggctcgaatcgaaattctcaggaattttcgatctctatcaccattattactaacaaataagtgttttcacggagaagtccaatgaaaatcgcaaattaacttcgcatagttttggtgaaaaatg

SEQ ID NO: 108116 - DNA, 107 bp, Heterodera glycines
  Promoter: Source sequence=SeqID_4471; Location=6728..6834; Strand=+; Gene=SeqID_54566
atccgacaaaagtgaacgaaaaacggaaaaaagcggtggaggagagcaagagcttccaagcgataagcaagctgagtgccgacatattcaaccaggacttgtacatg

SEQ ID NO: 108117 - DNA, 72 bp, Heterodera glycines; identical to SEQ ID NO: 98808
  Promoter: Source sequence=SeqID_654; Location=2132..2203; Strand=-; Gene=SeqID_58216

SEQ ID NO: 108118 - DNA, 318 bp, Heterodera glycines
  Promoter: Source sequence=SeqID_823; Location=7909..8226; Strand=+; Gene=SeqID_62121
acaaaattttgagcagatcaaaattgtaacaattaaaatatttattaattgtatggaattaattttattaaatattttgtttcattcaaattcttgtgtcataaatatgacaaacctatttgcccaggaaaaatgattgatttcattcaatgatattaaccttttgagtcggcggataagccgcataaccgctattgtacgttttttggatctcctagcgcacccatacgccctaacagatggtcatgctgtcttataaaaaggcaacggaaaatgccggccacctttttcctgtgccccatttttcgtccaaaaatg

SEQ ID NO: 108119 - DNA, 907 bp, Heterodera glycines
  Promoter: Source sequence=SeqID_25525; Location=429..1335; Strand=-; Gene=SeqID_56268
ttttgatcagccgaaagctgcagatcaaaaacaacaaaaaaatgatttgagcaatgagcagagagagagagagagagagagagagaatcagcagggggaggggggggggattgaaatgagagggaaaaaagtttggaatttctgactttttcgcctcgtcaaaaatgccccaggcaattgccccctttttgtcctatgaatggcaaataaggataaatttggataagaaatggtaattacttaaccaattaatgcaaattgaccggcagaaaatttgacagagttgcgaatgacttaacggaaatcctatgggacattgaatggaatggcggtgccattcgatgggacgtgggaagggaatggcagtgccaatgtgtgcaaattgtgtgggcaaaatgaaactagggaagtgcgagaaattgctttatcgagaatcaagactgagagaataatgccgagaatcgcaattgaggaaggacaaaaattcgagctgagataaaaatattttatatttaagcatacataaaatagaaaaaataaataattttttgaaacaatttttttgtataaaagcgtttggcaaaaaaagacgggaatttactggggtttccactttcccgccacgggaatccagactggcttctactctacattattaacagttattcggtctgatttttaaaatagagaaataccgtatgaaaaacattacgacaaatttaaattcttccatacaaactcacagaactggcattgattttcctcttttccaattaatagtcccttaggcacatagtcacataactaactcatagaaatcaaattttctttttttatagaacagacatttttgttattccttgaatactcatcattttaaaaaagagttaccaatttcaccacaatg

SEQ ID NO: 108120 - DNA, 148 bp, Heterodera glycines
  Promoter: Source sequence=SeqID_10756; Location=1..148; Strand=+; Gene=SeqID_74007
ggggatttgtatctgattttctaaatcctttttcttcatcccccacccccattcagaattgtgaagaggccataaatgattactggcagcgatatcgagaaggcaaagagtacagagagcggaagaaagagaaaaagaggaaaagatg

SEQ ID NO: 108121 - DNA, 300 bp, Heterodera glycines
  misc_feature (11)..(11): n is a, c, g, or t
  Promoter: Source sequence=SeqID_13158; Location=2027..2326; Strand=-; Gene=SeqID_76969
cattgaaattnttgcaaaaaaaaaaaaataataagatttttcgatgaaaaatttttctattaattttctttaaagaaatcacataaaatttttcagcaaagttattacaatttgccggaaatgacaatacaaaacagaacttataaaaaagaccacacagatataaattcacttaatctatttttaaatttggattttacattcctaaattaaaatatttttttttcagttcaatttgaattcaaaatttgaatttcctcatcccagtgctctctaattcgtccctctccctaattaatg

SEQ ID NO: 108122 - DNA, 299 bp, Heterodera glycines
  Promoter: Source sequence=SeqID_37368; Location=1..299; Strand=+; Gene=SeqID_66457
cagcaatattgacttcaaacatattttaaaactgataaatcacacgtatcagtgcgctgtatttttaagattgtcaaaagtactaattgcgtttctcttattgctttcgtgtgagatttttcttgatgaaattagggaatagaatggtcagcaatcaatttcagacgctttttgcaggtttaacgtataaataatgcttttccagcgattgaatataatcacaagcaatttcaattattgccaatgaagctttgcaagaaaaatgatgttgacttctatgcgagggtttattaaccatg

SEQ ID NO: 108123 - DNA, 111 bp, Heterodera glycines
  Promoter: Source sequence=SeqID_9812; Location=1..111; Strand=+; Gene= SeqID_72787
tgtgagcagattttctgcgaagccgtaaaatgggcgcccggcctaaccaacagtcacttgctcgaatttattcgctccaccgattcggctacggacaaaagtttgcggatg

SEQ ID NO: 108124 - DNA, 144 bp, Heterodera glycines
  misc_feature (49)..(49): n is a, c, g, or t
  Promoter: Source sequence=SeqID_36264; Location=838..981; Strand=-; Gene=SeqID_65628
attaatgtataattgtaattaaaataaatttaaatttttaaaagaaatntagtctgaaaaaggcgaataatgaggcgtgcaatattgtcgttttgcatcattgtttcaatgtttgctatttcggcagtttgttgtacaacaatg

SEQ ID NO: 108125 - DNA, 1003 bp, Heterodera glycines
  Promoter: Source sequence=SeqID_324; Location=6618..7620; Strand=+; Gene=SeqID_82303
cgcagaaggcgaattgcttacacttgaagtggcggttgatcatcctaattattttgacaacaattaccggactttttctaaagatacaggtggtgatcagctgtttttcggatatgacaaaaataatgcatgtttggtaagaaaaaataacaatagccaatggacaatcagtttgcaaagctataataaactgattctctcttctcctgtaactattcaaagtattcgaccaattgaaccgacggcgtgttttgagtataacggaaagagctatgtgttctttgaggaccgtgaggcggacgagatgcacatttattgtggtcatcagcaaaaaattgtcaggggcttttttgcgaacgccaacagaccaatatttgactatatgacagaacgtttgtacatttctgatagacatgagagtcagatcagtgaaattgatctaagctatcttgagcggttgtggacaaataaaaatcaaacaaattatgcgattataaaagtcaattttgtatgtctgttacccagggataaaaccgatttcgcaattctagacaacaatatatacttgattcgatcagaccttcgcatttataaatatagaattgttgaccgtcaagttgaactaaagtttgtggtcaatagtagtagcgcgaaattcaactttttattatttaaagaataccgcgacgacgccaataataataatatacttcaagcaggctctcaaacgcctcagttaaaattattgttaggggttgcttatacctttgacgtactattgatcataatttgtgcatttgccgtgaaacagatccgccgagcgagcagcagaagtaacacatcttccgaaaatcttggcatgttcgacctagtggaattggcagcgcttaaaaataattccaaagaacttgtgtacacgcccacaacagtagtcaaagagaggagtatttaaggtaactattctggccatcagcgctcatttcgtacactaaaccactatatg

SEQ ID NO: 108126 - DNA, 107 bp, Heterodera glycines
  Promoter: Source sequence=SeqID_23539; Location=95..201; Strand=-; Gene=SeqID_54223
tgcgcagttggtccatccggttgccgaaagggaagtgggttaacattcccacgccaggctagggaaatgacggttcgcaagagctgttttgcgcggtaacgcaaatg

SEQ ID NO: 108127 - DNA, 301 bp, Heterodera glycines
  Promoter: Source sequence=SeqID_21470; Location=1..301; Strand=+; Gene=SeqID_52080
atatattttcaagtgggagaaggaaaggattgctgaacttttaaaaaaacaaaagcagttgaagatgaacagccaagttacggtttgaattaaaaaaattaaattaattttattaaaaaatggattttaatagaaaggctctggagattttgttaaaaatccaccggcgacgggaagtccaataaaaaaagttgtaagtaaatttaaacttggcatttttatggtttcgaattttttattattaaatattcctctaattatgcttatatcattttttctaattatcaaaaggatgtaaatg

SEQ ID NO: 108128 - DNA, 522 bp, Heterodera glycines
  Promoter: Source sequence=SeqID_19709; Location=1..522; Strand=+; Gene=SeqID_84456
ttcctggcttctccttgctctaaatagcaggaaaaacactttattttttgtgtttgcgaacaaaaaccgggacttttatttacatatttcggggttttcttacatatttgtacatattttggatttttttcatatatattttcatttttttactattttagtattttttacggaaatttttggaaatcctcaaaaaaaatccaaaatttcggcaaatatttttgtacatattttcatttttttttacatattttgaaaatttataaagaaaaaataagtttgaaaatgttgcctaaaaataccaaaaaaagtaatttttatgtcattttgtggctatttcatattttacggggattttctttcccaaaaaataccattaaaaaaattttatttacatatttggggttttttgtacatattttgggatttttcttacatatttatgtacatatttggaccactttttgtacatattttttgcagccctagttattaggtatataattttgcaacaaaaaaatg

SEQ ID NO: 108129 - DNA, 171 bp, Heterodera glycines
  Promoter: Source sequence=SeqID_20385; Location=2092..2262; Strand=-; Gene=SeqID_50906
tttgaaaacaattaaataggtgtattaaaaaaaaaattggagaatattgaactatgagaagcttaaacaatatttcaacttcgacaaaagaccgaaacgccttaagtttttagatattttaaatcctttttttctttttatttgattaaaattaatttttttttaaaaatg

SEQ ID NO: 108130 - DNA, 376 bp, Heterodera glycines
  Promoter: Source sequence=SeqID_71; Location=11004..11379; Strand=-; Gene=SeqID_62106
cccgagctgtactcgtgaaattcccaagccatggacgaatttctgatggaacacagccaagcgcacgggaagagggacactggcgttggaattgaaaaagtgtcggaatttgctgaagagtctgtagggcgttaccgattcagtgataccgtattcatcaaaggattggcatggaaaattaaagcagaaataagggaaggcactgctgctgatgagaagaaatatttgggatttttcttatggtatgagcgaacaaaacacggtacaacaatttaaataataatttaaaaaattaaaattaatcatttttttaacaatgatagaaaacccattggactgcgttttttcggcaacatttcgaattgtgtcggaaatg

SEQ ID NO: 108131 - DNA, 442 bp, Heterodera glycines
  Promoter: Source sequence=SeqID_38335; Location=610..1051; Strand=-; Gene=SeqID_67182
tttcctgaaatttgcgttcctaaattatgtgagtttttgcgacccaagccaaaattggtgggatcccttcgggattttcccggttatcttgatcctggtctcgcccaatattccttgagttttctgattttttggaaaatttatgcttttattttagtttaagaagcctaaatgctcagttttttcacaaatttcagcattttaaaattaatcaccaaagaaaaccatcgtaaggccttttaaaaattttatcaaaaaatattatcgacgaaagcttctgtcacccgctaattgaaagtttcaaacattgctcctccttcttaaattacaataatttgttgataataaatgtttattttaatacatttttgaaaattgactaaatttttaaatattttatttattaacaccaaaatccagttgaggttaaattatattgatg

SEQ ID NO: 108132 - DNA, 209 bp, Heterodera glycines
  Promoter: Source sequence=SeqID_5779; Location=1..209; Strand=+; Gene= SeqID_59196
tttttgttcgaattcgggtccggggttcttaattggccaaaatggataccggattcgtggtcaatgccccccaaaagccaaggaacttgtttttatgacaatagaattttactgacgcattttccactgacgcattttccgggcgccgggcaagctgctcttccattaaatcattcagttcaaatgcgataactacgtaagcaaatatg

SEQ ID NO: 108133 - DNA, 559 bp, Heterodera glycines
  Promoter: Source sequence=SeqID_15402; Location=1..559; Strand=+; Gene=SeqID_79664
aattttcacttatttattttgtacaacttttcttctctttcttcccaatttcctctcccatcctaaccaaactttactgtaaacccaagccaagccaatttgtgtccatcccagctcactctcgactccaccccttttctcttttgctatttaaactgaattcattccttgcattattaccctttttttctactcactttgactcattcccattttacttacctttctcacttttgctaaataaactttcattaacaaacttaaagtcttgcttttgattgggaaataagtcgggaacacaacatcttttggtgccacgacccgggaccaaaaaaaagttcccttttcccaaatttctgagcaaggccgagtgccgaattgctgtcgagggttggtcgaagctgtgtgctcccaaccgaagagactaattgcggagggctagtcgaagctgtgtgctcctagctgatcaaacggataattatttgagttagtcgatctgtgtgatcctaaccgggctgtgtgccaatttcaaaaaaaaaagtggaaaaacagtaaaatg

SEQ ID NO: 108134 - DNA, 72 bp, Heterodera glycines
  Promoter: Source sequence=SeqID_3995; Location=471..542; Strand=+; Gene=SeqID_45690
agtccgaccgaaactgatggcatttgtaaatgtttttcttgaagatatgtcggcgaatcggaggcgaacatg

SEQ ID NO: 108135 - DNA, 142 bp, Heterodera glycines
  Promoter: Source sequence=SeqID_24792; Location=1..142; Strand=+; Gene=SeqID_55539
agcatctataatctacccctattcatttccatcattcgctattgatgaggatgatatcattagcattaaacttgttaacccgaactatagattcctagacgacaaaaaatttgtgcatatagaactaaaggttccaagcatg

SEQ ID NO: 108136 - DNA, 60 bp, Heterodera glycines
  Promoter: Source sequence=SeqID_16381; Location=1758..1817; Strand=-; Gene=SeqID_80774
ttttagtgtgaaaaactttggagaattattttcaaaattcttgcccgtattaagagcatg

SEQ ID NO: 108137 - DNA, 785 bp, Heterodera glycines
  Promoter: Source sequence=SeqID_1385; Location=1512..2296; Strand=-; Gene=SeqID_73203
gttcaaccagacctccaactatttcttcaaataaaattaaaaactactaaactacctagttcaaactttcttaaaaattttccacaaaaattttttctccaacccctatgtatataaaaaaaaaccaattccctttgttggaggtctgactttctactttctgcttctccactcaaaatttcaattgtcttttaccactgcttgccatttcacctcatttccaccaaaagtgtaagtggcacatgcccttcttttggttatttttatttttgaataaataaaataaataattaaaaaagaaaaaaggtatttatttacccgtgtgaattttgaattagctcgcaaaaaattacgccatttataattttggcgaaatgagttttgtctaacactgggcttgacccatagtgtagtgagtaatggaccaaccaatagtgccaactgacaatttgtaatcgcgtgtacttacatttatttattttttttgtagcgaattcgaaaaataaaatgccaaatatgagctctgatttttcaagaaccttcattttgtctaagatattcatcaagtaacataaaaaaataaatttgcagccaagcggactcgaacccaaggcccccatctcatataaatgctttttgaaattttccaattttttttacatcggcgtgaccgcaattctacacctttgccaaatttcaaaaattaattatttaatcaagctaatttgttctttttttttgccttcgagtttttccatttgccaatgcattggcattttttgatg

SEQ ID NO: 108138 - DNA, 128 bp, Heterodera glycines
  Promoter: Source sequence=SeqID_19924; Location=218..345; Strand=+; Gene=SeqID_84683
tgttgcactggcgagtctcattttgcatgcatagctcgccagctccgtgaaaccagtttgaaaaaaatttaaaaaaataattaaaaataataattaaaataacggatcccctatagatataattaatg

SEQ ID NO: 108139 - DNA, 685 bp, Heterodera glycines
  Promoter: Source sequence=SeqID_21582; Location=852..1536; Strand=-; Gene=SeqID_52189
aatttgaccccaaaatggcaaaaatgttgtcattttttgcgtaagaccggtacaaatttcgagcttttttcccggtttagtttatttggaggatcaagattaccataaacgagtgatctgatcaagttaatgcaaaagactttttaatcagcataaaaagaagatatattatggtattatttttgttgaaattaaaaaattccatttatccccctggggataaatggagactgggggattatttttcaacctcctcagaaaggggggggataattggagactacgggattaatagagactgggcgataattagagaatatatcgtatgtttattagtaaattgctccgaaaattaaaaaaatattaaattgggactaatccgggaaaatcccgaatttccgaccagagtcgagattcagctttacgcatttgacaagggaatcattccaaacagttagaaaataagaatttaaattaggcaccatcggatggagcgaagctgattcctattgtaaatttttaaagtttttcccataaccgaaaacccagggtgattttatgaggcctcgaaaacgggattttttgactgctgataaaaaatctctgtattatatgcttaaatgatttcctaaaatgagtgctgtttttaaccaaattagatactattttaactaaaacagaaatg

SEQ ID NO: 108140 - DNA, 1003 bp, Heterodera glycines
  Promoter: Source sequence=SeqID_8149; Location=710..1712; Strand=+; Gene=SeqID_67140
gacagttgcggcgctcagtcaaagcgacacttgcggcgcagacatttgcggcgtgacacttgcggcgccgacacttgcggcgacgacacttgcggcgccgacacttccggcgcccagtcaaaaggacacttgcggcgccgacacttgcggcgcccagtcaaaaggacatttgcggcggcgcaaaattcaacgaccccaaaattatttcaacaatttatttccattaaaaacattgataatgactctctcagtcccattcttcaaagcctttcatccctaggcgatattgcaacgcatgaatgtgattaattatatcagcttgctttttgttttccttatggtcaaaatcgatgactaatcgtcggatcgcttcatcatttcttaaatatttttttaagcgtggcctttcagcaattccacgagttgggtcaatttcataaggtctcagacggttttgttggtgttcttcctcatttttgatggcgataatgaaccttattgaaattattttattacagtacccatttatactttgaaaatgctgggtggggcgaagtgaaacgttttctgaagctgttatgccacctaagaaattaattgcaatatcgcctagggatgaaaggctttgaagaatgggactgagagagtcattatcaatgtttttaatggaaataaattgttgaaatatttttggggtcgttgaattttgcgccgccgcaaatgtccttttgactgggcgccgcaagtgtcggcgccgcaagtgtccttttgactgggcgccgcaagtgtcggcgccgcaagtgtcgcgccgcaagtgtcggcgccgcaaatgtcctcgccgcaagtgtctgcgccgcaagtgtcgctttgactgggcgccgcaaatgtctgcgccgcaagtgtcagcgccgcaaatgtcagcgccgcaaatgtcggccaatcggacgaatcggagggaaaggggcagacaaagcggatcgacgatgaatttgtacagaagatg

SEQ ID NO: 108141 - DNA, 395 bp, Heterodera glycines
  Promoter: Source sequence=SeqID_5407; Location=992..1386; Strand=-; Gene=SeqID_57922
tcattagcgtacggatttttaggttttaaccattttgccctttttccaaaattcatagcaaacatggaataaaaacgaaaaataaactctacgaatcgaaatcaaaaaaatttaaaaaaatataccctaaaaattgaccaaaatttcaaaaatattcccctaagaaatgaaaaattttcctcaaaaatttatctcaaaaatttgtttttatttgtcttcttgacaagttgcaattttagcacctaaaagccctagctctaattacaatatgttaagcatgggctgcacccttgatccatgtgtgggtcataccgttgtccatcgcactgtactccatcacgccgctgttcgccgaaacatttgactcgttggtgatcaagcgggccctcgccatg

SEQ ID NO: 108142 - DNA, 306 bp, Heterodera glycines
  Promoter: Source sequence=SeqID_20556; Location=1324..1629; Strand=-; Gene=SeqID_51103
tttcccaatgggggattattcgaaaaaaaaacatttgaggagttttttttctctttcaagtagaaacgaaaaaattaatcaaataacaaaaaaaatgaattaaaaaacaaaacagatttctttcttaaataggttttatttttatttattttttaaagattttttggaaaaaacttttgcaacaacaattattttaatatttaaagccggtttagaaccttttttgttttttaaaatatttattatatttttattttaaacttaaaaaatagcatttaattttagaattcctttttcccttctatg

SEQ ID NO: 108143 - DNA, 537 bp, Heterodera glycines
  Promoter: Source sequence=SeqID_2316; Location=3649..4185; Strand=-; Gene=SeqID_47247
taatagaagaatttaaaaatgtgaacggacgcgatgaatgagagaaaattttgcaatgctcgcctttatatagacaagcaaaaaaatttcgaaattaagggaaaaaaagttgtataaaagggcgacatttcctcacttttcctcacaattcacttcatcgccctcatattatattatattattattattatcatcgtccatcgtctacaacacttcatcacacacgaagcggacgtgcccggcgcaacaacttcaatggaggattactgtttcgacgcaacggcagcagcagcggcggagcagtctcggcgtcaatcgggagcggcatcggaccttgtgcaaggagacggcctgtcaaccggcttcctggacgcgatcatcacgaaggtcaaccgctcgcctcctcagcgcttcacggatgaggtagaaaaatttttgagtttttcaaaaattaattttccccccttttttccccaacagatcagtgacgatgaaatccgccagctctgcaaagcggccacggacgtcttccgaatg

SEQ ID NO: 108144 - DNA, 287 bp, Heterodera glycines
  Promoter: Source sequence=SeqID_30632; Location=1..287; Strand=+; Gene=SeqID_61041
tgctgatctttcccctacttagggaaagattcggcaacaaatgcataagttttatctgcattcttaatgggatgtgtgagcgatcaatttctgcactcaatgacctttgtgcgaaattggacatgtttgattcgcagcggcatcactgtggcaaacaaggaagatgcaccttaatttttcacatttcaatgtttttgataaatatttgattaatgtggtttattggttgttttccccaaatattttgccgcatgtacacatcattgcttcatttttgttttcagatg

SEQ ID NO: 108145 - DNA, 861 bp, Heterodera glycines
  Promoter: Source sequence=SeqID_24964; Location=1..861; Strand=+; Gene=SeqID_55699
ttattcttccaattgcatacaaaaaacaattctttaccaattatgattaaattacttttttactcgatcaaaaagactaaaatcggaatccatgacaaattgaacctttggcatgccattaaaattttgcattaagctttgaataaaattatgcaaatcaaccaatcagtcagttgaaaatcacacactcgaatatgccaaaaagtttttgaatgccgaaaacgaaaattcgacttcgcatgactaaataggcgcgtatattaacattgcaatgacatctgtcgggtggcaaatgtgtttgaagatgttttaatttagatgttttaatttcctcgaatttattttttttttttttttttttttttttttttttaacaaaaacatccaatatttttctactgacgaatatttgcaaatttccattgattattgttattaatatatgtaaaataaaggtttttaccttttacatttatgaaaaattttactttgcgaaattcataattattatttttttgaattttaaacgatgaaaaactttcttggccttttatttatcattaatggcattgatggaattgatgaggatttttttgaagacttgtggaaaaatctaaaaccatcgacatcaaaaaacaccaaaaaagaaaaattcggaggaattaaggaagaaacatttcaaaatgtcaataaaatgataaagtccgaaaagtgcagtgaaaacgaaatggaaaacaacgccaaaattatcgcaaaaaatttaaaatgaacatttggaggaaaaaaatgttaatttaaaaacaaaaatcaaagagccaaaaattgaattggaccaattggaagaagtatcatttggaaatg

SEQ ID NO: 108146 - DNA, 1003 bp, Heterodera glycines
  Promoter: Source sequence=SeqID_9602; Location=58..1060; Strand=+; Gene=SeqID_72045
ggaattccatccctggcaccaactacactattaccaatttttgaattactgtttcctcggatgtccattatcccatcccctgttcttcacgtgtacccgagtatataaagtcgaccaaatcccctcagcccattcaattacatcaactgaaaggagcagacagtgttttgttcaaatttccgaagaaggaattgatggcaatacatggcgatacgacgaatttcattaaatccgcctgacacgctacatgacttcaattgaggtatttatgtcacttggggtgtaccgctgtacagcagggatggcattccgaggccccaaaactttttggaactcggaattccgggggtccaaaatttttcggaaatcggaattccgaggcccacaaatttttcggaagtcggaaatcggaattccgaccccaaaaacgtcggaaatcggaattcggaagtcggaaatttttcaaaaaacataaaacataataaaaattttctaaatattttaataggctaaattttaaattcttaaccaagtaaaaggtgactcaaaaaattttttggatctatttaaaagcatattttcatggtcaaatgtttatctacaccccaaaaaaatcaatattttgtaggcccaaaattctgaaaaaattcctgctaagctaacttttgatgatgatcaaaaaagtgttttacaccaatttgatcagatcactccttcatggtgatctgaaacctcaaaaatggcaaaaattccttcgaattcatgattagcagaccgtaagggatcgattggtatctatttggtcgcaattccatgcgtttttggctttggacggttcagtcccaaagccatttggccatttcagtcccgggtctgtaacgacaaagggtaaccctggattatgtgcattaaatagaattgttttgaattttatattaatacatgtaggtatgcaaataatgttttttggaaaatatcggtcatatggcccgaagcccaaatg

SEQ ID NO: 108147 - DNA, 484 bp, Heterodera glycines
  Promoter: Source sequence=SeqID_38192; Location=246..729; Strand=-; Gene=SeqID_67087
tgtccggaatcccgttaaaagtctcaacaccctccccgattaaccctaaaatactatcattcatctcaccataacaataaagaattttcttaggcggtggttcaattagaatcttatgatgttttaaaaaccgtaatagccaacgggtcttaccactcccggtagcccccgagagaattagagtgaacggaccgcgaaacatttttaatgcctcttatttatttgatctatttatattttcatagggaacatatttcgcgcatttggggcatatccagaaattatcaaaaaatgatgtaccgaaatgcgactgtgctttttacacctgctacaaatctcgtaatgacagggacagtaatgacaacacttaattttatgtgggcagttcatttttcaatttaattttattttgggttgctatttatagaaggggtatataaagggagtgaaaggaccatttgattggtacattgtatcaaaaatg

SEQ ID NO: 108148 - DNA, 187 bp, Heterodera glycines
  Promoter: Source sequence=SeqID_14350; Location=1..187; Strand=+; Gene=SeqID_78380
tttcctttgttgcgtatatggtgttggttctccccccccccccccatcctgctatttgccttttcgttttaattttgcgcagcaatcatttattgatttgatattttttggaaattttacccgttttaaatgcttacaaatattttatttaaaatgccgaaacaattaaaattttatttagaatatg

SEQ ID NO: 108149 - DNA, 645 bp, Heterodera glycines
  misc_feature (20)..(20): n is a, c, g, or t
  Promoter: Source sequence=SeqID_34711; Location=1..645; Strand=+; Gene=SeqID_64431
tgcaggtctacagggctatnagggaagctattcccgaaggattcggtctccccataaatctgggcgcatcggctcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcagggggactgccccgaaaacccaaaaaaaaatttttttggataaaaattatttaaatgaactgactagataatatttaaaataggttattactcttcctttcagtatccctgcaaagtttggtgcgcttctgatcagtttctgaaaaaaaagttaagcctaaactttttggcctgtttaaaaaggaattaaaaattttattcatctccctttttgatagaaaaagcatcagagtgcctaaactaacctgtaaataaagttttgtgtgtttcagagcactttctgaaaaaatacttatgaattaattttgcaaaaaataaataattaatgaaaaagtcagaatttcgaaaaattttaaaaacaacaagcgttggcattttttcaggttaagttagtcctttacaatg

SEQ ID NO: 108150 - DNA, 371 bp, Heterodera glycines
  Promoter: Source sequence=SeqID_16606; Location=1..371; Strand=+; Gene=SeqID_81021
ttttattttcattttacccccttggacaattctgaaacggccatgatggtggcggaatttacaaacggcattgagttaatgtgccaaaaaacctttcgcatatatgggtggctcggtggttttatcgttcgaaagttcttgatgaggagaagcttattctgagcattttaatgttgaaactataaattcataggcgccgtttcaaagccggacccacagacaacttacaatttgcaatgttcaggaattaattaaaaacacaatgaattttgtccagtacctttggctaatatccagggcccagcttaatccaaatccaaattgtctccgatttgtttaaatttgataggcagttgcttcttgccccgatg

SEQ ID NO: 108151 - DNA, 74 bp, Heterodera glycines
  Promoter: Source sequence=SeqID_22937; Location=1618..1691; Strand=+; Gene=SeqID_53640
gataaaacaagttttttttttattgattaacgtaaataatcgtgtatttgtaggtgaaaagcaggaaaaagatg

SEQ ID NO: 108152 - DNA, 152 bp, Heterodera glycines
  Promoter: Source sequence=SeqID_20774; Location=1939..2090; Strand=-; Gene=SeqID_51335
taatagagaacacttagggctttcggttgataccaacaatattagatttggttgacaaagaaaaaagttatagtccaaaaactgagctggcgccgaaacggtcggcgccgaaacgcagtggaccctcatttggaataccaatcgccaaaatg

SEQ ID NO: 108153 - DNA, 57 bp, Heterodera glycines
  Promoter: Source sequence=SeqID_41962; Location=79..135; Strand=+; Gene=SeqID_69991
tggccgactttgaggtggtgattggttgttgttaattgcttttgtttcgacagtatg

SEQ ID NO: 108154 - DNA, 75 bp, Heterodera glycines
  Promoter: Source sequence=SeqID_30804; Location=1..75; Strand=+; Gene= SeqID_61187
taataagatttatcataaaatttcaattaaaaatccatcctcgattattggtatgaacgatactttccaaacatg

SEQ ID NO: 108155 - DNA, 333 bp, Heterodera glycines
  misc_feature (34)..(34): n is a, c, g, or t
  misc_feature (74)..(74): n is a, c, g, or t
  misc_feature (95)..(95): n is a, c, g, or t
  Promoter: Source sequence=SeqID_44348; Location=1..333; Strand=+; Gene=SeqID_71846
aaaatccaatcgctcatttccccactgaataatntaataataaaaaattttattgttttttaattttattttgncatagttttcaaatgcttttntaagcatgaaataaagcaatgattttattacaaaaatgaatgatgttttattttgaggcaatcccataataaaattattttggcaataaattttttgcccaattttggacaaacgataattttgtccatccatataaatatttaaaaatttcaaatttttgtcatttaaagatttttagtttatccaattttcaattcattccccattaaaaataagactaattaaggtcctattatg

SEQ ID NO: 108156 - DNA, 135 bp, Heterodera glycines
  Promoter: Source sequence=SeqID_30847; Location=1..135; Strand=+; Gene=SeqID_61241
tcccgaaaaagcgataaattgaccagttttgtaagaaatttttcaaatctaactgggagctacagactttttttaatactgattttaattccttttattcagaaatgatgcacagcaacaacacattggcaaatg

SEQ ID NO: 108157 - DNA, 1003 bp, Heterodera glycines
  Promoter: Source sequence=SeqID_10674; Location=399..1401; Strand=-; Gene=SeqID_73920
tttaatctataccccaaaaaattcaaaatttattacaacaagacattattattttgtaagatttgtacctccaaatcggaacattctttaaaaaaatcggacccctgggttaatgcaattagtaatttcaacaagtttttttttctatattctatttaaaaaattaaattggttaatcatagaaaaaccattaattttgaagtcaaatattgagcattttttaaggtcctaaaaataaggcaagatcgagaccgagaatttaaaaattttagcgattttcttcaataattgaatgtgaatgagtatatatttttctgtttttatgtgatttcattttcatgttaaatacatgttttaatttgtctatattttacggatgagtgatgagtgacgattccaataggcgccgcccgccggatttagttttcgccaatttgaatctaagtttagtatcatattttttccgctcgcattttcttgaaatgcaaaactttctctcggtgtcgcattttccggctcccgaaacagaaaccaaaaaggccgaacaatttttagacgagaccaaggacctcgagctaagtatcaattaagttctattttggaatttttaaatcctatttttgttagagcgaagatgacctaattttcattaattcaaaatctttccttaaagacacactatattctaaatatgtttaaatttgtacgttttttacaaaaaattttagaattttcaattttagaattttttttctttattggccatttatcgactatttctttaaacacatgcgattttgacaatgccattatgatgatgatgacttacgttaacaaaaagaataatttaaacaaaaagattgcatttatgtaatttatgcaaaatgtcatcataattggattttctcaattctttacacattcactttattagttttttataaaaattatttttactaatattaatcctaattttgttttatatttaggcaaattctaaatg

SEQ ID NO: 108158 - DNA, 61 bp, Heterodera glycines
  Promoter: Source sequence=SeqID_7374; Location=3419..3479; Strand=-; Gene=SeqID_64642
tggggggggggagggaaaggcgcacttccgacaattttttatagcggcttcaccaaatatg

SEQ ID NO: 108159 - DNA, 113 bp, Heterodera glycines
  Promoter: Source sequence=SeqID_44520; Location=1168..1280; Strand=-; Gene=SeqID_71998
ctgtactttattctgcgttggattttgctccccataaatgtttgagtaccccaaacggacacttgaaaaaatcgatttttttgtttcataaatatttttttcagaaagtcatg

SEQ ID NO: 108160 - DNA, 867 bp, Heterodera glycines
  misc_feature (7)..(7): n is a, c, g, or t
  Promoter: Source sequence=SeqID_9867; Location=858..1724; Strand=-; Gene=SeqID_72896
ccccccnccacccatcccccgcaaaaaattgtcccataaataaatttatttatagggggggggaggtatttatttacataatgtattatagtaggcattctttttctctaaagctacacaaaattgtattagtggatggcatttgctatgaaaaaaaaacaaattagtgccattttgggtatgttttttggcgaaaaatgcgtcatttttttgtatcaaaaactaccaaaatgtcattcaataggttcgaaatgttattttaatttggaagcaatttttaaaaaattagctgtaaacaaaaattttaaaaaaaaaagaattatttttcaatgatttgaattttacagtttttttttggggtttttcaaaaaccaaattggcgcattgttttccgctaccggcggcacatttaattactaattattttttgtacgcgttacgcgcacattttatatgtatgagatattccatattatatccggatatgcaattatttaataaataataaagtataaatcgaaaacaaaaattttaacaaaatatccgccgccaagatactataattttaaatacaccaataaattcatttatgtttgttttttattgcataacatccgcatatttgctatcatccggacttccgtgttaacatccggcccttttaattaattgattatctccgatatacaattagtttatatataagcatggaaaagtttcaccaagaaatactgacaacaatatacatagttttattcaaagcattgctacaaaaaagaccatataaatacatatttaattattttatttttttattatgaaatatattttcaactatcccaattttattttatatttttttgtatg

SEQ ID NO: 108161 - DNA, 695 bp, Heterodera glycines
  Promoter: Source sequence=SeqID_6832; Location=1..695; Strand=+; Gene= SeqID_63033
actgaataagccaaatgccaaactgatacgattgctgtaatgtatcacaagcgtcaaaaaagtaaatgtcgcaggaaaataattggcaattttattttagttttttgtaattgccacaaaggaaagggagggaaagggaatgagttgggacgcgaggaatggccaaatgttgtgaaaaaagctaaagcaaacattgaccgaagtttctttttttgtgaataattgaagccaacaagcactattaatgaataaagaatttctccgttatatttgcttttcattaaaaaaatccctttttattttccgttttcacaacttttttttcatttagtttttctgaattgggttaattttttgagttaatttctgagttgacacctttttataaaaatttattattatctaattaacataaatatcactctcttttgaaatatgaatcaattttaagcaaaaataagtaattataatctaaagcctttttatttaagtattattctaatcattttaattaaatcaatagaccccgatatcctgctttaattgcgctcaataccggaccacaatgcccggacctgtctactccggttgtgccggattttcccaaaaatgccggaccgtatgccaacacttgaactgatttaattaatttgcgctaattatataacatccataaatttattagatttcaaatg

SEQ ID NO: 108162 - DNA, 269 bp, Heterodera glycines
  Promoter: Source sequence=SeqID_17360; Location=1175..1443; Strand=-; Gene=SeqID_81844
tgcaggtcaaaaatttctccttcttcaccattccctactcttttttccatccagacccccattcttaccagggcaaatttttaccggctgtatcggtactagacaaaccggtaccgatactttgatttttgaaaaaaccggtaccggtaccaaaaaaaccggtaattaccggtcggtaccggtaccggtaccgctcaaccctactttttgtcgcaaaattcgcaattaaaatattaaaagaattaccgtattattcccttcaagaaatg

SEQ ID NO: 108163 - DNA, 774 bp, Heterodera glycines
  Promoter: Source sequence=SeqID_31019; Location=706..1479; Strand=-; Gene=SeqID_61375
cgcaatgttttctttgcgtatgcccaggctctccttttcgactgggagtgagaaaaacaaatttatttttataattagggttgtaaattatatggactaaaaaacgcgaaatatggacattaaatatggactaaaaaagcccaaaatatggactaaaaaggccaaaaatggaccaaaatatggataaaaaatgccaaaatatatgttgtaaacccccaaaaatcccaaaaaaggtgtgcatatttaatatttgcttaaataaacctaaaaagtacaataaacaaccaaaaaatggggtttaaaacttaaaaatgcatattttttattgttgttcgttgtatcaaaaacacctccaagtttgccaaatttcgaaaaaattctcattaaaaaaaaagaaatgttcgcaaaaaaatgacgaaaatatttattgaaaatgccaaaatgacgacgaaaactcaaatttttcgtgttttgtggggtgtaatttttaaaaatttccaaaaagttgatctttaggggtgtatttttcgtttttttttcatttttcttgtgaaaatttccaaaaaatggccaaaatatggactaaaaacccaaaaatggcgaaatatggatttattcccgaaaacccccaaaatatggatttatatggactaaaaaccttcaccaaatcaaaaaattttaacgcagaaatgctatttttaagcccctttcttcatagtatatgcgcagaaaaaatatgttaatccatataatttacaacccttattaataatg

SEQ ID NO: 108164 - DNA, 878 bp, Heterodera glycines
  Promoter: Source sequence=SeqID_30084; Location=1195..2072; Strand=-; Gene=SeqID_60526
gaaatgaaaaaaataaagtaacttgagcaacggaagaggggaaaattgggaatgagaagcgggtgggagggatggtcaacactcacaaatcagcacactcatccaataatatattgaaaaaccagctccattttatattttcaacattttgagcaaatctgaggaatcggttgattggtaaaagagaatttcaatcagaagcctaaatatgtaagaaaatttggcgctacaaaaagtgattctttttgaaaaaattttttcaaatacttttccatcaattttagtgttttatgttttttttatttttttttaaaagatggttaaaatgttttagatattctttcattgatttcactaatctccgattcggcttccaactgtagatgaagtaaatatgaggtgaattttcgaaaaaagatgcgtttcaagcaaaatgtgagaaattaattattttttattaatatatttttaagtggcactctcgtaattgtaaataaatatttgaaaattttttcaaaaagttcaaaaagaaccactttaaagcgccataatttttatgatttgcataatatttaagattggtccctccgaaaatattggaaatgccatttaaacagtaagaacggaagtcggaagtgccaagcgatcatcaacatttttggttgccaatttctccctattagctgacactttttcaattcatttcccttttttcccttttcatgctttcaatgtgaaattgaaaatgctctgttttaagcgtccatcgttaagtgtttgccgccccttcgcccgcacttttggcgatgcgaccgacgattgacccattttttacattcgcacatccatttgcagtttcaggagatcagcagcaaatg

SEQ ID NO: 108165 - DNA, 622 bp, Heterodera glycines
  Promoter: Source sequence=SeqID_15106; Location=816..1437; Strand=-; Gene=SeqID_79284
tagctacgaatttctccttaagaataatacttatgcactgagctttgcctttgaaaatatgggtgtttcatgtaatttcttaaagttaaatggaaatctgccaagacttatttgaaaaactgagtgcagccaacgcgagacaatttaacggcatctgccgaaacagagatcatctgcggatccaattcgcaaattcgcttcactcgaccgatcggatagccgaacgtgcgggaccgacatatgaaggcacaacacactcaaaactgggaaacttaaattgtagctgattgtgagctttagcttaatacaaaaaacaaaaaaataaaattaaaacattatgccagctttttgaaagttttatttttttaaattttatgtttaaattttcttctggttttaaattgaccaactaagaaaaaaaaagcggattctaacctacgcccatttcccttcactgtcgtatcagcaaatccaatggtgatttttgcggtgtttttcgcccaacctttcttttttgtttgtttatctttcgttagtaagttcgtattttttagttacaattgggtttccatccatttgagtttcttattgcgtctctttttcttactagccgtaagcaatg

SEQ ID NO: 108166 - DNA, 57 bp, Heterodera glycines
  Promoter: Source sequence=SeqID_7781; Location=1141..1197; Strand=+; Gene=SeqID_65941
aactgtttttcccaagaaaattaaatcaaatattttcagatttaatttcatttaatg

SEQ ID NO: 108167 - DNA, 212 bp, Heterodera glycines
  Promoter: Source sequence=SeqID_1749; Location=1139..1350; Strand=+; Gene=SeqID_75679
tctcacccgccgatgcagctagccggtgccagaagcagattctgagccattttcaaagataaccgcattttagcgatcacacatattttgaccgatcggttcttttggcacattgccaaaatatggaaattcaatttggtattttgttgccattttaaaattgttcgaattttgccgaataaataaatgcatttttacagactaaaaacatg

SEQ ID NO: 108168 - DNA, 76 bp, Heterodera glycines
  Promoter: Source sequence=SeqID_35108; Location=726..801; Strand=+; Gene=SeqID_46413
actgtaaatgcaaaatttaatttattttggcaaataaattcactgttatattaatttgtgcgttttctttcagatg

SEQ ID NO: 108169 - DNA, 819 bp, Heterodera glycines
  Promoter: Source sequence=SeqID_13642; Location=1277..2095; Strand=-; Gene=SeqID_77545
actctctttccaaggacaggtatactgatttacaaggacataacgaacaaattttaagaaacccaaggacattaaaaaattggttaaaatttattcaaatggtttatattttcaccagaatagattttttcaaagatttttttccgctaatttttttcatcatttcatgccataagttaattttaaaaaataggtagaaaatttcaaaaaattgtagtatttcgaatgtttttttctaatgctcatttccaaggacatccttggcatccaaggacaaatacgctccctgttttaatggcataaaaagaatgaaaaatagagaaacattttagaaattgttaatttatgcttttgaaatgtttaaagcaaacttattttaatgctctgtgattgaaaaatgatcgtgatatttgcataaattatagaaaatctttttttattattattattagtttagctggattaataaaaacctaactgttgtgatgacataaatattaataaaataatttcaaataaaagattcttcaataattcaataatcaatgggccattgagggttttgggtggattacacagaattgaaatgataaattggcaaatcaattgaattcacgagctttttagggtttgcatttcccactgaacaaataattaatgaaaaaattgaattacgagaaaagataataataaatttaaaaaaaacaaaagaattaatcaataattatgaacaagtgtttaaattagtgaagaagttataccggggtaatagaaaaagtttacagaaaattgcaaaaaaaaaaaaaaattgaaaaaatg

SEQ ID NO: 108170 - DNA, 115 bp, Heterodera glycines
  Promoter: Source sequence=SeqID_12853; Location=3055..3169; Strand=-; Gene=SeqID_76582
cgtaattccatgatactgtatttattactactataacccctgaggggagaaaatatgatttttaattttttttttaatatgaattctcaattttttagccaaaaatgtgctgatg

SEQ ID NO: 108171 - DNA, 335 bp, Heterodera glycines
  Promoter: Source sequence=SeqID_9131; Location=1176..1510; Strand=-; Gene=SeqID_70348
gatggcaccatttggcccagagaattggaaatcattggtgccaaacgtttgatggtccaatacaaaggaaatcgcttaagaggtaattgtcacaaattaacaaaaaaattattaaagaaatttaataattaaaattaaaatcactttaaatacgattattttaattgaaaggaagtcgctcaatgttcacaaaactctgtctgcattctgagcacaaattcgtccatttcttacatcgaaatgaaaatcatcagtatgaaaatgtaaataaatcttagaaaaataaaaattatattttaaatttataatttataataatttttaggtgcgcaatg

SEQ ID NO: 108172 - DNA, 175 bp, Heterodera glycines
  Promoter: Source sequence=SeqID_3713; Location=1..175; Strand=+; Gene= SeqID_51584
cggggacctctagagtcctcagcggagcggagagtcggcctttgtttatgtgtctcaacggcgaaaacatagtgcaacaagacgtaagtatataatttatttacaagagaatcaacatttgttcaattaggtgggcaatgatcggagttttgtggcgaatgatggccaatttatg

SEQ ID NO: 108173 - DNA, 726 bp, Heterodera glycines
  Promoter: Source sequence=SeqID_15961; Location=2020..2745; Strand=+; Gene=SeqID_80317
attgatcattgatcggcactcacctccaattgtgatcggacaaaaatgatattaattgtatatgtacatatatatcaacactcggacaataaagtataatgtgtgtttttttacttggcatggattttctgaattttgggcaggacaacgtccaattcggcgcacctttgttttatggttttcatgccgcaatcgaaaaaatgacttgccatgataaaatcatatgacaattctgatgtcagattcgtggtaatactggagaattggtgtcccggcgaaaaataaatttaaaaattttagtttaaaaatctggttccttgtgtacttttgatcataattttgttcaaacattaacgaaattttataaaattttgcaggctaatagagaactcatagggttatcgaataacctcaagaatttaaaaaaataattaatttataattaaattttttaattagaaacaaaataattttggtcatctaaaattctaattaaaactttcttagaaccaacagaattaagtgtcttgatattattcgatagccctaagtgttttctactagatttccatttgatagttttttttatataaaatgccctttttgaatgtttttatataacgggtcaccaccgacaaaatacagtatacgggcgaaataggcataaagtagataacatatttgctgtgaaaaaatgaagaaaaaaaaaattatttaggccgaatg

SEQ ID NO: 108174 - DNA, 372 bp, Heterodera glycines
  Promoter: Source sequence=SeqID_4866; Location=1858..2229; Strand=+; Gene=SeqID_56002
ttgaggggaggaggccaaaggaagcggagagaggaggcaacaatcggaaatattctgtccataatatttaagtattcactgtctggaaaagtggccaatggtcagaaagttttttggattgttcaaataaatttcactggctaaggccgtcccttcaatggccactgcgactaaaatcacacactttttgcgctttgttgttttttcgatttctttaattttattgagccttttttcatttgcttataaacaacaaataaatgcaatggttgtcatttcacttaacggtaaaagttgccattgctttccttttttatttgttttcgttttcctttacggttcctatcaaaaaaggtcgcttttatgatgatg

SEQ ID NO: 108175 - DNA, 1003 bp, Heterodera glycines
  Promoter: Source sequence=SeqID_4488; Location=1384..2386; Strand=-; Gene=SeqID_54637
aaaaaacgataaagttaaataataaaaattgtgatatttttatttaaaacatgaaattccttaaatgtttcataattttaattagagaccgagatttccaaaaatgccgggccgggctggtagaagtaaccgggttccgggcccggcctctcaaaacccggtcaacccgggttttcaaattgccgggcccgggaccgggttccgggtcggtaaaatttttaattttcacatatatttcaactccaaaattaacaaaaaaagctcgggcaatcgttaaatttctgctctatttcacttcaggcgtcaataaatcgacatcttcaattataacttcaaatttttcaacaaaaaaaatcttaaattttctataagagaaaaaccaagaagtaaattttagaaaactttcctcgcgctctgaatttttgtaataaataatgttttgcatcagggttggcataggtaccaaattttcgaaatcggaaattttttggtatttttttagtatttgcttgaaaaattattcaatgatgttcatcaaaattttttttcattttacattgttttagaacattttcgaaaagggactattacagcggcgctttttccaaaagccttttggggaataagggggtccggcggtgccgataggcgccgccgaggggaaatttttaaatttttaatgcgatttgttgacagattttgcccaaaaaggactaattttagcgattttgagcaaatttttcacgaaaattaatgattttttagggtctggtttattgacgttttttaaataggccaatttcccaaataagactcattatctttaaattaaaaagaaaaaagaagtaaattctcatttctataaagtagaattgttcgaatgaaaaaatttaaccagaaaattgacaaaaaacatttataaacattatgccaaagagattttcgaatggaaaaagaacaaattttggctaaatcataacccggtaaaacccggtcaaaaatg

SEQ ID NO: 108176 - DNA, 120 bp, Heterodera glycines
  Promoter: Source sequence=SeqID_16277; Location=320..439; Strand=+; Gene=SeqID_80669
ggtgagtgatttttcccaattgatatttaacccggtaaacaaccatttttcagcgctcaccgggaggcgaatcgaatacgcgccgcgtcgctcgggtaaaggaaggaaggggaaggaatg

SEQ ID NO: 108177 - DNA, 1003 bp, Heterodera glycines
  Promoter: Source sequence=SeqID_3429; Location=4286..5288; Strand=+; Gene=SeqID_84655
tattattttaacaatttaattttaattaaatttattttttaatttatttattattattattattatttatatttttgtgtggtattagagagagcaagagaaaagagagagtgagagagaagagagaatgaaagagagagaaagaaaaaagagagagagtgagagagagagaaaagagagagataagagagagaaagaaaagaaagatagtgagagagagataagagagagagagagaaagaaaagaaagaaagaaagagagtgagagagagaaagaaaagagagagagagaaagaaaagagagagagaaaagagagatataagagagagaaagaaaaaagaaagagagtgagagagagagtgagataagagagaatgagagagagagaaaaaaagagagagaaaagagagatataagagagagaaagaaaaaagagagagagtgagagagagagataagagagagagtgagagagagaaagaaaaaagagagagagagaaaagagagatataagagagagagaaagaaaaaagaaagagagtaagagagagagagagagataagagagagagtgagagagagaaagaaaagaaagatagtgagagagacagaagagatagagagagaatgaatgttagcttttttattcaattattttttaaattataaaaaattttttttaaatttatttattttaatttataatttattttattttaatttaatttattttttattaatcaataaaaacccttcaataggtttaggttcactcccgcacccatccaataggttttggtttaaaccaataggttttagttttgggattgtttatttatttttatttttattatttatttttaatttaatttaattatttaaatttattattaatcaataaaaacccttcaataggctttggtttaaaccaataggctttggtttggaacggtggttttccaacccccaaaatcgcccggagtaactactgatttacaaatg

SEQ ID NO: 108178 - DNA, 432 bp, Heterodera glycines
  Promoter: Source sequence=SeqID_728; Location=4228..4659; Strand=+; Gene=SeqID_59929
agaagatggttcgcatttcacgagcaaatgtggcccgaacataacggaccacactgtcgtgctcccattccagcatcccgaaataagcacgacatgccaagtcatgtgcttggctgggagaaccaaattctccttggtgggacaactccattacatcccactccgacaacagtcagaattcggagcccgagtctccgaaagcctcgaagaggccagcaactcaggctgggctgacttcagtttcgactggaactccacttttcatgctctgtttggccttaaaacaggcctaattttcttcattgtcttgatgatcggcattcattggaagaggctccctatgaccaagaggggcccaacaggggatccccgtctcgacggttcttcgaggccattggcctccgaagaggcaatccgaatgttggcgaaatg

SEQ ID NO: 108179 - DNA, 114 bp, Heterodera glycines
  Promoter: Source sequence=SeqID_25954; Location=1309..1422; Strand=-; Gene=SeqID_56706
aaaacgaaatcgctttgataatggttaaacgacggtagtttatttaaacaaatttcactaaggaaaataccgaaggagacgcgtcccgtgtgaagagcgaacccgcgaaatatg

SEQ ID NO: 108180 - DNA, 304 bp, Heterodera glycines
  misc_feature (30)..(30): n is a, c, g, or t
  Promoter: Source sequence=SeqID_3559; Location=692..995; Strand=-; Gene=SeqID_50863
tgatcaattccgatttcctaatctaaattngaacaaaaaatcataattttaaaaattcaaaatttcgatttttattcgagttcgggttagggattagaaattagtcaaaatacatgtcagattcgtgattagcgacctttaaaaccccggataaaaaattatcatggttttttatcttaaaaaaattttgcaaaacaaaagggtccccccttttgtttcaaaaactgtcactttcaatatagtgccgaaaaatttattgttattttcttttgtacccatttcgtacctacatttgacgaaaatg

SEQ ID NO: 108181 - DNA, 153 bp, Heterodera glycines
  Promoter: Source sequence=SeqID_11169; Location=1..153; Strand=+; Gene=SeqID_74523
ggtagagaagtgtcattagacaagctcccaagccatccgctggagagcttctttgcccgtcggattcgtgaggcccaactcatcatcattgatgagatcaccatgcttcacaacacggtgattgaggtcatcgaccgagtgtgcaaagagatg

SEQ ID NO: 108182 - DNA, 702 bp, Heterodera glycines
  Promoter: Source sequence=SeqID_9000; Location=1..702; Strand=+; Gene= SeqID_69956
ttgggacaaaacttaattactttggcaaagtgccctcctccaacccaaaaaaaattcaagtaatagtttcaagtttttaaaaagaattgttaggaagtgctgaattaaattttgatttcacaaatccaacatctgccactttctgggtcatttttcagaccgattgcctttgggaagtttcaaaatttaaattatttctggcgaaatgccctcatccaacccaaccaagtaattagtctcaagtttttaagaaagaatttatcagaagtgcggatttaaattttttttttaagcagattttacaaatttaacatctgccaccttcagcagggggtggtcatttatcacaccagccttatagagatttttaaaattgaaattttgtttggcgaaatgcactcctcccataaaaaacattccaactgtgcgcaacaaatgctcaacaatggaaaaaggagacatcaccatagcagatgaatgggaatgaataaatgaatgaatttgtgtgtcgaaagcatatgtttgtgccccgcattttatgggtctgttgtgtgttatgtttacttttgtatttggcgcgtgaataaatttttttttcgggacggggacaaaaattgcgggggaaaaataaatttttgcgggggtggaaagcaatgtgaaaagtcaagaatttatttcctctttttttttgcgagaataatg

SEQ ID NO: 108183 - DNA, 1003 bp, Heterodera glycines
  Promoter: Source sequence=SeqID_9449; Location=293..1295; Strand=+; Gene=SeqID_71463
cttcattccatcaaaaagtgccattctcttcattccacaaaaaagtgccattctgtcttccatcgtttgcgcgtccttttctatcgattacctatttttgtatttttctgctgtgctcagacgaataaattttggcttctctcctttcttccatggaaaaatagcacatcaaaacattttgaagaaaaaaataaaataaaaattattttcactttttaaaatttaagttttttattaatattctcgaaaaatttcctagaaacttatttatgaaattttcggtcgccgtatataattactcacacccttaaagcatacacaaccattaaaattatgacataaatatttaaaataaatcctacattgccattaatctggtttttaacttgttattttatacaataattttatgcttgtgttgagcgtatacattttttttcggtcgcattaattaagtttattgtacgcgattctgccatatcttctaaataaaagggcaaaatggcaccaactttttccaaacaacattcattcacggcactgggctccttcattacatattgcggcacaaggagaagcgcacggattgcaatgaaagcacgcaaatatccaagaaaaatgtattattatttttaaaatgatgacaatgttaataggtttaataccaaatggccaattgatagtgttctgggcagattattaaaaaaatacgatatatttgacccgttatcttttacacagagctctgttatactatctgccaccgtataaggataccgtattagctgaactttcaagtgacaccaaacaattgaaaaaatcatttccttaaatttgatgctgataataaaaaaataaataaattggaaaattttcgaaaaatatcttagctaggggtaaatgttttttttttaaataagtattttctaccgaagtcttttgaatggtgagtttaagaaattccgatttggcttttagctatgtttgcagtgacatttggatg

SEQ ID NO: 108184 - DNA, 133 bp, Heterodera glycines
  Promoter: Source sequence=SeqID_3274; Location=1..133; Strand=+; Gene= SeqID_84019
ccttccgattgtgaaacggtggtgaaagcgctgacaggactaccgtgttaaaacaacatacaaagacagaaatggatacaccaaaagctttgcttttggtggaattacagcacaaggagctgcaataactatg

SEQ ID NO: 108185 - DNA, 1003 bp, Heterodera glycines
  Promoter: Source sequence=SeqID_14526; Location=1324..2326; Strand=+; Gene=SeqID_78580
ttgacaactttgaaacaggattttaaaactttaaatcaatttttcgcactgtccttccgtctgtccgttacaattaattaactagttgttcgaattaattatttactaaatgaggaagtaatttttgtgcttttaatcatttttacgatcattttggagtttgtaatcacaacacagaaattattattcattattaaacatttaataatggcaagggcaaaggcttctcccccattttcttccgccaaagtcaaagtgattccccccgccgcccatcgtttggcaataaaagggcaaatggaagagaatgggaggggggggggagggggaggagaagcactaaaacattattagaggtgtttttaaagagacaaaacaatgtttacggacagaataccaacagaaagaaacagcgaaagcgcacacaaaatgcattttatccgatcaaaatcagcttactgattgataatgaagttgcatttgaatacacattttaaccaatgaataacccaatcgatggcacgtcgtttaatggcgaaaaaatacagtatttaatttatggcttatagacttgggcccggcttcctaaagggtcgatctctttgaaagcttcaaaaaagttaaatcattaaaaaagttgtttatacatttttttaattttcaaaaatttaaaaatttttcgcaacaatttcaacctcaccattttcgccatttgtacgagttcttatgacacaatttcttttggggtttttcgccactaaaaatccgggcataattatgaaaaataaaaatgtaattaaaaaattgccgttcagattattgttaattgattattgcttttgccttccaaatgcttagaaagcttttttatctcataatggtggcactcaccggaacagttcagtcaaaacttcaaaataaattaaattttgattattagggggacgggggctttttcaatcatttttaaaattcgataaatggccaggtgcagcagacaatg

SEQ ID NO: 108186 - DNA, 546 bp, Heterodera glycines
  Promoter: Source sequence=SeqID_16541; Location=1402..1947; Strand=-; Gene=SeqID_80946
aaataggagttaagcagacgctttcacattatgtaatttatgtgcaaaattgggagggcagaggacctttaccgctccgttaatttatgctatgagaatagtaattgtaaaaaatgccttcagcgcgccctttgttcattttttaaaattttgaggtgtaggcacaaaaccgaaaagtacctttaataattcccaactgatttaagtctgtcggcacttttgaaaccttttgcatatttgtgcatatttttgcatttcaggcatattttattagcatagttggatattaaaaaaatcttctcttaaacggctacttttaatatttagttttttttagagatttttagcttaaatttaatgagaagagttttgagatattttacactgaacttgataaatttatgtgcattcttttcaatttttggttgattttatgcgtataatttgcgattttatatggataaaattgcccacccttcatatgagaaacaataattattagtaatcacgaactctctggcatcattattatttttttgattaatg

SEQ ID NO: 108187 - DNA, 756 bp, Heterodera glycines
  Promoter: Source sequence=SeqID_6848; Location=1085..1840; Strand=+; Gene=SeqID_63096
gctgcaaaagcaaatttcaatcatacatatacaaggggtgtctcgagacacccccccccccccccctcgttcgtcgtagggggggggggtcgtcgcggagtgtggtcgtaacgaagagggaaaatttccttagcgaaacatacaaaattcaaaaaaattttcccggcggcgcctacgcaaagaaaaagagtgtggctgaatagaaaaaaaagaataaatataatataaagatgtgagaaaacgcggatgcttatatggagagagaaagcgtaggtggagcaattttagcagagcgacaaacaacaaaaaagagtgactaatactaagcacagaaatcacatcacaggaatataaaaaatcacaattattcaaaattatccaaattaactcaattaaatttctcttcctcaatttccttccatttctctctctctctctctctttttccctcatttcttctttttctccactttcttagtcgctttggcgacagcccttgggctgagacaccccttgtacatgtatgaatggcacacaattaatcggaaacagtcctaattggttctaattaagcacacccttctgccggaccaagccctcgaattggccaaggccgcttctcaagtgacgacagcgaacgcaaatcgcaatcagcgaacggcacaacaacagctgcaagcacccactcaaaatggtggggacacttcctcctcttccacgtcttccgttgtcagtgagcgaaggacatcacaaatg

SEQ ID NO: 108188 - DNA, 306 bp, Heterodera glycines
  Promoter: Source sequence=SeqID_32129; Location=1..306; Strand=+; Gene=SeqID_62457
atcattgttttttcagttgatattacctttctgagctttttaattctgaaaaagaggtaatactgaatgcttgctacaaatgtaaactgcttatttcttgaaaaccttaataaaaaatatatttttaacgaataattaaattctttgttgaaaaataggttttaattatctttcaggcgaattgtaaccagctgactaatccagcagaagccatagaaaagtgatcagaatttaaaaagggaccgaatcacgcaattctgtcattttttggcatattgatacaaattggcatttgcagctcaaatg

SEQ ID NO: 108189 - DNA, 157 bp, Heterodera glycines
  Promoter: Source sequence=SeqID_6832; Location=1221..1377; Strand=+; Gene=SeqID_63034
agtaatattattttatcttattttttaaataaattgtactaaagcttgatatttttcgtattagatttaataaaattattgaattttattaataagtaattcttttaatttaattagtctattttaattagaaaatcaaattaaggtttacaaaatg

SEQ ID NO: 108190 - DNA, 278 bp, Heterodera glycines
  misc_feature (30)..(30): n is a, c, g, or t
  Promoter: Source sequence=SeqID_41554; Location=1249..1526; Strand=-; Gene=SeqID_69643
cacacaatataattttcaggttttcacttnttttcccacttccgttaagtaagaaaatcttttattaaagaaattaattgcgataatttttttctctgaattacaaaatcttaaattttttaaatgattaaaattaattaatgaaataaagaagaaatttttttatgaataatataaaatgttgtaaaataactgaattactcaaccaaaattttcaaataaatataaatattttaagcagacaaattttcataaaacttatttttacatcaataatg

SEQ ID NO: 108191 - DNA, 234 bp, Heterodera glycines
  Promoter: Source sequence=SeqID_36645; Location=55..288; Strand=-; Gene=SeqID_65902
ttttctaagaaaaaataggagttttgggggcgcagcggtgccgataggcgccgccggggaaaaaattggaaattttgatcatttataaacagtttttcactgaaaattagccaatttataggtaaaattttgaaaaattttatgggaatttaatccaattcttaggggtgtaaaagtcgcatttcgcgccaaaaagcgaaatgcgaaaagcgaaatgcgaaacgccaaaaaatg

SEQ ID NO: 108192 - DNA, 888 bp, Heterodera glycines
  Promoter: Source sequence=SeqID_17626; Location=1200..2087; Strand=+; Gene=SeqID_82151
ggtcagttttgagatggcaattttttaaaatttaaaaaaaaaaaaaattaattttaatgccaaaaaatcatgaaaattttaaaatagtgtcggtgaaaacaaatttttcattagtttgcgaacttaattgcaaaaaaataaattaattatttgtttgacaacttaaaaatttctcttctaccgaaaaaacgatttttaattttttatgttttttgtcacaaaacctcgaaaatttctttaccaaagtgacttttctgaaattttttttaaaaggtcggtcttagggggtgcaattttttttactcttattcaattttttatttaataaaattttacaaactttgaaaatactaaaaaaacaaattaaaaaagcataaaatatttttttcaatgtttaaaaaaattaaacgcaaaaatgtatttatttttgagcttatttcttaaaaatagagcaaaaaaaaaacaaacaaacaaaattttgacttaatattgaaaaccaatttttctgcttttaattttggaagggaaatttctgtgttttttgattattttttaatattaatcaaaaaagaaaaatttaaattccataaaatatcacaatgaataattgtatttgtgttttttgtattcaaaatcatcgcacccttaaatatcatatcgtttcctattttaccgtatccttttttgctgaaatactgtattattgccgaactttccaaaatcggtgcaaaccaaattttcactgacaaatgagtttaattgcaaaagtatttgaaaaccaatttttctgctattaatttttagaagggaatttttatgttttcaaaatcattttaatatttggatgataatttaatcaaggcacttttatggagtgccgtgtaaatg

SEQ ID NO: 108193 - DNA, 733 bp, Heterodera glycines
  misc_feature (440)..(440): n is a, c, g, or t
  misc_feature (443)..(445): n is a, c, g, or t
  misc_feature (450)..(450): n is a, c, g, or t
  misc_feature (452)..(453): n is a, c, g, or t
  misc_feature (461)..(464): n is a, c, g, or t
  misc_feature (477)..(477): n is a, c, g, or t
  misc_feature (483)..(483): n is a, c, g, or t
  misc_feature (487)..(488): n is a, c, g, or t
  misc_feature (499)..(499): n is a, c, g, or t
  misc_feature (506)..(507): n is a, c, g, or t
  misc_feature (519)..(520): n is a, c, g, or t
  misc_feature (527)..(527): n is a, c, g, or t
  misc_feature (562)..(562): n is a, c, g, or t
  misc_feature (573)..(573): n is a, c, g, or t
  misc_feature (583)..(583): n is a, c, g, or t
  misc_feature (594)..(594): n is a, c, g, or t
  misc_feature (609)..(609): n is a, c, g, or t
  misc_feature (611)..(611): n is a, c, g, or t
  misc_feature (617)..(619): n is a, c, g, or t
  misc_feature (621)..(621): n is a, c, g, or t
  misc_feature (635)..(635): n is a, c, g, or t
  misc_feature (643)..(643): n is a, c, g, or t
  misc_feature (652)..(652): n is a, c, g, or t
  misc_feature (655)..(655): n is a, c, g, or t
  misc_feature (662)..(662): n is a, c, g, or t
  misc_feature (667)..(668): n is a, c, g, or t
  misc_feature (679)..(679): n is a, c, g, or t
  misc_feature (681)..(683): n is a, c, g, or t
  misc_feature (687)..(687): n is a, c, g, or t
  misc_feature (692)..(693): n is a, c, g, or t
  misc_feature (699)..(699): n is a, c, g, or t
  misc_feature (701)..(701): n is a, c, g, or t
  misc_feature (710)..(711): n is a, c, g, or t
  misc_feature (713)..(714): n is a, c, g, or t
  misc_feature (725)..(725): n is a, c, g, or t
  misc_feature (730)..(730): n is a, c, g, or t
  Promoter: Source sequence=SeqID_2658; Location=1384..2116; Strand=-; Gene=SeqID_80922
agtgacccccagggaaaagggagggggaaattcattaaaattaaaaaaaaaaaaatttcttgacggtgcctaatggggcacagtcggatgggacggaccatcatttgatcatattttttgaaaatttgactccataaaatggaaaatgggttactttttaacttttttttttttggcttaaaagcggctaccaaatttcttattcttctcccaggggtttaaaatttcgaaaaataatacttgaaaaacagtttttggcatgatgagtaaaaaaaaaaaagtctccggatttccccgacaaaatttctttaacgaaaatggttaaatttttaaacagtatgccatttttttaatgaatttcgttgaaaatctcaaaaatttaatttttccatgttgccgcctattggcacagttggaccacaaaaatattttttttattnaannnaaatntnnaaaatggnnnnatttattaaagtnaaaatnagtnnagaaatggganttaattnntaaaaatgtggnnaattttntaagaaaatttggaaaaaaaaatttttggggaatnaaattttgttnaaaagttagnaattttttttntttttgtttaaagtngntttggnnnanaattattttttttnattttttntgtttttgnagngttaagntgggnntgttttgtggnannncggnggttnngttgtngngaaatgtgnnannaaaaattgggnttganatg

SEQ ID NO: 108194 - DNA, 908 bp, Heterodera glycines
  misc_feature (712)..(712): n is a, c, g, or t
  Promoter: Source sequence=SeqID_40613; Location=614..1521; Strand=-; Gene=SeqID_68886
agtagagctcggcctgtacttggatccaggcctgtatttttcctggatccaggtacaggtacaggcaaattttcggcaacatgtatttttcctgtacctgtattttcctgtacttttgtccagaaaatacaggtacaggccaattgggaaatacaggtacaggtacatgtaggcttttttcaaaatataccgagctctagatcagagttttgaaaaattccgcagtattttcaaatatgtaaatatataacgccaaaacttaatgtggaaaattatatttgaaaaattctgcgtttttcgtaaatttatcgggatttttataaatgtaattcctgtcctagttaggtttttgatttttttataaatacagctgggaatgggacctcaggcccccataagtttttttatttttcgctttagggcaaaattcacaaatgtttaatctgtaatttcgattttaactttgaaagagcgagagagagagagagagagaggaaaaagcgagagaaagaggaaaaagagaaaaagagagagagtgtagagggacagagaaaagaaaaaaggaaaatttgaagagagacgggaagaggaggagagaaagagagagtggaaggaacatttaatcgattacttttgctgcatgaaatgaatgttttgtgagttccgttagttcagttcatgtgactaaatttatccgaattatttgggctanaccacaatggtaaatcactgaagaatggatgagaaagccccaattaggattgtttttactaattattaaactaacaaactcagagagtctttgctttgtttaattattctttttagaagttatatttaaacaaagaaacggttaagctaccagcagtaataatacctactaagtcagttgttttctgtcaccaatg

SEQ ID NO: 108195 - DNA, 89 bp, Heterodera glycines
  Promoter: Source sequence=SeqID_22632; Location=875..963; Strand=-; Gene=SeqID_53306
actgaattctcagagtccttgtaccaatcgtgaaattcttggatcaaaaacattctgccgttgtcgattccaatgtagaaaatggaatg

SEQ ID NO: 108196 - DNA, 975 bp, Heterodera glycines
  Promoter: Source sequence=SeqID_6368; Location=669..1643; Strand=+; Gene=SeqID_46236
aaaaaatcagagaacatttgaagcgaagaatggggagggggctttaaaggagggaaaagaaagtgttttatccgctaaattaaaatttccatattttctcaatagtataaattgcccttatttcctcctaactcaaatttgctatgattctttattttcccattttaattaagccgaattgttgcactttccgccgtttgcatcggatgcgcaaaatttcatcgcactaatggcctcatcactgactccaaacccactaattacggtatattaaataacttagcccaaatatctgagtcaaaagatatttcttgttgaaagggcgtacttgaaaactagaaaatcacataaccctaaacaatgggagcctatttcaaagggtttaaggacataactttaaagaattcacgcggaagcttctgttctggtaagttgttgttccaactatgtccttgaaaataagacccaccccaattttctgggaattaaagtacatgttttcaagtacttatagcacccatgcagggctgcacgaaatttcgtgtcgttttcgtttcatcctacattttcggcactttttgagttcgttttcgattttaaaaattccatttttcgtctcgtgtttcgttttcgagttttaaaatttaaaattttcgtttcgttttcgtcagacggaattttgacgaaaaagacgaaaatatttacacccttaagaatgacttttttagtaaaaaaaataagtgatttcattgaactgttgtagtttagtcgtgcacacttcagatttttgttgtttttttatatgggttcgtcccatatgcccgcactctcgagctatcaaatttttttatatctggaatttttgtaattttttttgtcagcttgccccaacccattttgagtgtcatggaattgtaaaattgtttaattaatgaaaagcacaaacataatttaaaggaatcaacagttttaatg

SEQ ID NO: 108197 - DNA, 571 bp, Heterodera glycines
  Promoter: Source sequence=SeqID_7483; Location=1..571; Strand=+; Gene= SeqID_64961
aaaaccctttttttaattcaaaaaatttttaagaaatttcaagaaagaaaaaattaggaaatttttttagcgatttttttcaaagtttaatgatgaatttttaaaaaaattgcaaaataaaaaagtttcaaaatttttgaaaaaactttcatttattttttttcttgaaatttttttggtaaaaattttttaaagaattttgcttgaaaatttctgtttgaaaatttttttagaagcattcgacggcgagattttgtagcgacttcgggcggcgagattttgtcccgccccataaaatagcataactaaaactccaaaaattattaatttataattttcataattatgttaaacatttaagcgaatcttctgagcttgatcttgacgccagttttgtgctagaaaatgcgcgtttaaagctgatcaaatcccatgatcagaaacaatttgagaagttgatgcacagacggcaatcattggcgataaccgtttccacgaaaaaagtaaaataatcttttatttttccatttaaatatttattattattattattataatttagctaaaaatg

SEQ ID NO: 108198 - DNA, 1003 bp, Heterodera glycines
  Promoter: Source sequence=SeqID_4834; Location=794..1796; Strand=-; Gene=SeqID_55882
tggaaaaatgcgccgtaaaaattcttaaaaatctgattttttgatcccgagtgcactgaacactgaaatttacgatttgttaatttcctcaccaaaatttttaaagatgatcatgggaggtgaaaaatataatatttaatacatttttgatcgaataaattgtaaaaataacgatctgaagcaattttgcaaaatgttctgattttcgaccccaaaatctgattttttggacccgatgttctgattttgaaaatttttcgatccgaaccctgtgtgcaaatcgatcagatagatggacaagtgcttgggaagcagggctggctggccgtaactggattttcaattatggaaatccgtaattacggcgaatttctcaattatggcttccgtaatccgcagggctcccaagtgtgcttatttctaagatttgtgcttatttcagcattacgtgcttattttgggatttgaaaataaaaaaatgcaaaattttaatgaatgttttgaattatcgttttttattgaagcgaatatttgaattactaattcgattttgaaaaaattcaaatttatttcgttttattgagtgaaaatacccaaaatttcagagaaaatctgtaaaaaacagtcaaaatttctatttttcctccggcggcgcttttcggctccgcgggtccccaaaacatttgttttcttaaaaattggctcaaaatctcaaaaattggtcattttctggcggaactctgttaacaaattgggcgctacttaaaaagagtattcttttgaaaatttcacttttttttggtcaacatttttttttgttttgtttgttttgatacagaatttgtttttttaacagatggtacgaatgacaaaaaaaacaacaaaaaaagtgaaagattttgaattttatcaaaaaaccaaaggggggaggggacccttttgttttcaaaattttttgaaataaaaaatcgtgaatatacttttattgttgagtcatgttatg

SEQ ID NO: 108199 - DNA, 924 bp, Heterodera glycines
  Promoter: Source sequence=SeqID_33673; Location=1..924; Strand=+; Gene=SeqID_63669
tgatcatttcttcaaattacttatatttcatccaaataaataaaattattaattgttaatttttcataatgcattttgaagttttggggtgtccagatcacaatgaagaagagatcagaaattgatgtaaaagactttttaatcagtgtaaaaaagaaggcagaccatattttctttaaaaattaaacattatgccaaattaataaaattcaatgaaaaaaaaattccgttttgttcttcagattttgattttcaagatggacagtgaccgagtttaggcgggaaattttgccattttatcaaggacagatcaggctattaaaataaaataaaccattttttttcaagccaaatttgagatttttcaatttgtcaaaaaacgacacataattgtgcaccgaccaattaacattttaaaatgtatttatttgacaggataatgaatttacggccaaaagcagtcaattttgacgatgtgtggtcaaagctacgtgaaactctcgaggcgatcatttctctcaagccaattgagcgtattacctgggaccataattttaggtggatcatttagttttttttcttctattttcacgccttttagcgatatatactttgtttgtgtgagcgttcccgaggcccaatctcgacgactttatacggcggtcaaaaactcgttagaactacacactatttcaatccgagaggttttgccctctgatttgtcatttcatctttaccacattagtctttgctccgtttgtccggtgaccaattgctcagtgcgtacaacagcgaatgggaaaaatttcacaaaggcgccatttatttgcataatctttacgggtaagaaagcgaaaatcatctaaaaaatatataaatttccccttaagttatctgaacaaacaattggtcaaggaaaaaatg

SEQ ID NO: 108200 - DNA, 156 bp, Heterodera glycines
  Promoter: Source sequence=SeqID_20139; Location=682..837; Strand=+; Gene=SeqID_84926
ttggcatttattatttttaagagcgcatcccatcacatgccattcaggtgcttattcatccattcattggcattttgtctcacttccccccaggggatggtctctctgcgctccttggatctgtccaacaatgccatcgactcggtcggcaaaatg

SEQ ID NO: 108201 - DNA, 401 bp, Heterodera glycines
  misc_feature (15)..(15): n is a, c, g, or t
  Promoter: Source sequence=SeqID_32301; Location=744..1144; Strand=-; Gene=SeqID_62606
tgaaaaatgtagtanccctatgaaattaattgtaaagaatatttatttcgatcagtttcgaggatttatctttgataagtgcatgaactttaccgacaaagtgccgaagcaccagcggcacttgtgttgtacgtgccgtgccgcccaccttcattcaaacatatttttgtaaattttttttgtgttttactgtatttagtattagcccaccaatcgttagctcaattttaaaggaaaaaacatttttaaaaaatctctgctgctgtcgatggggaggaaagagtgctgctgtgcaaatattgggcctaaatgatcgcggaggagaaaaaggggtctttgtcttcccattttccttggcagcctttgcgcaaaatttggccaaattctaccgccatgtgatg

SEQ ID NO: 108202 - DNA, 192 bp, Heterodera glycines
  Promoter: Source sequence=SeqID_37064; Location=550..741; Strand=+; Gene=SeqID_66239
atctgatccgcttttccgttacgcatatttcagtcccatccctttaaacagatcttcaaatggcgcgttttcatcgatggtcctccggaaacaccatagtgagtgggcggcggcggcagaggaaaagtgcaaatcaatcaaattaattgtttccccattaatccctcctctccccttttttagcgcgggatg

SEQ ID NO: 108203 - DNA, 198 bp, Heterodera glycines
  misc_feature (13)..(13): n is a, c, g, or t
  misc_feature (70)..(70): n is a, c, g, or t
  Promoter: Source sequence=SeqID_4442; Location=780..977; Strand=-; Gene=SeqID_54471
ttttgacccaaanttcaggtcataatccttattatttctgatccgcaattgattgggcacataaatgagncctagatggactggtattgtgtctcgttgggacgcggataggtgttaactttttcgaaaatttttttaaattaatttaattttttcgattatttttaaataaattattttttatttttttggtatatg

SEQ ID NO: 108204 - DNA, 1003 bp, Heterodera glycines
  Promoter: Source sequence=SeqID_785; Location=1396..2398; Strand=-; Gene=SeqID_61213
aaagaatcaacaaaagcatttcaaagagaaaatgatggcataaaatccgtttcctattggcgagatcgatcatttctcaaaaataattaattcatttccacgcaattagacgacattttcacaaataaatcattcattccgctgatccacttatttgtttttccaaaaaatgccgaaagttatttatgtccatattttgcgatttttggtccatattttatggccatatttcgcgattttatatccatatttttggcagccctagtgggtcggggtcacttcgccgcggccaactcgccgcggccatctcgccgcgagaaactcgccgcgtggccaactcgccgcggcgctatctcgccgccgcccaactcgccgcggccaactcgccgcgccttgttttttggctatctcgccgccagatttttttcattgaaaggttacctcattattttgatataaaattaaaaaatgcattaatttatttcataagaatcattaaaataacaaacactggtccataacacaatttgattcttttcgactttattcgaattcaggctggtgttataaataggttgaaatggagtgctcagtagagaccggaaatttcaaatttgcggatcccgctgcgggattggaactcaaaattctttgcgggacgggatcccgcgggattaatcccgcatttaaaaaaaatgtgggattgcggactgggatcccgaaaaatcccgcgcgggatcccgtcccgcgccggtctctagtgctcagcgcctcaaaatacccaaagaaacttgttaaagaattcccagaaaaaaaaaattcgggaccaatgaccgacatgattgctctttaaaactttgctgaaatataacacattgaatacaattaactgttaaagaatttttgcttttaatgcatttttttaacgaaaaatctggcggcgatttgggtatataatgaggtcaaaaagactttttcattcataatacatatcgcaaaaatg

SEQ ID NO: 108205 - DNA, 307 bp, Heterodera glycines
  Promoter: Source sequence=SeqID_28394; Location=1..307; Strand=+; Gene=SeqID_59019
acctcctcagaaaaggggggataattagagactggccgtttagtgtagagggattatttttcaaaacacctcgtagactgtgggataattggagactgcgggattaatagagactgggctataattagagcatatacggtaatttgtaaaaaacgtaaaactattttatccttcttttgtaaaaaaacctaaattttgcatttaacttttataaatgtttatattaattttgattatatgaaattaaaaaattaattaattaaattatttataaaatcaggccgaatttctgacacatttgccaatg

SEQ ID NO: 108206 - DNA, 159 bp, Heterodera glycines
  misc_feature (79)..(79): n is a, c, g, or t
  misc_feature (108)..(108): n is a, c, g, or t
  misc_feature (149)..(149): n is a, c, g, or t
  Promoter: Source sequence=SeqID_3205; Location=1..159; Strand=+; Gene= SeqID_83691
aaaatgtgaaaattgcgaaagccatataaggtcctagccagtgttaatggtaatcagtattataatattgtggtgtttntaatttttaagcaagatgatcaattattntacaaaaatccagtgaaaaataattttaactaatttaaatntaacagcatg

SEQ ID NO: 108207 - DNA, 81 bp, Heterodera glycines
  Promoter: Source sequence=SeqID_34092; Location=1..81; Strand=+; Gene= SeqID_63971
ttattatttttaagtttacaataactctaatcccaaatattatcaatcaaaaaattttagtgtgctgttctcgcggccatg

SEQ ID NO: 108208 - DNA, 54 bp, Heterodera glycines
  Promoter: Source sequence=SeqID_17685; Location=590..643; Strand=+; Gene=SeqID_82213
aacaacgccggaggcaccacaggtgggagagggggcggggtgctttttaaaatg

SEQ ID NO: 108209 - DNA, 66 bp, Heterodera glycines
  Promoter: Source sequence=SeqID_21082; Location=631..696; Strand=+; Gene=SeqID_51671
ttgacccgcttgacacgttgtttttaaatttttatttcttgaaaatccatttgtagcagtaaaatg

SEQ ID NO: 108210 - DNA, 594 bp, Heterodera glycines
  Promoter: Source sequence=SeqID_4488; Location=563..1156; Strand=-; Gene=SeqID_54638
ataaagatagacaacggaaggaaaggcgagagaacgcaaagagtgttgccccaggagagaaaaagcgagaacagagaagcaaagacaaggagtgtgcacgttagaagaagaggaaagtgagacagtttagcagacacttcacaaaaccccttgggggaccacgaaaagcgaccgaatcattgtgaaacgacgaacgcaacgcaacgcaaggcatagagacaataaaaaggagagagagagagagtgaagagagagaaaaagagagcaaaggagagagagagaaggagagagagagagtgaagagagagagtgaagagagcataggagagagagagaaggagagagagagagaggagagagtgagagcgaaaaaaaaaggcagacaaagcagaagagataaagcaaacgcaaatgagagaaaagaaaaacggccattccttctgctgctattgttagtgccgggacgaagcgagccaaaccaagttcaaagtgccaatgcgacgacggcggtttttgttcaatgctaatcagctattgctcactaattaccccaaataacaaaactatgcttctcccaacaatggcccccaaatg

SEQ ID NO: 108211 - DNA, 932 bp, Heterodera glycines
  Promoter: Source sequence=SeqID_3781; Location=2750..3681; Strand=+; Gene=SeqID_51854
ttttgctaaaaaaaagagaagctaatatgaatataatatattaaaataaagttgatggagagaaaaaatcaattaatgtaagaatatttctgttgagaaaggacgaattgatttcgaaattttataaaaagaaaaaaaaaattttttttagattacaaaaaagcatttaaattttatatccatttagtaattagagttttgagtaaatatttgaagtaaattaaggatttaggcccggagacggtgaaagatgccaccagggaaaaatttaccaaaacataagcgctaatagtctataaaatttcatagattttatacttcaaaatttttgcaaaaatatgcgtgttttcaagtttgaaaaaattcggtttttttaagtttttaaaatttgcatgctgtatcatttatggggtccactgcgtttcggcgcgctcgtttcggcgccagcatgtttttccactatagcttttttctttgtcatccaaatccaacattgttgatatcattcgaaagctaacatgtttagaagctttttctaagctattgattcgccgttagacaattaccaaaaaagttatacatgaaaattgcaaaaagtcgaaatttttgaagtttttttattaataagagttttctaagtttgaaaatcttttcgcttttggttaaggctaataaagcatttcgaatgataccaagattgttagatttggatgccaaagaaaaaagctatatctgacaatacaaaataataagaaaatcagcttttacaatcttgtaaaatttgaaatcgaaattttcggtctatttttaatgcctctttgaggatatatgcatatttattgcgtatttttctaccctttctgcttattcagttccaattttagttttaatataaaaaaggcatggatttgatattttcagacattcgtatg

SEQ ID NO: 108212 - DNA, 131 bp, Heterodera glycines
  Promoter: Source sequence=SeqID_10482; Location=186..316; Strand=+; Gene=SeqID_73694
tcgttcataaaactgcatttggtcggcattcatcagtgccaatgatgccaaataatggtactaccactttgccccacattttaatttttttttgattttggcatattgtccttttaggcattgtgccaatg

SEQ ID NO: 108213 - DNA, 600 bp, Heterodera glycines
  Promoter: Source sequence=SeqID_4933; Location=1..600; Strand=+; Gene= SeqID_56274
aagttcttcgtaaagagcgaaataggcacaaaatgccataaaaatgacctaaaacagaaatgtttttcctactatttagaacattggagaatcgaggaaaatacaatatgtattacataaaatttgcgcctctactaattataaatttttcgtcatttaatttaattttcttttgctccacaacaatgaaaatttaaaatacaatatattaatttttttcttcaaactgtctaattcaatacatcactttggatttttttttgcctaatgttagccatttttttgtgatgacaactgattgatgaatcacccaccaacgatactgctcagaataattaattgcaattacttttgattaataaaagatcacattaaatttcccaaaaaataaaatatgaaatttttgtaatataaattaattaataaaaataatattttaaaaggtcattgaatgcaaatgtaaagttgtgacacatttgtcaccttcccccgctccccaaatatcaaatgcattttcacaaactttttgattctattaattattaaaataaaatgctttttactggtacaaaaatattttttagagtatcaatgaaaatg

SEQ ID NO: 108214 - DNA, 653 bp, Heterodera glycines
  Promoter: Source sequence=SeqID_7624; Location=5646..6298; Strand=-; Gene=SeqID_65442
aggaaaagccaaaagaacggagtcattcggcgatggacgggtgaggacggaatgaatggacaaataaggggtttaccattttgtagttgtgacacgaatcggacagtctcaacgcttgtcctaccgcctgtttcgcccacccgcaccgttattttgtccggcagcagtttcgacaccgtccgattgaatttctccaagtaagaaacagtcgtctcaataatttatttggctgcttttgaagttgaacatcatatatctccatgaacattcaattcgatttccttagaactgaaagtgattcgattggtcctcacaatcagcaacattcgtccgtttgcgctgcccctcccttttccccctcgccggatgctcttcccctctttcctccgccttcttcctcccgccttttgcctccctcttccaccgcttctgtctcttcgcccgtttcttcacggattcctgtcaatgtttcgtcgctcactgcgcgttcagcgcgtcaccgccaattcagtacccttcaaaaaagtgacatcgaagccattcagcaacaacagaagaagcaatcgctgcgaccggtgctgtcatcgtcaaagtcaacggcggggcacaggcacaaaattatgcaaaacagcgaacggaaagtcggcgcaatg

SEQ ID NO: 108215 - DNA, 1003 bp, Heterodera glycines
  misc_feature (933)..(933): n is a, c, g, or t
  Promoter: Source sequence=SeqID_13520; Location=1411..2413; Strand=+; Gene=SeqID_77419
ccgcgccgcgcagcgccgcgggaaggtcatcaatcatccacctgtcaccaaagtgacaggtggaggaaattcaatttaacttttgcaaattttaatcttttgtttcaaaaccttttagcgttttattttctcaatcctgaaattttttttatgatgattttttgatcctgaaattaaaaattctttttgaaaattagccaaaatcgtgaggtttttttcatttccactcactccctgccgatgcgccgcgatgccgagtcgcgcgcaaaaaaaaaaatcgataacggaatttggaagaagtgcaaattaattgatattggcagcaaataattttgattatgaattggacaataaaattactatttaaatccaatttaaaagtaaaatcaaagaatgaataaataaattaaaaaactttttcaaaagtaggtcacctgtcaactaaaaattgattgatgggttttttatttttcttcccttatttctcaatctgcacgtgactttttgttcaaattatttcgcaatatctcccctaaattaggtcaactgtcaataaaatgtgattgattggtttcttatttaaatgtctccattatttttgggtccaactatttcgcaatatggcccgtaattttgcaaacctgtcaaaaaaaaatgattgatgactttcgaaataaggaatatccaaacgatttttgcacggtttttgaataaaatgagacagctgtctaccgaaatgattgatgaccccctaaattaaggcaaccccagacagtcatgtgactagacccctcccctctcgcccaatccgtacacccgggccaaatcgcaaatcattcaactaaatagttggatttcattaaactctcttcacgctctaattttatttctctccgctctatttttatttgcattaattaaatcttctattanattcccgtctttttcttttcaaatctctgctctctttaattcttctgtttcaatttcttgttttaaaatg

SEQ ID NO: 108216 - DNA, 1003 bp, Heterodera glycines
  misc_feature (654)..(655): n is a, c, g, or t
  misc_feature (683)..(683): n is a, c, g, or t
  Promoter: Source sequence=SeqID_1494; Location=188..1190; Strand=+; Gene=SeqID_73934
atcatcaattgttggcattattttttgccccggatgaaaatgtttcacaatgtgcaaatttattatttaaaatatttttaaaatacatacattaaaaatgacgttcatcaattattctcactcttttttgtccaattgtctttcttatttttatccatttcattaatccattcgctttcctttgaatatcccattttaatgtattattttttcttctccaattattattatattaattattgtttacggtttaaaataataaaaattgttcctttttatttaaatttgcgatataattattttttatttaattttttataatttactttttaatttatcccatcccttcgctgtcaaagaaaagatctgaagactgaatcgactgactgatttgatcagtcatagccacccgaattggttgaatcaatttcagcattttgaatcgaagaaataaatcaaaaattgttttcaacttgcgcatcccccgggggaatatctttccggatcccgagcactgctaagatcatcgagataagccttttcttccaacccgctgcccatctgtcacattttgtccttaagcagaccaaaaaaaaaattaagcacaaaactttatttattttgattttgttagttttttaaaattatttttannactaattttttaaagcttaaatcttctntttaattatttgccttttaattaatttcttttttaattaattggcaattaattaatcggaaagattgaaacaaatatgaaaattgaattttaaacaaattctttatttacctataactaaattaattagaattccaattgaatttcgaatttttccccccaaattttatttaattagcataaagcaattagcaaaatcaatcagaaaaattgaagaaaatatgagaattgaattaaaagaatttttttttaattttactaaaaaattaatgaatttaattcccattaaatttttaaatttaccgcacaattttaaaaatg

SEQ ID NO: 108217 - DNA, 126 bp, Heterodera glycines
  Promoter: Source sequence=SeqID_28537; Location=912..1037; Strand=-; Gene=SeqID_59142
ctttgttttccttcgcgcatttacatcatttgtttgattggtttttgcatatttgagaagcacaataattatggccttatttccccttgaggcgaaggaaaaaaaacacatttctttcacaaaatg

SEQ ID NO: 108218 - DNA, 130 bp, Heterodera glycines
  Promoter: Source sequence=SeqID_22749; Location=1..130; Strand=+; Gene=SeqID_53439
tttggttataactctttgtaaatttttttctagattttaaaaaattaaataagataggatttgataggatatgtaatgcatcgcgtaataccaatttttattaatttaactaaatttaagctaagttatg

SEQ ID NO: 108219 - DNA, 292 bp, Heterodera glycines
  Promoter: Source sequence=SeqID_34235; Location=1..292; Strand=+; Gene=SeqID_64076
ttttttttaatcttttgaaaaaattgttatggaaatattaattctctcgtgttggggaacgggagaagttcgttttccccgcccaaatttttttttcattttcgaatttataacggaaccactcgaactgtaactcgaaaaacgtatataaatttggtattttggttccattgttcgaaattttacaagaaaataaaacgaaaaaatttttctcgctttttttcaaaattttatgatgaatcactaaatttttatcaaaaaattgccgtagtgcacccggggaaaacaaatg

SEQ ID NO: 108220 - DNA, 971 bp, Heterodera glycines
  Promoter: Source sequence=SeqID_697; Location=2143..3113; Strand=-; Gene=SeqID_59216
ttggcacacttttctccacttttgatcaaaaataatgatacaatctgtttttttctgttaatggaatttgtatttaactcgcattgtttttttccttcattatgacgaataatagatataatttttgtacatctttaggtattcttgaaatttaaggtactcaacaaattaaaatttagtaggggaaaaggccactgaaattgtggtgaaatcagctaattttaaataaagtatttttcgttaaaatctcctaaaaaaacaaaaaggtttgtgcatatatcttcttgatctaaaggagggtcattcttcagtaaaattcagatttattgcataaaaattagagtgccacgggaccgggaattttgggcaaacccgggaccgggaccttttcggtttgaaaaaccgggaatttttagctgggaaaaccgggaaaaaacctggactagtcccggtcaaaaccgggaccttggtactcagttgtccgcttccaggtcccgtggcactctaataaaaatacaaaagacaatttacgcggaaatttaaaattggaatttttattatttttcaatttgaatatttagtgtacggtagattttgtgcgagatgatagtcatccactactatgcttcatttcattcctctctctgtctcattccgacatttttcacttccactaccaattcagtaaatcccaaacatttttcaatttctcttgtgagatttaatatttgggagttacttagttttttatataaaaatgtatgaaaatacagtcgtttaagctgggtcaaaagcaccaaattttatgcaaatttagggttactattatttatgccaactaactcatccaaagacaatctcatccaccttaagctcgtttatagaaccatttgatatgcatcaacaaacaatttgaatttaaaaagttccaattttcagcccttgattgttgtaccaaataacttttcatg

SEQ ID NO: 108221 - DNA, 91 bp, Heterodera glycines; identical to SEQ ID NO: 102829
  Promoter: Source sequence=SeqID_18416; Location=1015..1105; Strand=-; Gene=SeqID_83012

SEQ ID NO: 108222 - DNA, 139 bp, Heterodera glycines
  Promoter: Source sequence=SeqID_37379; Location=595..733; Strand=-; Gene=SeqID_66470
ggacgtccttggcatccaaggacgaatgacactcctggcataaacactacaatttctatttcccttacattttttcataaaactcatgaagaattttattcaattttagcgccatcattaaattcggagtttcaaaatg

SEQ ID NO: 108223 - DNA, 326 bp, Heterodera glycines
  Promoter: Source sequence=SeqID_5246; Location=5201..5526; Strand=-; Gene=SeqID_46007
tttcgtcggggcaaattgttaagacaatttccggcactttttcaattttgcgatggcttcgttgttttggtggttttttgaggcggtcccaatacttcaaaagaatggcacaacaaatcataaacattggcacagcgacgtttttgtcgttcgtattcgacgccttcttaaaaccaaattttcaacttttttggctcgaactttttttaaacttaacaatttttttttagaattttgcaggctaatagagcatctgaagggctcttgaatgataccaacaacattggatttggttggcaaagaaaaaagttatagccaaaaacatg

SEQ ID NO: 108224 - DNA, 706 bp, Heterodera glycines
  Promoter: Source sequence=SeqID_13831; Location=411..1116; Strand=-; Gene=SeqID_77770
tgtctaaaatatggaattttttcaaaaagaaaccggaatgaaatttttaacactactttggcttgtgaaatttaaacaaaactgtattcaactatttttgcttgtaaacaaaaaagttataaaaaataaattaattaatttgaaatttgtggcaaataaagccaaagtaccattatttctaaatatactcgggacaaaacggaattttgccttttctcaccgtatctcttttcttacatttacaaattttcgagactttaacactcgtttggtaccaaaaattatgttttggcaattaagaaaagagttaggcaaggaactaagtggtcattatgtttagaggattttgcttttcttgggtgccacccccccccccttgaacaattctaattagcccaaaaatgggtcgatgtgtggcaaagaatatcagagttcctttagtcttttgtgttttgatgaaacaagtttaaccggacggcaccgtgttttgtgaattgaataattaaatttatttgtttaattttatcgattactgtgagtttttcgtgcaacgcccacactgagcttttttgtggaacgacctagcaccttgcaaaactacgatgacaaacttgaatcagattttttgtaacttttggatagagaatctttaggactattaagtgatacgaagaatgctctgaagttttgaactcacttttcaatg

SEQ ID NO: 108225 - DNA, 501 bp, Heterodera glycines
  Promoter: Source sequence=SeqID_1929; Location=1..501; Strand=+; Gene= SeqID_76841
ttaacctagtagcggtcagtcattaagcgctcaaattatcacaagcgtgcgctcaaatggcccctgcgggcgctcatgtggtacgcgcgagtgctcaaatgacccggcgtcgcttccctcccgacagctgacgccctttcccttctccattaggctttggttttgcgaattatttatttttatttttaatttaatttattttttattaattaataaaaacccttcaataggtttaggttcacccccgcacccatctaataggctttggttcactcccacacccattcaataggttttggttaaccaataggctttggtttggaacggtggttttccaagggccaaaaagggggtagtaactactaattttattgtctttttcaactgcataaaataaagaattttttcttaaaatcaatttttttaccatcactattttgtttaaattctaaatttataatattcattaaattaaattaatttttatattatagaaaaatg

SEQ ID NO: 108226 - DNA, 62 bp, Heterodera glycines
  Promoter: Source sequence=SeqID_28709; Location=1..62; Strand=+; Gene= SeqID_59285
tttgatacacaaattttttttattaaaaattttttttttaatttcaacaaaacacaatcatg

SEQ ID NO: 108227 - DNA, 74 bp, Heterodera glycines
  Promoter: Source sequence=SeqID_1295; Location=863..936; Strand=-; Gene=SeqID_71822
aaattttaatgcatttcataatagagaccccaaaaatccattcctaggtgagcgtggttgcgcgacgaggaatg

SEQ ID NO: 108228 - DNA, 245 bp, Heterodera glycines
  Promoter: Source sequence=SeqID_6957; Location=753..997; Strand=-; Gene=SeqID_63398
gctagttgcccaaagtttttgataaatcttgaatttgaagcaataagcagatttaggtatatgaaaaaagctacacagaaaaagagaaaaataaaagctgtttttttaaataaatagtacgccaaatgcgttttaaattaatatttcactttttcctttttttgtttaaaaattttaacgaataataattttacattcaaattcgttgaagtttcattctcgttgttgtacgtaatcttgtaatg

SEQ ID NO: 108229 - DNA, 197 bp, Heterodera glycines
  Promoter: Source sequence=SeqID_8767; Location=1714..1910; Strand=+; Gene=SeqID_69157
tttcgatagaattttttgaaaattttgcaaatgaatcctgattttgggtaggtgaaggttgggaagcgaaaaatgggcggagcttcgaactgtcgaaaagtgggcggagcctagtcgaatgaaaacatataaaatcggcacgcttttgaacttccacacgatttcgcaaatcattcttaattttaccaacaaaaatg

SEQ ID NO: 108230 - DNA, 318 bp, Heterodera glycines
  Promoter: Source sequence=SeqID_478; Location=1..318; Strand=+; Gene =SeqID_45761
aaaaaaaacacttacgattcccgccccctcctatgcagcgccgacgagaaagtgagaagtcattgtgtccgttgttgggcgcactgaagtcgttcgttcgttgattgggtgttgtgtcagcagcaaatgtgcaaatggacaaaaattctccccttttatatgcattttctgttgcactttttttcagtgggaaatttgaatataaaaaggcgtgaaattgagagaaatttcattctcgtcacattcttaattctattctctgcactattacatctaattgctgctgctcatcgactccatcgacaacgacacgcgatg

SEQ ID NO: 108231 - DNA, 1003 bp, Heterodera glycines
  Promoter: Source sequence=SeqID_3228; Location=1456..2458; Strand=+; Gene=SeqID_83784
cccgaaaactctaaataaaataggaatttaggcattataaaagtcatcgtagacaccgcaaatcaagcggaaaatgcgtttttcgtgcttatctgtgcgtatcaagtgcgctgaaattttaggcatttgccaaaaaacgaatccctagtgatattaaatgaaaaatttgtgagcgaaattaagaaaattttgaaaaccaccaaaatataaatatattgtaattggattattggaagtatcaattcaaggttaaaagttcaaatctttgtattactttatcgcgtttcgtttttcaatacattctgattcattgaagcattttcaaccgacacgacacattcaattaaatgatgaaaataataaagaattaacaaaatttatttttcaacatttttttgttaaaaatttaaaaataaaattattttctgcatttattattgatagaataattgctggaaatgatgttactttgcaccgttatgatgccaagaacgcgaccattattttgatgttgttagctccagtaaattggacaccaatagaaaattggaccctaatcgatataaaataaaaataaaattttggcatagactaaaagataagcattatcttaaatgtctgttttttcattttttaaaagacgaatttggtatacaaaattcctgtggtttccattgtcaaattttctggtgtctatttattttaactttttatagaatttaattagagtgtcaataaatttttccttaaccagattatatttcttttaatttgtataaattatttttttttaaatttattttacaacatttacgaatgaaaagggaaatttaaattattttattttatttttaatcaattattaatcattaaaaatacgttgcaattggtatggcatttctcgtaataaaagattttttcatatattccatttataatataagacataaaagctgaaaatcaaaactaatttgtttaatgaatttttttgattcaaaaaatg

SEQ ID NO: 108232 - DNA, 193 bp, Heterodera glycines
  Promoter: Source sequence=SeqID_5266; Location=1..193; Strand=+; Gene= SeqID_57513
tttataggaaatagaagcttgtgtaatattttacgagattcttgaatatcaataaatatttcaagaaaactgaaaattttgcaatttttatttatttcatgacaaggacacaaattttttatgttttttggattttaaaatacataaaaatttaaaataattttatatatttttaaataaaaaaaaaattatg

SEQ ID NO: 108233 - DNA, 72 bp, Heterodera glycines
  Promoter: Source sequence=SeqID_19727; Location=1072..1143; Strand=-; Gene=SeqID_84470
tcttggaattaaaagaaatttgcaaaaaataaattatgtaaatcattttgcaggcaaaaccccaaaaaaatg

SEQ ID NO: 108234 - DNA, 279 bp, Heterodera glycines
  Promoter: Source sequence=SeqID_13265; Location=1748..2026; Strand=-; Gene=SeqID_77100
ttgattattgttccttgctaaaagtagaagaacaatttaattatatgattaagtcgaagtggggataaaatggggtcaaattgggtgtcaacatctctatataaataaagaggaagatgcattaacgtatgcataaaaatgtttattgcgccattcactctaattttgtcgggggccactggtagtggcaaaacgcaatggttgatgaaattgttgagaaattacagggaactaatagacccgccgcctgcaaaaattctgtactgctactcggagatg

SEQ ID NO: 108235 - DNA, 1003 bp, Heterodera glycines
  Promoter: Source sequence=SeqID_1839; Location=725..1727; Strand=+; Gene=SeqID_76282
gagttcaaaaagtcattcttcaattttttgagtcactttacttccattcttttttagccttccaaattcagaaccaaacgacaaatatatcatctaagagttcattattatatttattttgatcagtagggctggcaaaaatatgcacatgcatatttttttcctggactgtgggaggcctgaaacgcacgaaaaccatgtttttagcttgttttgaagcttctaggatgactttccatatgcatattttgcatatttgtgcatatttcgcgatttatgtgcatatttgtgcatatttgtgcatattttggcatttcgtgcatattttatgtgcatattttggcgtttttccaaaaaacctctaatagatcggcccccaacagacaaattggcctttttgacctcaaaaaccggaaaattttccaaaaaaataattttttagcaaaattttcacgaaaaatattgaataaataaattttctcaaaaaatggttaatttatgtcaaaaataagcaaaattttgcttttcaggttgatttttcgctaaaatgagtaaattttaagctgtatcgtgtttttttctcctaaaatgatttttaataccacatttagccatttttgaagattttactttatgtttaacaaatttgaagaaattttgagaaattacaccctcaattggaaaattttatgtgcatatttttcactttttatgtgcatatttttgccaaccctaatgatcagcgaactctaaaaccccggataacaaataatcatgtttttttatcataaaaagggtccccccttttgtttttgataaaattcaaaatcggccactttccgtatagcgccgatatttttttctctgcactctctatttattgacacatctcgttttttgaaacggtgtgtaatgttgtgcaaccctttccacaatgctaatgtataaaataaccgggtacttttctagtttacggggtacttttcacatacattttcagatg

SEQ ID NO: 108236 - DNA, 57 bp, Heterodera glycines
  Promoter: Source sequence=SeqID_12620; Location=1..57; Strand=+; Gene= SeqID_76289
gaatttataatttcggaccagtcctttgcaataccaccccccgagtactttgaaatg

SEQ ID NO: 108237 - DNA, 1003 bp, Heterodera glycines
  Promoter: Source sequence=SeqID_10211; Location=1194..2196; Strand=+; Gene=SeqID_73336
attaatacatggttgaaggtcttacctaatatttcaggatatttttgtaagacaattgtcaaacaaataaacaaaattggaattccttaattgtgttttctgtttaaatttaaatggctttttttggaatttcaaagcttgcgtaatttaacatgcaaaagtcaaaactacgaaatgcataaacatttgttcttcttaagctacatatattgccctcaaaaaacacttttcttttattttttaaatgaataaacatttttattttttcgcttttttatgtatgtacaatttagcgtttacattgcaaatgcccggttaaatgagtacacctaattaggtaaaaatgaaaagaaaatcatattatgtatgtataaaagtataatttttaattctatatacatgaatgaaatgaaattctggaggaatacttaactttttttttttaattttgatattattttacgctatttattgttttaaattctatataaaataaatttgcgattattagtcaatcgcatgcgacaaaaagttgtcgcaaaagccaactcagaaaaaaggttttagacgaatcaaatacatttaagatttaaacctatgaattcagtaaataaaattggtctgaacttcaaaaaaaaaaaaactggtttttggtttctaatttttgatggcattgaaaattgcattgaattcgttagatttacacgaaaacttaatccaaaagtattgataaaaaaggactatcatttgaatagtttactaatgcgtatgattggctcttattccgttcagatcccacatttttttacatttttttcattttcaaataaaaaacactaaattaagagattttcggggtagctgatcacgaaacctacaacccatttctatccccggaccaggactcgaacaaaaaatcgattttggataaatgtgaattttggtgaaaatgaatgttggctttttgttagcattgggtccgggttagaaattgttcaaaatg

SEQ ID NO: 108238 - DNA, 176 bp, Heterodera glycines
  Promoter: Source sequence=SeqID_5455; Location=2398..2573; Strand=+; Gene=SeqID_46045
cgtttggggttggcattggaacggaacccatttttaaattagtttttaaccattttttaacttttctatgctttccctccccctcccccctttagccgactgtcccctcaccctcaacccgtgcgctgacgaggagccgttgttggatcccgaggggcgaccgcagcggtgcaatg

SEQ ID NO: 108239 - DNA, 354 bp, Heterodera glycines
  Promoter: Source sequence=SeqID_5807; Location=2805..3158; Strand=+; Gene=SeqID_59289
agttggaatagcaattgccaaatcgtctgagaataaagctaattcccagtggaatagctgcacacccaggaggtggcattctcaattactggtgttaatccgagttggataacagccagacgtcaatcgccgaatttggagaatttctacattcaattgttaatccgagacggataacaattgcgaatcactgttaattcgagttgaataacagtgaccgtccatcatcaatttcattgttaatccggttcggataacaattgacaatcactgttaatcccagttggataacagttgaccatccatcatctttaatttgatcctagtttggacaaattataaaacgcaacaatg

SEQ ID NO: 108240 - DNA, 135 bp, Heterodera glycines
  Promoter: Source sequence=SeqID_15416; Location=530..664; Strand=-; Gene=SeqID_79683
ccttaagattaattcaaattatttgattaaataattttgttctctttacttttgcggggtcgaatttgaattgtggcccaaaatttgtctcaataaaatcgccagaatcattcaaagaaatgaacggaaacaatg

SEQ ID NO: 108241 - DNA, 349 bp, Heterodera glycines
  misc_feature (90)..(90): n is a, c, g, or t
  misc_feature (130)..(130): n is a, c, g, or t
  misc_feature (140)..(140): n is a, c, g, or t
  Promoter: Source sequence=SeqID_35374; Location=670..1018; Strand=-; Gene=SeqID_64939
cccttaaaataaactagaaaaaaaaagtatttttgctgaaatttcgttttttacttggtgatatcccctcccaagacttacctcttccanaatttcaaaaaaaaatttcactaatttttgaaaaatccantaaaaatacnaatttttaatgaaagtctgctaaaaatggccgaaatgaagacccaaatttattcgagactcctgagaccgagagttgacccccgaagccattgctaatttctatagaaaaataaataatgattaaataatttcataggaattgttcaatgccataaaacgcatgttggacattgaaaatgaacgggcaaagaaaatgcagcaaaaaatg

SEQ ID NO: 108242 - DNA, 948 bp, Heterodera glycines
  Promoter: Source sequence=SeqID_9249; Location=2445..3392; Strand=-; Gene=SeqID_70747
tttcttgaatccgtttgaatgtccgccccaaagacgatccatcgtattgcagtatatgcggcaaaaatgtaaacaattacctttagattacctggggattttacgtttcaatgccaaaaattatcacattttcttcggaggacatttcttgaaacaattcccagcgcaccgtgtgattggaaaagagatcagctattgtgggcgaaaagttgaattaatagcttaacaatagagtgcggcgggatcaggactaccgtgggattttacgggagtacaactccctgctcccgctattgtaggaagagcagacaaacgaacacaaagaacaattaatgctctatttttgtgcgcgactcatcacaaaattaatcgtagaattagagactccataccaaagttacagtcaaaaagatacagtaagaacatccacagtatacagtagtgtatctgtgcagatgattaaagagaagcagcattaacattttagtccttttattagtttgggaatgttttttcattaaacgtgcaaaaaaaaagatatattcaggtcaggtttttaaaataaaaaaacactcgcggtctctgttcgaacaccccttttccaaaatccaaaagttttggttttaaatattgccatttttgtcctttttttcttggacctccgatggcattctggtaaatgacacacaatttagtgaattttgaatattaattgtcatttaattaaggtcatcgacatagcttcaacgagaaaatggatgctcagttggtttagcacagtgttggctcaaatgtcgcaagaattttatgcgatcgttggagcgtcaagaattgatcaagaagagatggtaaaatacgtatactgtataacagtgaccagaaaaataaaaattatttaatcattgcaaaataaaaattcattttattttacatcaggaaaagcgaatg

SEQ ID NO: 108243 - DNA, 462 bp, Heterodera glycines
  Promoter: Source sequence=SeqID_41072; Location=595..1056; Strand=-; Gene=SeqID_69279
tggaaacccacaggtgttcaaagcattcaaatattcaacaagtttctattattttcgtgaacagcaacatttttcggcgctaaaatttcatttttggccattttacaccaattttctgatataatgaaatttcataaaatctctttatttttctaaaatctctttacattgtgaatttattttatttttattgaaaatatgtttattattttcgaatgagctccagtaaaactaataaattttatttaatcattaatttaccaattggcaattattttgtcattaagataaaattattattattatttctttgaaattaaacaggatttccttattttattaagtaaaataatgatttattcagttttttaatcagaaaaaaatcatttaaatgcctcaaaaaatgaattgccatttaattgaagaaaaataaaataaaatcatttcgagacgacaaaaatg

SEQ ID NO: 108244 - DNA, 280 bp, Heterodera glycines
  Promoter: Source sequence=SeqID_10056; Location=964..1243; Strand=-; Gene=SeqID_73121
atagcgtagaaacagcttataaaaatgtctagctttcgaatgatcccacgtttacttgctttggatgacaaagaaaaaagttatagaaagttatagtggaaaaatatgctggggcccaaccgtgccggcccaactgaggtagaccgctaaatttctagatatgtttggtttcaaagacaagagctagaggaaaaaccctcacataaacttggatgtgtttagagctttaaaatactattacataataataattattattatattttaaaaattcacaatg

SEQ ID NO: 108245 - DNA, 256 bp, Heterodera glycines
  Promoter: Source sequence=SeqID_19937; Location=1..256; Strand=+; Gene=SeqID_84698
caggacggtcgcttcgcgcttaaaagtcgaatgccttttagtttaaattttttttataataaaatactcgttttattaattaaaaacaacgtcgaaaattaataattgaatatttgtttaatttgaaatgaaattaatttttttgcaaattcaaaaaataaataatgaaaatttttaattaaaaaaaattaatttaaataatttacaacaaaactattttaatttattaaatgcagtgaaaattacccaaaaaatg

SEQ ID NO: 108246 - DNA, 90 bp, Heterodera glycines
  Promoter: Source sequence=SeqID_27989; Location=473..562; Strand=+; Gene=SeqID_58646
ggttagcgtaaacgaccggtacacaatgtgccttacaattaattatcactgcatctttaggtgattttgcctgtgccggctttcaacatg

SEQ ID NO: 108247 - DNA, 1003 bp, Heterodera glycines
  Promoter: Source sequence=SeqID_5437; Location=1398..2400; Strand=+; Gene=SeqID_58033
gcccatcaccccagcagatgttttcatttccctgccaatgggtgccattaaaacattttaaattcaattttattagccaatatttttccccctttcacaatgtgagttatccattcggcattctccccgttttattggcatcagttaaaccaaattgagtataatgccaagattttgccccaatggctcattggcattttgccgtcccccctccttcctttttttgattgtcttttggccgtttccatagtcacccgctccctcccccccccccggtgccaataatactaataaaacgatgaatttctgtctttgcttttggcctatcgataggccaaagaaagaccaggccatacaagtaaataaaatattaacatttattaggttcacaatttacaaaaggtattttgaaattaattcaattaactaaaccataaaaataacatttttatttctatatttaacattaatttacacccaaattaaaatgcttaattcggaagccaaaattaatggtcattttgaaattggaatcattccaaaaacggacataaaaattgaaatctcatttgacggagacaaatttgtcaccattcgatcataagacgaacgcattaatgatcaaataggaaatttacagcaataatgcgtttattttagtaatttgcttagaggaatttattttttgcttattgacggcaaaaattcctatgcctctttttccctaaaaaataggtaattagtaagtaattaggtaaataattcaccaccggcggattttgaaaacttaagttaataattagaagagatttttaaccaaaaatgacttttcaaaaattgtgcggagaaagtgtgtttttggtgcaccaaatgacattcgtagaaaaacaaatacaaaaccttccatgataattacttaaaatagttcattagaattgtaatttccgctaaataattttccccaagtttccattagaaaaaaataattatacggtagaaaatg

SEQ ID NO: 108248 - DNA, 728 bp, Heterodera glycines
  Promoter: Source sequence=SeqID_10443; Location=3966..4693; Strand=-; Gene=SeqID_73642
ataagttattttctttaaatatgaaaattaaaaaagaaaaaagcttacaacaccttcgattcccaggacgtctccgttccaagtactaagaaggcccaacgttgcttcacttgccagatcggacgggatggcgtgttttcaacgtggtatggtcgtaagcgaaagcgctccatttgaaagcaattaaatagtcaatttttaatgcatttattctctttggttaacttatcattaaccaaaacaaggattgttaaagaatttagaattcacttaaataaggtaaaaataaaagaaaaattcgatagtttttttcgaaatgaaagagcaaaaattcggaattttgaattcttttttaactaatttcccaactgcaaatcggctgaaattaaaaatgatttatataaattttgaaatcatcgcaaattctctttaaaagcacatataaagcctttccctaggaacaatttaattgttttgattagaaaaacctcgaaaagcaaaatttcttaagaaaaattggttttagtggtgattttaagaaagtcatccacccatcatttttagtggttaaagtcatctttttggttaaagtcatcttttgaggctccaatattaaattttattgtattccgttaagaaatttaaaaattcatttcggcacaaatgccaaaaaaggcaaaatggggatacaaaagtcatactaatggttttaaaccaacctaaaaatg

SEQ ID NO: 108249 - DNA, 107 bp, Heterodera glycines
  Promoter: Source sequence=SeqID_39485; Location=1..107; Strand=+; Gene=SeqID_68051
tagttcttccgaaatgaataatttctccacggagtgctctttagcggtatttaacgaattaaacctaacaatttttttattattagagcgcaagaaatagtcaaatg

SEQ ID NO: 108250 - DNA, 989 bp, Heterodera glycines
  misc_feature (14)..(14): n is a, c, g, or t
  Promoter: Source sequence=SeqID_25966; Location=1..989; Strand=+; Gene=SeqID_56724
atattttaatatanagcggacaaccatttaaaccgatggctccaaaatcaaaattacgaaaaaattttcccaatcccctagggattttttcggaactcgaacagccacacaaatggacgaccgaattcagcgactttctgcttaaatgtctcgtcaaaaaagtggacgaacggtggggcgcttcacaattgctaatggtcagtctttggaatgggaaaaggaaagagccaggaaataaacagtttaatattttacctattgtaaacagtcataggaaggaaaatgttgtagcaccatcagatttttccgggtgcactacgttccccccccccccccggccacttatttgactctcgacactcatttctctttcgacttcaccactcatttctctctcgatttcatatgcttgatcagatttcataaacctgatgaaatgtaagcatctttgaattcaaaaccgatttaaaattattttccaaatttaggtgcgttaacattaaacatattttggtggtaatactatactattgtatatgaaaactgttttcggtcaagtacaaagattaccagttgatcagatttttattgctttaaattttcaaaaattttggttctcaaaaatagaagtgccaattaatatgtagcattgattgacttactttttcatgtcctttggcttgtatgttccctttttgaacagttccaacgccaacttaaaaaatcgataattgcgttgttttctattcattgtatttcttttattgagtctatttacattataataataccagctttttcttatcttgtttaatttttattttgcattttttgtttttacacccccccccccccaataaaaagaaagaaaccgaaaatttcagacatatattaattaacaaagcctgatgcgaggaaataacatgtaaatcagcgactccaacttttttttgttgcttttctcagcattacacaccatcccgaaaatg

SEQ ID NO: 108251 - DNA, 176 bp, Heterodera glycines
  Promoter: Source sequence=SeqID_25717; Location=639..814; Strand=+; Gene=SeqID_56461
ttttgttggaaattttttgatttttttttgcaaatgaatcgtgattttggacggatgaactttacgaactgaaaagtgggcggagcctaaccgattgaaaagtataaaattggcccgtttttgaaattccaccccatttggcgaatcattctaaatttttctcgacaaaaaaaatg

SEQ ID NO: 108252 - DNA, 136 bp, Heterodera glycines
  misc_feature (115)..(115): n is a, c, g, or t
  Promoter: Source sequence=SeqID_16136; Location=1..136; Strand=+; Gene=SeqID_80500
taccaatttcccaaatgtgccacctggcttgatcacaaaagtgccgtgccatcgaaattattaccattttttgccaggtgtgggcccgtaaccagggcggcctgcacgccccgcncggattcactgatcttcgatg

SEQ ID NO: 108253 - DNA, 770 bp, Heterodera glycines
  Promoter: Source sequence=SeqID_15923; Location=252..1021; Strand=-; Gene=SeqID_80269
tgtaccagcgtcacagccatgcgaaagacttcacttggattttgcttttacacatatactcatcgctaaataaaccgattgttgaattaatcggagctttcaattggggaatccgcgctttgggccaatgcccctggcattggcccagggcccaacggattcacgcgcgcacccattttatggtggaccttgtggggaattaaattaaacttcccaaagcggcgcttttctttttatctcccccttcattactaattaattaaatttaattaaaaattattcaatttcccattgcaattataccatttattctcccatcacatttctgatttaattttgcaattttttacttccccccccccaatttctattttttcgcattaaaaattacattttttttgtttgattttcctatatatttttcttttcattttaattagtaccaaaaaataaacttcttttattaatcactcccaccatttttttttgcctcctatttatcattactaaaatacttaaccaataaccaaaattgatagtaataattaatgaaaaactttgaataataaatatttgaataaatttgtttattaaattaacaaataaaatatcttaacaagtgatgtgttaaggccgtgccaacgattaacccgaaattacattgaggagacaatacgactggacaaaacactaacacggcgctgacattgatcacagaccccaaatgaggcaaatagcaagtctcggcggacacggaccacagccaaatg

SEQ ID NO: 108254 - DNA, 161 bp, Heterodera glycines
  Promoter: Source sequence=SeqID_3595; Location=1756..1916; Strand=+; Gene=SeqID_51012
ggtgattggcattataaaataattgagaattctcctgtttgaggaagaggaagatttgtcagaaattgtccaattggtcggcaaagcatcgcttgccgaggccgacaaaatcactttggaggtggccaaactgatcaaggacgatttccttcagcaaaatg

SEQ ID NO: 108255 - DNA, 80 bp, Heterodera glycines
  misc_feature (10)..(10): n is a, c, g, or t
  Promoter: Source sequence=SeqID_35689; Location=1..80; Strand=+; Gene= SeqID_65181
cctattctantgaccacattctgaaaaaaatcccagaaatacgaggaaagatatgcttggtcacaataaaataaaaaatg

SEQ ID NO: 108256 - DNA, 113 bp, Heterodera glycines
  Promoter: Source sequence=SeqID_16195; Location=799..911; Strand=+; Gene=SeqID_80561
actttaaaatatttaataaaattaactgggtagagggaaaacttgtcaactatcgtattttttggtttaataataaatttttttaagcaattttttacagctgggagtttatg

SEQ ID NO: 108257 - DNA, 97 bp, Heterodera glycines
  Promoter: Source sequence=SeqID_8253; Location=1703..1799; Strand=+; Gene=SeqID_67457
tttgttgggagattgccgcaagttggtcactaagagcggtgtacgggtagtcagtggtggatttttttgatgcgttgtctgagagaggagaaagatg

SEQ ID NO: 108258 - DNA, 814 bp, Heterodera glycines
  Promoter: Source sequence=SeqID_39628; Location=441..1254; Strand=-; Gene=SeqID_68147
attggcatggaaaagtgatcagttcgagcagaaaatgtgcaatttcgaaattacacaataaaaaactgatgaaaaattggggtataaagaataaaaaacatttgcgtagctcaatttttaacagaaatttaaattatgtaattgggaatgaatttcaaagggaattcccccaatcaatgccaaatctgaagaaggaaaaagcacatttaagccttaatacgcccaatgctttaatattttgccaatgagaaggaaaagcaatcgatgaacacaaaattgaaacaaaacaaagcaaaggaaatgaaatgatacaaattgaaaagatcgatatttatgcccaatccattcaaaattagacttacataatttatattatattttttaatataataaatattactattttttacttttatttttattttaaataaaataattaattaattattaattaaacatttctctatttattttaatcgaatattaagatcatcctttcgtcatttaatgtcaatctataattgaaaatgtatcattgtctatttttccttattttatttgccttttccccattttcgtcagcgtttcccggagaaaaactgataaaaagcatgcaaaattaaaacaagtaattaaaaaactggcaaatgattattaattatctaataatatatgtttaattatggggattataataataatataatgcttaatattaatgatgtaattagcaatgcctttttttgtttgttcagcgcttaatcggtggtacaattagtttcgcttcaattttcacaatcagagcggcggaatg

SEQ ID NO: 108259 - DNA, 460 bp, Heterodera glycines
  Promoter: Source sequence=SeqID_3369; Location=3350..3809; Strand=-; Gene=SeqID_84399
ggtgggaaaattgaaaaaaagctccaattttatttaaatatattttaatttttgcttcggatttcatccgaattttttattggtttaattttcctattataattttaatatagtgactaaagaacaaatttaatttcaataaagtagtttagaatttctcaatgaattcaagaatagttttcgtttcttttcttaaaatctgatcacggcaaaatgatttttagcggcaaggacaaacaaaaccattggaattggcatcaaaaaccaaatttatgcggatgacaaaaatggcatttcaccaccgcagcaacagcaacaggaaagacaattaaaccaatgggcgtggaagtccgacgacaattcatttccctttgatcgtgccgcggttgctctttctgctgctgaggagaacagcacgagcagaacgagaacaagcatcccagaaggaacgacgacgatg

SEQ ID NO: 108260 - DNA, 146 bp, Heterodera glycines
  Promoter: Source sequence=SeqID_8747; Location=217..362; Strand=+; Gene=SeqID_69094
ggtaaataataaatttgaaataaataattaacggaccgaaattttgcatactttgaaaaggcgaaaaaattttaacggaccataagcttttacaattttgaacagttacaaattttaaatgaacatatttaattagctgaccaatg

SEQ ID NO: 108261 - DNA, 379 bp, Heterodera glycines
  Promoter: Source sequence=SeqID_12102; Location=352..730; Strand=+; Gene=SeqID_75662
atggacagtaccatcagcaggtggcactgtttgcctgtccaatcccaaaattgcttctctttaccaatctgccgttgcgggggccgagtgttgcgagggagagagtcattgctaatgaatgattggcttggcagctactgtataatgccgaaatgcattctaatgtatttaaattttttttttctcgcggcattttctattcattgttaaccttaaatcggtcagtttttaataaaattggtactttgataaacattactaaactatatgtacttcccttgttttttaccacattgcctttttgaaaaaaaacatatatcttcaatacttattaatttaattattcgtccattttaattaacctataaagaaataaatg

SEQ ID NO: 108262 - DNA, 111 bp, Heterodera glycines
  Promoter: Source sequence=SeqID_26115; Location=1..111; Strand=+; Gene=SeqID_56864
ttggattacacgaaaaaaccacaaatcccatgtttactaattttgttgtgtttttgacaatttcaatatttttgttaattttatatttgcaatatttccaattttttgatg

SEQ ID NO: 108263 - DNA, 232 bp, Heterodera glycines
  Promoter: Source sequence=SeqID_27748; Location=770..1001; Strand=+; Gene=SeqID_58417
aagaaattatttaataggactgaaatttttaaataaaaaacaaggaaaatttcgtgagaggtcaaaaaatacaacaaatcaaaaaatggagaacagagaatgatattataaatttacaagattcggacagagacctctataatataacaaattgaatattcccgtatttaaattgcgatattttgcatcggtccgtggcctttcaaaatgtgcacgccgaagtcaaccaatg

SEQ ID NO: 108264 - DNA, 739 bp, Heterodera glycines
  Promoter: Source sequence=SeqID_30095; Location=1077..1815; Strand=-; Gene=SeqID_60537
tcacatcactttttttcggagcgctttttcaaaaaactttttgggaaagaaggggtccggcggtgctgataggcgccgcctggggaaattttaaaaatttgggtgcaatttgttaacagattttcaacaaaaaaaggttggtttttgcgattattaagctcaattggtaggattttcatttaaaaaatgataaaatatgtatcaatttaaaaaaaactatgaggaatcatattttctctataggaaacccacgagtatacaaaaacaaaattcaaaataatttactttctgtagagggattgaaccaggggaaagaagaagggaaagtcaaggagactagccattaggccatttgcacacttgggcagtgttatttttaaagaatatattaattattattttttatttttccctttgactcctattttcttcactaatttttcactcagaccccccattcttaccaatgcttgtttttcccggttcccggttgccctaccgggaccgggacctgagcttttcaaaaccccgggaccgggacctcggatgaccgggaattcccggcccggtcccggtcccgtggcactctagtttgaccttgaaaaatgaattttatttgtcttacaatggatcgaaaaaagatttaaattcttcaaaaatgtcgtgaacacaaatttttggatacaatgacagcgaaaacgaagggaattctgagcaccacgaataaaacgccaaaatg

SEQ ID NO: 108265 - DNA, 251 bp, Heterodera glycines
  Promoter: Source sequence=SeqID_6104; Location=4776..5026; Strand=+; Gene=SeqID_60350
aagcatttgacaggtcagcgcgaagatgtgcccagaggacatcgcttcttcattcaacgcatctcaaaagacccggaaatgatgaaactgcttcaaaaaataccacaaaggggggaaggccggcggcgcagcacagtgaagaaaatgggaaagaaaaaattagtgcttgtcaatatgatgaattcatcgtctataaaaaccccaggattacaccgaacggaaccaaaacgcaaatttaaacctgaattatg

SEQ ID NO: 108266 - DNA, 238 bp, Heterodera glycines
  Promoter: Source sequence=SeqID_14785; Location=641..878; Strand=-; Gene=SeqID_78926
ttctccacatttgatcgattttagttttctccaccgcatgtctcaatattttttcactcaccattccttcgtcgtcatccctcctcagtgcataattctacacatatttaatttattagcttcgtattttaagctttttaattttgtataatccttcggaaatgacattattttatttttaatttatttttatttaatcattgcatttcctttctaaaatcagattttggatgtcatg

SEQ ID NO: 108267 - DNA, 925 bp, Heterodera glycines
  Promoter: Source sequence=SeqID_5072; Location=1..925; Strand=+; Gene= SeqID_56795
gtgtatttaattgtaatttgcttaagaaaaaacacattttccggatgtatttttaattgtaatttaatcattagaaaattcgcattttacgtatgtgttaatgtaatttgctcatgagaaaacacattttccggatgtatttttattgtaatttaatcattggaaaattcgcatgttacgtatgtgttaatttgcgaatttttttagatattttcagcaaattctttaggtattcgattgtcgggagccggcgaaatgataaggaatgagattttttggaatttttatgcaaaaacacttttgatattccaatgtttaatattttagcaaatattttggcatttttgggggttttagcacatatttcagcatttttataacaaattttattacatatttcaggatttttagcaaataaaaaacccagctctacttatatgcaatttcatacttacagttcagcatgttcccttgtcagtgagacaagtcgaattcatgccttgtgaaaagaaatttttgccttgtgaaaagaaatttttttttttggaaaacgggggcggggttctatctattgagggcgttgtaacttctcatcagcaaccatagagaaacacgaaaagacatctcaacgaattttgaacttaaattcccttttccatagcaggaaaatggagtgcaacgtctcaacagacagacgaacccaaatgaaggtagcgaaccaaaaatggaagtgtgttgaaactacaaaatattcagccttttatacccttttgagactcataaagctatttttgcaaatttgtagtttttgcgggaaatgtatgtataaaagggcgtgcgtttttccttttcaagtaattgtccttaagatttgacacaatttgcatttcatttcttcctaatttttgttctacatcgaatcatg

SEQ ID NO: 108268 - DNA, 61 bp, Heterodera glycines
  Promoter: Source sequence=SeqID_20154; Location=2903..2963; Strand=-; Gene=SeqID_84940
attgttcatttaaaaatgatttaaaacaattaaatttaagacttgttgcatcattcctatg

SEQ ID NO: 108269 - DNA, 283 bp, Heterodera glycines
  Promoter: Source sequence=SeqID_34969; Location=246..528; Strand=+; Gene=SeqID_64648
tgtgaaccgatctagggctccaacattttaaagaacaattggcagtgaatgcattttcaatttaatctaatcattagtgaacggattcttaagtttttgcttattttttctgagcatggacggtaaaaaacgaaaaaaattgccaaaaaataattggcgtaaaacaaaacgccaacacactcaaattgaaaaacaaattatattttcatctgatatttgttattaatgattaaataattcataaactaacagatagaatcaaaaaataacagatgaatcgatg

SEQ ID NO: 108270 - DNA, 663 bp, Heterodera glycines
  Promoter: Source sequence=SeqID_9156; Location=2513..3175; Strand=-; Gene=SeqID_70432
aatcgtctttttattatatatcaatgactgcattagggcacttccggtttccattatatttacaatgtaatgtgtcagcttctcaatgaagtgaaaccaagtgcatgtcgggcgacgcaaagaccctaaagaaaataaggacctgcccttcttgggattgtggttcgaggacctgccttttgaggattgtgggccacaacggtttacaatgatgatttccttattgttaccggccaacatccggcgcgaagctggtcccgcactttgccaagaccagtggactggtgagaggtaacataggatatcggagttaaccaaaacttatcaagtaaaaccttggtgacaataaagacctcaatttgggaatggtggttcaaggacctgctctttcttgagattgtggttcacaatggttatcgattagttccttaaccaataatgataactctctgcactcagtgcccttagggcagatgggatgataggtgagccctggctgatagatttcaacagcggcttcatttgtggcaagcgaagaaacgacaccatttttcacattattacttcatttgcataaatatttgattttgtgtgcactcattggttaatttccttcatatttttgttacacccaattttcacactgattttgtatttaagatg

SEQ ID NO: 108271 - DNA, 952 bp, Heterodera glycines
  misc_feature (237)..(237): n is a, c, g, or t
  Promoter: Source sequence=SeqID_37623; Location=362..1313; Strand=-; Gene=SeqID_66645
aaaatgaccagcccaccggtatataaatagataaatacccgtatttcccatccattctttttttactgtgcccctttttctcattttttacctattacattttaaaaacgtccaaaaaatttggaaaaggagtgcggtgagcgggacaccattaaggcttgggctactgtacatattttgctgaaaatctatatgtaaataccgcattaaaataccgtatttgctctaattatcccncaatctccattaatcccccagtctaggaggggtttgaaaaataatcccccagtctccatttatcccccagggggataaatagaatttggtcgtaacatttttaggggatgcataataacggaaaagtacctccaatttgtgaaaattttggcctaggaattccgttttttgttaatttgaataaattaggtataatatttcttctgtagcaattggtgaaaattagcagcaattcgccgcgttcatgtgtgaaaatcaatcaaatttttaattccttatatcattcgatagttctagatgttttctattagcctacagaatttcaaaaagtttcgttaagtttcaagaaagttatgagctaaaatgttgtaaaaaacttggttttttgagcttctcaagttataacttttttgaaacttaacgaaactttttgaaattttataggctaataaaaaacggtttggcctttttatgtcaaaatgtttccgcgccttccgtttttatcaatgatttttcgcctcccattggccattggcaacaatttaagacgaacaaaattcaaaaattgttggataaaatgtgattttcgttaaaatttttggttttccgcttttctcattatataaaaataaaacttccaacgcaattaattcttctgctatttgtgtgacatcattcggaactcgtccaaattgtgctaattgcctcaaaaatg

SEQ ID NO: 108272 - DNA, 268 bp, Heterodera glycines
  Promoter: Source sequence=SeqID_25157; Location=1127..1394; Strand=+; Gene=SeqID_55886
ttttatcgctttatcagtaaaatattcccttttgttcaatgttcgaatgcatttaactgataaaatgaaaaatggccaataaaattttgtcataaatcgcagcaaaccatagtttgcgttcataacattttgaaacgagttggaacaaagacaaaaatttttcctgctttcatttatttgcaaattatcattttggaaaatttttaataaatttaatttgctgatttcaggatttgttaagaagctgcaactgttgcccaaagggatg

SEQ ID NO: 108273 - DNA, 191 bp, Heterodera glycines
  Promoter: Source sequence=SeqID_10025; Location=1781..1971; Strand=-; Gene=SeqID_73077
tttcaataaatttatgacgcgtaaatgggaatgaagtgtgaccagggatggcacggaattccaatttcctttttggagtcggaattccgttcccgaaattttttgaagcctcggatttatttcccaaagttagacgttggaatttccatcactgctaaaccatggtctcaaaaaccgttttttcccccatg

SEQ ID NO: 108274 - DNA, 81 bp, Heterodera glycines
  Promoter: Source sequence=SeqID_16294; Location=301..381; Strand=+; Gene=SeqID_80682
ggtcggttttttcggggaggtggaagaattgtaagtaatcttattttgctccattttcagacttggtgctgctttttcatg

SEQ ID NO: 108275 - DNA, 1003 bp, Heterodera glycines
  Promoter: Source sequence=SeqID_904; Location=2259..3261; Strand=-; Gene=SeqID_63630
atcgaaactatccagactaaacaaattcacaatgttggaccgatcgacaaaaaattgttgtttaccccttacaaaacaaatgtaaaattttcattatttttcccacttcctcttcccattgttgcacacggaaatttgttggcccttccgccgtcgtctccgccatttctcatctttgtccaaatttggccatgtcgtcgttaattgcggtgatgtcatcaaaaaagaaaaaatttatggtacaagcaaatttaatgggggtctttgtccgtccgttcaactcaaatctaaattctccgatcttaacaaagcaaaaaataaatcgcattggtttagtaatacggaaataaaaaaaattttggttttccaaaaattggttaaatccaatcctcgctttttgctttatgtattttcaaacagcacaaagccattccattttaatcgattatctatgtacaattttcacatcatttgtaatgcgagaagcgagtgaatgaaacgaaaaatatgcaaacatcgatgagtaaacgaatgggaatttttttttcaaacaaaaactaaaaaattcagtgaaaatcggatgccgtttatttaaatgctaattttatttttggtatgaaatttttgcgagaaagtttaagggttcacaaaagatgaacaaattcgttgcatttgtccttattttgaggaaaatcttggttttcgttgcgacgagagaaaaaactgtcggcacatatttaaaccaattaagaaaaaaaaaacctgtgacatggggaagcaaatatgccagaaaaacttgagacacctatgaacatattgcacaaaaggcagccgggggaagacatttatctcctcaagaaattctgaaaacaaaatttagccagatatgcttggtaaattaaaaaaaaaaaattcagtgaaaatttacgagggtacagaaaacaaagaagaaaaaaattgaagggattggattgttgtgcaattcatcttaacaaaaataatg

SEQ ID NO: 108276 - DNA, 380 bp, Heterodera glycines
  Promoter: Source sequence=SeqID_550; Location=6402..6781; Strand=-; Gene=SeqID_56030
tgttccttaacaaatggcggcataaatttaaaattaaattatttaaaatttggaaaatgcaaagtgaaaaccgatttttttcgtttttattttcataatattcaatgcattgttcattattttctcgaaattttcatttttagtcattatttttgtaaatatttaaaccatttttcgaaaatatttatttaaatgttttggcattttataaatcctttctcgaattatgaatttcatcagatatacgctaaaaatgacgttaattaaatatttatagattaattaaattcaaatttctctaaaaaccccaaaggtttccctcgaaggcaaaaaatgtccacttggcaacaccaaatacaatttttctcattagttaaatg

SEQ ID NO: 108277 - DNA, 265 bp, Heterodera glycines
  Promoter: Source sequence=SeqID_12745; Location=2188..2452; Strand=-; Gene=SeqID_76452
ttattagctaggattatttattttaataaattaaatatattagaataaaggattgaataaagtgatcttgttcaccgtttttatacagattgatgtttgtttaacccagaaaaacaaaaccaagattgttataaatagttgatgcacacttatatttttcagttttattcttcacttcgttaattctgctctttttctccctaaatttacatcttttcttcattaatttttacaatattttagcttttgaatttgattaattatg

SEQ ID NO: 108278 - DNA, 673 bp, Heterodera glycines
  Promoter: Source sequence=SeqID_39904; Location=514..1186; Strand=-; Gene=SeqID_68364
cctgaaatatgtaataaaatatgtgctaaaaaatgctgaaatatgtgctataagccaaaaaaatgccaaaatatgtgctcaaaattggaaaaatcaatggtatttttgcataaaaattccaaaaaactcattctttatcattttcgcccgcacaattgcaaataaaaaacatttgggggtaaaattagtccttttttgataaattgtttttaaagataatttttccatcagttgagtaagttccagcaagaaacttcgatatccagtaacgaattaatgaagaattcgattttcggtacacgaaataaataaagaaaattttgaaagagcctataaaaatggcaagaaagttgatttttaggggtgcatttttgaattttttgtgtttttcttagatatttttttcaaaatgacaaaatatgtgcaaaatatgtgccaaaccccgaaatatgtgcgatatgtttttatgtgcgaaaacgccaaaatatgtgtttttataagtcgctctaaatcaaaaattgttcggagaaaatgctatttttgggcttctctcgccataactaagccgcaaaaaaaatatgttaaaacataaaaatcccagccctaatgattagggaaaataatgttgttaaatttagaattacagcttcatttaaccatgtttcagaaaatg

SEQ ID NO: 108279 - DNA, 363 bp, Heterodera glycines
  misc_feature (265)..(265): n is a, c, g, or t
  Promoter: Source sequence=SeqID_23; Location=1..363; Strand=+; Gene =SeqID_80477
ataccataccataccataccataccataccataccatgcgctaccttaccatgctatgagctaccataccatgcgctaccatactctaccatgcgcttaccataccatgcgataccatatcatatcataccatgcgcttccataccataccatgcgctaccataccatgcgcttaccataccatgcgataccataccatgcgctaccataccataccatgcgctaccataccataccataccatgcgctaccatacccccccccnccccccatttttttgtttcaaaattaaatttatttgtcattttttatccattactctgctcatcgatataaattattatgtttttaggtccagaaatg

SEQ ID NO: 108280 - DNA, 99 bp, Heterodera glycines
  Promoter: Source sequence=SeqID_37795; Location=838..936; Strand=-; Gene=SeqID_66782
aaaaatttcaatagattttataaataagattttttaaattcaggcccgtattgcgcgccgcatgtcgacaggtcgcagggcattgagcggcccgaaatg

SEQ ID NO: 108281 - DNA, 99 bp, Heterodera glycines
  Promoter: Source sequence=SeqID_4054; Location=1..99; Strand=+; Gene =SeqID_52991
gaatcaactcatttacgtgcctcattccgggtttttaatctggagattttttaagcttttcttatttttagacttttctgaaatcaacacttacctatg

SEQ ID NO: 108282 - DNA, 775 bp, Heterodera glycines
  Promoter: Source sequence=SeqID_1169; Location=1024..1798; Strand=+; Gene=SeqID_46645
ggtaagcctttgtcccttctgaataaataaattcgaatgattattttattggtagtcttctttaattcggtctcatccataaaatttgattttaattttataacggttgttcaacttataattatgtaatagtaatagtcatctcgtaactctttgaggccactcgaataaacaaaagtttagatttgttatattacgacaatttgtttcttttgaccaccaccagcaaatcaatctttttgccaaaaaatgcaacgaacatttttgtactcagacacatccgacattttacgacttcgccacttttacgcctccatcggcaacaacagcagaaacggttgacattcattctaaaattgtccaccaccgaaccaaacaaaaatgagttcactcctcagaatcctttttccttaaatcgaccattgaccatttgttgtccgagttggagcggacgcgcaaacacagctacgaattggccggacggaacagaaaactcgagcgagaaaacgagtgagtacagggcacagcacacagacccgggctggccaatgacatttttggccaaaattggtcaatttttggctttctaatttcaataattctcgtgaaattcgcgtccaccggtgcgcggtaaacagagaaatgcaaattttaagtaaattggtaaagaaaagtggaacttataaacaaaccctgtttatgggcctggtccgaccacctatcacatggcatattttgagcatttgaaatactcaaaaactttagcgttttgatg

SEQ ID NO: 108283 - DNA, 790 bp, Heterodera glycines
  Promoter: Source sequence=SeqID_16560; Location=722..1511; Strand=-; Gene=SeqID_80967
tcaccgggtccggtgttcaccaatcgctgtcgccaactgatcgctgcacacaccagtcgaggaccaattgacgccgttggatcaggtcaagcacagccaactggccaattagccggttatttaaccggctatccctcgcgtgtcaattagtcgattgtttaatcggctaacaatctggtcttaacatcctatctcccaacggcccattcattcacagttgcgcaggcaaccgccgcttaagtcccattccaagcggtttgcgttagtggcgacctgtccccacagggacgaccgcagctatcagttactaaccctaaaccccaaaacctattgtacggtccgatacgtccaatcatagaattttaattttttctttttgtttgcacatccttttcggtcagttttgaacctattttttttgtgaaccaatttgacttcacacatttattctgattaattttgatcagtcctgatcaagtatttgtctattgatattaaattttgattacgcatttaatatttatttttgttgagttgctgtcagttttgaacttactaatttaattttttttggggagagcgttgcttagtcagttttgactaaacaatttcaattttttgaagtttaattagtgcatttacaatttgttattcaacattttattgtttaattcatatcattaaccaagggcttccgaattatcaagttgatacatttttacgaatcaaatcgtgactatttagtcaaatcaaataaaatctgaattaaacttaaaaagggatcataatg

SEQ ID NO: 108284 - DNA, 127 bp, Heterodera glycines
  Promoter: Source sequence=SeqID_24238; Location=1..127; Strand=+; Gene=SeqID_54955
agcaaacggcactcagccaaaggcggcttcgtcatcatttgccacccaatcggcgatcaaaaaggacaattatcaggcccacgagttggtgctgaaccgtcccaaggccgaggtggacaaatggatg

SEQ ID NO: 108285 - DNA, 220 bp, Heterodera glycines
  Promoter: Source sequence=SeqID_32140; Location=196..415; Strand=+; Gene=SeqID_62469
tcctcaacgacgggtgaatgcacccggggcaccggaagtcggggacgtcgtgcttgtagaagacaaattccacccccgcaacttatgggccatggggcgaatcgaggcgctcagaggttcagacggtcacacccgcagcgtgctgatcagaatggcaaatggaaggatttgggggagacccgtaagcagaatttgccccctggagagaagtacagaaatg

SEQ ID NO: 108286 - DNA, 218 bp, Heterodera glycines
  Promoter: Source sequence=SeqID_20229; Location=1..218; Strand=+; Gene=SeqID_85032
gattgggtgatatatgccaatcaggttgtgctgagacaagacattgaccaaattcgaaaaaatttttaattttccaaccaaatcacttcaaattacccataattattacacaaaggtacaaaaatttttccggtcagtaaaaaattaatcatccaaattttttaataaaaaataaagggaatgttaaatgctgcctaataaacattaggtcactaatg

SEQ ID NO: 108287 - DNA, 78 bp, Heterodera glycines
  Promoter: Source sequence=SeqID_36656; Location=1..78; Strand=+; Gene= SeqID_65914
tctagagtcataggacatggtagactactgaaagagggaatacagttcttttgaggagatacagtggatgcgctaatg

SEQ ID NO: 108288 - DNA, 290 bp, Heterodera glycines
  misc_feature (38)..(38): n is a, c, g, or t
  misc_feature (110)..(110): n is a, c, g, or t
  Promoter: Source sequence=SeqID_15500; Location=1721..2010; Strand=-; Gene=SeqID_79781
tgtataattcaaatttattaaattttctcatttttttntaattttcactttccacaaaaagtttgattggttttttttgtaagaagaattcaaaacttttgtacttttcncagcaattaagattacttgaaattttttacaaagattcttacaattagtaaaatgcgaatcgaattatcaaaagcgcttaaattttttgatttttacattaaattttaatccctctaattacgggtaaagaggtttcaagaaagttcatttttaaattgttcattcttgtaggtagaatg

SEQ ID NO: 108289 - DNA, 892 bp, Heterodera glycines
  Promoter: Source sequence=SeqID_17984; Location=1721..2612; Strand=-; Gene=SeqID_82550
atgtttattattaaaccaaaaatttattttttattttagtcctgattatgtttttccatcgcagctttcatcagattctgacgaaaattaattcgtatgtcttagaattttgctctaatttatttatgcaaaaatattatcacgcattttgtttaaggaatctgtagtgactgcattgtttgtgtatgtgtttgggccgtggtaaagtggaactccacttcagctgttcttcgcattactctcattataacatttgttttaaaatgaatgtgttcggaccgtggtaagtggaactccacttcagcggttcgacacatatttggataagaatatattttgcaaaaaacaaccattttcattctaatttttaaatgtaataaaaaaacattattagaacaaaaatatgtttaatattgtttaacaagcaaaaacaattaaatgtttaattaattggtttggacctaaacaacaaaaagtcagtatgacccgcgaactgtaagggcggtctgtgctgttatgcttggacggggcttttgtcaacaagaaataggcagcacagattcaaactcacatatttattttcttgctcttgcagttctaagctcaaaaatgtatgtgcacatattgaattaatttgtgcatatgcagttttgaccgggtccccgtcctggcgtttttcgtaagtccagcgacgacggggtgcttcttaaatatgaatgcttaagtgcaaaatcatatttaatgagtataaagatataaatttgtgtattataatttatctataatatatttaaatataatactatttcaattttttatttgttaactaccataatcatataactcaaaatacaaaatttttatagcttttttatttgtcaaatcaaaaatg

SEQ ID NO: 108290 - DNA, 347 bp, Heterodera glycines
  Promoter: Source sequence=SeqID_4472; Location=1302..1648; Strand=+; Gene=SeqID_54574
tactgtatgtataccgtagcggagcctaaagtccgaataccactattggtcctcctctcccccggtctcgtctctctcggcaagttgatgtctcagaaacgactctcgagaagggtacacttcattcccccgccctttggaccgagacccaaaaaagccgagactgagattctcgagcaagctgcacaccccacctctttgatgtaaatgttctccaacggcatgccgatggcttgtctttgttgttgcgcagcgtccaatgccgtcaacgttggcgttgcggttgttgccccgccggcggtgcaaaaatgatgctgattttgcgacgatggtgacggcggcgaatg

SEQ ID NO: 108291 - DNA, 302 bp, Heterodera glycines
  Promoter: Source sequence=SeqID_13284; Location=2284..2585; Strand=-; Gene=SeqID_77125
gggggtctactgcgtttcggcgccgcgcgtttcggcgccagcccagtttttggactataacttttttctatgtcaaccaaatcaaaaattattggtatcattcgaaagcccttcagattctctattatcttgcataattccaaaaaatttcatcaattttgaacaaatttatggccataaaagttggaaaatctggttttttaagttgttctggccataatttttttgaacctttacataatttttcaaaattttgtaggctaatataggacatttacagctttcgaatgataccaacaatg

SEQ ID NO: 108292 - DNA, 196 bp, Heterodera glycines
  Promoter: Source sequence=SeqID_827; Location=1..196; Strand=+; Gene =SeqID_62232
taccatgcgcttaccataccatgcgctaccataccataccatgcgctaccataccataccataccatgcgctaccataccataccatgacgctaccatacccccccatttttttgtttcaaaattaaatttatttgtcattttttatccattactctgctcatcgatataaattatgtttttcaggtccagaaatg

SEQ ID NO: 108293 - DNA, 258 bp, Heterodera glycines
  Promoter: Source sequence=SeqID_8289; Location=281..538; Strand=+; Gene=SeqID_67581
ggtgagagggctgctggactttgtattgtttacgttttacgatgaaatttaaaaatccgaagggtccatccgtgcactccgtgcaaagacgacagaatcaccggaggggtggtcggatgcatgcgcgaaatcgactgctattgtcagttgaaaaaagagcaaaaagtatttggccacagcaaacgttttgttcagtgaactgtccgcccggttccgtttactgtccgacgaccgattcgtgtcaaatgtgtgcccatg

SEQ ID NO: 108294 - DNA, 1003 bp, Heterodera glycines
  Promoter: Source sequence=SeqID_15774; Location=1096..2098; Strand=-; Gene=SeqID_80098
tgctaatttggttagttatgtttttttttttgtatttttgcgttgcccttttgacgaaatgacctagcaagggatttcgtggaagatgaataggacgcgcagaagaaatagcacaaaatttgcttattttcccttggaatactgtagttttattttcgaactttcattctccatggaaaaaagttgtagagacttgtgatctttcttttgcttttctgctcgttctatccgtcctattcatttccacgtgaatgtttttccgtatttactccgttttcaattttccgatcgaattataaatattatcttttttgatgagcataaaaaaagttatgatgtatgaatttttcaaatgtacatgtcttcaaagtattgagttgataatttcgtaacgccgaatttgggaacttcttgggaaaaattcataaaatttcttctatcctttctgttttttaaatgtaatcttaatctaagataatttgcttgttaggggccatggtaagtaagtaaaacgacaaaaaaaattgagttcgtaatttattaatagagacaggcttttgaggcatataattttgtaattattgtacccttttttgcctttttcaccttttccttgcctatttttaaaatgttccaaatttggtcatttttggggcaaaataaatgcgccgtaaaaaatggtttgaaaaaaaaagatctttttatggcttactgcccattttattttataaatcaaaattccacaaattttgaaaaaacgcccgccggccaaaattttggaccgggcctggtacgcccggtaaaacggctttttttgaacgggcggcccggtcccggccaattgtctaagccggtattttaaaaatccggtctctaatgatgataaacaattagataaataaatatagcactttttttttgcatgcgcggccttattttgctcaccattatacatactatgtgaatttagatttgtgttaaattcctttttttcttaacaatg

SEQ ID NO: 108295 - DNA, 216 bp, Heterodera glycines
  Promoter: Source sequence=SeqID_28526; Location=1..216; Strand=+; Gene=SeqID_59135
attaattaaacaacagttttgtcagattatgtcggaggaagtcagaaaaatatacaacaattaataataacatcaacaaatcggaaaccaatttgttttccaacgagacaagaaaaagagaacaaatttgtataaatactgcccatgttaataacagaaaaacatccaaattaacacggcacagtaataaaacattaaagactctgaaaaaatatg

SEQ ID NO: 108296 - DNA, 693 bp, Heterodera glycines
  Promoter: Source sequence=SeqID_41949; Location=213..905; Strand=-; Gene=SeqID_69981
tgacaaattttgtttttatttccataaattttcattttttaaaaattcaataattgcaattaaattcagactgacctaaatataaaagaaataatttaaattttcttaaaaatgaattttcttttttataataaattcttcatttgttaagtaaattattgatgtaattattaaattatattataaataatatttaatttctctctactgattgctcgttttgtcaatatccacccgtatccggatatatccatagataccaacagaaacaaatataaaaaaactaattaaatttcaattaaacaatttctgagtttaagtgatcaggagaattggaatttaactttatccagatcttttcataaaatattttaatggaacaaaaaacatttgaagaaatatttggagaaaaatgggaagaaaaagaagaagaaaatttggaagaaaaaaagaaatgaacagcgaaagagagaaattattcacaaattcaacaaaataaaagaaaaaattaaacaaaaagagaaaaaatattcagcaaaagaaaggaataaaattgagggaaaaatagcgaaaaaattgggcacaaatcgccaatatatttataaatggataaaaatattcggcctttataaatttaacaaatcaaaaacggatgaacaaaaaattgaaattgttcaacaatttatagcaatg

SEQ ID NO: 108297 - DNA, 86 bp, Heterodera glycines
  Promoter: Source sequence=SeqID_11790; Location=2436..2521; Strand=-; Gene=SeqID_75291
atttttgaaaattttaaatcaaatttaatggattattttaatcaatataataatttgcatttttctgtgctcagactgtcgaaatg

SEQ ID NO: 108298 - DNA, 296 bp, Heterodera glycines
  Promoter: Source sequence=SeqID_21098; Location=2328..2623; Strand=-; Gene=SeqID_51690
ggtgctaatgctaggccagaaatttttacttattcggcacaaattttacgatattggatttcctaaagcatataattgctggtcgagaattaaattctcgagaacgatacttcaaccttaaaaaaactcatggcccgatgaggtcaattagtgccactaattgatattggagaacttagatttgcttggtgccgagaacagtctcttggaatcatttaatctctgctcctaatgttctaaacaggtgtctgatttgatgatgtgcacacttgtacaacaattgtccacaaaagatg

SEQ ID NO: 108299 - DNA, 683 bp, Heterodera glycines
  misc_feature (14)..(14): n is a, c, g, or t
  Promoter: Source sequence=SeqID_3901; Location=1..683; Strand=+; Gene= SeqID_52350
ggatatcattaccnaatagtttgtttttttttttttcaaatgataaatgtcgacgagtagagaaaaacttcgaatagcaatttttatatcttccgagggattaatggcaactcgtacaaaaattatttttacaaaataaagcctaagcctatgtacgagtagactttgtatggtttccattatgtacaaattgtcatgactctcatttccagagcgataattcaatctttcggagtaattttctatacatagattttcgagagtttctaaaatagaataaagcattcattgaactcgatattttttatcgtacaatttattttcccttttcatacaatttatttttcgttttatttttgttattttgtaataattgaatcattcatcttccaaacacagaaaaatttattgccaggaaaataattatgcataaatttactgatttgggtgtcaatcagcgttttttttgctcacatcagtgatgaaaccgcattacattctcattaaacacaagagatatgcatcgaaaacagaattgtacatcccttcccaaccattcatttcatttcattttggacaaccaatttatttggttaataataaataaaaataaataaaaacgatttaaaaataaaataaattttcatatgtttttagataatccaagaaccaaccttaaaatg

SEQ ID NO: 108300 - DNA, 251 bp, Heterodera glycines
  Promoter: Source sequence=SeqID_12519; Location=1863..2113; Strand=+; Gene=SeqID_76168
actgaaattttcaataaattaaaaaatagttttaaaaatttgaaagggatttattgaaatttcaggttgatcaagcattattatacataaagtattttcggaaaattatttattaaatttttaaatctttagaaatttttcaattttgaatttttttaaaaaacccaggagggaaatttcagaaataaataaattacttcaataattttgattttttaaattcaatataattaattcaacccctaaaaatg

SEQ ID NO: 108301 - DNA, 413 bp, Heterodera glycines
  misc_feature (14)..(14): n is a, c, g, or t
  Promoter: Source sequence=SeqID_43493; Location=844..1256; Strand=-; Gene=SeqID_71139
gtaactttttacgnggtccatccattgcatttgttatttaaaaatttgtggacttatttttccgaatggaatggcgccgtcatttgtccttcattgtctttgctatatataatacttaggattgctttttttcatcccattctgtaatttgtaattcaaactcctttctgtattttatggatattaaacacaaatctctgatcaatcgatttcaaatattactcaaacttgcggtccaatgttttagagtaaaagtgcgtctggggacctctgaacttggaccgctgtgtatacaattgatgataaaatttgatttattggttcattgtctagtaaatatatgcataggatgttcaaatacaacctaataatttttgtgaacattgcatcgaacatttttaaagtattcaatg

SEQ ID NO: 108302 - DNA, 1003 bp, Heterodera glycines
  Promoter: Source sequence=SeqID_19028; Location=337..1339; Strand=+; Gene=SeqID_83760
aaaaaaagcatttaaatttttttattaatgatttttagggagcaaaacacgtaaaaactaaccaaaaactaaattttgctgatttatggataattcaatattttataatgtttttcaataaggaaatttttaaacctaaaattttttatcaagaaataaaatgaattttggcgcacaatttttgtgaaaatttttcaattcataaaggtatattctctgaatttttttagatcatttcttagcggtttatttttctcaattttaaattattttcaaattaaaaaacagctatttaaaaaattacaccccctaaatttggaactttttcgccactatttttgccactattttggcattttttgtcactatttagttaattatttggggattttttatcactaaaaatccgggccctagtaatcaccaatataaaatgcattctccaatttgtcttttcacttcttaccattttcttaattcagcaagtaattgcaattattttccgttaatgggcaaaaacaaaactcgtcacttttcagggccattaataaatgaaaaatttacaacaatattttttattttctttttttatttttgccttcggttttctcttattgattctgcgcaacagtttcaaattcatcacaattaaacagtccaatttattattattattattattgttctgttcaaattgcagcagaagtgatacaatcctttagaaaatgaatggttttattgtctaaaaaatgcagaaatattttaaatttattaattttttgatgaataatttaaataaaaataaaaaagattaaaaaccttttgggtttaggactaaaaaatgcacggtaaaggatattttttaacaaattttaaatttatcttaaatattttttaacaaaaaaatatcttaacagtttttttttatattacgacaaaataaattattatttttattaactttaacaattttttcccatttatttttctccctttagaaatg

SEQ ID NO: 108303 - DNA, 433 bp, Heterodera glycines
  misc_feature (9)..(9): n is a, c, g, or t
  Promoter: Source sequence=SeqID_13540; Location=1..433; Strand=+; Gene=SeqID_77440
ttcaaatanaggggattgaaaaataaaattaaaatctggctttctagcaattttgaaatatttttatttcgctaaaactaattggttttaaattacttttttatgttacttttttgctatttttccatttgtgccatccctctttccctccaattgttcccattgtgtcgtcctctatttttccccttcggggggtttaattacccaagtttgagcctaatgataaattggattatttctgcgcactgctccttgggtctttatttcaacaacttgctctgaatactctgatatcctctcgccccgacccccaacaaaaaaccatttagtaataggtaaaatctttcctaaactgttaagcttttaaatgatataatatgcgaaaaaaatatatttatttttacaattttagcaaaaaaaattctctaaaatg

SEQ ID NO: 108304 - DNA, 1003 bp, Heterodera glycines
  Promoter: Source sequence=SeqID_22216; Location=152..1154; Strand=+; Gene=SeqID_52889
ttatttaataaattaaattaatgaaaattttcaaacaaattttcttcaattatttcaaacaattaatcatttttggactaaatcatcgaatattaatagaaattcagatttgattttcacatcacttttttcggagcgctttttcaaaaaacttttgggaaagaaggggtccggcggtgccgataggcgccgccgggggaaattttaaaaatttgggtgcaaattgttaaaaattttcaacaaaaaaatgttggtttttgcgattattaagctcaattggtaggattttcatttaaaaaatgataaaatatgtatcaatttaaaaaaaactatgagtaatcatattttctttataggaaacccacgagtatacaaaaaaaaaattgaaaataatctaatttctgtagagggattgaaccaggggaaagaagaagggaaagtcaaggagactagccattaggccatttgcacacttgggcagtgttacttttaaagaatatattaattattattttttatttttccctttgactccaattttcttcactaatttttcactcagacccccattcttaccagtgcttgtttttcccggttcccggttgccctaccgggaccgggacctgagcttttcaaaacccgggacctcggatgaccgggaattcccggcccggtcccgtggcactctaatttttacatctgggcaaagcatgaccgcattttggagttcgttttgcgcaacatttggccaatgctcgaaaaaaacatttgtggcatggaattgcccttcggatttttgcaccgtttgcgtaaatttgcccctttttgaaactatgttcgttggatcagatactaaaaaaaaattcttaggataaagaaattttgctgaaagaaggggggagggagggtaccatccgaaacatatctgagtgtttttttaaaattttctatttaaaaaattctctacctttttaaaaattcattttggtttccagcagttatg

SEQ ID NO: 108305 - DNA, 1003 bp, Heterodera glycines
  Promoter: Source sequence=SeqID_6478; Location=3465..4467; Strand=+; Gene=SeqID_61737
acagattgccttatggtgatcttggtgagatatcacacaatttttcccatacaactggtcatttcgtgacttttcttaaagatttaaggcatcttccctgctcattaatgattttaagcagtgcttctctgccaactatctgtctgcaatttgctgcccaatgtggtctcccacataagaaacaattcggcattgtccctgtttccctcatatttcttcggtcattttcttggaccgaaaatactctttttacatcgccgactctgttataattatttggtctgaaaccatttcctttgaatcgattattgcttttttgtatttcttcaaatctcttttgagcaaataaattagggtttaagcttaagcttctcgtacagcgcagtgcttcttctcttaatgatattacttcgcttaggcactctctccatctcgaaaccttccatttgaatcccgattctttttccttttttaaaatttctaagattatggtccttgttaaattatatttttcactgccagtaacaaaaattcaccgccttcttccttcatgtttttccaaattatgtattcgtctactactacatatgaattctccatagcaagcattgagagaaattccataatactcttttgatgaagagacaaataaaactatatggattagaaaaaattccggcaccgtaaaaatgttataatttattatcttggatgcttggaatgtactaatttttcgccactatttgcgataatttcgctttttaattaataaatttgggattttttgcgcttaaaatttgcatccgattgattatgattactctcaaataaggattaaataaaatttttgtgatttgtagtttgtttttattaaaaaaaatccaatttattaatatgaaaatcatttcacgaataataaatgcccattcattcataaaattaaatcatattggattttattaaagaaatcatacaacattttgagaatattttgaagaaaatg

SEQ ID NO: 108306 - DNA, 314 bp, Heterodera glycines
  Promoter: Source sequence=SeqID_42; Location=2602..2915; Strand=+; Gene=SeqID_55513
agggtcagcagggcggctttttggaaaactatgtgcgacgtggccaaaactaaatcaatgatcaaatttcatctaccaaatttctctcatcattttgccaacagcactcaaagttcaaagcatttgtccgcattcggcaatgttttaagcctaaatcataaataacatttttgtattagatcacggtgatcgagacactgaaaattgggaaaattttagaaaaaaattcataggggcttagaaaatttttttgaaaaaaatcattaagactaccaaaaagaacacaaaaaagctaccgaattgtcttatgaatg

SEQ ID NO: 108307 - DNA, 441 bp, Heterodera glycines
  Promoter: Source sequence=SeqID_7964; Location=4088..4528; Strand=-; Gene=SeqID_66524
tttttgaatttgcagtctccaacaattttttgattgttttaaaaatatgtattaaatcaacttgagtcccatcttctatctgcgcaatttcaatcaccatgaacttcgcaaaaactttaaaacaaaaaagcattaatacttccaattttataattcgttattcattttagctcatttctcaagtattgaaaaggataattaatgtccgcaataataatacgtttacaaaatttgccccttagtgcaaaagctcatgatatcagagacttctttggggatttgaaaatccctaagggatcagtcaacattgtcgggggttcgaatggcgatgccttcataggatttcagactgacgaagacgctaggctggctatgctgctggacggacgtttactgcaccaatcaaaaattcggctgatgctttcttcgaggagagaaatg

SEQ ID NO: 108308 - DNA, 235 bp, Heterodera glycines
  misc_feature (80)..(80): n is a, c, g, or t
  Promoter: Source sequence=SeqID_20457; Location=1..235; Strand=+; Gene=SeqID_50989
tctttggccttaaaaatagcacgcgagacacaatcgccgcctcattcataatacctaattatgcatatccatttcatttntcgtagggttcgactggaatgaacccttgccaaagccaaccgttaaacgaatttgcgtatttacacacagtcagaattagtagaatacaattttaaatctcaataaaacatgtaatttacaaattgaggttaagtgtgcggtatttattgaaatg

SEQ ID NO: 108309 - DNA, 392 bp, Heterodera glycines
  Promoter: Source sequence=SeqID_44775; Location=549..940; Strand=-; Gene=SeqID_72202
tagtgggcttgttcactttgccaattgggtgattagtgctaattatccgcgacggattgtcttcgattgtgtcactccgtccgtccttctcatcgcccctctctctttctctctgttctcattctcagctcgtgttgttctctttcttctgtgcaatcaatccctaattatgtacttagggtgtaacataagtttccgcacaactttttttaaagaatttttttatgaatataaatttaaaaaaccacaatcatgatccgaaatatctgacattattattgagaatgagtttgctatttatcgggcaagggataaatcccattagaaaagtatttaaggagttagagttgataatgtaaaaatggtcattttcgaggtatgtatttttgatg

SEQ ID NO: 108310 - DNA, 106 bp, Heterodera glycines
  Promoter: Source sequence=SeqID_739; Location=5885..5990; Strand=-; Gene=SeqID_60191
ggtgtccttattaaaggacaagtatgggaaaaatgaaaatttaatcagagatttacataatcaattggcccggctttcaaattcgatatctcttggagacgacatg

SEQ ID NO: 108311 - DNA, 1003 bp, Heterodera glycines
  Promoter: Source sequence=SeqID_23376; Location=292..1294; Strand=+; Gene=SeqID_54084
aatgatcggaataaaccccctcggttctcttttgatcttcgaaaattaattagtgcgggaaataaaggactatgaaaaaccgtgaaataatggttttaaattagtaatttttttgcaataatttttaatcacgaaatattaaaaatatttatattgggataaatgttttttaattcggtaataaatttttttcaaatcattctatatccgttttttcatgtgatgaattaacaattaaaaaggatagtttgctgggactattcctcccactaagcagtattttgtcctatggtatttttattgcggaaataaaggactatgaaaatgcacgattaaattaataaataaattcttttcaaatctatcccatattggaattcatacatctgatgaattcacaattaaaaggcttgtattttgggactccttccattaatcaataaacctcacacccaataccgaaaaattataatatgaataaatgaaaaatattttttaatgcacatgtaattaagaatcgaaaaaataaatttttttgcgggaaatgaagggcaattttattctcgtttaatttttattaataagtatttttcccgatttatatcatgaaaattataataaatattttcatttcgggaaaattgctctgttgtcaaagggttttaaaaaatatcagagaatttcgccctcatctaaagctatcagttatatctatttgttgttgttaaaaaataattaaaaccattaactaataatatatgattaaaaatagttaaaataaaaatctgatagggtatggcgggtaatacgctgcccccctcaaaatgaccccaacaaatcccgaggggtggggtacccaccaaaaaatcgttggcccacctgcttacgtgtggtcggaatggtgcaacacttttttttgaaaagcggcacgtatgtaagaagtgacccaaaggtcgatgcgcacgccaccccattcccgcccccaccaaccccctgccccatg

SEQ ID NO: 108312 - DNA, 51 bp, Heterodera glycines
  Promoter: Source sequence=SeqID_25547; Location=1439..1489; Strand=-; Gene=SeqID_45942
cgagagttccatgtaaaaaagcgcaaatgaaacttatttttcaaagtgatg

SEQ ID NO: 108313 - DNA, 209 bp, Heterodera glycines
  Promoter: Source sequence=SeqID_37390; Location=198..406; Strand=+; Gene=SeqID_66475
ttgttcgagtgagtgttgtgtgtcaccaaagttggggcttgaacaaaagagcactaccgatccgcttctttccaagcgccgcctttttaaatgtgtgcagcagcagcgcggaagaagcgccgcttccgcgaattttcttccctcttgctttccttgtagcggtaatagcaacagcagcggcattactgcttttgcgtttggtcaatatg

SEQ ID NO: 108314 - DNA, 225 bp, Heterodera glycines
  Promoter: Source sequence=SeqID_5372; Location=1..225; Strand=+; Gene= SeqID_57809
atactgttcggcaaaacattttcaaaccccctttaattaaagttaatcaggcccaaaaattattttttccaaatttatgttgaatattacagtatgcgacattccggattttggtcatattcggaagtctttaagtttaataaaatattgaaaataaaaaataatagtcttaagtagtaattaaattaatttttttttttattaggtgttgggtttgacagtatg

SEQ ID NO: 108315 - DNA, 408 bp, Heterodera glycines
  Promoter: Source sequence=SeqID_43088; Location=1..408; Strand=+; Gene=SeqID_70851
tgctcccttcactctttccccgcccccgggacatcgaatccgattttgataattttaaaatcgagaaattcagtgacaaataatcattacaaacacttttccattttttcgctcatcgtcaggcggaatcgcgaagcagagacatcgttcatcgaagaaggagaaattgcatttgacgatcaatcgtgctcaaattgttcacaaacgaagagattgaaaaagtccgcaaatttttgcatgaacaattccaatccgacaaaatcaggtgccccggggcaaaaaacaacaccgaaaatggcacctcttttcgatatgaaaatagttttttaaaaaccattcaattttagaggtattctgcagggctctggcggtcagttgcgcgtcaaattcaaaacattgcaaccgatg

SEQ ID NO: 108316 - DNA, 657 bp, Heterodera glycines
  Promoter: Source sequence=SeqID_1967; Location=1..657; Strand=+; Gene= SeqID_77076
gttgtgcgcagcgacaacgcggagattcgcccgggcagatcatcatatccttcagctccacgtacaggacttcgctcctaaattgaaaaaatgtttttatctaggatttcggattgctccattcgcttaccagttgattgtccctgcttccgtcctcggataacatgtggagtacagttccagtccggcgatcaaatcaagcgttccttcgacgaacaccggcaaatcgggatgatcgtcgttgaaaatgtgtacacaaccaagaacacaaagaggattcgggtaatattcacccggggcgctcaaaatctcttctttaaaatgtgtatacaattgttcaacgctgccaagtccaaaggattcttgaaaatgctttatcgctctttgcatgaaatagttagcagcagcaaatacgcaatataattatttttggctgtcataaaatgacagtaaatttatgcaagtgtggtatggaaaattcaaaaaaaaagtgagcatttaaatagtggcacatgatcttagctggtgggcggtccttggtgctatagtggttggattgtatacagcagacgcgtcataggctccgcccccattgttgttgttttgcaacgaaagtgaatggaaaagatcgtattcatttagttccatcgcgtcatg

SEQ ID NO: 108317 - DNA, 257 bp, Heterodera glycines
  Promoter: Source sequence=SeqID_6349; Location=3152..3408; Strand=-; Gene=SeqID_61231
ttttcggcggcgcctatctgcaccgccgggctcctttattccccccaaaaatttttggaaaatgcacgccacaaaaaaccagtttagaaaaagcaaaaaaagggtcgtcaaacgatgttcatactccttcacaaattggcgctgtgatcacccctctccccccagactcgttagcaaaaatttcggttaaaattggcttttttcgttaaaaattttttgttgatcactcactacccgatcggggtccccggactatg

SEQ ID NO: 108318 - DNA, 54 bp, Heterodera glycines
  Promoter: Source sequence=SeqID_16152; Location=1..54; Strand=+; Gene= SeqID_80516
caaaatgagcaaaatgataactctacagcagttgatcaaatgggtgaagaaatg

SEQ ID NO: 108319 - DNA, 232 bp, Heterodera glycines
  Promoter: Source sequence=SeqID_514; Location=751..982; Strand=+; Gene=SeqID_54985
agaatgaccattggaaactcgaaatgtcattaataaccgctaattgaactgaaaagacagataatattcgagactatagactgtatagaagaaatttctctgatcatacattgccgtttaaactgccggtcaaaaaaggcatttattgggacaacagagagggaaatggaaaactgctcatagcgcattgatgaggataattagttttaaatattttacagtacccgagatg

SEQ ID NO: 108320 - DNA, 560 bp, Heterodera glycines
  Promoter: Source sequence=SeqID_19740; Location=1818..2377; Strand=-; Gene=SeqID_84482
aactagcgggtgcgtgaaccgtcggatctgggcttgggataaagcgcttcgcgcttcttgagcttcgctacctaggctgtgaagcgattcaaattgatcgaattggttggagtgatttttttgaatttttaaaaaattattaggggtttttagtccacatcgaggctcaagacgggcgcttcgcgcccgttttttagcttgttaggccgcttcgcggcctcagtcgggctcttcgcgcccgtttttcaaattttgttgggcttggacgggcgcttcgcgcacgttgtttaattttgtagaggccaaacgggcgcttcgcgcccgtatttaaatgttgttgagctcagacgaggtacaaaaattgttggaagatgtgttagaagaggtacaacagtgatcagaagagttacaacagtgattagaagaggtaaaacagtgactaaaagaggtaaacagtgattagaagaggtacaacagtgattagaagaggtacaacagtgatcagaagaggtataactgtgattaaaagaggtacaactgtgattaggagaggtacaatg

SEQ ID NO: 108321 - DNA, 1003 bp, Heterodera glycines
  Promoter: Source sequence=SeqID_2569; Location=1958..2960; Strand=-; Gene=SeqID_80445
atgattacgagttgttaattattgggtaatattaattaagaagcaattaatcattaaatggtgagaaattaataacatttttttgtcaaaatgattttacggaggaattttatggcatgggtgagaaataatattaatgatttatgacaaattaccaataatggtgagtagcggtgtagtgggctaattgtctcattgaccaactgtcatttttaattatcttccttgaaacggtttggtgtaagtttaactaactatcagctcctaacatccaattattaaatttgggaaatttatgaattaattattttttattgggatgattttacataggaagtttatcgtttgggtgagactcttcaaacttatgtgattaattatgacaaattaccaagaatggtttctagtatatgcttgtgaataatgagtcctcgacaaccataaggtctaattagtgtcagtttgtaacgacatgatatatgattcacaactaatcactatctatataccattgtttttagatgagaaggtgtagtaattgatgaatttaatgatgaagcattgaacatattataagtgggaagtatgaaaaaatcaaagaattttaattaatagtgacagttgttaaatcaatttttgggtaatttaattaagaaccaattaatcattaaaatgcgagaaaattattaacaaagttttgatcgagatgttttacatttgtgttttggtatggtcgaatcccatgctaaaatactccaattgctaatagggtatgacatctgcattaattataattataaccaattattctttaatttttacaaactgaatatttctggggaaagaagggttatgatggaacttaaattatatgccacatttttgctgtaattcaatgaagcagaatacttgaagctgagacaaaggaaatgatgaacactaaatgagtatgataattgttgacagattaacttagttatggtattgatggctaggaaatatg

SEQ ID NO: 108322 - DNA, 145 bp, Heterodera glycines
  Promoter: Source sequence=SeqID_6188; Location=2547..2691; Strand=-; Gene=SeqID_60655
aaaattcgccccttagacgaaataaaacaattaaaaatttatcaaagtttggggacgggtaaatttagctgagggttaaaaatttaaaatttcttgagaggaaaaatcaggcatgaattgtgttcttttccatttgtttcagatg

SEQ ID NO: 108323 - DNA, 298 bp, Heterodera glycines
  Promoter: Source sequence=SeqID_19653; Location=780..1077; Strand=+; Gene=SeqID_84389
ctgtttgaaggacggcgcgctttatgtgtgcacaatgccagcaaaaggaggcgaatcggaggcggaagtgcaggcggatgaggagcaggaacagtgccaattcagagcgaattcgcacgaagtgagaagcaaaaaaggaaagggggggggggcaaagggacaacaactaatgagtgatcggaaaaagtgatcaggtaggggggaagctttccacgtgttggcactgtgaggcatggcttatctcggccaattcaaattatccgtccaaaacctttcgcttttccctcatcagacaatg

SEQ ID NO: 108324 - DNA, 321 bp, Heterodera glycines
  Promoter: Source sequence=SeqID_35385; Location=703..1023; Strand=-; Gene=SeqID_64948
ttaggattgctttcctaaaaatgggcacgagatgttgtttcgaaacagtatcttttttgtccttttttcaaaacactcaaataatcgtcattttttctgcaaatctacaaaaatttaagtatttgaatctaatttaaaagttcccggacgtgcctttagccataacaaaccctttgttcttaaaatttgtttaaaaaagcttgaattggatgttgccagtcctatcttttctgcaaatcatattaatttcttttttaagaagaacataaacaagaaattaaagaattggaagcaaaacaagacacattaaaaagaaaaatg

SEQ ID NO: 108325 - DNA, 55 bp, Heterodera glycines
  Promoter: Source sequence=SeqID_43231; Location=1168..1222; Strand=-; Gene=SeqID_70955
tgaacgatctgaacgtgaaattggccaggctgaagttgcataaattcgccgcatg

SEQ ID NO: 108326 - DNA, 67 bp, Heterodera glycines
  Promoter: Source sequence=SeqID_14093; Location=1..67; Strand=+; Gene= SeqID_78068
tttttccaatatttaattggtgtttcagacggtaaatcaagtggtcatctctgactatgctcaaatg

SEQ ID NO: 108327 - DNA, 224 bp, Heterodera glycines
  Promoter: Source sequence=SeqID_26715; Location=1..224; Strand=+; Gene=SeqID_57476
cgttctaagatttttttcttgaaaaatttctaagttagcaaaattttttttaaaactttcacggagggaaacggcggggggggggggggaaatgaagtgcaccccccaaatccaatacgtcctaaacatatctcttaattgttttgtttaaggtatttgccaaacttcgtgccaccctttttgccacttttgccaaatgccaaggccattgttccattgcaatg

SEQ ID NO: 108328 - DNA, 179 bp, Heterodera glycines
  Promoter: Source sequence=SeqID_12120; Location=669..847; Strand=+; Gene=SeqID_75689
actgaaattttggggaaatgaataaaaaatgacggatttaaagatgcacagcaccaccttgaacaagttgttcacaaagtcgttccatttgccttccttccatttgttcagcttcagtgacaccggtccgtgcccttcctcgcgctgcgtgtgaacccacgtgtacaattcacggcatg

SEQ ID NO: 108329 - DNA, 665 bp, Heterodera glycines
  Promoter: Source sequence=SeqID_21609; Location=1..665; Strand=+; Gene=SeqID_52208
cggaaaatggaaattcaatccgaattaattacgcctctctagacagaatcgatcgattgttttgcttaattttctgaccaccatttcagtacgtgttcttcaaagatgtgaagcttgtccaccattaccatcgtactgattaacaaacagcagcagaagattagtgctgtggatgagcaaaagcaaaacaaaaaaaagaattattttaattttttaattttagcgcatttattcaaaatattgtttgctaatgaatgaaaagacactaataaattaggattcattagagtttattaatgttcaagtgtgtttcgattaaaattggggctcagttggataaattcacatttttggagttgggttcaaatccaatagaaaaataaataaattttaattaatgcataatataactaattaatacagaaaacattttttggactaaaaaaatgtattatagtctttctttagtgaaaataagcaaaaatcagtcaattttaaaggttagggaattaattgaaagttaacaaagctggaaatgggaactttggccaaaatttcgatttttgaagcactataactttttgatttcttcctatgggaacgtaatattaaaaattcacaatagaagtcgatcctgctctatccaatggtatataacacatatg

SEQ ID NO: 108330 - DNA, 85 bp, Heterodera glycines
  Promoter: Source sequence=SeqID_1545; Location=7443..7527; Strand=-; Gene=SeqID_74363
ttttgttctacatatacatatgtacaataacaataataaaaataataatttattattattattttaattgattttttgtggaatg

SEQ ID NO: 108331 - DNA, 1003 bp, Heterodera glycines
  Promoter: Source sequence=SeqID_8197; Location=224..1226; Strand=+; Gene=SeqID_67282
cctgtgatttgtgccgtaaaattgcagaaattgagtcccaagattaagtgttgaagaatttttgagattgagtcccaagattaagtaacgaagaattttttgagattgagtcccgtgattggaatgccggagaagaattgagtcccagtgattgggatgcatatgaattaggtcacagtgattggaatgtcgtataattgagtacaggtgattggactgccggagaattgagtcccagattaaatacagggaatgagtcccagttattagaatgctggagaattgagtccttgtgatttgtgccgtaaaattgcagaaattgagtcccaagattaagtgttgaagaatttttgagattgagtcccgtgattggaatgccggaaaagaatttagttccagtgactgggataccgaagaatccgtgagatgagtcccacgatggaagggataattgagtcccaataattgggattccgaagaagtggggagaatgagtcccagttattagaatgccgaagaattgagtccctgtgattttgtgccgtaaattgccgaaattgagtcccaagattaagtgcgaaggtttttagaatgagtcccagtcattgggatgccggaaaagaattgagtcccaatgataactaaattccaataagtaattttaggaaataactatagtaatgatagagcacaaattcaatatcgttcaaaaaattcagagtcgtctctaaaggtttaaaatcgatgagaaaactacgtttaggttaggcgcatgcttgcaatttttaataagcaagtccttttctaatttcaacagggactgaatagtccgataaaaatttaaaaatgcatttttttgggacaatttctttcaattctgaatgtctaaaacgattttgagttttggaccaattattaatgtttcattaggtttttctttgttacctattgtgccacaaataggctgctttatctatttttctttttaaatttagacaatatg

SEQ ID NO: 108332 - DNA, 74 bp, Heterodera glycines
  Promoter: Source sequence=SeqID_16945; Location=612..685; Strand=+; Gene=SeqID_81374
ggtcgcacggcatttaaaagcttaccaatcgctttccttttccttttagcgttgactttttgcgcattcgaatg

SEQ ID NO: 108333 - DNA, 67 bp, Heterodera glycines
  Promoter: Source sequence=SeqID_11535; Location=1153..1219; Strand=+; Gene=SeqID_74973
ggcagaaaatggagccctgactcttctaattgttttaacacatgcattttttgtagcatcacaaatg

SEQ ID NO: 108334 - DNA, 533 bp, Heterodera glycines
  Promoter: Source sequence=SeqID_36352; Location=556..1088; Strand=-; Gene=SeqID_65688
attaaagagaaaagagcctaggtttttctatgatatcgaattttttggcttaagtggctatttcaatcccgtggctttaactgggggttaaaaaataaagcccccggcggggctttattttagaagtacggtaacttccaagtacggtaatttctaatttcgccggtttttaaaaaatagcagtatgccaagaaagagatttaagatttaattaccagtatgtaacgataaaattacacaattaggtagatgggatcaaaatttttttacttacacaactcaattcctgttgaataaatttttaaatcaaactagcgaagcaaacagatacggtttggctttttgtatgcatattacttcgtatgaacattgacctgcctttgtttggatctgatacacgccctgatgatttctgattacttattagtcttgcaattaacaccttttgactatcgctttccaaatcggtgtttattaatggtaaacattcagtccattcgtttaaaaatttctgtccgactctctctgaaatg

SEQ ID NO: 108335 - DNA, 1003 bp, Heterodera glycines
  Promoter: Source sequence=SeqID_4203; Location=3003..4005; Strand=-; Gene=SeqID_45743
tttgggtattcattagtgcattaattaacgttcctttggcataaataaaatctttttcaccccattcctttttgagaaaatcgaatttttgcgaaaaaaaaatttttttggtgcaatacttttgcgtttgaccgtgagtgtataagatggtttttcaggtttgaggcaagactttttttgcactcatttttgggttctttgatctttcagcgataaaatttaatattcccaatttttgcctctttgaggcatgacttttttgggtcactgtaattgttcacttattttggcgagattttccattcactcccgccttttctttattaccgttcctcgtttccggaaatttctagcgcaaatattagcaaaaaatttatactgaatcttcgcctttattttttaattattgaacaaaaaaattatttttcccattgaaaggttcgtccttttaaattaacgcattcatagtattgattaataaatggattttgtgcaagctaacaaaagttaaagagcattgcatttgcttacacattaaatttattataggaatgggatcataatctattgacgaaaaacaattactcaaaaatgttatttgtattgtaattcggttgaaacttttcaggaaaaaaaatactaaatatcgggagaaaaatttatgcccttttttcaaaatagcgtctcggcgatcgtgattaataatataattattttttaaaaaataatttttggttgcatgtttcaattctatccatccaaatgattattgtcaaattttatttcatgcgtttaagccgattttgaagattgactttcgactttttgttcgaatccaggttcggggttaaaattaggtcgaaatggatgtcggaatcgaaaaccccttaaacaattttactctattttccaaaaaggtggccataccatcgggactattaccgaatattcatttgactttaagtgcgttctttgaaggattaaatacctaattctcttaatg

SEQ ID NO: 108336 - DNA, 367 bp, Heterodera glycines
  Promoter: Source sequence=SeqID_19791; Location=1724..2090; Strand=-; Gene=SeqID_84531
cctaaaaacgtgtgcttttcctgtacctctaattaaaaatggtaatttgaattttttttaaattttttaaaagcctattcaaagtgttttggattcaacgaacaaaattttgttgtttccgaccaaagagtatcaagagtatcacgtaatttgatgaattttattttaattttattcattcattcatcgaattggggatggatttttttttacaaaaacttatgcacctaatttgcctttaattagtaatttgcaagtattaattactaattaatgtgcgcaaacctttctatttaaaggcaaatgatagtgtttaattggaaatcattcgaatatttttttagcagcaaatttcacactgaaaatg

SEQ ID NO: 108337 - DNA, 512 bp, Heterodera glycines
  Promoter: Source sequence=SeqID_45194; Location=1..512; Strand=+; Gene=SeqID_72537
acaccaccagctgaatttgtgcgaagaaagctaaccggtttcaacgcaattaattactttttgcttaattagccttacatttgctgcttaagtccgggtaagggtattcgccccgggcggtttcaatctgacaaaatgtaaacagcagaaaatcaattgatcaagcaacacaaatgatgaataaaatgaccagagaaatgccaagactccacacgtcggtccgaatgtcgtacccgtcttgactcgctgttaagcgttctggctaaaaccaaagcatgttaattatctggtaattagtagttaattgtgttaatttgccactagtaatagccaatttatagagacagatttcccaccgacatatacggtctgcagccaatgtccttcgttttagcaattgagtccttaaataaaaattcgttttcgcgccgcaatgtgttcaaaatgcctcaaggtatcctgagattccaaaatcgcacagttttatttgaccacgaatgttcaacaaaatg

SEQ ID NO: 108338 - DNA, 530 bp, Heterodera glycines
  misc_feature (17)..(17): n is a, c, g, or t
  misc_feature (84)..(84): n is a, c, g, or t
  Promoter: Source sequence=SeqID_21769; Location=1..530; Strand=+; Gene=SeqID_52374
aaaatgaatttttattnttaaaacctacttttaaaaattatgataaaatataaaattaaaataccggctgttaatgcaaaaaanttgcggcttttttcttgtgttttaatttgtgaaaacacaatttcagaacggagttctgatttttttgaaaatcgaaagtttccagaattctggaaaatttttcatctttaatttataaaaactagagtccggtaaaaaattttttccgggaacgggaaaacgaaaaacaacggggcgggattcccgtgttttcccgcgggaatctcgttcccgccggactctaataaaaaccaaataaaaaattttattcttcctgtaccaagggtacccgcattagcaagatgccaataaggatattatccatgcaaattttctaattttatttttgttcgagttcgggtcagcggttcgaaattgggaaaaatgggtgctgtattcgtgatcagcgaccctaaaaaccccttaaaacttattttataaaacacatttataggcatttaaaaatg

SEQ ID NO: 108339 - DNA, 105 bp, Heterodera glycines
  Promoter: Source sequence=SeqID_11859; Location=3851..3955; Strand=-; Gene=SeqID_75358
tgtcttcttccaccctctccgtcgggtactgtcaactttttgcacacgccgccgcctcctccgccccctcggcctgcaattcatcagcctcatacttctccaatg

SEQ ID NO: 108340 - DNA, 126 bp, Heterodera glycines
  misc_feature (60)..(60): n is a, c, g, or t
  Promoter: Source sequence=SeqID_33841; Location=947..1072; Strand=-; Gene=SeqID_63787
caaagcgaagcggagacggaaaggtggcacggaaaaggattgggaaatttgttttgaaantagaaaaataaataaaattaaaatgcaaaaaataaaaaataaattttaagaattcgcttggcaatg

SEQ ID NO: 108341 - DNA, 664 bp, Heterodera glycines
  Promoter: Source sequence=SeqID_6456; Location=352..1015; Strand=-; Gene=SeqID_61658
tattttcccacacgattcgagaatcgtatataagaaatttgttgtattcttgactacagtccagcaggagttattagtatagaaaaaatgaaagtgattcattttttaataaaaataatcatacgaatctttattattaccacttactcaattctaaattttgtatatgcaaattgtatattaatagtaattcatatgtacaataaatcaagtagaaaatcaattaaaaagaactgccgaaaccaatcactgtcgaaaacagctggtacggttttatcgaacttaactctttttataattagaaaaatcgcactaaattttacagatatactccccggtacagaactaacttatcctgaaaatatttcaacgcatattgattgtaaaaatttgttcgaaattctgagtttccaatatttttttgcaacattaattcataaaatattttttgaaaaagtgctctgaaacgcaccaaattttaattgaattttcattaaaacatttttcactcgatctttaggggtgtgtttttcccgaaacttcgggtaagttacccgaagccgaagctcgaagttcgaagccccaaaaacgcgaagttttcgaagcacgaagctcgaagtttcgcccacccctggttgggattgatagagcggtgccgtgaatg

SEQ ID NO: 108342 - DNA, 1003 bp, Heterodera glycines
  Promoter: Source sequence=SeqID_9351; Location=1260..2262; Strand=+; Gene=SeqID_71095
acatttcgaagtgtttggggtaaaattgtctttttttgataaatcatttctataaattgaaagttccagcagagaacttcgaaatccaatgacgaattaatgaattcgagatttcattagtttctacaatcgaagaaaaaattttttaatttgaaaattatgttaataattaggaaaaaagtcgatttttagggggtgtatttttcaattttcttgtatttttattgcaatttttctcaaaaatgccaaaatatgtgcaaaatatgtgccaaaccccaaaatatgtgctaacatattttatgtgccaaaacgccaaaatatgtgtttttatgtgtttataagtcgctctaaatcaaaaattgttcggagataatgctatttttgggcttctctcgccataactaagccgcaaaaaaagtatgttaaaacataaaaatcctagccctaataatcatgcataccaattgtcattcatttttaaatagaattttcccatttcgaattattgatgcaaaaacatatttttggactcagaagttcttaagtggaggagaaaattcaaggaacaaccaaactatagaggtaaataattttaaataagttttctaataaataaaattgagaaaaattttatatttattttttcattcaaataatttttttgtttatttaaaagtttaatttttcttctttaatattaatgttatggccaaaaaatattataaaaaaatgatttaccttttttaaaacgctacaaaatattctttatttctaaaaataaacggaaagaaaaaatatataaattaaaatacaaaaaataaaacaacaatattgttgttgtttttttttaattttatttttttggttgttctcctaatagcctatttaattaaatctattattaaacaatgcttatgctttataaaacttcaaatttattctccgtttgtctaattacacattgacacaatacgaaatttcgaatttcttgagggtaattatg

SEQ ID NO: 108343 - DNA, 94 bp, Heterodera glycines
  Promoter: Source sequence=SeqID_2752; Location=2899..2992; Strand=+; Gene=SeqID_81415
aagctggtgagttaacggaagggaatttaacatttatccaactaattaagcgtgaggaggaacgacgggagcaagcggaggaagacaacgaatg

SEQ ID NO: 108344 - DNA, 173 bp, Heterodera glycines
  Promoter: Source sequence=SeqID_14149; Location=1017..1189; Strand=-; Gene=SeqID_78150
tcgggatcggggtttgccggggtcgggaaatgccccctttcgaggcttgcaaaatgtcggggtcgggaaatgtcattcctctgggttgaaaaatgtcggggtcgggaaatgtcagttctcggggttgaaaaatgtcggggtcgggaaatgtcagttctcggggttgaaaaatg

SEQ ID NO: 108345 - DNA, 370 bp, Heterodera glycines
  misc_feature (35)..(35): n is a, c, g, or t
  misc_feature (39)..(39): n is a, c, g, or t
  misc_feature (98)..(98): n is a, c, g, or t
  Promoter: Source sequence=SeqID_35700; Location=1..370; Strand=+; Gene=SeqID_65189
cgacaggtcaaatgggtagtagtgatagagacaanttancattggtgatgaaaaaaatgaggtcaatgggcagttgtgatatgagttgaaatttaatntaaagaagcggaaaagtcgacctccagcaaagggaaattggtttttataacaatttgagtaaaaaattttttgtgggaaatttttaagaaatttgtagtagaaataaatggaaaaatgaaatgaatttcaataaaattaaaatgaaaataatgcaaagaagtttttatgtgagaaaaagaaaaaaaaacattgacgatttgatgaatttaaaagtttatatggccaaggcaaacagaaagaatttgtgaaggaattgggcatttctgaaatg

SEQ ID NO: 108346 - DNA, 79 bp, Heterodera glycines
  Promoter: Source sequence=SeqID_21694; Location=837..915; Strand=+; Gene=SeqID_52305
attactttttctcggccacatcgtatcttcaaatggcatacgccccgacccagcgcgctcagaggcaattcagaaaatg

SEQ ID NO: 108347 - DNA, 314 bp, Heterodera glycines
  Promoter: Source sequence=SeqID_18054; Location=1..314; Strand=+; Gene=SeqID_82646
ggagcagatgttggaggacgaggaaagagagaaggcggcggggggtgccgaaggtgaacagatcgccaaaggtgggcactatgatcactcagcagcaggcagaggtataattagtgttaatgcgcgattggaaaacgtcaaaagggtcgatcagagggggagtggggagggacggggattgccaaactgatcagcaaaattgcccaattacctaattacaaaatgcaacagatgctaactcaactgtctgtggcactgtgcattcgcaatttgttgaggcatttcaccagacaattgtcgccactgaaacaatg

SEQ ID NO: 108348 - DNA, 1003 bp, Heterodera glycines
  Promoter: Source sequence=SeqID_12251; Location=435..1437; Strand=-; Gene=SeqID_75838
atctctggacaaaaaagtgacttaggactccgccactttaagcagattaatttacccgctcaaacccaaagtcatttttacaaaatgtcatcatcatctcccgaaaaaattttggctcaacctccgtctccgaaaaagtgcaaagttgatcatcgagctatgtgaaaattttcaaaggcaaatacatgttagcaatttatctctgtgatgatgactggcggaatcagttccacaacaaagagaaagttcgccgaatgggcaatgatcgtgtggccctaagtttcgaaatgtgcgaaagttgtgcgcgtgtgaattgcaacggaacggacatattggctccgtcaaagaaacgtaaacttttaacccatcaagcctaatgagatcatgatataattattttattattattattatgtattttacaatcgaaccaataaaaaaataatctaattcaatttgcgcaatggtggcaggggaggggggggggggggtacccatctgtcggcagcaaattccgcatcagttgttgttgttgtgttgttattgttcggcatatcctcacacactctgccctcatccttttccttccttatttttgcattttatctcccaccctcttcacggttaataaaaatgagtgcaaattccgcatcggttgaaagtgaaattgcgtcactataaaaaaattattggcgcacagtccgtaaaattgatgcagatgcgtcaccattttgtgaactaccgcttcagacttgagaaacttgaggcttgggccggtgaagtaaggtattcaatgttttttgtgatcacagtttttaactagggtaaagacaaaatgtttgttcgttcacaacacgcaacaaacgattttctgtggacgacgagccagcaacatcggccgcaacttccggtaatggtagtgtaatattactgggaacagtgcgctttttcagatgggatggcaatggaaagcttcaaaaaagattttttggaagccaaaatg

SEQ ID NO: 108349 - DNA, 436 bp, Heterodera glycines
  Promoter: Source sequence=SeqID_26962; Location=1..436; Strand=+; Gene=SeqID_46020
ctccccaattcttctttccttttgtgaatttttccaattattctcaactatccacatatcattgatccatctccttttttttcgcccatccatccgcacaccccccaccctaccctctacacaaacagtctccgtaccagtcacccccttcgactgtgttgtgcacgacttcttccagccgcccccctcccaatataatcgatcgtacacttcacataacgaagttccgaaaatatctttctttgctctttctttttcgtttttcagttatcattttaataaataatacaatttatttcatttatgtaaaatttggtcaatttcaataaaaattcagattttttcttacaatagaaattttttgcctttttttcccctattttttacaattttattccgttttgcacaccggatcattttgaaacaaaatataatg

SEQ ID NO: 108350 - DNA, 1003 bp, Heterodera glycines
  Promoter: Source sequence=SeqID_3406; Location=2361..3363; Strand=+; Gene=SeqID_84550
ataaaacaagcaaatttcttctttataaattcgtaaatttctgtcgcattattagtttttccgtaattatttcatgcactttgtaaattccttcttatgtaaatgtgaatttcggaggctggggtgaaatttgaatattaaacccgggccttacttactaattttcgggcccctggaagccctacaaagcgctttgaaatcgattgaagttcggaaaaaaaaattttcgatccaatttaggagtccggagaccggataaagctggtaaaatagacgtttctttttgttagaagtatttggtcatttattatttttacattatcttggcaaaaagggagaaaacatgacaaaccgtaatctaatgccaaggggtgagtttgaggaaaataaaatttgaagaatttgttgacaaaaacgagaattaaaatattttcaagatttatttttttccggaaattatgcgtattaaatcgtttattgtaggaatatcaaatttgaattatatttaaaatttgtgatatttaaattatttgaagttttattatttagtcaaattaatgcacaaaatgatgattaatgaaaaatgactgtttcttcagtcgttccattatttgctgtaaatgcgcgcttatgagatcataaattgcgtatgcccccgaggaaaagcattcgggtgattggtctagtggtatgattctcgctttgggtgcgagaggtcctgggttcaattcccagatcaccccaaaatttttaggtaaattttcaaaaaattgaacatctaataaggaaaaaaaaaattattttctcactatccattaattatttttgttcctcaattttgttaaattttttgcacgtcgtgttcagcgtataaaattaccattaaaatatttaaattttcagcggggggggggacaaaaagtaaaagtaccgtttatttaattttcttttattttaaaacgaagaattcataaatatttttaaaaattttagtccaaaaatg

SEQ ID NO: 108351 - DNA, 106 bp, Heterodera glycines
  Promoter: Source sequence=SeqID_8773; Location=1..106; Strand=+; Gene= SeqID_69182
taatttaaagcagtcagatttatgggaatattttgaatcggcgggattggccgggaattctattttgctcggagatagtggctatcccttaaaaaaatggctaatg

SEQ ID NO: 108352 - DNA, 185 bp, Heterodera glycines
  Promoter: Source sequence=SeqID_4131; Location=1127..1311; Strand=-; Gene=SeqID_53301
agttcagcgtcagcattttcccaaaaaatgggactgagtcggcgtcgccttcgctcgccaaccctttgtcggtgtgcagtggcagtcgccgttcgaccagcgccgactcggagcgctcacttcgactagaaatcgcggaaagcagcggaggcggcacaagcggagcggaatcgccgctggcgatg

SEQ ID NO: 108353 - DNA, 363 bp, Heterodera glycines
  Promoter: Source sequence=SeqID_26126; Location=906..1268; Strand=-; Gene=SeqID_56874
ctaaacgaacgatcagaaagaggaaagaaagaacgaaagaaagtgatcaattggcggaaacggcggaacgtacaaaaaacgtcctcaaaacaaaaataaataaataattcgccaattattgcagcggaatttcccattaaaattcagtgaaagtaaaattatgaggcaataaaaaggggatgggatgaacaaaacaataaaacaaaataaaaatatgaaaataaacaaacggacgaataaaatgccaattttgtgggggattaataaaagcgaccgattagagaattatggcaaatgttttgggactgactgagccattggcctaaaagtgacagagattcggatcagagtctcgtcaaaatg

SEQ ID NO: 108354 - DNA, 62 bp, Heterodera glycines
  misc_feature (12)..(12): n is a, c, g, or t
  misc_feature (21)..(21): n is a, c, g, or t
  Promoter: Source sequence=SeqID_30106; Location=49..110; Strand=+; Gene=SeqID_60546
agtaataaattnaattatatntaatattgtgccaaatttgccaatttgaagccaaaccaatg

SEQ ID NO: 108355 - DNA, 1003 bp, Heterodera glycines
  Promoter: Source sequence=SeqID_12565; Location=1298..2300; Strand=-; Gene=SeqID_76226
cattaaaggcttgttcattctctttttactatacaaaacatttttttcattcaaacaaatatcaaaaatcaaatcagatttttttcgtatgtattataatcaaaaaagtaccaatagctttttaagaaacaaacaattttcatatcaaaccaattctaattcagttttctaatcaaacaattctccaaaatcatttacataatcaaaacataaccattcatatcaaaaaataaatcaatttaacataaataaataagaaataaaaaatttgacagcacaaaaaagtgggaattttcatttttaatagaatgcttttttgcaacgcagaaaacaaaaaccaaatatttcttttttttcaaattcatttttaacgcaaaactcaaacaaaacgccacacaaattcaaacacggacacatacatacatacatacatacaaacactcaactttattatataggatatgaatgaaatttatgaagaaattaattcaaaagctttaaataaatttttaccaaatttcttataaaattttctaaaatccacaaaaattcttaaaacaaaaattattggcccctaaaaagctgtacaaagtgtatggcctcatatttttttttgttgtttaaattggccaaaatatttaaaattaaaacggatggttggggggactcatatgccaaagacccatttgtaaggaacacagttttcatcatcacttcactatcctctgattgttgtgaggtgatgattgatttttggaggaaaaaactttacggagagaaaggctttttggaagttttaatacattgtaaattgactctgattgaccttcagttttttggacttttccttcgcaaagaaattttcttacagaataaattatacaatacatattattcctctaacaataattattaataataataataaataatttataaaattaagcaaattttacaaaataataactaacgaatttgcgagtttcttcaaaaattcatgatg

SEQ ID NO: 108356 - DNA, 70 bp, Heterodera glycines
  Promoter: Source sequence=SeqID_14804; Location=1..70; Strand=+; Gene= SeqID_78953
ttttagccgtttttttttgccaaaaattactattttttgctcattttggtctccatttttcaaaaatatg

SEQ ID NO: 108357 - DNA, 1003 bp, Heterodera glycines
  Promoter: Source sequence=SeqID_2930; Location=3042..4044; Strand=+; Gene=SeqID_82395
tcagaatcaagagtcaattctaataattttttaaaggtgtttaaggagctagacattaacgttttatcaagggcattccaggccttgactgatctgttaacaaaagatttggaagattttttagattgtaatttaacatttaaccggaaaaaagacttatttcgagtatttaggttagttcttttaaacagagaatttgggtccaaatgtgtaaaaccatgtaaaattttgtaagtagttaggaggtcaaaaatttttcttcgtttttcaagagtagctaatttaaaaaattggagccgttggtcataggtagggcccggatttttatgtgctaaaaatcctgaaatatgtaataaaatatgtgctaaaaaatgctgaaatatgtgctaaaaacccccaaaaatgccaaaatatgtgctaaaatatgtgttaaaaattgaaaaaataagtgtgtttttgcataaaaattcccaaaaatctcattctttatcatttttagcccatacaacgcaaatcaaatacatttcgaagtgtttggggtaaaattgtctttttttgataaatcatttctataaattgaaagttccagcagagaacttcgaaatccaatgacgaattaatgaattcgagatttcattagtttctacaatcgaagaaaaattttttaatttgaaaattatgttaataattaggaaaaaagtcgatttttaggggtgtatttttcaattttcttgtatttttattgcaatttttctcaaaaatgccaaaatatgtgcaaaatatgtgccaaaccccaaaatatgtgctaacatattttatgtgacaaaacgccaaaatatgtgtttttatgtttttataagtcgctctaaatcaaaaattgttcggagataatgctatttttgggcttctctcgccataactaagccgcaaaaaaaaaatgtaaaaacataaaaatccggtctctatatattattatttaattaattttggttttaaaacaatg

SEQ ID NO: 108358 - DNA, 107 bp, Heterodera glycines
  Promoter: Source sequence=SeqID_12894; Location=2458..2564; Strand=-; Gene=SeqID_76629
aggattactttatggtggaaaaacaattgagagaacgtcgtgttggaatacaaaatttctcttcgatggttttgtttgaccggaaagcgaagcagcgacaaaaaatg

SEQ ID NO: 108359 - DNA, 111 bp, Heterodera glycines
  Promoter: Source sequence=SeqID_7280; Location=1..111; Strand=+; Gene= SeqID_64337
atatatacatatatatatttatagtattttacacttaatgcgcttgtggcaaaaatcatcataattgctaattcatagtttacccctcgtacccagttacgtaaaaaaatg

SEQ ID NO: 108360 - DNA, 166 bp, Heterodera glycines
  Promoter: Source sequence=SeqID_1635; Location=541..706; Strand=+; Gene=SeqID_74990
tgtcagtgttttggtcccggtcccgctctactctattttttcactaatggtactcaaattttactataaaagttccctggtttcttcttcccctcctcattccgttcattcgctcattcatttttaaccgaaattttccccgctcatttttgttgctgcaaaaatg

SEQ ID NO: 108361 - DNA, 272 bp, Heterodera glycines
  Promoter: Source sequence=SeqID_45509; Location=477..748; Strand=+; Gene=SeqID_72792
tttttggcatttccttcgccccgccctccctttgatttgctttgcttacaatcggtcgtaagctgcgcgttgtcggctttgaactgtccgttcgtcccttcgattctctgccaatttctgtctgagatgacgagtgccgaaaatgacttttgaggagggaaactgaaaacagaaggaaagtgatcagacgaaaaaaagggacggaccgtacgaatgccaacgaacgcgcgattggaagagggaaaagcggaatcgaagccgtagaagggatg

SEQ ID NO: 108362 - DNA, 934 bp, Heterodera glycines
  Promoter: Source sequence=SeqID_6546; Location=800..1733; Strand=+; Gene=SeqID_61959
gcacggaaagggaagcacaaccgaaagaaagacagaacaaagccttttctaattggctaattaataataccacgaaatgtcacaataaataaaataaatgtgtcataataaaattaacaatttgagcaaattaaatggttaatgagaagagaaaagggactgattgactgctgctggacggggatgggcccggggatgggtcagtgacaattggacaatgattaaattgataaaacttaaatattagtgacgtattgtccattgacagattgtctgctgggcatcataaactcacgtagtccatttgtcaatataaaaattcaggaattagataatcgggaatttattggaatttaattgttccattttttaaataatttttttgtgctatgaaaaatctatgcaattaaaacgggaccagagcgtttgggcccccgtttttgggcccccgcgtttgggcccccgtttttgggccccgggggtcgtttgggcccccgttttttgggccccggggtcgtttgggccccaacccaaaaatcgaaaaatgtgcttttttaaaaattaagattctaaaaactaagcctgagggatccctcgccacttggcataagttaggtttaattaacattcgctcattttttacaattttacttattccaaatcctattattttttaatagttaaccaatttgatgtacattctgatttggacatttttcagaaatggctaacccaattgcaaccaaaaaacaaaaagtaaaattgtcttacgaaggccacctttacaccttcgctaaaatgagttctgatgggatgacaaaattttggagatgcgagttcaaaaacagcaccgacaaatgcaacggccgaatctggacggacctccacgaccaattcattcgcctcgcaactccgcacacatgtccagcagatg

SEQ ID NO: 108363 - DNA, 224 bp, Heterodera glycines
  Promoter: Source sequence=SeqID_4203; Location=1176..1399; Strand=-; Gene=SeqID_53585
acacctttttttatcagaaggaatttcttatttattctccctttctttggcaaataactttgtattttcacatgcataacatacagtattctaaccaataaatgataatttatttattttcacaacgaattcttttatttattgattattcatattttggcttacttatctaacttacacattttccgtatttctgtttaacattgagtatttttgtttgaatg

SEQ ID NO: 108364 - DNA, 1003 bp, Heterodera glycines
  Promoter: Source sequence=SeqID_10045; Location=2190..3192; Strand=-; Gene=SeqID_73107
tttttttgcaattaaatgagcaaatagccaccaaaaaatgtagtggttgcttaaaatcgcagtcatttggatgatttaacccgttttttaaaattgtctcttcttttttgtgttaattgcataatttagtattaattcctaaaaatttgattgattttctttgtttatcatttcaaattagataggtttgcatttaaattttgactattatgtaggtaaagtcgtaaattgaaacagtgggtaccggttgcgcattagttaatccatcgatttttatacataacatttaatggtaatggatgaacataaatgtacacgagttaagggggaggggggagatttgccgacaaaaaagttaaacatattaacattcaaaattttttgttgtcatacatattttacgttggtattcaataattgatttataatgacatcatcactaaaaattaaaatattttgtcttccgattccattttccacaatgcttttcgctttgaatattataattaatgcttattaaaattaggtatgcttctgctgtatgcaagcacactcattcattcatatgtttgcgcacctttcattcaaagatttcccaaaaaacagcgaccaaagtgttcaggggagaagggaaggggcaggtggggtgcatggaggcaagaaatgtaaaaaatgcattaatatttattattttcttatgtaattaactctgcttttctttgtattgcatagaaaaatggctcttaattaaatgaaatatataaaaatataaaattgcatttttgtttttctgtaataataataaattaggtattttaaattgctttcatctccattatcatatcacatatcatttacacattttgacttatttcatgtgtctcttaagacttaggcttgattgtttattgcttcactcccacatacacatattttttttctcatattcaacggccttgggcttttgctttccaattggtacagtcagtgtcaaacagaaatg

SEQ ID NO: 108365 - DNA, 736 bp, Heterodera glycines
  misc_feature (522)..(522): n is a, c, g, or t
  Promoter: Source sequence=SeqID_16314; Location=2339..3074; Strand=-; Gene=SeqID_80706
ttaatgataaaaaatccacgattaagataaaaaatgtttgtttctcccaattttttgtccttttttacggtgaatccgaaggagagtaaagcgtaaggggaactaaataaattaaaaatttgtaaaaatttgtctttaggataataaatgctgtttatttactgatgcattttttttgattgaaatttcaaagtaaaaaatgccggagaaatccttgccaaacaaaattggatgggtagctaagacaatgcgaaatccgcctaaattaaaaaaatgtattgtaaatttagatttaattaccttcatttccgttatggcaatggacccttaactcagtgatttgaatctcattattacaagctttggcatccccaagattttgtcggaagtttaaaagcgctttaaacaaaccaagaatgggagccggcgcaaaaaaagtcaggaacaaaagaaacttcaaaaaaatcatacgtaataaacaaaaatggagattaggattttgacgatataattttagcgcgngcttattgggttttcaatatttatttagaaaatcaaataaatagtgtttttagcttgctttgaaaataattgggttttcgcttttgaccgaaaaaataattgctttaaggtatttcgagaatttgaaccgattttttgacaaattttgtaatttccgaattttgtttttttaagatttgcgatttcaagaatcaaacagaaatatttggaaatg

SEQ ID NO: 108366 - DNA, 110 bp, Heterodera glycines
  Promoter: Source sequence=SeqID_7583; Location=301..410; Strand=-; Gene=SeqID_65308
ttttcggtgtttcatataaataatgacaatttgagaattttaattagaaaaattgaaataataaaacgtaataaaaaaatgcacttttacagaaaaaaacagagaaaatg

SEQ ID NO: 108367 - DNA, 87 bp, Heterodera glycines
  Promoter: Source sequence=SeqID_20976; Location=511..597; Strand=+; Gene=SeqID_51551
tcaggcaccaattttcatattttttccctttttaaataatttcaaatttactctaaaaatgtgtagacatcgttgctgtgccacatg

SEQ ID NO: 108368 - DNA, 197 bp, Heterodera glycines
  misc_feature (7)..(8): n is a, c, g, or t
  Promoter: Source sequence=SeqID_14577; Location=2958..3154; Strand=-; Gene=SeqID_78651
cctgcannggtcttgtaaaaatttaaattttgaaaggcatttttgtgggctttaagtatattcgaggctgtggggatcgaattctgcgacatggctttaaccaaacggccgcccaaatctaccggctaaaccaggtgttgtttatgtggaaatggaaacttgtcaggaaaatttaaaaaaaaacaggtggacaaatg

SEQ ID NO: 108369 - DNA, 678 bp, Heterodera glycines
  Promoter: Source sequence=SeqID_11617; Location=1202..1879; Strand=-; Gene=SeqID_75065
tcactatccaagcaaagagaatttcaaattctgcaagttgagaaaaactttctttttaaacaaacatactatatatagataatatggttggacggatccggacccaagtaacaattttcgtgctggggggtcatagggaggggggggggacgacaaacttacgaacggggtcctgccagaatcgacgagtttttttttccgatttttgcgattttgagcattttttaatgaaaattaagtttttgtggttctgcgatgctgataggcgttgccagggaaattttttaagaatttaaagaaatttgtttaaaaaaaagttgaattttcagtaatttttcttttgttcacttcgtttcagattcaatttctaacgatttaagtaaaaatgaaaacatgaaaatgagttaattttaattattattgcatcatttgattttttttaaatcctcatgaataattaattgattaactgtctccattaattgattaacaggccagtgtttacctaatttttatctaatgtaatggggagtttttttattgtcttctcgcccatttagcctgtttcctttccacttcatgtcgtgcgtgctttaccactttggtcatatttcttctcgaccactgctcattcgaaccagcagataagcaacaattccgtgtctctctctctctatg

SEQ ID NO: 108370 - DNA, 156 bp, Heterodera glycines
  Promoter: Source sequence=SeqID_18965; Location=1108..1263; Strand=-; Gene=SeqID_83699
ggtcgttttgctgtttgttgtctcattggcactcatattactcaattcagtcccgttccaagcgttgtcctaccaaaggatgaaaacaaatcctttgggtctgaaggattgccaaaggttcagtcggagcaacgggcggcggacaatttagaaatg

SEQ ID NO: 108371 - DNA, 1003 bp, Heterodera glycines
  Promoter: Source sequence=SeqID_11212; Location=1212..2214; Strand=+; Gene=SeqID_74570
atagaaatttttcaaaattggaatatcatgcccaaaaaatcagattttcaaaaatgagaacatttaacaacatagccttaaataatttttttacaatttaataaattaatatcaatttttgtattttcgcctcagatgatcatttttaataattttgagaaacggaatcaaaaaatcagatttttaaaattttttttgctgcaaattttttcaaaaactttaggggaaccggggggggggaggtcggcaaaatgcctaaaaaatttgccaaaatttctaaaaaaattcatttttttgggggtttacttttaagaaatttccaaaaagtcgatccttaggggtgtattttttcactttttttccattttcatgtgaaaatttgctaaaaatggccgaaatatggacttattcccgaaacccccaaaatatggatttatatggactaaaaaccttcaccaaatcaaaaaattttaacgtaaaaatgatatttttgatcccctttcttcatagcatatgcgcagaaaaaatatgtttattcaatataatttataaccctactacatatttacggaaaaaagcaaaaaaacatatacaaggtgacattttgatggaaaatgcgtcagtgaatcaggatttattcaaaaacgagtactttagtattattacctgaaagcataagcgttgattggtatgtaagcaagcttacaacaatccattagagtataatttcatgttattagtgaacctttaaaaacttaattgaaaaaattagaacgaaatttttctacattctgaccttttgtaatacaatacttaatgaaacagtactttattttagaaatactgtattactgatgcattttctactgacgctttttacacttacgctttttccgggaaccttttaaatcagttccccgataaaagctgaaaaataatttaatgaaataacctataacaatgagagtataaattttttaaaaatttctcaaaggttgagatg

SEQ ID NO: 108372 - DNA, 75 bp, Heterodera glycines
  Promoter: Source sequence=SeqID_21022; Location=2706..2780; Strand=-; Gene=SeqID_51602
gaagaggaacagaaagtggaagaggaagtggaagacgaacagaaagtggaagaagaagtggaagaggaacagatg

SEQ ID NO: 108373 - DNA, 57 bp, Heterodera glycines
  Promoter: Source sequence=SeqID_32975; Location=971..1027; Strand=-; Gene=SeqID_63183
atatttatttttaaatctatatttgcctttttctttcggatttccagggactgcatg

SEQ ID NO: 108374 - DNA, 411 bp, Heterodera glycines
  Promoter: Source sequence=SeqID_1129; Location=2992..3402; Strand=-; Gene=SeqID_68304
taatatgaaaaatgatcgattccgggttcggggttcagaatttgtcaaaaataaggtcggattcgtgctcagtaccctaaaaaaaaacgggaccagtaaactgcaggattgcctttaatggtaccgaaaaagtgccggtggtgtaaaaaaacggatgaaattttgcgcattaatttcactattttactcggagcggattatatataactccgttcatagttttacaaaccggacccattaggtaccattcgatagcattaagtgtaaattttgtaattaaatagagaaaccattgggctatggaatgacatcaaattcatctaattcggacaaatacggggggtcttttgaataaaaaatgaaccccatttttcaataaatttttgtttattaaatttcattttttcgatg

SEQ ID NO: 108375 - DNA, 58 bp, Heterodera glycines
  Promoter: Source sequence=SeqID_43504; Location=1..58; Strand=+; Gene= SeqID_71145
atttctaaaacggttataccaacccccagatttttgaatccggttttcagaaaaaatg

SEQ ID NO: 108376 - DNA, 895 bp, Heterodera glycines
  Promoter: Source sequence=SeqID_9499; Location=1943..2837; Strand=-; Gene=SeqID_71646
attgccaattaagaaacaaatttaaaaaattttaaatttgatattcaaatatttttctttttctaattgttaagaagagaatttgtattacaataccaaatgtatgaaaagcatattgttttcttgtttttaaagcttctatggcatagttttttgtgcttttttattgatcaaattaaaattttcttttagtataaatattttcataaaatgctatgaaataatgggtgaattttttgagtatcaattttcataaatttgaaattgaccggaaaatgctgtatggccaatgagcaaaaaaaaaggtcaaaaccaggaaagtgtgccgactccctcaaaaaaattcggcaatcggaaattgtgacgactgaaaaaatttcggccggaattccgagtcccaaaatgtcgtaaatcagcattccggcaaatctcgagttattttctggcaacagggcctagtctaattaatcatttcgtcagcaggtgttatgccgatggttgcaccaacatggcatggcggtagtgtgcagttgtggcccaacaactcaaattggccaacaaacgaacattttcgattttggcataagcaacgaagacatgcgacgcttgaatagcttgtacaacagaaatgtcattgcgcggccatatcagtaaattaaattaaaaaataattacttaatttcattttaaatcacaaattaatggaagaattattggtaaaatttttcgatttaaaatttcattaatttgcatccaatagcaaccgatcttttttgtggcctttaatgaatgaataatgctttaagaattttgagtgtattataagtcaacaatgaacacaatgcttaagcccatttatttatgagtattttacaaaaaaaaatatttaaatatg

SEQ ID NO: 108377 - DNA, 269 bp, Heterodera glycines
  Promoter: Source sequence=SeqID_3350; Location=2078..2346; Strand=-; Gene=SeqID_84323
tgtatttccggccttcaccaactgatggtggtgcccaattagaggtaaacggcttaatatacgacaactcgcatgtcgtgccgtataatccttatattctgctacgttaccgagtacaccataatgtactgtttgcatatggtaacaaagcaaatattaaatacgcactcaagtacccttttaaagggccaggacattgttatgtcgagtgcaaagaagagtccggcaataaaatcaaaattgacgagccggctcaatatgccaagatg

SEQ ID NO: 108378 - DNA, 497 bp, Heterodera glycines
  Promoter: Source sequence=SeqID_7096; Location=1728..2224; Strand=-; Gene=SeqID_63825
tattcgatgaaattgattaactaaaaaagttttatttttgttgattttaaccaaatatttgaatttttatatttttgtttggcgccgaaacgcgggcgccgaaacgagctggcgccgaaacgcgagcgccgaaacgcggcgccgaaacgcgagcgccgaaacgcgggcgccgaaacgcgtgggtccccttggggcaagcccgggtccactgcgtttgggcgcgctcgttgggcgccagcatgtttttccacgaaagctttctataacttttttcaatgtcatccaaatccaacatttttgatacattcgaaagcttaacatgtttagaagctttttctaagctactgcttcacgattagacaattaccaaaacaatccttttcaaactttgcatatctatagagaaaaaaattctgcaccgtttaatgctgattttattattaattatgctaacatttaaaaaattagattattttttctttttaataggatttatg

SEQ ID NO: 108379 - DNA, 175 bp, Heterodera glycines
  Promoter: Source sequence=SeqID_16577; Location=841..1015; Strand=+; Gene=SeqID_80984
aggagacttgcttaatgctttgtacataaccccctctgcgtttaaaaaaaaaacaaaaaaaaattaaattaaaaaaaaaaatatgtattttacattacccatttattttagtgtatcacttagtccaaatgcatgagtttagaaaaagttgaaaacaaaaatttgtcttctaatg

SEQ ID NO: 108380 - DNA, 142 bp, Heterodera glycines
  Promoter: Source sequence=SeqID_3320; Location=4930..5071; Strand=+; Gene=SeqID_84197
ttttcgtccctaaaactcaaataaattattaaaaacattcaaaaattttttaaaaatatataaataattaaaatctttaaggatttttttcattttacttattttaagaaattcacaaaatcatttcttacaatctcaaatg

SEQ ID NO: 108381 - DNA, 947 bp, Heterodera glycines
  Promoter: Source sequence=SeqID_4152; Location=1528..2474; Strand=-; Gene=SeqID_53381
attttgtcctaaatataaataaattattcaagcttaaatcatattaatcatatatttaatttcaaatatttcataatttttttttcgagtgtttctccagaatccaggtcttcgatcccaacaaccaatttgaatgatttgcataataattaaatgagggcatattaagatttaattcgaaatttcagaggcagctatcaaataattgaataattaatttagaaaaattttctcatattttcttcagacttttaccaagaaatctcgtttccatgagctaaatagttttattctgaatataaataagttattcaagcttaaatcatatttttcgagggtttcttcagagtcccatttctcgatccaaacaatcaatttgaatgatttgcataataattaaatgagggcatattaacttttaatcattgttcacactagcttatcaaattatttttgttcatcctttatttctttgttacttaagtgtccattttcactggtactagttgtcccagtgctctgatggcctcgtcttgactccatcccaaatttttagacttagctcgtcaagagctttcgaatgataccaaatttgtttggaaatttttaatttaaatgggtttttggctgatttttggtgcaatttttcgtgatttaaaccggctcaaaaaccggttttttgatttttccgcacctcgggaatattttttacgatgattagaggtcataagagattgattggaacacgttttgggcgtttttttaacggggccacttctaaggtacaccctggggcgcttattctgcactagaatctattaatttttttaaataataaaatggatgttaaaaatcgcaaacgaatggaaaaataacaaaatggaaatggataattgaaatataattaattattaaactacctatgtatgaattgtaggaaataaatg

SEQ ID NO: 108382 - DNA, 290 bp, Heterodera glycines
  misc_feature (54)..(54): n is a, c, g, or t
  Promoter: Source sequence=SeqID_39639; Location=660..949; Strand=-; Gene=SeqID_68156
gatgagcaaacggagtgcgtcccacgaggggaaacgatgaacggagcgcaaatnttgtccgttgtttgtttttttaccactatttttgaacctcttatttattcgaccatttttgaatctctctatttttgtttttgaatggataaaaacgggttgcatcgtaccaaatgcgctttcgatcacagattgttgcaaaatgcaatttaaacgatgtataaatgtttgtgaaggagaggcatcattgcgtgttgttttgccattgacactttcagcaaacaaacaaaaaaatg

SEQ ID NO: 108383 - DNA, 555 bp, Heterodera glycines
  Promoter: Source sequence=SeqID_31047; Location=1138..1692; Strand=-; Gene=SeqID_61418
tatttgcacaatttctaaccaccagtttaatatgtgataaagaaatgccaaaaaaaaaattattatttttacattctttagccataataattattagaggacaaattaattggaaattaaattgaatatcgtatattttttaatcatttaaaataacattgaataatatccgtaaaaataggcaaaagaaattttttttacaaattttaatagttccatcatcgccattgcccaaaaaggaacaaacaaagccattggtaagtatttggaatttagaaattttaaaataaatttttaatatttaaaattaaaattaaaaaataaataaataataaaaaaatgtagtttaaacattttgggtttttgtttacgaaaccccaaaatatgaattttttgacccaaaaaacttcattcaaattatataaaccttcatattttaattccgactcggtttaacaaagttttttttttaataagtttccatagattctgccaaaaacgcctccagcatcagtgccaacgacacgtcgcactactgtggtgccatcgcaaatg

SEQ ID NO: 108384 - DNA, 475 bp, Heterodera glycines
  misc_feature (341)..(341): n is a, c, g, or t
  Promoter: Source sequence=SeqID_24649; Location=652..1126; Strand=+; Gene=SeqID_55385
atccgcgccggcccaaatacgatttcgtaccgatcagggcggaaagtgtcaatttaaaaggggaggtgttgggacgacattttaaatgttattcttttggcattttatttatgtccatttcagtccctcacacaattgtttatccgccattgacccagtcaattcattctgtccgcactcatcttctcctccgcattgtttttttttataatttaggtgttttttttgaacgaaagtattattgaaaatatttttaataatataaaactcctggcaattgtaccacgatgcatgtttatcttgttccaatctgcgcaatttatatttgcttcatttaattntaacttgttaatgtttttttacaaagttatcttaattgtggttttataaatttttaaattccaatgttcgaatttttattttttttttcaaataggctgtaataatttatataatatttttaaattttgagatg

SEQ ID NO: 108385 - DNA, 225 bp, Heterodera glycines
  Promoter: Source sequence=SeqID_20242; Location=1..225; Strand=+; Gene=SeqID_85044
aaaacctacaaaagagaattaaccaatttcaaaattttttctggtttagaaaatataatattataaaaattattgaaaaggcatttatatttttccaactgctgaaacgcaaccaattaaatataaaacgaacataattcaattgaaaaagcacaattattcgaaataaattttaaaatttttattgtagaaatttattaagactaaaataaattatttagaatg

SEQ ID NO: 108386 - DNA, 531 bp, Heterodera glycines
  misc_feature (73)..(74): n is a, c, g, or t
  misc_feature (104)..(104): n is a, c, g, or t
  Promoter: Source sequence=SeqID_13009; Location=443..973; Strand=-; Gene=SeqID_76784
aaaaaaaactatttcggaagttggccactaaaataattttttgccactattttggcatttttgaaaactttcnncaaaattgcaataaaaacgaaaaataaacncctaagaatcgacctaaaaaattcaaaaaatacacccctaagaaacgaactaaaaattttcaaaattacacccctaagaattggaaaaatttcgcaaaaattcttcccccaatttttttttcctgttcaatatttgctacgaaaatattttgtaactgcaatcagtgaataaaatctttttccttaattttaaattattttcaaattaaaaacagctatttaaaaaattacacccctaaatttggaactttttcgccactatttttaccactattttggcattttttggtcactatttagttaattattttgagattttttatcactaaaaatcccatccctagccataattacttttcaattagcctctgttgaaagtgccattgtggaagtgcccgacgttgagccaacggcgttcagagtgatg

SEQ ID NO: 108387 - DNA, 171 bp, Heterodera glycines
  Promoter: Source sequence=SeqID_36667; Location=654..824; Strand=-; Gene=SeqID_65924
atttttcggaatttccactggagagagcgaaaagtgaaagttcattggaatcggacgacgaggaggaaggggaggagggggaatttggtgaggaggaagaagagggggaaggtgaacaggaggaggaagaggaacatagagaaggcatttaagaggggaaagggagagatg

SEQ ID NO: 108388 - DNA, 154 bp, Heterodera glycines
  Promoter: Source sequence=SeqID_28244; Location=1..154; Strand=+; Gene=SeqID_58887
tgtcaatatcccatatatagtaactatcgggcgcgtggcacaatgcgacccagtcccaattcactgggccataactttatcatttctaactgaaatccctcccaccataaaaattggcactttcataaaattaaaatttctctaatgacaaatg

SEQ ID NO: 108389 - DNA, 87 bp, Heterodera glycines
  Promoter: Source sequence=SeqID_22159; Location=781..867; Strand=+; Gene=SeqID_52817
atggggctttaaattgtgatcggaagaagccaatttttggaaaacgaacatacagtaattttttgtaaattttagctgatcccaatg

SEQ ID NO: 108390 - DNA, 1003 bp, Heterodera glycines
  Promoter: Source sequence=SeqID_2729; Location=2546..3548; Strand=-; Gene=SeqID_81295
ttaataaacaaccaattaatcacaggcacaaaactcaaagagtatcatacaatgatgctgtggaaatccatgatttaattacaaagatacaacattaaataaataaatattaaataaatccaaatattattaaattaaataaagatagtaaaataagaattataatttagaacttaataaacctcttttaaaagaatcgcagcaaataaacaaaagaattgagtgtttaaaggtatcaaagcaacaaattattcaaaatatactcctatgaaatgaaaaaaaattttctcaaaaatttactttcttggcaaaaatttttaattttaaaaatttttttaggtaactattttgggttttttggtcttaaaaatcccagtcctactcatttgcaactgcaaatagtgaataaaaattattattttttaatttttggctgaaaattatgtcactattcgtcactattttggactttttgtcactatttcttcactattttgggatttttactcactattttagttaactatttcgggatttcgggattttttgctgccctaatcatgagtcattctgctcatttggtccctaatatcgggtcccaaaatttcaagtctcccaggtatcgtgtgccatgtgtgaaaatctgttcataagtctgagtttcaaatttttattatgccgtcgagttttctgatcgaagccgaaaaaagaaagatggtgaaattttggcaaaagtttcaagaatttttaacaattcacataacattagtttatttgtatccaaataaaaaaaaattcgggttaatgcaactttttagcacttaaaaacaaaatgctgcattttctaaatttttcttttaaaaattggtttaaatagtatttttattttttaatcttatttaaaattaaattttttatcttcacttaagtgtttaagtttttatacgctttatattaaataataattattttattttgcagacaaactatttattcatttatg

SEQ ID NO: 108391 - DNA, 285 bp, Heterodera glycines
  Promoter: Source sequence=SeqID_38773; Location=1..285; Strand=+; Gene=SeqID_67495
tccctgatcggcattgccattttcgagttttcagatcaccatgaaagagtgttctgatgaacatggtgtaattgacttttttttgataagcttcaaaacttaagctaaaatgaacaattatttcaaactttttggggcgactttttggatataatgaagttttcaaagttgaaaggatttttgaaaattgggaattaaattttcggaagatttttgtaattgtggatttaaatgttttcgagttttcaggacttgtccaattgtaccaaaacggatgatcatatg

SEQ ID NO: 108392 - DNA, 117 bp, Heterodera glycines
  Promoter: Source sequence=SeqID_40058; Location=481..597; Strand=-; Gene=SeqID_68491
accgagataaaaacatccgaatcaattaaatagcttctgagataataaggtttatcataaaatttcatttaaaaataaaccctcaattattggtatgaacgatactttccaaacatg

SEQ ID NO: 108393 - DNA, 142 bp, Heterodera glycines
  Promoter: Source sequence=SeqID_25236; Location=1..142; Strand=+; Gene=SeqID_55983
tatacgatactcattgaattgtattattagtttactaaagttcaaaaattttatttattttttctaaaaagttcaaaccaaaaactgtaaaaattgtcatagcttttgaaaaacttaataaaattttttgaaatttagcatg

SEQ ID NO: 108394 - DNA, 1003 bp, Heterodera glycines
  Promoter: Source sequence=SeqID_4505; Location=1402..2404; Strand=-; Gene=SeqID_54701
attccgattttagtctaattcttcaattttgggactatcttaaattggactagaaaatgaattgtggatgccattattttttatccgaaactattccagtcagagccttaattgcatggaaattaaattaacataaataggttattttacaagcagctcaattcattaatcgatataatttgtgaagaatttgaaatttaaaaccaaacttttttgctgaaaggctaccaaatatattaaggacaaacaaaattcaagctgagaaacttgaatctcttttagctacccaaaaatggaccatttcaagcgtttaatttggtagttcaatggctttgagtgaatgaggcttaatgcaattgaatgttatttttttacaggcaataataattattttttagttcttttttgtgaggcaatttaattcatatcagcaaaagcctagacatttaaggaacgtcgctccttcgggaattctttcatgttgaatggcgaaattgaaaatttatgtgccaaagagccttaagaatccaaactaaggcagaaaatgttttgttaaacgggcgatttaaaattttgaaatttaatcgccaaaaaaaaagccttataagagaaaaaaaatccgcttttgatgttttttgtttggacataatattggagacattttgctgagctttaccctgcgtgcacgcactaaaacagactgctccggaagttattaggccactcaaattattaaaaaaaaatattttatatgcttccaaatttaaacagaaaattaaaaccgctcacggccaattttttttttcaattttttacattgaggaactttcagaccgccctaacattgttatgatcagcagaagtacaatttttttttgtgatgatccattttttgcataaggcaaaatttagttgaaaaaaggccaaaaattctgattctgctctctcggctctctgaataaaaaaaaatattcacggcttttgtgccttttgtcaaaatatg

SEQ ID NO: 108395 - DNA, 365 bp, Heterodera glycines
  Promoter: Source sequence=SeqID_878; Location=879..1243; Strand=-; Gene=SeqID_63212
ggtaattaatggagcagcaggtcgtccgtcccctcccctcccccccccgtcccccctcccgccaattttcaaagagaaattttcaaacagaaagttttccaaaaaaaatttaggaaatattttcattaaggtttcaagaaaagaaaatttgtaaattttccagtttgaaaaaataattgttagtaaaaaaattcaatattaaattttcgaagattttttttgaaaaatttcggtaagaaaatgttttttggggccgagggggtaaatgacgagaggaatgaaatgcatctggtaatttggtgcttttaatttatgtaattataatatttttaaatacatactaaatttacagggcggtgaaaatg

SEQ ID NO: 108396 - DNA, 690 bp, Heterodera glycines
  Promoter: Source sequence=SeqID_8314; Location=1908..2597; Strand=-; Gene=SeqID_67665
ccgctttcagaatcgatcccctttaaaagagattagaaaaaatgataaatttgaaggaaacccaacaattaattgctttatttatggaaattgcaccattacctatcattttttcattattaaatttatataatttttattgtccaaatttttatatttggttaaaacgaaaaaaaaaggtgaaatcttccgttttattatataagaatattcgattattaatgatattaaatgaagatttcttaatcataaaaatgtaaaaaaattttaaaattacctaaattacaaatatatttttatatccatgaaaatatttcgtattccctttgccaacatttcttcaaagcatttaaaatcaattttcttgtcaataaaataaaaaaaataaaaattatttttatctgtgcacattattataccttacacatattgttagaaatgaaaatttgctctcaaatttcgcaacttcttctcattttgtttgtattgtcaggtcaattttttttattacaaattattataatgaaaaaacaattgaaatttttcgatttaatttttttaatttaattttaaattttcgttaaagtcccatcatacaatgcgaagaaaccagatgctgctgcttccgtaagccaaccactgatcagctacggccaattaattttggtcggaaagaccggcgtgaaaatg

SEQ ID NO: 108397 - DNA, 1003 bp, Heterodera glycines
  misc_feature (703)..(703): n is a, c, g, or t
  Promoter: Source sequence=SeqID_34114; Location=491..1493; Strand=-; Gene=SeqID_63990
ctaattaaatgtttcattttaattttcttcattatttttgattttgtaagaaaacaaaaaacaatcaaattattgttagtgtccaattgcttctgttgaacagcgtcgtcttggcatgaaaatcagagttcgaaagtttaaaattaataccgaaaaatgccccggatcaaaagtttatggtttttaaaaaaaatagaaaaattattttaattgataatttcgtaataataataataataatttttttttacaaatttaatatgtaattatttcataaaatcagtaattgagacaatcaaagattttttacaaacgccacaaagaatatgaaaaaaattcttaaaagtttttttatcatgtattatgatttattttaattaaaattaaagaaataattataaataaaaataaagtgcaattgattgaatgtataaaatgtggttatgaatttattattctcttaataattattttggcaaatatagaaaaataaataagataattaaacattatattatggctaaaaaaaaattaattatcaattaaataattaattagattattaaaataattttccgtactgaaatgacccccccccccttccgatcatctgactgtttcggcggtgcaaactctggaattttagtcaggttaacaaattttatccaaaaatgaactagttttggctattacccaaaaaaanttgatcattttttctgatcacttttgaaattgcaattttataccgactttaaacgttcgcaattcgtcatttcttcctctttttttttgctctttaagctgttcctttttctctttttttgcggtgtttacgaaaacattccccgccattagaaaaaaaggaataaataaataaacacaaaactaaggcactcattcattcggcattcattgaaaagcacagcagcccaaaggaaattcctctctctttttatattttaaagttttcagtttaattttgccaaatttctcagcagcaatg

SEQ ID NO: 108398 - DNA, 765 bp, Heterodera glycines
  Promoter: Source sequence=SeqID_43819; Location=505..1269; Strand=-; Gene=SeqID_71398
caacaaaattatatgaatcatttctattagagagatacctttaattggtcatttctaatcactaaatgatataaatcaacaatattttcataaatattttattaaagctcaaatgatttttttatttattgatattgcttgacattaaaaccaaatatttcggtgaaaattatatattttgtgtatttatctttaaaataaagttaaaaaattaaacgaaataaaaatcccaaccaatttatgaccacatttaagcaatgaaagaacgctgcggaagaacaagaacagatgggtggaaatgttcgtcgtccgccacaccaaagaaaaagcggaaaaaacaaaacgaaataaaataaaaaattatcaaattcgaaagaaatgaataaaaacaaaaataaataatgaatgcttttgtgtttttgtaaaagatcagtagaaagagaggaagttaattaaatgagcgattagcggcgctttcactgatcagaagaagcaacggaagggaaaagcatcggatcgattggacaaatggttttgttttgccagcaacagaaagaaaagaggcaataaaacatcttcgaattgctttcatttttaaaattcattatccaagctgagatcaaaggattattcaacaaaaattacaaaaaaaaacaataaaaaaaacaatttgaaatgtgtagctttttgactttatatacaaaaggtcgcgttctttggaagatttgtgagtgagtcttttcatttatcggcttgacaaagatg

SEQ ID NO: 108399 - DNA, 606 bp, Heterodera glycines
  Promoter: Source sequence=SeqID_4998; Location=1..606; Strand=+; Gene= SeqID_56498
cagaagttatcatattcgcgatcagcgaccttggaaacctcaaattacgaattttcgaatttttctgagggggggggcagcataacccggaagtaccatacgtagaaaaagcccgaaatatgtaaaaaaatatgtagataatcacaattgtcatctatcacattctacgcatttgacctcatttcatcatctccaaatgtcaatcgtcttgtattacttttaccaattttttaaaatctaacgtgtaagtggtcaccccttcgttagatattttatttcttttttctttttctgaataaagatttttctgacatccctattaattattaattggtaaaataatttttaccttttcattctttgttgtttaaaaaataataattctttgttcacagaatgggaaagttccttaatccccttctgctatttggaatgagtgaattgattaattaattatcatgcgaaaatcaaatttaattacatttattctttttgacgggcgaaatttaaatattaatttattcattaattgtaataattttggatattttcagttcgtatattttttaaattctgtttgattaccaattcaaacaaaaaaaaatg

SEQ ID NO: 108400 - DNA, 156 bp, Heterodera glycines
  Promoter: Source sequence=SeqID_18210; Location=358..513; Strand=-; Gene=SeqID_82807
aattattattctataaataatgtatatgcaaataataataatatgtcggggattgaaatggacaattaaatgctaataggtcggggaataggggcgggggcgactgatcggtcctttgtcatttattaatttggtcattaaccaatattaattatg

SEQ ID NO: 108401 - DNA, 417 bp, Heterodera glycines
  Promoter: Source sequence=SeqID_6049; Location=1722..2138; Strand=+; Gene=SeqID_60140
aattataaataaatacataaatattattacataatgttaaaatgaataacaccaacacaacgaaaccggccatacaaattttgaattccccagaagagcctaatgaaactcttttgcatgtactgcttttttctcattatcttcttgcatttcctgtgtttttgcttttttggttcgttttaattaggtggcttaaaagtcacgggcacctctcgcccagcgaggccgagacagtaatggaagagatgaaaaatatacctcgacaaccaccaatatttttcgcaacaaaatgatgcaaaggttagagaaaacagacaatgaactcgctcttcattatgacaaaatcgataatgacgcatgctggcggtgcattctcaaaactactcattcttttcatcattcattttacaaaaaatg

SEQ ID NO: 108402 - DNA, 115 bp, Heterodera glycines
  misc_feature (30)..(30): n is a, c, g, or t
  misc_feature (86)..(86): n is a, c, g, or t
  misc_feature (111)..(111): n is a, c, g, or t
  Promoter: Source sequence=SeqID_22228; Location=1..115; Strand=+; Gene=SeqID_52898
aggaattcgtggtgatcatgcccacaatgnaacggtgcacaaatgccggattctaaatttgccacaaaagcattgcgcaattattngagatttcacgcattaagagttttnaatg

SEQ ID NO: 108403 - DNA, 208 bp, Heterodera glycines
  misc_feature (62)..(62): n is a, c, g, or t
  Promoter: Source sequence=SeqID_7493; Location=1..208; Strand=+; Gene= SeqID_64995
gctgctggtagaagtgttggttctggacgccgtcttgccggtgcgactacaaactctcgttntcgtttcttcagagaggatttgtttcgggggttagctattctatctagttaaccatcacaagcctgacctaaattaggatgttcctgccggacaatggaagcatgacaagtttgcagagctctatggaggtggcaagaagcgcatg

SEQ ID NO: 108404 - DNA, 154 bp, Heterodera glycines
  Promoter: Source sequence=SeqID_4850; Location=1..154; Strand=+; Gene= SeqID_55946
aaaccatttgaactgacactaacaatgaaaatacctataaatcggcactaattaatttttgctgtttctagcggacaaaagtgtcatttacaccctttggggctgtatgcagaacaatgacaaagcatcgtgcgacaatgaagccaaagagatg

SEQ ID NO: 108405 - DNA, 338 bp, Heterodera glycines
  Promoter: Source sequence=SeqID_37401; Location=1..338; Strand=+; Gene=SeqID_66481
aaagcctttggcatcgattatagacaaaatcatcggtttttaattttaaatgccattttaatttcaagatattcaaaaataggaatgattgaaagcgaaaaatgttattaattaaaaaactaattacggcctaatgttgttgctttaacgtttgttttcgtttttctgttcgagtgcgttatttttatttcggtttcaaaaaaattaatttagctaatgttcctcgggttcattttgatgaaaagctttcaaaagaattaaaaaataaatttaacaaaattattcatttaaaaatttatttatttaagtgaaaccaattttataatgtaatattgatg

SEQ ID NO: 108406 - DNA, 1003 bp, Heterodera glycines
  Promoter: Source sequence=SeqID_8959; Location=1850..2852; Strand=-; Gene=SeqID_69812
ggaatgtttttctatccatgactactgtaatgacaaacttttattttattttaattttttgttaaattttaaataaattttgtatggttaaatttttttgtgttttttttacgattttaatgccttctatgtttgaccttttcttcctaaaaaattccattaaaatgtaataaataaaatatttaataatcatttaaatgaccaaaattaagttttattttcatgaactatttttaaaatagaattgttttttcaattattttcccgactattttctatcatccttcccttctgatcagtccttctttctattctgatcaatttaatttggtttaatttctctctctctcttctggtcatcctttccttctgttcactctttatttcctttctgatcagtttggtttggttttgtctctgatcactttctcttctctttttgttttcacttctccaatcgcttcataagtcattttttgtcttcgccactttcgcctccctttgtttatttttcttctgttctcatcactgtttattgtttttgcccacttatccctaagcatccgtttccctcaaaatcgcttccccttttcctctttcctaagatttattttgttttccgatttaaccgtcaaaattaatttaaattttttatttttcacttatttttattttgtattaattaagactaattgttctgcttatttacgtcatcgtcaactcaagaagaagcccttacttaataattaatactcattcattgtcatttgtccgtccttttttagaatgtctcacaaataccgtacctcttcctttcctctctatttgactaccgtttcttctcttctaagttttgttctcatttaactgttgtttgccttgaagcagttgaatctgatcattcggtttgtgtggaagtgatttgtcctttggaagaaaagggcacggcactccgactttttgagaaggccgaattgaaggaaggagaaaagtgcgagcgatg

SEQ ID NO: 108407 - DNA, 814 bp, Heterodera glycines
  misc_feature (71)..(71): n is a, c, g, or t
  Promoter: Source sequence=SeqID_15195; Location=1..814; Strand=+; Gene=SeqID_79401
ccgtaaataagtccgattcataatggtaaaaaaaaacaaaaacaaagattccttcaaattagttttgtttntaatgtatttttaactttttatttaattaattaatttattatttgtttgttgttatatcgatacaaaatgcaataaaaataaaaataataataataataatactattgtattttattcaaatttatttttattttataatttaaattgtttcttttttgctttttaattttttacttatttattacattttttgtcttcttcaatgcatatatttttctcattaacttttctattctttttaaaattcacggcacttcgtccatttgcgttacgatagggatggattaggaagaatatttgataattttattgttttttgttaattaatatgactatattatgcaatatattctgcttatgctaaatattttcaaatattgtaaattttaatattaatttatttatcaatttaagttttattttgtttaataaaaaataattgaatatttttgttttattatttccatgatttcccgaaggaacttttaccaatctattgcggttttttccatgaatgtctattgagtttcaattaataattttgtaatttattaaacatttgaaatttattttagtaaagaacaaaaactgataatattcaaatcttaaaaccatttctaagtttggcacttcctttgctgatatttattattaaaaaataaattgtcagcaaattgttttccatttttggatctttattctttaagtatctttttatgtatcttcagatctttttaaaatg

SEQ ID NO: 108408 - DNA, 546 bp, Heterodera glycines
  Promoter: Source sequence=SeqID_7331; Location=3232..3777; Strand=-; Gene=SeqID_64494
ccactttttggtctgcgggtcgctccggcgtttgtcattttccgagccaatcgctaattacccaaaagaatggtaaaatgccccgcggtcattttaagcttgctttttgatcgcagtgttcatggatgtggaggtgcctctacacgtttatgtgaacgaaagtgtgaatgttcacattgcggtctctgctgccaatttgacccaaaatcgccccgtacgatgccaaattcatttaccctccacaaatcccccccccctttttgaagttatccgtttgttttcacggcctttctccaaaagtttgtggtgatgttggccgcgagggtaaataattaattacttaattatttacaatttatccctttattatttattgcctttttgtatctttaaggcacttttggcgaaactgacttcactcgcgtggttttgacccccgagaacccagtccaactgaaaaatttgtaattcataacaaatttctgtgttttccgatcatccactcaaatcttttccagttttgtccgttttctgcgtcacggaatg

SEQ ID NO: 108409 - DNA, 562 bp, Heterodera glycines
  misc_feature (22)..(22): n is a, c, g, or t
  misc_feature (35)..(35): n is a, c, g, or t
  Promoter: Source sequence=SeqID_23831; Location=1..562; Strand=+; Gene=SeqID_54528
ttggcattttttgatcactatntagttaattattntgggattttttatcactaaaaatcccatctctaattatatgcgaatattttaaataatatttttttaattaaaaaataattttatttttatttttaaaagaattattaatacgtttaatttgatcacttgcacttttcctactttgtcatattacttggccaaggcacaattcgaataggaaaaccaaatatctttaagcgttttcattcgaaatcttcgtatgtatggttgcaaattatataaatttaatgtccattagttgaaaatttcaacgaggcttagaactgacaccgttttttatgcaaatccaaattatgcgctgaattgacacgaaatcccacaaaatcaaaaaaaaaaattacatttatgaagagacatttaaaacttcttcttcggccaataaatatgcatctttaaaaggcataggcactcatttttcagttaaaattttagaatgatatttatgaacccttaggaggcgaaagccacaaattctgacgggacgtatcgtgtgatcgagaagatg

SEQ ID NO: 108410 - DNA, 1003 bp, Heterodera glycines
  Promoter: Source sequence=SeqID_7007; Location=124..1126; Strand=+; Gene=SeqID_63553
gacgagaagtttgtcgccgtcaactggccatgctctctaattttcgttgtttgtcctcctcaataaattcaccatcgcctggctggacgcaactaaaaaattcaaatataaaaacgaacaaaaacaaaaaagcatacttgttggactttttttttgtgtgctcatactaaattgagaaattttttagacaattactgttaaatattaccactaatctgtccggcgatcccaagcccatttcatggaaataaacacatttgtgttcaagtcttttcgtcgagctcccaccggcaagcagctcagggtacgtcttaattgctttttttattgatcatattggaaaataacgaacctaaatgcccgtattgtcggtattaacttttgaggcatctcattgactctgacttccattttattttttcattattgtttgttttaacctgtgatctcactcgatatttattcacttactctgagactactttactgtgatcagtcatcagagtaagtggtctccgcccttctgatggcaatttttctttatcgataaataaacacagcggcccaattttgggctcccagtacaattatgcttattttttatttagtaatcagaacgccaaaactttgcaaaacttaaaattttccggagattttcccttgcaaaaaaagaagagccgatctcgagttaaaaactagacagctaaaaaataaactgtgattcgatagagtgggtcaaaatactggcctatgcaaaatttcaagaagattggtcaataggaaaaaatttttttcaaggacaaagttttttctttttctctcattttgacgcactatttccatgtctctaacatataaaataacacatggttcatttttttgtcaataaacaatttttttaaacttttgactaattaagaaatattcttcagaattttcccttcaaaaatgtttttcactttttgaaaataaaattttttctcagatttcgggttctccgatg

SEQ ID NO: 108411 - DNA, 221 bp, Heterodera glycines
  Promoter: Source sequence=SeqID_40922; Location=732..952; Strand=-; Gene=SeqID_69149
aaattatttcaaaacttaatcaaataggttggccccactgtcatttttttggttcgaagcaccaattaacaaattcatttcaaaagttctaattatagtattgcaaaaaagattaatttgcatgttttttaagtcttttactcgaattaacactaaaaaaatgatcaaaaatctaaagaatttgttcaaaccgcccaccaaacgccgtgagaaagaaaatg

SEQ ID NO: 108412 - DNA, 300 bp, Heterodera glycines
  misc_feature (17)..(17): n is a, c, g, or t
  misc_feature (118)..(118): n is a, c, g, or t
  misc_feature (140)..(140): n is a, c, g, or t
  misc_feature (220)..(220): n is a, c, g, or t
  Promoter: Source sequence=SeqID_39192; Location=1..300; Strand=+; Gene=SeqID_67822
aaaaaaaaatttaaaanttaatcatataaaaaaaattattaatttattttaaataaattttacattatatatttagtataggaatttattgttatttggtattttgtagtcactgaantcattttaatattcctttagcnaaccatttaatggcgaactaattaatcaattattgaacagcaggtgttttacgcgaaattttatctatttgttaagccanccgacgggaggattacgtcaaaagccgaaaaaggaggtcgtcgcttttgcgtttctgcgaaaattcgcgtgccaaaaatg

SEQ ID NO: 108413 - DNA, 734 bp, Heterodera glycines
  Promoter: Source sequence=SeqID_9724; Location=787..1520; Strand=-; Gene=SeqID_72491
ttcattagcattcggagagaattttacgatgggatttttgagcaatttccgacactaaatgattttttgaaaggaacggagaatattgcattgaacccaaacaaatatacggtaactaactctctctatggctttcttctctctctctctctcccgctttctcactcgcacttttctctctctcgattttttctccgactctctcgctttctcttctctctctctctcgctttctctccctctctctcttctctctctctctctcgctttctctccccctctctcttctctctctctcgcttttttctccgactctctcgctttctctctctttctcgcattctctctcttccttctctgtctctctctctcgctttctctatctctctcttctctctcgcggcgcatttaggcactgctgcttgctctccaatatgaaatattggggtgggaagaatgttatgtcaaagtgccgaaaaaattgatttagaaattcataacaattgaataataaagtaaattaaaacttggccagattattctcttataaatgcaggaagtgttaaaaagcattctttatagtcaatttcggtttacggttcttctaaaaatttcaattcttgacagccatataaacgatgtctctttaaataattgtagaaaacacaataaatctttcatatgtcaaataattggttgaaattaaaatattattttatttattctagaaaatg

SEQ ID NO: 108414 - DNA, 369 bp, Heterodera glycines
  Promoter: Source sequence=SeqID_555; Location=1..369; Strand=+; Gene =SeqID_56133
atgaatgagacagggattgcgaccaatcggtcggttgccccccccccctccaccagcaatctcctccaaaaatcattcgattatactttgagtttttatcctttttccacccgttctatttttacgctttaagtcgttcggtggccaaaactgtgcgtaaccgttttctttttgccttcctttccatcaattcaaaaggagagggagggaagaaacgcattggtttaactttcaaatggaatgactgttttatatgcatagtatgtgtacatacataattttcatttaatttagaaaaaaacgcaattggaaagaggccaaaaggagcacaattttaaattcaaagacgaagaaaaaaaggcgcaaatg

SEQ ID NO: 108415 - DNA, 482 bp, Heterodera glycines
  Promoter: Source sequence=SeqID_13303; Location=128..609; Strand=+; Gene=SeqID_77150
ggtgaaaaagaagaagcgcaacaaatgacaacaaaaggcaattaagcccaattagttagtcaattaattaattggtggtggaacagcaaatgaaatacatagcggtcgcccctctctcttcccgccgtactaacggaaatttcctccgaatgaactttttcctatgaataaaaatataacaatttaaaattattatattttttcattaccacaaagtgctaaaaaatgggaaggaatgcattttttaaaggtacataaaaataattttttttaaagaatttaatgggaaattggtactgaactacacttactgaaattgttgatcattggttgaattatcgagtaattattagtttgtgaccattcatatatttaaatgtatcataatatcctgagggctcataaaccaattaggaatgattcaaaaagcattttccattaaattttgaaaaattatagccaaataataaattagacatatg

SEQ ID NO: 108416 - DNA, 309 bp, Heterodera glycines
  Promoter: Source sequence=SeqID_12660; Location=560..868; Strand=+; Gene=SeqID_47068
tgtgacagatcgcaaacggaaattggtagagagacgaaaatttgaaaaatgccataattttacccatcatttttctcccacagccgcatttgccatcggacaacgaacttcttcttctgctgctgcttcttccccggttcaattacatcacagaaagcaagcaaaggacacgcaccaacaacctgcgcaccctctgtcagtgcatggcacccgcattttgttgtgtttgagtctctgaatcgcatccctttcccctctttcagcactgatgatggcaccggcaacttcttcctgagcgcatatgccatg

SEQ ID NO: 108417 - DNA, 114 bp, Heterodera glycines
  Promoter: Source sequence=SeqID_38368; Location=228..341; Strand=-; Gene=SeqID_67199
tttgccctctctccgattgtgccgataatttgaattttggcggtcgttcgggccgtttcataaataaaattctacccagcagagagtgccaatgaatataatttttgaaaaatg

SEQ ID NO: 108418 - DNA, 227 bp, Heterodera glycines
  misc_feature (120)..(120): n is a, c, g, or t
  misc_feature (163)..(163): n is a, c, g, or t
  Promoter: Source sequence=SeqID_14892; Location=3441..3667; Strand=-; Gene=SeqID_79052
aaaaaaattaaaaatgtttgccaaatcacattaataaccattatttgaaggtgtcgacatctgcattttctcagttttgacattattgttcagtgttagtgagaaaattgcaacaccaancaactgtagtgttaatgggtaaaattaaattttgattgccttntaaaaaataaaaatttgtagctttgaattcacaattctgcttttactggcgggcagtgataatg

SEQ ID NO: 108419 - DNA, 162 bp, Heterodera glycines
  Promoter: Source sequence=SeqID_7758; Location=4300..4461; Strand=-; Gene=SeqID_65848
tctaaaaaaccaattaaattaaaatagataattaaatattcattttttttgggttgctaattgcctttttatttgttctaattgaatccgagatcaaataattaattaattttgtatttatttctctacccattccaagcatcttcggctagccgataaatg

SEQ ID NO: 108420 - DNA, 1003 bp, Heterodera glycines
  Promoter: Source sequence=SeqID_5604; Location=1282..2284; Strand=-; Gene=SeqID_58613
gcaattctcagacaaaaataacgagttcgaacaaaaggtctaaaagtcgaacatttttagaataggttccaaaatgttcaggagaccattttaggcatgggtttaccccataaggggtaaaaaagcttgtattttcgtccaaaaatgacgtttagacccactttttgcagttcgaaaaattttcggtaattatttcggggctctagagcagccagaaaaccaaaaaattttcgcaactaataaaaaaatgatttcgagccattctcagaccaaaatagcgagttcgaacaaaaggtctaaaagtcgaactttgttcgaacttctctcaaaatgttcaggagaccattacagactagagtttaccccaaaggggtaaaaatgctcgtatttttgtccaaaaatgatgttagacccacttttcacagttcgaaaaatttttggccatcatttcgagccctagagtagccagaagaccaaaaaaattcttcacaacaaatttcaaaatgatttcgagacattctcagaccaaaatagcaagttcgaacaaaaggtcgaaaagtcgaacatttttataatttgtccaaaaaatgtcaggagaccattttaggcagggagatagatcaaggggtcacaaattttagtaattcacaatatatgttttaatccctactcagtactttaaacctttttagccattttaattctattttacttttggagccgtttttcccgccaaaacattgacaaaatgagcgacaaacttatgcgttttcaatttgtgccttcctcaaatcaaaaagctgctgccgacgaatttcctgcgcagcttaaaaatttaagtgaagtgattcagttcaattcacctggcacattttttgtgcgcgcagtcgtcgataatgttcagtactgtctttacaaggtcatttactcatacactcactctctaaaacaattcaatttgctttatggaatctaggcatgtccccttaaaaccgtgggcatg

SEQ ID NO: 108421 - DNA, 488 bp, Heterodera glycines
  Promoter: Source sequence=SeqID_44066; Location=1..488; Strand=+; Gene=SeqID_71611
aaaattgaccatcattgctttggtaattaattaaattacctcccctttttcctctcccctcccatttcccccctttttccatccaaccgatttttgttttatcatttgtccaatctctcctccccttcccctcgccctcttatcgtcgtcctccaatcggacaaccggtggccaatgaaagaatgatcagaatatgaaaagagaagagaatagtccaattctgttgttctcagcagatcattcattcatttacagcacatcctttgggtggtacaaagtcaaattaacaaataaaagtgataatctcctttttttttcttatcttttgcccatttgtcccgtcccattttttgtccgccctttttgccatttgtccgtcccttttgtccgtccctattccccctctccttgtggcccctttttggcacttttttcaacttatcatttccctttttgcactttcagctttttcattcgttttgctaatg

SEQ ID NO: 108422 - DNA, 360 bp, Heterodera glycines
  Promoter: Source sequence=SeqID_11810; Location=111..470; Strand=+; Gene=SeqID_75312
ggtccgttttataccgaaattttgaaatgaaagggatagaagagacctgacaatgcatcgggacttgagcacttgtaggagacggactgagacttttagtacatgactaacgtgtcatttgccgggattcctagtcccggtctttcctcttgataagtcccgtctggctcgcgtcatgtctttagtccgtcaggctgctcttttggtacactttattccattttgtccattccccattttcagactttgggggcgtcttttgctggagcgcaaaatcagcgcggtttgtgtttccatttcccaaaaattattgcattttccatttggtaggtggtcgtctcttttcccgccactgcaatg

SEQ ID NO: 108423 - DNA, 374 bp, Heterodera glycines
  Promoter: Source sequence=SeqID_23500; Location=1..374; Strand=+; Gene=SeqID_54198
ttatgctgtatcattgtgggcaaaggtatagattattggtcccgaaaaattctttaaataaaatttgagaaaattgtttttaggggtagtcttaggcgccgagcacgaatccggccttattttggctgtttcgaaccccgaacccggatttgaactaaagttcgagaattcaattttttcagttttagttcaaagcccggctatatacgtggaatcaaataggcacattaatacctcaataaaaaaattatttaaactacttagggtggaacataatttttgatacccaaatttttttaattaaaaattttttttttaatttcaacaaaccacaatcatgattcaaaatacccgccattattatcaataatatg

SEQ ID NO: 108424 - DNA, 78 bp, Heterodera glycines
  misc_feature (69)..(69): n is a, c, g, or t
  Promoter: Source sequence=SeqID_37264; Location=973..1050; Strand=-; Gene=SeqID_66370
tttgtgaattttttagaaatttctatcccgtcatatcggcttttggaattttaatgagtaaatcagtanccgtaaatg

SEQ ID NO: 108425 - DNA, 60 bp, Heterodera glycines
  misc_feature (30)..(30): n is a, c, g, or t
  Promoter: Source sequence=SeqID_33290; Location=1..60; Strand=+; Gene= SeqID_63396
tattaaatttttgggtgggtggtcggcacnaggacggatggcgtgtacacggagcaaatg

SEQ ID NO: 108426 - DNA, 66 bp, Heterodera glycines
  Promoter: Source sequence=SeqID_24579; Location=389..454; Strand=+; Gene=SeqID_55308
ttttttttaaattaacaaaattaaaagttatatatagagttttaaatctaaatgtaattaaaaatg

SEQ ID NO: 108427 - DNA, 251 bp, Heterodera glycines
  Promoter: Source sequence=SeqID_17077; Location=2377..2627; Strand=-; Gene=SeqID_81505
ttggttattgatcttaaattgtcagtcgatgatataataaataagttgtacgcttcaccttgatcaagcacttctcatgcacttggtgctgaacgtgtgtcaaacgacgtctggcgccccctttgatgtgccgcttcaccggaagtccgctgcgatcaactgttgttatgacaatggtgaacggctctccccatagcgtaacacctttctgttgttttgactgcgcaactttggtgaacagattcagaatg

SEQ ID NO: 108428 - DNA, 376 bp, Heterodera glycines
  Promoter: Source sequence=SeqID_22582; Location=1412..1787; Strand=-; Gene=SeqID_53246
cctaaaaaatggcaaaaatggtacaattttaaaatttgtccacttcatttcctaccgccgtttccgctccgctcccgtcctgtggccgctgactgcggttgtttcgacttcgtctgacccggtttaaagaacagacgtcaaccgaggcggctgaatccaaaacttttgattcgttttaggaaatgaaagttttatgtgaaaatgaagtgattggaaaaagtttttgttttggttttatttattttattataatttgccggattggcttaagaccgtccctgagaatgtcagggagttcgagtggccgggatggcacacaattgctttgaacgcaaggttttacaacgcaaaacctttattacacaccaaaaaaatg

SEQ ID NO: 108429 - DNA, 75 bp, Heterodera glycines
  Promoter: Source sequence=SeqID_21624; Location=1827..1901; Strand=-; Gene=SeqID_52220
ggtgctttcatttcaacatcactattacctaattaaatatttatgttccccctctttccaggctgtttcttcatg

SEQ ID NO: 108430 - DNA, 1003 bp, Heterodera glycines
  Promoter: Source sequence=SeqID_5500; Location=4131..5133; Strand=+; Gene=SeqID_58261
tttgtatgacctatttttgaacggtttttcataccttaaaaaattcaaatcaaaaatcgaaacaatttcgcatgctatacaaagtgttggctttcagatgataccacatctttttaaatttcttttttccctttttcgggattatcgtgccttaaatgccttttttggcatttttccattttggtgttatttttggcgtttttacgaaaaatccattaaaaatgcaataaaatcgggaaaatgcaccctaagaaatgacccgaaatttttttagaaaacacacccccttagaattgaagatttttttttcaatagacctctaagaaatgagaaatttctcaaaaattaatctccaaaataatatattttttgataaaaattttggtttaattatcaccaaaattatctgcgataagggcggagggaatggaatataaaagggacgaatgaatgaccaatgaaacgaaatgaattcgcctttttggcgcttatctccgcgccgacgaataaacgcggaaaatgaatgaatgttttgattttgtgcatttatttactctcctttttcacctctgtgtgcattaaattaaattgcccaaagtttaattagtaatttttaaatgcaaaaatatttttgttttaaaaattgttttgggaacaaatagaaaataaggggaaatgcaaacaaaatcatctttgcatatttaagttaagcctgtaatttataaaacaatttaattcattaaccaaaatgaatattaaattaaaccaaaaaagtaaaaattgcagaaaataatgatagattattaataaaccaaacgcttttctcattaactaaatgcactcattaaaaaggacaaattttgcaatattattttttatgcggcatttttttttaattcgagaaaaattttttaaaaaatttctttccatgcctttggttttgccaataattatttcatttttaataaataaatttcccagaaattcctcccacttttaaatg

SEQ ID NO: 108431 - DNA, 646 bp, Heterodera glycines
  Promoter: Source sequence=SeqID_25808; Location=1..646; Strand=+; Gene=SeqID_56572
acaatagacaggaacccggacgaacgggactaattgtcccattttgtcaggattcatttgtcctgacattttacccaaagagaaatctcggcaaacgcaaagcggaatcccgcaaatttgaaattcccgggctctagaaaattttgtacaaaaaacataggtttattgcaggctaattaggattgaattataagtaacttcaaaatttcacagattcatttcagcaattactttttttttacataatgccaagcctattttacattgccaaaatgccatcggattgattttcttttgtaaaataaatgccaaattctattaaggcaagaattattctcttcatgcctattcacattaatgcccttttacacgtgttggacaatgcacataaattcccagcagatcctccaaaatggcattcattcatttgttttttttaatttctaaaaatgcgtcggattccttttgcccaactgttcattctgctgaacattataattgaaattgtcatttttgtggatgggatggaccagtcccaatttgaaatgattgactattatggcacaacggagaagaaagacattgaaaaagcaaaacaaattcgcaacacatttgtcaccattggcattgtgaaattggaaaaatg

SEQ ID NO: 108432 - DNA, 57 bp, Heterodera glycines
  misc_feature (16)..(16): n is a, c, g, or t
  misc_feature (38)..(38): n is a, c, g, or t
  Promoter: Source sequence=SeqID_21781; Location=1..57; Strand=+; Gene= SeqID_52388
cgtcatcgaatttctntcgttcaaacaagcaaattttntgcgaaaggcaccaacatg

SEQ ID NO: 108433 - DNA, 256 bp, Heterodera glycines
  Promoter: Source sequence=SeqID_25989; Location=164..419; Strand=-; Gene=SeqID_56742
gatttttgtgaaattaaagaattagggagaattagcgtcaaaaattcggacaattattgtaagggaaatggaaaataaatatattaatgtatcttttaggtttgttttatgcgttaactttaagcagattttatcaattaattaataaaaatgacgaagagaaaattttgatggatcaatttcggaaaattataaagaatgaacagagacaaagcgaagcagtaaaaaaataattattgatgctaaaattaatatg

SEQ ID NO: 108434 - DNA, 707 bp, Heterodera glycines
  Promoter: Source sequence=SeqID_4099; Location=2604..3310; Strand=-; Gene=SeqID_53174
ttttgttagagagcatattttatccaagtaattaggctaggtatctttatatatttattatttattttacaataattataattttttttgtatttccgtgtaattcattgatttctttacttttgatcatttatcattgtagtccatcagcgactctttttttttttgtttcatttacacccttttgcttctttccgtgtcaatgaatttttggggcggttcagcagatttgaatcacaacaacacagcatttaccatttccattcaatttcaatcagtcagtcagctgtttcatctttcaacctcaaaaagccccaaagagtgaattcgacggcgaaattcgatcatttaaacagcgtccgatcaccaaattaacggaagagagaaagaaagaaagagaaaggagcaaaagcaccgaacattctcagaactgactgatcacattttaatgaacaaacaaattggcaaaaaaaatatgtgcaaagaaaaagccattaacaaaagaccgaccgatcgaacgggtggatgatttgtttattttttaaaacctttctccaaagaaaaattcatacataattaaaagcggacgtaattttccattttggttaaaaagtgaaaaatggaaatatatttttcttacaaaattaatgttggtaatattattttattagctgatattggacaaaatactttccttatttaaaatg

SEQ ID NO: 108435 - DNA, 82 bp, Heterodera glycines
  misc_feature (26)..(26): n is a, c, g, or t
  Promoter: Source sequence=SeqID_44381; Location=1..82; Strand=+; Gene= SeqID_71877
catgcacccagagactccggaagagnatccgccttcgaacaaatatatatgaacaaaaacaaatagtttacatgccaaaatg

SEQ ID NO: 108436 - DNA, 876 bp, Heterodera glycines
  Promoter: Source sequence=SeqID_1238; Location=3855..4730; Strand=+; Gene=SeqID_70472
ttatttattggcacccacttttgtaacagaaaattgaaaatataacgcggagttgttgggggataaattatacctaattagggcccggatttataagtttttactgattttttctgcgaccttttaatttaaaaattaagcgttttaaaacagagccatagaggcaataaacaaaaacagaattgaaagtataaggaaacattctgctttactgcttaggatataaatgatcaatatcttttgtcttttaaacaaaaatttcacaccaaaactgacagggcagccaacttttgttacacattttcactacataataaaattctttcaatttttgcaaattcggtagatataatactttgtatatttggttaccccaaattctgaagggttctcggggggcgctaaccagggatctgacatccattatatccaattttgaatgtctaacctaaattcaagcaaaaaagcaaactccgaaaaacttagttttctatttcactcgagttcgggtaagagatttgtcaaaattggtataagattcgtgattagctactcccgaaaacccataaaacaagttttcacgaaaaaaagggccctcaccctgtggtttttttcggagtgccccaacagcaaaaaatgcagatatgaattcccagggaaagaacaaattgaaaaattttttaatgggtatttttaaattaaatttgtcacttttttaatctggcataatgttaatagttaaaaaatttgaacgaaatatgactacttctggtagataaaaatcagtgctatcacttcaaaatcacaaattccttttcaaaaatacagacagaccagaaatattcttttgaactttcctttttgataattgtaatg

SEQ ID NO: 108437 - DNA, 305 bp, Heterodera glycines
  Promoter: Source sequence=SeqID_9378; Location=768..1072; Strand=+; Gene=SeqID_71178
aaccagagcggcagagagctttatgcccacggagcagctgcaggactgcgccacatccattcgagggcatcattcattgcaatattgctgcccgcaattgtctttacaccgggggagtgaagggcgaggcaaaaagcaaaaaatgtcataaaacaaactgctcatttatttataggtgaagatagcagacttcggcatgccataccaaggggcagtgaagacgatgccggcagacgcgcaactaccgatcgcatggatggcgcccgagtcgctgaggaagaactgcttcacggagaatagtgatg

SEQ ID NO: 108438 - DNA, 1003 bp, Heterodera glycines
  Promoter: Source sequence=SeqID_6486; Location=890..1892; Strand=-; Gene=SeqID_61758
ttttcctttcataaaggcaaaagttaaaatatttttaatcaaaaatcacatcactattttttaatgtcgaaaattttttggattcaaatgatagaatatgtattatgaaaaaagagccagagaaatccaaattaaatcttttaaccggtcagaagtgaattggaatccgaagaatttcttttctcttaaaaaattttcggaattttaaaaaacccataaagcaggattttgtggtaagctgtgccgacaggcgaaggtgggaaatttttgttattaatttgtctcaatttgcttacaattttctctaaaaagtacattcaaatcaattaatcctgtggaccaaaactgacgaaagtgcaagtccataaaataattgtatgattttatgattatttaactcttaaagtaaaatttctcatttttttattttaaaattactaactaactaataatgcatttttaggagcttaggttttttgtgaaaaaatttatttgatctgtcaaatgatatttatcataaaatatgcatcgagtgattcattcctttacgccgctttaattttgtcatcgcttcactattattttcaaaaaaattatgcaataataattcaccaaaaataataataatattttttaaattttagatattataaaacaaaaatataaaatcccaataaaaatagtcaaaaaattattcgaaataaatttggaaaacgtacctttcaatggatttagtgaattaaacctgatcatccttttaatcgcttttaattaattttttaattactttttattgtgtacgccacgcattaaattaaatttggtctttcagctataaaatttccccaatgccaagcatcatcattacggccacttttgtagcggtggtacttttcacttgcgcttttttggacctttgccatggtaaaaaaacattttcaatctcaatatatttaattgcttttttaataaagcattgacttgcaaaagccgttcgataatg

SEQ ID NO: 108439 - DNA, 798 bp, Heterodera glycines
  Promoter: Source sequence=SeqID_14311; Location=1..798; Strand=+; Gene=SeqID_78336
cagtgacgggtaaattttgagaatgggaagcgacactgcttgtttcacccgacaagcactgtcctggaccagtattgcttggtttaccttttcttatggatttgaaaggagttattgcacttggggaaaagaaagttcgattgggtgaaatttgacaagcagagtatcagtgataggcacagaaccaccaaaaccaccgagagtaattttaccaaaaaatgacacgtttgaaccacggacggaaaatattcttaatgcgagagttgatgaaatttttccaactggacaaaatttcttggtaaggggtatacagcatcagtaccctgggattatcattggaaggacattggttgccccaggcgcgaccaaagaagtcataataagacttatgaatgcgggaaatgcaccaattaaaatttacgggaactcaaatttggcagatttggagccattacaaattaatgcattacctggcgatgatattgcggctaaagattttattccacctgaaactcggtggagtgaaaatttgcctaaattacccgtaaatgacatgaatcggcctccttcagaaagaatagatttggaaaagacaagactaagtgaaaaggcacagcattaaagcaaattgtggacaaatattccgatgcatttgtcggtgatgacggaaaaattggtcgttacaatggtccaattgttcacaaaatcgatttgacgcccggggcgttaccattccattttagaccttatcgttaccccccagagactcagaaggaaattgagaggcaaattagaatg

SEQ ID NO: 108440 - DNA, 105 bp, Heterodera glycines
  Promoter: Source sequence=SeqID_12380; Location=1516..1620; Strand=-; Gene=SeqID_75988
ttcgtcaatcggcaaaaccctttccttttcatcacccgtggttctgtttttgagtcagaacaagcccgcctggaaaaaagtcttaaagacttgtcaaaacggatg

SEQ ID NO: 108441 - DNA, 746 bp, Heterodera glycines
  Promoter: Source sequence=SeqID_7758; Location=3073..3818; Strand=+; Gene=SeqID_65849
tgttcaggctgaacatcggcgaatggttacggcattttattggtaaaaaaaattatttaaaattaaaataattttttttaaatttactgtcaaatttccgattcaataaataataaattatttatttcaataaaacaaaaattaaatctcattcaagtttctattcaacaaataatataattatttatttcatttgaaaaaataaacctaaaaatgttatatgcttttttaattgcaaatattaataaaaaaaaaaattacgattatcctattgtagtgatttgtagggatgggatttttaggctctaaaaactgccaaaataggtaggctttaggctctaaaaaaccccaaaataggcaccaaaaatcctcaaatttagggggtgtaaaatgacaaaattttattcaaaaaagtaaaaaaaaattaggccaaatcagtattgagataaataatttttaaagcacaaattcttgtcaagaacataaaaaataaattttggagatgaatttttgaaaagtttttcatttctgtatgggtgtatttttgaaaattttcgggtcgattcttagggggtgtatttttcgtttttattgcatttttgttaataattttgggcaaaacgccaaaatagccaaaaataggctctttcaaatttttttaggctttttaggcgctaaaaataaaagcctagaaaataggcactaataactcgaaaaatagcttaacaacagcccaaaaaaacatg

SEQ ID NO: 108442 - DNA, 61 bp, Heterodera glycines
  Promoter: Source sequence=SeqID_15454; Location=1859..1919; Strand=-; Gene=SeqID_79717
agcaggaaattgagaaacagtggatggaattaacagcgctccgtctcgtgttcacggaatg

SEQ ID NO: 108443 - DNA, 132 bp, Heterodera glycines
  Promoter: Source sequence=SeqID_37502; Location=392..523; Strand=-; Gene=SeqID_66559
ttctttgcccccggcgctgcccagggccctttcccctggtggccccccggtccttccgattttccaaattcaaccatctacgcacacttgccgcatcccgacgaacttgccgacgaatttcccgacgaaatg

SEQ ID NO: 108444 - DNA, 454 bp, Heterodera glycines
  Promoter: Source sequence=SeqID_226; Location=1094..1547; Strand=+; Gene=SeqID_78603
aggcttcgaagcggaatatttaaagaggacgaagaagaaggagaaaaaatcattttcattccaaaaaatgggctcttgtaaaattggagatattgttcataaaaattttaattttattcgcgcattggcaaaaactaaatcgaacggaaaaagaaaacaaattttaaaacgcgcaaatgccgatcaattgttaacacttgttgaaatttgcctaaacatcctttgccaacgtttcaaaatgacaactcgacaaaaaaaacgtcttttaccatatgctaattttgttcggagtcttgctcgacgaagaaccgagaaaggagcccgcaaacttttagttcaaaccggaggcggacttggcggtgtttttgcagctctgcttacccctatattaattgatttggctcgatccgctataaattcgagctcatcttcggagaattaaccatttaggatg

SEQ ID NO: 108445 - DNA, 1003 bp, Heterodera glycines
  Promoter: Source sequence=SeqID_17403; Location=516..1518; Strand=+; Gene=SeqID_81885
gagagaagataataaatttttcaaagctcggctagcgcgaggtgcgcgagcgaagcgagcgcgcctgcgctagttaatattatttttcctaaaaattgaatttgcggaaaataaattgagcatcaagcgttgatatcccgacgaaaaaaatgttaaaaatttggcaggattttttctaggcttaaaaaatgcgctaaccacgaatatgaactcgtttttgaaaattattttgtctataaaattttatcatgtacttggttttttcaaaattttttattttctgtaaagcttttattttcaatgaatttgggataaaaaatgctcaggtcatgaataggatgaggattcttaggtttttatttattttttctgcggctttaactcgacgagaaattcacgaaaaaaaaacttttttttcgaaaattttgcgttcgcccttaaaataagtttttgcccttattttggcgttttgaccaaaatttattaacaaacatgcaataaaaacgaaaaatatatataccactgagaatcgaccctaaaattttcataatttgtaactgcaatcattgaataaaattgtttgccttaatctgaaattattttcatataaaaaagagcaatttagaattatacacctaaatttggaactttttcgtccttatttacggccttattttggctttttcgcccttaaaacctcgccctaatcatgaataggatgaggattcttaggtttttacttattttttctgcggctttaactcgacgagaaatgcatgaaaaacattttttgttcggaaattcttcgttttaacgcccctatccgaccctaggaatccctatttcagatgtacggccctaaaaatcctcaccctagtcatgaatctgtgttctcattttgcaagaaatttcaatatttttaagttttcccagaggtcgaataaccttagttaaaatattgccaaatttgctcaaaaataatttatttcgatggtaaaatatg

SEQ ID NO: 108446 - DNA, 64 bp, Heterodera glycines
  misc_feature (20)..(20): n is a, c, g, or t
  misc_feature (37)..(37): n is a, c, g, or t
  Promoter: Source sequence=SeqID_26137; Location=1..64; Strand=+; Gene= SeqID_56885
ttatgaagcctcaaagtcgntcacactcaaattgccnactttcaaagactcccacagcgaaatg

SEQ ID NO: 108447 - DNA, 238 bp, Heterodera glycines
  Promoter: Source sequence=SeqID_3166; Location=3824..4061; Strand=+; Gene=SeqID_83500
tccgaacaacacaataaagtcacatgaaaaaatttaagaggggtggggggagagaattggcacaactccagcaaaaaaaaaaacaacgttaaatggaaaattgctgaacttttaaaagaaaatgtataaaaaaacgactgacagcaataaattaatgataattaatgaaattagtaattaatttgggggatttgaacatagtctcaaataacacctgacaagcagagcaccgacaatg

SEQ ID NO: 108448 - DNA, 287 bp, Heterodera glycines
  Promoter: Source sequence=SeqID_17671; Location=434..720; Strand=+; Gene=SeqID_82201
ttcggagtcaaaagtgcgccaagcatttttcaaaaattgatggacgaactcaccgctggccttcacggagtgttcgggtatttggacgattttatcgtgggcacgcccactttggaggagcacgatgctctcctaaaacttttctttggtcgcctccaagactgggggctccgtgttcatttaaataaatgcaaatttctttgtccccaaattaagtttctgggcacatcgtttctgccgaaggaattcatcccgatccggcccggtcagcagcaattgagtcaatg

SEQ ID NO: 108449 - DNA, 306 bp, Heterodera glycines
  Promoter: Source sequence=SeqID_8227; Location=1..306; Strand=+; Gene= SeqID_67370
aagaccctttcactgaccacccccttgtacaggtatgggttgggatttaaattggtggaggttcgattagcgaaatcgcattttttaaaaaatctaaaatttactaaagtaagaaatttgaaacttaaaagggttttacaatgaaattctgagtttctcatttgctaataaaagcacataaacaaaaaagtaaaagcaaaatttccacctttggttttgttagtctctcatggcaattgtctattttccttagtcattgttcgaatagcccccccccccccccccttaggccgtttccttcaaatg

SEQ ID NO: 108450 - DNA, 84 bp, Heterodera glycines
  Promoter: Source sequence=SeqID_10633; Location=1742..1825; Strand=-; Gene=SeqID_73867
tgtaagaaatctttagatgtaatcaccaccttaaacgcaatattacccaattttacatccttttttaggtatggaattgcaatg

SEQ ID NO: 108451 - DNA, 636 bp, Heterodera glycines
  Promoter: Source sequence=SeqID_10463; Location=2081..2716; Strand=+; Gene=SeqID_73672
aatcccaaatcgagggacattcgacttaaggagggaggtgttggatagggatcaaagatcactttcccatcattgttatcgactattctctctccccctttctctgtccaacactatttccattctctctctctctgcctatctcctccacatttctctgaccccacgtctttataagtgcgtccattccctcactcatggctctccgctccattcattcgcattggacatttttattattttattctcctccgtcgctgcactcctccgacctcatcaatttgtgcatttatttttattggtgtttattaataaattgttgatacacaacaattttggcgcagtcagcagcagcagataaattctgcacatcatcaagccaaatcaaggctaattctgcaaaatcttcaagccaaatcaaggcatattctgcacaacctccaagccaaatcaaggcataattcagcaagcctaattttggcacttcaaaagcctgggcggctttcatcggacatcgacaaaaactgatcacctgggtggtgtaagttccgctgggtgcggtttctcatcgacaaaaactgatcacctgggtggtgtaaagtaccgctgggtgcggtttaatcaacaatcaaaatg

SEQ ID NO: 108452 - DNA, 52 bp, Heterodera glycines
  Promoter: Source sequence=SeqID_23051; Location=1..52; Strand=+; Gene= SeqID_53754
acataatggagtctctaactacttcaaaaaacagccaaataattttgtaatg

SEQ ID NO: 108453 - DNA, 175 bp, Heterodera glycines
  Promoter: Source sequence=SeqID_14819; Location=1841..2015; Strand=-; Gene=SeqID_78972
cgtctgcgcctttctctcctctcccttgggctgtcccacgttgttgtcatgcgtttttagttcttaaattttgctttatattatccataaaagctataattggataatttgttattaatgattaaataattcataaactaacagatagaatcaaaaaataacagatgaatcgatg

SEQ ID NO: 108454 - DNA, 518 bp, Heterodera glycines
  Promoter: Source sequence=SeqID_5129; Location=1513..2030; Strand=-; Gene=SeqID_57019
aatttcgccagtgaaactgccccaaatttgaaaaatttaataattattttgacaaaatgtctttagttcaaagattgaagacacaactcaagggatttttggaaattaatctgtgcaaatatcacaaaaccatataaaatattcaaaattttattccaaattagtattttttttgaaattctctcaactcaggggtggtctacccacctacaaagttccatttggaaatttttcttcaaaattaaatgtaaatattccattcatatgaaatgaaattcaaaaaaatttgttttgtaaaaaataaaaatttgattattttttgagtgtgtcattttaattttgccgatttcatttcaatttaggttaaggaactttttaaaaaaattaattaatttatttatttatttattttacagcgcctcccccgccaaaccccgagaactcttctgtgcctggtgaaatttttttttcttttctaatttttttttatttttcagtaccgccaaaactgcagaatg

SEQ ID NO: 108455 - DNA, 627 bp, Heterodera glycines
  Promoter: Source sequence=SeqID_6782; Location=1389..2015; Strand=-; Gene=SeqID_62888
ttgtacagaatagtttttggccgggctgaacataatttcattttgctcaaattgccggcttttagtgggtccgcaattgtggattgcagaattattaattgaagatgaagaaactgttaaaaattaatttaatttacatttcaaacctattaattaattttaaagtgaatattgctaatcacgtctatcttcagtttttgccgcgtgagattttttgaccatttttgttttttagacaaagttattttttctgaattacaattttcctttacttagtagaattttttaagcttaagcaatttaaatatttctatttccacttttataaaaatttgtataaaaatcaccaaaattgttcatttttaaaacaatttaaattacttgaatgtctagaaattttaacgtcccgaccttgcttgtcatacaaaatccgtcccccaatttccaaccccgccatcgtggtttttagcagtaaaattagtatttagtccaatgtttagatgctggaactcgtttccaaaccggcggtattttttaaaattttttttttccatttttgttgtttaaaatttgtcagaaaattatctatcatggatgatttaaattttccattttttgaaggtgatg

SEQ ID NO: 108456 - DNA, 478 bp, Heterodera glycines
  Promoter: Source sequence=SeqID_26312; Location=957..1434; Strand=-; Gene=SeqID_57057
tattgatataaacaaaattttaattaatcaaaaaaaaacgattgataaataccattagaaattattatcttttttattccataaaatgaaaattaaattcaaacgaataaaacacagcggagcgagatatttaacataattaatgaatatgaaactaattaaaatataattacgcattaattaattaataaaggtcaaaaataataaataacaaacatatttattgctatgagtaaaaaacaaatactcattttcggagcagtgaaaggagccattgaacaactcaatgccatgggagttgtaaacatcaataaaagaaaaaaaagatgctaacaaaaatattaaaaattaattccatagtgaatgctgaaaaaaattatggcataaaaataaaaatttataaaataaacaaaaaataataagaaaaaactaaaaaatacattaaaaaatcttaaggcaataaaaaatccgataaatg

SEQ ID NO: 108457 - DNA, 1003 bp, Heterodera glycines
  Promoter: Source sequence=SeqID_188; Location=841..1843; Strand=-; Gene=SeqID_76952
ttaaataaaaattgataaaataaaaattatttttaataattagggaaatgatacaatattaaaatttgaattaacacaaaaaatttttatttgtaatttatttttagagaaaaaaatcatttatataaaattattatttaaattaatttataaatgattcttaaagagatttaatctcgtctttattttatttattgtttataaactcctaacaattgataaaaaaattatttttatttctaaataaaaaattgtttttaaattatttcattaaaaattactgaaaataattaaacgaaaaattgttatactcaatcattttggaaacaaaaaataatcaaaaatctttatcaaggatttcattgctgctgaagcgatatctgaattttcatttagacaaattggcttctctcgagaaacagtcctttttatttgagtgggtaattctttggctctttttaaaataaaaatggaattaaataaaatttgcattttaataaagaaaataatataaaattaaaaaaactaaattaaccaaaaaatttattagtaatttaattttttgatcaaaaaagaatcatttaatataaaattataatttcaattaaatttacaaaatttaatctcgtctttattttatttattgtttataaactcctaacaattgataaaaaattatttttatttctaaataaaaataaaataaaaattatttcgtaaaaattgcggaaaataaactaaacgaaaaattgttattatcaatcatttttgaaacaaaaaaaaatgaaagtttataatcaaggctttctttcactgctgctgaagcgatctctgaattttcatttagacaaattggcttctcccgagaagctgtcctttttatttgagtgggtaattatttggctctcgagatttgattgatggatggcattatttttctcgtcaaaatgtgcatgttgacgttaaccccaccgtttagtgtgctgattgagcggtaaaaatg

SEQ ID NO: 108458 - DNA, 346 bp, Heterodera glycines
  Promoter: Source sequence=SeqID_4233; Location=166..511; Strand=-; Gene=SeqID_53705
ttttgtgggcgaattttattgtcagtcactgccccctcccccccccctttcattttaatccattttcatttttttcgcgcatttccttccctttcttttcaccccaaagtgtttatttccacccttttttctccccttttctccttcgcttacactttcaattccgatcaatttttcttccccctccttccaacttcctcttcccccccccctttacagcactgatgatgatggttcgttcttcctcctcctcttccttttcccttccgtcgtacttcctttctctcctccccctccttctcctccttttctcccaatgttccaaaatttcttttgcttgccaatg

SEQ ID NO: 108459 - DNA, 103 bp, Heterodera glycines
  Promoter: Source sequence=SeqID_32019; Location=1128..1230; Strand=-; Gene=SeqID_62332
cccctttaaccgacagaatgcagaaaaaggcgttttgcttttgcccaaatgggtgctcagcaattaccgggtgtaccgctcggaagtgcccaggggcaacatg

SEQ ID NO: 108460 - DNA, 145 bp, Heterodera glycines
  Promoter: Source sequence=SeqID_14281; Location=1584..1728; Strand=-; Gene=SeqID_78300
gttttattttaatccgattaaatattataaatatcaatttaaaaaatggtaccatcataatgttgaaccaaaattattgaatgagaataaattgagaaatgaaattaaatcggaaaacggaccaaaaaagtaaattaatgaaatg

SEQ ID NO: 108461 - DNA, 323 bp, Heterodera glycines
  Promoter: Source sequence=SeqID_3606; Location=1390..1712; Strand=-; Gene=SeqID_51072
aaaaataaataaaaacaaaaatatttaaaatggaaataatcgaaattaatttattctggaagaagtcagagaaactggaaatggaattgagggtggccaaacaaatgtgcgcgttcatcaaaatggaacttgaagaggcagggattccagaaaaagctaaaaatcaaataccataaatatttaaaaaataaaataaaattacaaaactttgaaaaataaatttcgtaaattttaatttttcacagaaggcacttcaagcagaattaaaacagcaaagactgattgaagaaaacattgagttgaaagtcaaaatttacagaatg

SEQ ID NO: 108462 - DNA, 101 bp, Heterodera glycines
  Promoter: Source sequence=SeqID_34673; Location=812..912; Strand=-; Gene=SeqID_64405
tttttctctttttttgcccattttcaggcaaacttttgtggaacgaatggggtttctacggtgttgaatacagtgcacaacgtttgagcaaaatcagaatg

SEQ ID NO: 108463 - DNA, 312 bp, Heterodera glycines
  Promoter: Source sequence=SeqID_14596; Location=2732..3043; Strand=+; Gene=SeqID_78674
agtatgggttgagaaattgttacaaaatatatttaagaatttgtcttttcaacaggtggttgctccattgactctaaaaatgaaatcacctgtcctcggcatgtcgcttttcccgattttcccgcctttcatttaagacattgcgcctattgccaacaaaaacccgaatcgccaggtttcacagttacactaaccttgaacttgactaacactttttcagatgaactagttaaatgtacagtttgctttcggtcagcacatttgaaatgttacaatgaatcaaaactgacggcgacaaatgacgagggaatg

SEQ ID NO: 108464 - DNA, 309 bp, Heterodera glycines
  Promoter: Source sequence=SeqID_15957; Location=1561..1869; Strand=-; Gene=SeqID_80308
ccccgggcgacgaattttttttgcggccctttttacaaacaacttttgggaaatagaggggtcctgtggtgtcgactttttttgagaattagagtgaaatttattaacagattttgtccagaaaattggtaaattttagattttcggaaaaatttgggtgaggtatctcttcgatagggtaccaacaaggaaaatcgaaaattttcggcaaaaatatatttttccacaatacatgtgcccccttctctgttgttaagctccaacaagtcgttgccaactcctttcgttgttttggcactttttccgatg

SEQ ID NO: 108465 - DNA, 179 bp, Heterodera glycines
  Promoter: Source sequence=SeqID_5886; Location=1451..1629; Strand=-; Gene=SeqID_59560
tttttttttgtgtcgagaaaaatttagaatgattcgccaaatggggtggaatttcaaaagcgggccaattttatacttttcaatcggttaggctccgcccacttttcagttcgcaaagttcatccgtccaaaatcacgattcatttgcaaaaaaaaatcaaaaaatttccaacaaaatg

SEQ ID NO: 108466 - DNA, 1003 bp, Heterodera glycines
  Promoter: Source sequence=SeqID_20721; Location=124..1126; Strand=+; Gene=SeqID_51281
ctttgctgactccgatttcatttacgtatttggcggatacaacccatttcactctcctgacagcacttagtctgtgcttttctattttaaaaacgatcttttagctaaagatcattttcataattttagcactgatttttggcgcttcaaccgtctcacccatttatggcaaaaatgcggcctttcctcctctgacccaacgactcagttgccgaattcgttggcttcttttgcatgtaatttcatttgtgcaattatcaatcattgaacaattttttaataaaagttcaaacgaagggacaaagtccgcatacatttttgaagaaaaattaatacgtttatttcccccttttagtggcttcatcttctaggcccagcgagtgttttatttttgggggtaccggcattcccttcggtctcgccgcttcaaatgaattgcatcgaattcgaattgatttgcttggaaatgtcaatgttcgggtatgaaaatggggtggtatattcccgatgccccccccccccttttttttgacagaaaaaatttttaagacgaaaaacatatttctaaatttagaattttttattttttttcggatcagtgattttatataggccaaataaatgatatatttgtgaaaagcgactcccaaaaccctcagaagcatgctttcacgacaaataaaacaaattgtctttcaaaaaaaaggggggggaacagcaaaatttgatatggaacagaacgaccattcgcaagactctgcttcagactgagccgaaacaaagctatgaacaaagacaaaacacagcgaacattcggcagagggggcgcagtggcggggaggcggcggacgacgcggcggaacagcggctgatgcccccgcggatgtgagcaaaggcatttttagggatgggaaattggcaattctttgtttttacgcttgtgcggttattaatgatgctttttacccatttaattgtttttttcagatacggacacgcaatg

SEQ ID NO: 108467 - DNA, 74 bp, Heterodera glycines; identical to SEQ ID NO: 99895
  Promoter: Source sequence=SeqID_5451; Location=2356..2429; Strand=+; Gene=SeqID_58097

SEQ ID NO: 108468 - DNA, 724 bp, Heterodera glycines
  Promoter: Source sequence=SeqID_27288; Location=391..1114; Strand=-; Gene=SeqID_57970
caaaaaaaacgcgacctcgagagggagcacattctgtcgattgcgctcactttgactttccgtgtgcgaaatgcgttgtctaagtcgtccaacttggtcctttttgtgcgcaattttcgcccgaatttcttcaatggagcgactgagctggtgaaattcaccctcgaatttgatctgaaaattacaaatgtttcatttagaccgaagaatttcaggcaatccggggaatggaatggaaaatcgatgactcaaatctaagcgaataaactacgaaattgaaaaaagcactcaaaatttttccgacgacctttttttaggttcaccccattttttgcggcgctttttccaaagaactttaggggacggggggtgggccgcgcgccggaggtgccgaattatcacactttgttaatagattttgtcgaaaagtgaccgaatttgctatttttaaggcgatttcattaactctctaccatatacttttgaaaaatttacgaaattggagaaacgcaaaagaaattaataaaaaaaattatgaaatcggaaaaaacttgatagacttttgtctttaacaatgcttttttcgattttcgccaaaaattaaacgaaattgaccccccccccccgccccttgtccacctatggcaataaaacaggaccggatcagaaaagcctttccccgggtgggactcacttcgtcggcgagtgcgttctggatgagatg

SEQ ID NO: 108469 - DNA, 146 bp, Heterodera glycines
  misc_feature (13)..(13): n is a, c, g, or t
  misc_feature (28)..(28): n is a, c, g, or t
  Promoter: Source sequence=SeqID_37817; Location=1..146; Strand=+; Gene=SeqID_66798
ttaatgatactantagcaaacaaatganggtgtttttcaatgcaaatattatctattttttggcctaccatcaaaaatgtgagtcaaatttgctgaattcatttaaaaacttatttttctattaaaatttttaggacaattttatg

SEQ ID NO: 108470 - DNA, 155 bp, Heterodera glycines
  Promoter: Source sequence=SeqID_32986; Location=573..727; Strand=-; Gene=SeqID_63194
gagtgcaaaaacttgcccaaatcagccgcttttcatgcccgagttgacctcaaaaaggtggtaccaacagcaatccattatttgctgtattttacaatttcgttgtttcattcatttagttccctcattacaacgacaaaattcagcgaccgatg

SEQ ID NO: 108471 - DNA, 73 bp, Heterodera glycines
  Promoter: Source sequence=SeqID_4110; Location=2684..2756; Strand=-; Gene=SeqID_53228
tgtaagtaaataatttaattaaaacaaaaaatttttaataattttaacatttttaagaattaatttcgttatg

SEQ ID NO: 108472 - DNA, 1003 bp, Heterodera glycines
  Promoter: Source sequence=SeqID_3385; Location=410..1412; Strand=-; Gene=SeqID_84476
cgctgatcacgaatacagcacccttttttgccaatttcgaatccctgacacgaactcaaacaaaaaaaattagacaatttgtatggatgatatcttcattggcaccttgctcatgagggtattattggtacaggaagcctatcaagtctttgtccctgacagctcatgtagtgaatggtagcgctgatctgagcccggattcgtgatcagcgagagaaattacaaagaaaaagagaaacgacgagatagtactaggcttttctctgcacagtggagtgacccatagtgtcttcttacaatcgtcatttcaacgggaaccgcccacttcggcgccggccttttcggcgccgttgctaacaacttttttcctgatcaaccaaattaaaaatgtttgttatcattcgatagctcttcagattctctattagcctgtaaaacttcaaaaaatttcgtcagtttacaaaaaagttatggccaaaaaacctcaaaaattaactttttcttggctttccgcgtggcataactttcttatttttgaatcattcatttctatttttacatgtaaatatagagcacacatagagctttcaaatgatgccagattggctaaagctaactgacaaataaaaaagttatagcatttcaaaatttgcggcgccgaaatggtccgcgccgaagtgaccccgacccatttcaacaatataagaatcatttgtttttattttttacatacagtagaagcatgtctttaacaataaataaaagcatctccttaacgagaagtggaagaaatcttacttcaatctccgttaattgctctaccttggttggtaagcagcttttgttttcatcatggattatgaacaaaatttaagccatcattgaaggaaagggcaataatcgtgggcaaattggtgcgtttatcgtcgatgtgtggtttggaaatttctttttgcataggcatggccgcaatggacattcgctattctgaactcactctatg

SEQ ID NO: 108473 - DNA, 518 bp, Heterodera glycines
  Promoter: Source sequence=SeqID_645; Location=3437..3954; Strand=-; Gene=SeqID_58005
tttttggcggcggttcgaacaacgaaaagaaacggacggaggaggccaaatgctttgtccaatgcttttgtcgatgaatttccaaaagaaaatcgcttaattaattaattaaccaattaattaatggatgactcacttaaaatgtcccattaaaatttttaatattaatacaaaatttctcaataaactcaaattatctccgaatttttcatttgtttaggcggcgtttaaaagataaaaataaaaagtgttttgttttgtcgtcgcattttatcatttcattggtgggaaagagaagagaagggataaacaaaaagtcgcattcattcgcaagaaaatgtttcatttgaaaaagctgaacaaatcaaaaaagagtcccttttcaacaaaaaataataatttattcatttcatgtttaattgtttcatttattttaactttttagtctttagaaataaaaagggaaaattaatttaaatatttattaataataattattattatttaataatattatg

SEQ ID NO: 108474 - DNA, 504 bp, Heterodera glycines
  Promoter: Source sequence=SeqID_2100; Location=1717..2220; Strand=-; Gene=SeqID_77842
tattctcaactgaaccgaacaaatttaatatctaaaaaaagtatttgaaaaggagaatcttttctatgcgaatgctaagcaatttgtcagcacagaaaaaaattgtcgataaaggaataatttgaaaatttagaagaaaaaaaaataaatgaggcaaaaagtaagcttttggataaatttttctccaaattttacattattgtcccaaatctattcaaatggactgaatataatagaaaataaatatcacggccatttagtgcattttaatcgatttcggacaatacaagagaattttgtgaaaaattaaatttcgacttttgttcgagttcgggttctgggtccgaaataggtcgaaatggttcgttttcttgtgtcgtttttgtccactaaagtttttgtttcgttttcggtttacaaaattttgattttttgtttcctgtttcgtttttgtcaaagcaaaattggacaaaaaatacgaaaatatttacacccttaagaatg

SEQ ID NO: 108475 - DNA, 94 bp, Heterodera glycines
  Promoter: Source sequence=SeqID_41587; Location=1240..1333; Strand=-; Gene=SeqID_69674
tgagattttttgggtagatagagcacacctggggttctaagaaaaaatgttttaaatttctgccaaatgaccccctgtgccgagataaaaaatg

SEQ ID NO: 108476 - DNA, 1003 bp, Heterodera glycines
  Promoter: Source sequence=SeqID_20256; Location=338..1340; Strand=+; Gene=SeqID_85060
gatcgcacaaaaaagaaaccgcggtcgcgcattcaaattgccgcggccgcgaccgcggatcgcacaaaaaaagaaacgcggtcgcgcattcaaattgccgcggccgcgaccgcggatcgcacaaaaaagaaaccgcggtcgcgcattcaaattgccgcggccgcgaccacggatcgcgcaaaaaaagaaaccgcggtcgcgcattcaaattgccgcggccgcgaccgcggatcgcacaaaaaagaaaccgcggtcgcgcattcaaattgccgcggccgcgaccacggatcgcgcaaaaaaagaaaccgcggtcgcgcattcaaattgccgcggccgcgaccgcggatcgcacaaaaaaaaacgccgcggatcgcggtcgcgcttcactcttgttattaacccaattaaatgtattattaattaattcacaaattatttaattaatttaatgttttaataatcatgcataccaattgtcattcattattttaaatagaattttcccatttcgaattattgatgcaaaaacatatttttggactcagatgtttttaagtggaggagaaaaattcaaggaacaaccaaactatagaggtaaataatttttaataagttttctaataaataattttatatttattttttcattcaaataatttttttgtttatttaaaagtttaatttttcttctttaatattaatgttatggccaaaaaatattataaaaaaatgatttaccttttttaaaacgctacaaaatattctttatttctaaaaatagacggaaagaaaaaatatataaattaaaatccaaaaaataaaacaacaacattgttgttgtttttttttaaatttatttttttggttgttctcctaatagcctatttaattaaatctattattaaacaatgcttatgctttagaaaacttcaaatttattctccgtttgtctaattacacattgacacaatacgaaatttcgaatttcttgagggtaattatg

SEQ ID NO: 108477 - DNA, 239 bp, Heterodera glycines
  Promoter: Source sequence=SeqID_38784; Location=1..239; Strand=+; Gene=SeqID_67501
cgacagaaggcctaatttttgttgtttttgaatggtttattcctgtttttccttttttcaattgaacaggactgtgccgccaagaaaaaaaaccgttttaccgggcgactcggtcccggttcaaaatttttgctgggcgccctccgggatcgggcttttttcaaaatggtcctaaaaaacttcatcaatccaaagttattttttgatgcgtttatgttatttcacgcttttttcagatg

SEQ ID NO: 108478 - DNA, 432 bp, Heterodera glycines
  misc_feature (74)..(75): n is a, c, g, or t
  Promoter: Source sequence=SeqID_16109; Location=1..432; Strand=+; Gene=SeqID_80465
agcattgactgtttgctgtgtgaacagcgggacaagtgttttttgcgggtattacataatcccattaattaatnntgttggggtaacaaaaaaattgtttaattgattttttaattgtttcttgtgccttttgtatcaatttagctaatgatccctgattaggggggatgacaaaaatctccgccgctcaaaaaatccgggaagaccaaaaataaattctttttatccctcatatgttttttttttattcctattcaccaatgactactcttaacactaaaaatgatttgaagcatgccccaataccaagccttcagacggacacaaaaagctacctaaaattagggacaccctcgtttcgtcggcaatatcatcattggaacaggacgaatcaagctcaagcaaccgtccaacatctctttcgtgctaatg

SEQ ID NO: 108479 - DNA, 284 bp, Heterodera glycines; identical to SEQ ID NO: 98949
  Promoter: Source sequence=SeqID_11511; Location=207..490; Strand=+; Gene=SeqID_74937

SEQ ID NO: 108480 - DNA, 167 bp, Heterodera glycines
  Promoter: Source sequence=SeqID_27431; Location=461..627; Strand=-; Gene=SeqID_58124
ttgattgtaaaaaaaaattgtataaatatggcaaaaggccataattatgattattaaatttttaaaaattatttaaaataacataaatataaataattctaaagacaaaatttgtgtaaatatttttattttaaaataattagtttttcatttttgggacagaaatg

SEQ ID NO: 108481 - DNA, 94 bp, Heterodera glycines
  Promoter: Source sequence=SeqID_18017; Location=1384..1477; Strand=-; Gene=SeqID_82593
tttagttctatcggcaaatgatcaaattgtaaagcattgtaatattgaaggcggggttttttcatcagatcatttggcgcaatttttcactatg

SEQ ID NO: 108482 - DNA, 145 bp, Heterodera glycines
  Promoter: Source sequence=SeqID_20179; Location=2132..2276; Strand=-; Gene=SeqID_84966
tgacatacgcgcgtccgacgggtgagaaaaagtgatatttttgattcatcccttatttttgatgtttattgcccacgcattttggcatttttcgcttctttatagcatttaacagaaatttccgtataaactctataagattatg

SEQ ID NO: 108483 - DNA, 465 bp, Heterodera glycines
  Promoter: Source sequence=SeqID_19442; Location=1437..1901; Strand=+; Gene=SeqID_84166
tattgtatagtagaatctcgataagactaaaatttggttaaattttcaaaaaagttttttaaaaaaattgaaagcccgctgattatagatctgaaatctgtttcgccgatgtcctaatcacggacccgattcagcaatcgaggacccttttttgatcaaaaagagccatacgaatttgggaaatttgagctcgactttgtgggttaaaatttagtcgaaaggaatgtcagattcgttaccaggggccttgaaatggactaaaaagttatcgtataatttttttttttttgaaatttcaacccaaaaaaaccagttccgagtaaactggtgataaacaagtaccgagtcgtcaccaataaccacacacagttttggtttcgcaccaaaatctttgtgaatttcgatagtcctccaaattttcttttctgtgccattgaaatgtttgtccactaaaacatcaaaatg

SEQ ID NO: 108484 - DNA, 156 bp, Heterodera glycines
  Promoter: Source sequence=SeqID_4536; Location=541..696; Strand=-; Gene=SeqID_54811
taacattgttggacctgaaaatttcaaagcataaattcctttagcataagaattgttcaaattttacctgattttcaattcgaaactttgggttgttaccattcaggggacaaaagccgtagttaagacagacaaggccatcccgggttcgaaatg

SEQ ID NO: 108485 - DNA, 505 bp, Heterodera glycines
  Promoter: Source sequence=SeqID_9207; Location=621..1125; Strand=-; Gene=SeqID_70596
agttgtgcttggctttttggcactgaccgttccgtttcgctaatttccgcgtgtatcgacggagccattagaatttgggacgcaaaaagtggcgagcctttggcggtagacaattcgaacaaaacgaaaaccacgaattatgtggtaaattttagttacttctcggagcagaggaggaaatttactatttgtgtgtggctaaggacggcgatgggcgcatttttctcttttccgcgtgtgccaatggcacagttcgaatatttcgactgacggccaatgaattgacgcgggcggagagttaacacggcgtcccctcgaattattttgtcgcgattatttttgttaaatttttaaattttaagcattttttcggtttattggaaaatcccatcccattttatgttttgttttatttgtttttcgttttaattttttatttctccttagtttgtttatttatctgttgttgattttctcaacagtgttctctttttcggccacaatg

SEQ ID NO: 108486 - DNA, 351 bp, Heterodera glycines
  Promoter: Source sequence=SeqID_5550; Location=6680..7030; Strand=-; Gene=SeqID_58420
ctcaaaaaatttctcaatgactaacctagaaaagtctcacaataaattacacgttatccctattttgtgaaaaaacaaaatacaaatgacaaacttttgaaaatattacaaaaaaaaaactctagctataattgtatacaaaagatattatagttattatgaacttaatgcaaaatttttattattttaaaaacaaaataaataaatattttaattatagaaataaaaaacaaacacaaaaaccgactatatctataagataaacgagtaaataagaagcaaatctgcgtagttataccataccaatttaaataaatataaattttaagaaacattaaagcaataaacatg

SEQ ID NO: 108487 - DNA, 779 bp, Heterodera glycines
  Promoter: Source sequence=SeqID_2733; Location=5390..6168; Strand=+; Gene=SeqID_81332
agaaattgcgcttaattatgtatttatcaaagaatttttaattatttttagtttagtaaatcttttttaattggccacacataattatgaaattatttttttaaattaaattttaaatgctctttgacctctaattgattgattggctaatgagtcgcataaacaaattcacttaatttgatgggttcgaaatgatggataaaatatccgatgaatggacagttgtcgttcatttttactcatttactgctgaattccaatcgccaattgttcatttttctcattttttttgtcaataatttacctcaaacgtgttcaagtactctttaaattttaaaccttaaaatcccaatattaaagcctttgatccgaaagaatatttctctttccatttttaaagcattaacaatttaatcccaaaatcctttaaaatttagtcaatttttttaaaattccgccctctaaactctgaaagaattcatgaaacattaataaacaattgaaaataaattttatttttctttgttaaaactagggttcctccccgaccctcatggagagaacagtcggggatcgggcaggaaatcacccagaaaaagaatggatccatttaaataattttcaccaaaaaattgatattctatttttgattttttggttgcttaagaaaaaaaaagaaaactaaatttaatattcacggtggcaagtcattttttttaaagcaaatttgtggtaaataataaatttaaaagcaaaaagacaattcttttgtgccaatg

SEQ ID NO: 108488 - DNA, 60 bp, Heterodera glycines
  Promoter: Source sequence=SeqID_7734; Location=119..178; Strand=+; Gene=SeqID_65774
agttggatgaggaggaagggatgtcgaaatgctccgaatcgatgcttaagcaagctaatg

SEQ ID NO: 108489 - DNA, 470 bp, Heterodera glycines
  Promoter: Source sequence=SeqID_18430; Location=1127..1596; Strand=-; Gene=SeqID_47516
aggtgctaaattttgaatgcttttcaatgcttctaacttgatgtgttaaggctgaagaaatttgccattgtttgacggtgcgccgattagaattttgtttgtgtgacctttgatatgtttacatagatggttattttttgcataatttctcattgttttttattcaaataaattcgtcgaaacattttgactttttctcaattattggctgttgtattatacaggaataagttattcttaaaatttatttattttttaaaacattttttaaccattgatttgggtttgaataaaaattgaaaagtgagcactttaaaattaaatcccattaaaatgaatatttctagtgaggggaagagaacacaaagtgtagaagaatgccagaacgatttattttttaaggatcattgaagacactgaccctttacatatttcagctttttcacggaatacacttcattttggaaatg

SEQ ID NO: 108490 - DNA, 358 bp, Heterodera glycines
  Promoter: Source sequence=SeqID_18227; Location=2372..2729; Strand=-; Gene=SeqID_82822
taaattattattttttgatctaaagtttagcaaaagattatacaataaatatatatatgtatatgctagtgggatttgcgaaaacaacgcagttattttatcagaatatttgttaggttatcaatagcgaccggattttgaagcatacctatgccttttttgcgaacttgctacggcctaatacagacgaaaaacgagtttttaacatggtttgaagcttctagctttaacttattggtgcgctttttgcgattttgatgcctaatgctgggcacgtaattttgtaatcttttttgacctttgatgccttgttcatgcctttttcagtatttttttgaaaattttcttaatgaaaatg

SEQ ID NO: 108491 - DNA, 447 bp, Heterodera glycines
  Promoter: Source sequence=SeqID_8888; Location=2857..3303; Strand=-; Gene=SeqID_69545
tttcaatttaaaaatcaaaaatcagttttcctcctgccaaaatagaacggcaaacggcagaatcggcacacaacggacggtgacgccgcaggcgctgcttccgcttgtggccaatgcgtgtgttgaggtagacagacagaaacaccagcggggggggggggggggattagtaactaacgctgcagggaatgccgactcggaaattgctgaatctgttccgccgactgaaattgtcgatttcggaatcactttttaaattagccattggcatttaaatttaagaaatttatttgcaaaatatgaatggagcttattagtgttttgcctttgcttacaattgtctcttaagcacaaacttctctattttctcaggtcaatgtttcgtgtctgttcgagaattccgtgtccccccaatggaacgcacgtcgcgtgctcgacctgcgcatg

SEQ ID NO: 108492 - DNA, 75 bp, Heterodera glycines
  Promoter: Source sequence=SeqID_37240; Location=1..75; Strand=+; Gene= SeqID_66355
tatagccctgggagctgtcttgatacctgtcctgagtgttttagcccaacatttattagaaaaaataacatcatg

SEQ ID NO: 108493 - DNA, 199 bp, Heterodera glycines
  Promoter: Source sequence=SeqID_42938; Location=1..199; Strand=+; Gene=SeqID_70729
acctatcatgccttgaaatattttaaaataaattccttaaaaaattaaaaattttattataattgcaaaatgtgatcccagcaaccaacatttatgcaaaactaatttataataaattatttatttctttttcttttagctcatattaaatttgccaataaatcagaaaatttgtttgtttgcttttcattggcacatg

SEQ ID NO: 108494 - DNA, 337 bp, Heterodera glycines
  misc_feature (50)..(50): n is a, c, g, or t
  Promoter: Source sequence=SeqID_22239; Location=2102..2438; Strand=-; Gene=SeqID_52913
ctttttatataaatttgactggacagatcaaaagttaatttgtagttttntattagaaaataaaattataaaattaattagttaattttttttttgataatgaaacttttttgtatcaaatcccgatcaacgttatgttattgactacttaattaggagaaaaatgtctcgcaaataatcagcgactaattgacctatttttacatgcaatttcaattttacctttaagcatttctttaatgaaaaattcatccaaaatgaacttttaattctttaattatattttaaattgaatttttacaaataaaattcatttaaaatatttagattaaaaatg

SEQ ID NO: 108495 - DNA, 76 bp, Heterodera glycines
  Promoter: Source sequence=SeqID_6615; Location=1..76; Strand=+; Gene =SeqID_62211
aaaaaatgatttgagcaaaacgtcggaaagagagaaagagcaaaatgtaataaaaggaattgtgagaaggaaaatg

SEQ ID NO: 108496 - DNA, 904 bp, Heterodera glycines
  Promoter: Source sequence=SeqID_2100; Location=1..904; Strand=+; Gene= SeqID_77843
agagaatgaattgacgcttttccctccgttcgcttctcctgttgctcaattcattttgttcgaatgtttttagtggtggaaatccgttcaaatttcactaaatttcaaatgtcaaaatctctttttcccatttcatttctttttaatacgatgtcttcaatttgtcgtccaaaatgaatcgcattaattcggtgcttccgccgccgcttccatttcgaaacttaataagtgccgaaatgtaggacgaaacgaaaacgaaacgttttcgtcaatccctgggtctgacaaaggaaggtccccaggtgtccgtgggatttccaaatgaaatttggtgggtggatagagcacccatggtttcttaagaaaaatatttttattttctgcgaaatgagcacgagtgccgagttatgacgtgccaaagttttttaatgaataaacaaattaaaaaattgtttggacacctctgcagagttcagtggtgcagcggtagtgcgctattcagtgttttctggacccaggttcggatctcccacatacattttcattttttaatttttgctttttatgccaaagtcaattatcattatcacaaaaaaaaatttttttgatttaaaatcttatttttttaatccattttgacaaataaattactcataaagttttacacaaaaattaatttgtttttaagtaaaaattgtaaaatgtattagaacgcagaggattcgaacctgggacacaaaaaaattttacctaacacactacctctgcaccatcagatgcttttaagtgaacaaaataattgttccttttctttaattagaaaaaataaaaactttggcacgtcataactcggcactcgtgctcatttcgcagaaaataaaaatatttttcttaagaaaccatg

SEQ ID NO: 108497 - DNA, 347 bp, Heterodera glycines
  Promoter: Source sequence=SeqID_14667; Location=1..347; Strand=+; Gene=SeqID_78768
ccccttttgtgggagtgaaaaaaaaaccccccggggggttctatgctatcaaaagtatcacaattttagttcactgactcagggacggtccctgggttttatggggcataaaaacccataattactgtgttcaaaaacgcttccataatccctgactagcccaagtgacgatcctaggctcggctggagaaactgaaaaccctgattttatattaaatgatcattttttcaaaaaagagtaattttggccacttgtaatggacgggggggggggattttgtttcgaaatagttaattttcatgattttttgtaattaaatgttccgagaatttcggagtcattaatg

SEQ ID NO: 108498 - DNA, 930 bp, Heterodera glycines
  Promoter: Source sequence=SeqID_5234; Location=1446..2375; Strand=+; Gene=SeqID_57382
aacggacaattcattgttgtgtttaaatatcatttgttgatttcacaatttcaaaattttacataattgaataaatttccacaaagtggaaaaaattgattcaaaaagggatagtttagtaattttgcgttttttgctgtggttaggtcgcaatgattttctaccaaaaattgtgtgagcaaattaaaaaatattttcttttgcgttttatctatttttcgtctacaatctgacaacaacactatttccatttcctctgtgtctgttttacattgtttgttcctaatggcagagagtaccaacaaataaaataaatattttacgcgttttcccaccggcggagacgaaaaatttgcacaccccgaaaaaagcactgctgcttctgccgattagtcatgtttcttctcctttgttcgtcgtcataaatacaaaaatgtgatgtgtccaatcgctttttgtttttctccattggttcacttacctaattaaatatttccctacaatttcgcgtaaaagtgccaaattttgatgcaaaaatcgcaagattggcataaaaaagacaactttaccttcagatccattgacattttaattcccttatatttatccaatctgtttgaaaaattgtgaccaatttttaatgatttaggaaaaatctgtaattttacaaacttgcccaattttcattaaaattgcattggccaatcgctgcccaaattcatttgaatttataatttttgtacaaaatttttcattattttactttttgttcgtttcctctcttatctttcttccatttgctatttttgagctacccatttccttttttgcactgtcatcattttttcgtacaaattttggtttttttggccaaaaaatcatttttcaggaaatgttcatttattactgttgccgaacaactgaaaaatg

SEQ ID NO: 108499 - DNA, 152 bp, Heterodera glycines
  Promoter: Source sequence=SeqID_21317; Location=513..664; Strand=+; Gene=SeqID_51911
actgaaatcaaatttgccacaactcgatgacacacatgtgtaagttgaaatccgtgagcgaatattaaagtttttactaatttttttctgcggctttaattcaatgaaaaaagtgcataaaaatacatttttagcgcgaaaatgcttaaatg

SEQ ID NO: 108500 - DNA, 433 bp, Heterodera glycines
  Promoter: Source sequence=SeqID_2962; Location=892..1324; Strand=-; Gene=SeqID_82518
tgaagaaatagattttttaagaattgtcctaattgcctcgttttcggctcaatttggtctcaaggtctcgagttgaataaaattttgccaacaagcataaaacaaattataacaattttaaaaatgaatccttttttaatcattaatttcagtgaaaaacccgatcttttggaaagattgagtaaattgatggtatggtgaataatcaaaatgcatattaattatgacaaattgtgttgggaaaatgaaaatcattcagctgctatccgatcattagagaagggacggacactttttttaaacaaattcatcatttttaaccactacaaattttgtccatttttatgcattttcacaaaaaatctctcaattaatttatcctgtttctttttgataagttttttgatttaaatagattttagccataattatg

SEQ ID NO: 108501 - DNA, 194 bp, Heterodera glycines
  Promoter: Source sequence=SeqID_2053; Location=1..194; Strand=+; Gene= SeqID_77541
tgaaacgaaaccggcggtaagacgactcaatcgagaattgtaggaagttcaccgtaggagccaaccccatttattggtgtgcccacaagggatcatccttgtggagaataccggacgcggataaatcaccattctgcaaaccacctccaggcctcacctctcagtggaaaagattgaccatctcactttacatg

SEQ ID NO: 108502 - DNA, 231 bp, Heterodera glycines
  Promoter: Source sequence=SeqID_11203; Location=4122..4352; Strand=-; Gene=SeqID_74557
agtggacaatccgtcactggacaatccctcagtaagtggacaatccgtcagtggatatccgtcagtaactaatccataagcaaatttatttttaaaatacccagatttatttaaaatcatgtgaaaatttatttgattcgctaaaaagctgaattaatgatttgtgttatttaaaaaaaaatatatgaaataatcattttttaaaaaattaaatgataatttctagagatg

SEQ ID NO: 108503 - DNA, 634 bp, Heterodera glycines
  Promoter: Source sequence=SeqID_12057; Location=456..1089; Strand=-; Gene=SeqID_75585
tgtttttattgtgaaagaaatgtgtggcgcggcggttagtgtcaaaaaaataggagacaaaattgtcgagaacatcaaagcagcacattcgagagcgcacgagaaccggttgtttacgggagaagtaatttaattggggacgaaaattgtaaattttaaattggcaatcaatggaaaacaatgaaatcttgtcttataaagaaagggctagtggaacttaggctgggcaaattttaattctaatcagatttttctagcagctttttgctaatttgaggaattttgtcaaaaaatcctttaaaacaataaaaaaaactcaactccttactttcaaaaaatcctctttaaacttctccaaaaccacatatgatgtgataaattcttgaaactatattctgcttataattaaacgaaattgctcaaaatattattcccttcaaattaaagagaagccaattataaattaatttatttcttattttttatattcggtgtttttttttgccaaggggaaataataaattctctaaatatcgtcgtaaattgtgctcccggcccacctgactgctggttgctaattgatcaagggaacgttttcaatcaccgatcgcattaaattttacaccacaaaatg

SEQ ID NO: 108504 - DNA, 253 bp, Heterodera glycines
  Promoter: Source sequence=SeqID_2699; Location=4747..4999; Strand=+; Gene=SeqID_81150
agtgaataaaaagtgaaagaaacaaaatgattggacagtttagcacggttttgttgacattgaccaattggaaaggaacaatttgcccaaaatgacagaacagccccaggcgaagacacggaaaatgtcggcgacatcaaactcagccaagtttagtcgaaattggccaacaaattgcaggcgagggaagaggaaaacgaaacgacaaacattttaggtgtcaatttcatggacaacgaccgcaccaaaaatg

SEQ ID NO: 108505 - DNA, 1003 bp, Heterodera glycines
  Promoter: Source sequence=SeqID_29537; Location=607..1609; Strand=-; Gene=SeqID_60029
caaatcccaaccccaaattgcactgcggcaatgtccctccgctgactttccgtctttgttcattaatccaaaaatcatttccaaaagtgccctccgctcaaatgtcttcaaagggtgagaaatgggcgagggaatcccatcagatggaacttccgttgaggacgacccgtaatagaaggcaaagttcggaaggccacgaaaatggcggaagaccaaaaagaaatcgttcgatttcgaccgatgacggaaaatgcgttgggagaagcgatgcgcgcgcaatgggaacaaatattaaaccgacaaagagaatggcaggcgaaatcaggcacaaatgacttacgatgcgatgggatggcaatgaatcgcgccaatttcacctctttccctccctttgtgctccttcctcgcccttggcatgtttaggcaatttggacaatggcaataaaacactcagagattgttatgaataattaattacctaattaattaacattccaaattgccgaattcccctctttagtcattttttaaaagttcataattcgcttttttcatatcattatgcttctttttaagtcttggctttgctcgagtttaaaatgcttttttttgttctttgttttatgggattattttcatagtttgatactttcttcttcatctgaattttgactgcaaactaaaaatttataaacccggaattcgaaaaaaatatcttaactttttttttacgaataaatcttctgctttttcttagaaatctctttcgatactaaaattgttcagtttaattagagctaaagctgaagcgagctatagcctatcgaaataacatcttaaaaagggcattgatcaatgcattttgaattttgcacaaatatggccaggtttggtgttatgattgttttgtttaaaacatggacacggagttgacccaccatttaaacatgtgtggacccataatcggatggttaggtatacctattttgtttttaagaaaatg

SEQ ID NO: 108506 - DNA, 530 bp, Heterodera glycines
  Promoter: Source sequence=SeqID_35235; Location=216..745; Strand=-; Gene=SeqID_64834
ttgtcagttgggtcgcatccatttaatagcatctttcagtgacctacctattcgtcattccttcatttttatctttgtttatccatgtacatattccaactctctctgaatcaataactccgcttttctcctcccaattttttttttattggtcgttttcgtttagtcgcaatattatggacattgtacccatttttattccaaaaattcattgttattttgctcaaaacaaataaatagtacaatttatttgtatattcgaagagctcaaatgttctgagcattcaaaattctaaaaaatcgttttgtttacaaaaaaacacaaataaaaaatatttttaatctttttttgttatagcttttttaaaactattaatttttttgaattttaaattataaaaagttgaaattcccattatattaattgaatttaatatctcatgacccctaacactcttctgactctaaatttggaatttccttgcgcttacaaataatttaactaaatttaaatgtttagaaaagcgatg

SEQ ID NO: 108507 - DNA, 80 bp, Heterodera glycines
  misc_feature (58)..(58): n is a, c, g, or t
  Promoter: Source sequence=SeqID_9746; Location=1..80; Strand=+; Gene =SeqID_72569
atttttatgaattttaataatcatttcataaaatttaccattttttattttattatgnagaggcaaatgaaaaaggaatg

SEQ ID NO: 108508 - DNA, 839 bp, Heterodera glycines
  Promoter: Source sequence=SeqID_19772; Location=517..1355; Strand=-; Gene=SeqID_84506
tgacgggcttcaagtgaatggatcaagaaccggacccggcctgggagatagcctttgaaaaactgaacaaaaaattgttcttaaccgggccggtccgggttccggatcaggcacttttggtgccccgaaagtggtgcgataggcttccggaaaatgaccaatcaatcactgagcttttttgtggaatgactcaccacgctttcgaatgataccaagattgttagatttggccaacaacgacaaaagttgtagtccaaaacttgggctggcaccgtaccgtcctgagaaaaacagtaattttaaaaattgacatattctgaattttcatttttaaaatttcacgatatgtgttgaaattttccaaattattttttttagtgaaaattggttacaaaacagtaacgaaaggtgcaatttaattgttgaccaaattacaaaagggccaaagaacaaattgtggcagaaaattgtttcactattcgtcaccatttcagactttttgtcactattttgactttggtaatatttcgagattttttaaagaaatggtttttaagttgacttttttttattatgtatattaattttaagtttcagattatcgaaaacaaacttaaagtgaatgggaattgccgggaaattgaggtacagtatgtgtttttttggtactgtatatataattttgatttggttttattgcaaaaatgagcattcttttcacaaaaaataaaatcccattaacaactaaataaagtatgtaactggtgggatggatggcattccgaggcatggaaattccaacataaatcgaattcttacctcaaaaatgtcaggaaatg

SEQ ID NO: 108509 - DNA, 536 bp, Heterodera glycines
  Promoter: Source sequence=SeqID_140; Location=1008..1543; Strand=-; Gene=SeqID_74213
ttcaaacatggcgaaatatggaaaaaatatggacgaaaaagtgaaatatggaaatatatggattatatggaaaatatggaaacacaaatacaaaaaatgaaaaatttaccagagaattggattaaacatttgatttacatttttagagcaaatacagaataaaggaaaaggaaaattttctgtttggaaagaaaataaaagctttcgcttagaagaataaccaatcaaagttatttcataagaaaaattgtttttgcttttgaaaatgcacggtgtgtcaataacaaactctttttgttgtttggtgtcttaatcgagtgtgcatgtgagcaataacaaagaaagaaaagggaaggagagagaaattgcaaaatctttcgtgccaataaataatctgtttttccgctcaaaaaaggcaaaaaaacacggaatgacacacccaattagtataatagattattatgtatgtatattttttgttattgtgaaacttgccaaatacatacatattatcattttagatagattttttaatg

SEQ ID NO: 108510 - DNA, 125 bp, Heterodera glycines
  Promoter: Source sequence=SeqID_32263; Location=985..1109; Strand=-; Gene=SeqID_62580
taaaattaaatcaaaaaatttaaaaaagaatatataatcttcaaaaatcaattctatttttaggttattttttctttttattttttaaaatgattttaatttaaattcttttcaggccagaaatg

SEQ ID NO: 108511 - DNA, 1003 bp, Heterodera glycines
  Promoter: Source sequence=SeqID_7856; Location=1238..2240; Strand=-; Gene=SeqID_66176
ttatcagaggcataaatcataaaaaactgtccacaaacattcgacgggcgtggatttgatccttttcgctgctgccgacgacggtcaaatggaaaaggcgcaatccatcggccgattaggcgggggggggggagacggatgatcagagcaatcggcaggatcaatcagccccgttggtgtcaacctgtttactaatcagccattcttggtcaccgacagcaaacagtccgccaacgaaatgcaaaaagaaagtcccatctgtgaacaatgagtgagcaaaacgcatcatattaagcaggatttggacaccaccgaataaattaattaatgaaagcatttaaaataaaaagtcaaaatgttaagcaaaactgatcaatgaaaaagaaggtcacatacgcactgttaaccataatagcggatttacgaaaaaaaacttacaattagcatcaccgatttgtcataatttgcttaatttctctacaaaacgcattacattaatttaattcttttttattataattattattaaatgaaaaaacaccttcccaactcacgtcattcgttagttggcacgtggcatgtgacttcaaaaaacaaaataaaaaacaataataataataataattattattattataatgttagtggtgtctcaatgctaaaaaacataatatttttaacggaaataagagctaaaaaataaaagggccctaaagaaaaaggagaaatcacacgacaacataataaatattttcgcacgagaaaatgcgaaaaattttgtataaaagtgaacgcatttcactcaatctcaataacttttgcgggaaaagtgcccactccccctcgcctccctcgtcagattagtcagcccatgccatgccattagtgacaatcaaagttttttatgatgtaaaatcatttacatggaataattttgctggaaaagtgcattttcattgatcttaaaaaatatttttttatataacagaaagaaattgaaatg

SEQ ID NO: 108512 - DNA, 913 bp, Heterodera glycines
  Promoter: Source sequence=SeqID_7780; Location=2455..3367; Strand=+; Gene=SeqID_65939
tttcggagcctttagtaaaaagacgacaattaattattaattaaataattaggaagcaaaattaggcaaatgcctacattttcaggaagtgttaatgctaaaataagcaagaaaaacaattttcacttagttttgagcttatatatttataaaaaattttgtgcctaaaattgactattaattaattatttaattaattactaatttaatgcgatttaacgctggatttacggaccactcatttttttccaacggaaaacgagcacaattgcaaccaaaatataaaataagaaggaagtgcagtcaatcagcagcccatttcgcaacgctgtttccgccgccatgccaaaggcgaacgcgtcactgttagtgcacaaaacgggcctaataaaaaacaataattaattaattaattgattgatttaattgaccaatccggatatgtaaaaagtgcccaattagcagccatcacaaccatataaatgctgtaaccgaaagtgacgaaaagcatcggagagatgtaaagaaggagatgtttctccaaaaggttgcaactaattgatccattaattggttaataattacacattaattatgcaaaattaccgtaacggaaagagaacggcgattaatcggtcgaagccgacaaagaaaacaatccaaacggaggagaaaatgctcaaatttggcagaagttggaggaagtaacaggtgaaaagggagatgaagttgtggccagacaaagtgacgacaaaagtgacggagaaagtgagcaaagaaacgatgtcgagcaaagaaccaatggccaaaagggtggagcaagtggagcggagactccttggaattcgggggggggggggtacaatgttttaatgagacacggaaaaaccaaaatatacatacataaataatg

SEQ ID NO: 108513 - DNA, 83 bp, Heterodera glycines
  Promoter: Source sequence=SeqID_15470; Location=996..1078; Strand=-; Gene=SeqID_79744
agtttagaaggatattgattaacgacattactaagggatttgaccccttgccgaggagttgtacgaagcagggggttgcgatg

SEQ ID NO: 108514 - DNA, 1003 bp, Heterodera glycines
  Promoter: Source sequence=SeqID_31439; Location=646..1648; Strand=-; Gene=SeqID_61782
attcgttttttttcgattttttataaaagtcgttcgattgtttcggtttttttgataaattcagtcgtttttttacagcactttgtttgcgctgcgcatattcaagaaataattttcggaataggggagttcggcagtgccgataaacgccgccggtaaatttttttaaattttcaccaatttcttaacagattttatacgtccaaataagaacaaaggtcgcttttttgagtcaatttttaatggattcttctgacaggccgaaggcagagtctagaaaattttacaatttttctaaaattttgcgatgaatgagatttattgttaaaacttatttagttatagtataaaatcattttttgagaaatatttcgatgacatttgatagaatgggatgatttctattaattttttgataataccaaggagtgtttaggcgtccaatgagtgaccaccctcactttttttggtcataacttttttcctggtcaatccatgcattcttggtatcattcgaaagtttagcttaggaaagattttttatgcaaaattctcggataaaggcaatacacaaaaaaattattcttgaaatatacgcgaaaaaatatgcatttcgtggttttctcattgcaattttttcttaatacaagtatttgttcttttcttgtatttataaattccctaaactttaagctttcgaatgataccaagaaattaaccaagtaaaaaaaaagttatgacctataaaattgagggtggtcactcattggacgcgtaaacatcgattggacgcgtaaactggaatagagtcttttgtttattacgccattttattttctgccacttttttcccttttttaccgtccatgccttatcttatcccgcgatcccccccccaccccctaaattccgtattaaattgacaaaaaaaagagcataaaaacggagcccacaccatttccctccaatttaaccagaattgctgacatcagtgattggaatg

SEQ ID NO: 108515 - DNA, 630 bp, Heterodera glycines
  Promoter: Source sequence=SeqID_9601; Location=1461..2090; Strand=-; Gene=SeqID_72044
ttcgtctttttcatcaattatttggatttgtaatttctctattttctggaaatgttcttcgagcgatttttaaggaatttctagtattagaaaattttaaaaatttcaacggcggtgctttttgaaacgaaaatcttttaccgaacgatgattatcctccctttcttaggccttaactttttccgtacttggtcattgcatatattccagctatcaaacaaaatcttagtctctgaatttataaatgatgcgttgatgagaaacgaaatttccgtattttcagtaacaatttttttatttcttttcttgagcatagtttagttacacaaaaacttctgtacctttcaagcttccgattgatactaaaaaatttaggtcgggaccaagtaagaaaaaagttatggcctaagaaactatgtatggtcatgattggacacgcaacaaaattcattatgcaaccctgactaaatacacattacacatccgtacaaattgtcacccttttttgtcaatcttgtaaaaggaccttatttgttaaaattgtaaacagcaatattcccgttttccgaagcagctaactaatccttttttagaaattctaaaataaattctttattttctgaaaaaatg

SEQ ID NO: 108516 - DNA, 975 bp, Heterodera glycines
  Promoter: Source sequence=SeqID_3073; Location=1..975; Strand=+; Gene= SeqID_83080
taatctgccaaatgttgttaatatcgctttagtaaaatttcagctaaatatatagtatatattttaatacaaaaacagaggtataaaattttgatctaagatgcagttaaaaaattatatttcaagatagaattttcaaataaagatattttttatataaatgtagagaaaacataattattagtaaaattaaaaaaattttacaacaaaattttttaattttattaaattatgcaatattcaaaatagcaaaattctcgtttaaacaaatcaaataatgaaaacattaatacaatttccaatttaatttaattatttttgattgcgatttgccactaatagcagccacagcaattgtaaccacgccctgctccatgaaggaacagcaaagattcgtcatgtcaaagtttgaggacaacaacttgtttgatcgccatggctcatcaacaccactaatgaggactgcagatgtcccacaaactattagggcaattgaaatgaaacatgtacactctacaaaaattatacttttgacaaatcaattaaataattttcaacaaattaagaaacaaaataaaagtgtctttgaatctaaacgacaaatattgaacgaaaaaataattaatcgcggaaatttaatcgctataattcaataaccaaataattttaaaaaactaagaggtaaaaatggaactgaaactaaaattatttattaaaattcattgattgcaaaaaaatacggcgtcatttaaaaaaaatatcatgcaaattctatgggaataatttttgcagcaaatttttaaatatttaaagaaactaaattataataagaaaaaaatattataaaaagcaaataaaaagaagcattataattgatactatcatattacatcggccggcggactgttggattttggacgcttggggttttttcattttttttgcttttttaatttaattttttgcagtgggatg

SEQ ID NO: 108517 - DNA, 183 bp, Heterodera glycines
  Promoter: Source sequence=SeqID_9324; Location=837..1019; Strand=-; Gene=SeqID_70996
aaggaagtgatcgtcgactccatcgacattcaacgacaactcctaaatgagcaggcggtcgcctttcggtccatgcgccgcagtatagaggaggccaccgacacaagaagaagtcctctcagtgaagtccgcctcctcgagcgctggtccacctggtctctgcgcggggagtgtcgccaaatg

SEQ ID NO: 108518 - DNA, 163 bp, Heterodera glycines
  Promoter: Source sequence=SeqID_22594; Location=1205..1367; Strand=-; Gene=SeqID_53259
ggtcaatatttatctttaaggcgggatcagtaacaaattgattcactcttgttcttcttgatcatccaaaatttttacgttttattaaatttcagtctttctccattggtcatcatagtttccttttttgcagattttggtggagcaaagtaatgcagaaatg

SEQ ID NO: 108519 - DNA, 407 bp, Heterodera glycines
  Promoter: Source sequence=SeqID_14985; Location=1..407; Strand=+; Gene=SeqID_79145
atttggcacgtgatcagttggccgttgatggggagctttcgatttggaatgctgtaacattttttaaaatttattaaaatggaaatttgttttttcctatttttcccttaggcactccgttgggccgacgcgcaatgcctccaaaaaggcaaagaatgttcgggggaaagtcggcgtgatgtgcttggcccggcactgttcaaaattcgtcttacgcacatcactcgggaggatttctacaaatatatcggtgaaaaacttaaacctttcggtgaatttaaatagttggccttgtaatccttcaacataatggtcgaaaatccccgactaaatttatttgtggggtcggtataataataataattaatttgccagttccgaccggtgtgttgacagtttgcgaaatg

SEQ ID NO: 108520 - DNA, 201 bp, Heterodera glycines
  Promoter: Source sequence=SeqID_12162; Location=889..1089; Strand=+; Gene=SeqID_75735
aataatatttaaaatttagttcaaattagaaaaacggaaacgccaagaaaatcgaaaagaataattcaaataaatgaaaaaaacaaaattgaacactgtgcagaggaagcaaaaaaatgcattgagaaacggagaaaaagtgacaatttataaaataattatgaagtggaattaattattcattcagaaagcagccaaatg

SEQ ID NO: 108521 - DNA, 1003 bp, Heterodera glycines
  Promoter: Source sequence=SeqID_19586; Location=831..1833; Strand=+; Gene=SeqID_84326
tttctgttgatttcactgataagccaaaaataatgtgaattaattgttaagcaaacactttttttcttttatgtttccgaatttcttaaatagttattagtcatcattaattaaatgattaaattccaaatttcattaaattatttgtggcaattttttaagcagctattaaaatgccatatttacacgtaattgccattttttcttgtaatttttttttatcactctttgagatgccgctggacgagcttttgggtaagtttttttttcattgtcaactaaattgaacattgttagtattactatgggatgacagttttagacaaaaaaatcgccaaaaaagggccgaaaaaatcaaaaattccaaaggcatgaaaaaggcaaaaaattaaaaaaggcagcaaaaaactgcgctaattttctcaaatttttccataattgatttgatgatttgaaatatttctgaagaaaaaataaataatttatttttatttaacttgaaaaatggtaaaatattttttgcaagttccaattgttttcttcacacgattccgttcagtgcccattttcggtgaaattctttaaaattaggggtccctattttaggtgcaaaaaaaccaaaaataagggcggggccaagaaaatgcttcatttggcattccgcaatcaatttcaattgttttggtgtttttgtaatcttaataacttacatttttctatagttttttgcccatttttgaaataaaaaggacggttcttacgacatttttcggtcccattttgcctatgcttttttccctcccctccaaaataattttagctttttaatatacgctacagaaaaaagcatcgtgtctttttttggcactgcaaatcatttaaattttttattaattgatttgtatttgccatcaaatggctggcaaattcgagtggtttcctatattttttaaaacatatgcattttataaagaattgtaaaatatttccaaattcacagatg

SEQ ID NO: 108522 - DNA, 341 bp, Heterodera glycines
  misc_feature (74)..(74): n is a, c, g, or t
  misc_feature (108)..(108): n is a, c, g, or t
  Promoter: Source sequence=SeqID_39346; Location=1058..1398; Strand=-; Gene=SeqID_67933
catcaatttttgcacgtacaacttatcaccacacaattcattaattgtttgtttataaaaattaattttttatntaaaaaatattctgaaaattaatgaaaaattctntaaataatatagggaattgtctttaacagggctgtcagaatatgcaaatgtatattttttcctggattcacgtagtctgattagtaggaaaaacactttgtttttagtatttgcgtatgaagtcgggacttttatttccataatttgtatattcatttttcgtcaaatacttccgatttgaaatcccttagaaaaaatttgatcatgccaaaaattaaatccaaatcttaatg

SEQ ID NO: 108523 - DNA, 394 bp, Heterodera glycines
  misc_feature (68)..(68): n is a, c, g, or t
  Promoter: Source sequence=SeqID_28570; Location=1..394; Strand=+; Gene=SeqID_59169
caactcgtgcgcttaaactccgccccaccagcagaaaatcctttaacgtacaccacgttgggtacggnacgtccctcccctcctccgtcatccgtcggcggtattttgccagcggcaattgatttgcgttcgttcgtcaaattccccccgctgctggtgtccccccgccattcgtcggtgaacgaacggtcgcactttttctcgaaaacattgcgaaaggttctaaggtcctcgagactgttttttgccttttgccccttttggtcaatgccttcccaattttgtcaaatgcaaacgcaaatttcccactttaagattttgcggtgagaagtgccttttgtgcctttttgtttctttttttgtgcctttcctttggcggaactccaaaaaaatg

SEQ ID NO: 108524 - DNA, 895 bp, Heterodera glycines
  misc_feature (65)..(65): n is a, c, g, or t
  misc_feature (87)..(87): n is a, c, g, or t
  misc_feature (102)..(102): n is a, c, g, or t
  Promoter: Source sequence=SeqID_25819; Location=1..895; Strand=+; Gene=SeqID_56583
gtcagttcatttaaatatttttatccaaaaaattttttttgggtttcgggggcagtccccctganccgatgcgcccagattatgggngagacgaaatccttncggaatagcttcactatagcctgtacttaatttctgcgtgggatttttgctccccataattgttggagtaccccaaacggacacttgaaaaaatcgatttatttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataaatgtttgagtaccccaaacggacacttgaaaaaatcgatttttttgtttcataaatatttttttcagaaagtcatg

SEQ ID NO: 108525 - DNA, 1000 bp, Heterodera glycines
  Promoter: Source sequence=SeqID_2150; Location=7103..8102; Strand=-; Gene=SeqID_78098
tgattggccatgatcaatttagagcaatttttttttagaaataggtaagcattttgtgaaattctaagcacgaaaaacggaagttgatttttttgcggcgctttttccgaaaaacttgaggaataaggggggccagcggtgccgataggcgccgccgcgaagaattttgtgatttttaatacgatttgttaacagatttatccacaaaaatggccaaattttacggttttgagcaaatttttaagaaaataaaggatttttaagctcggggtgttccgataggcgccgccggggaaaaattaagaattttgactatatttttagctgattttcattgcaaaaattcttaattttgtgaattttcggaaaagaattggttattttctagtttttatgaaatatttaacaaaaaaccacaaaaaacctcaaaatttctcaaaaaaccacaaaaagcctcaaagtctcattttgaaaatttagcctcattgacctatcaaaaaaccacaaaatgaggctaaaacctcacatctgggagccctgattatcacgaaagcgtgaaaaagacaaaaaaaaaatttaaaaattttattattggtatttaattcttttcaaaaactttcttatgcattcattcattttctcaccaaatttttttcaaagtgtgtgaaaatatgtaacacaaatgtctcaaatttgttgattttcatttccatatcatttatattggcaaagtcaattattttattaaaatcacaaaaatttttggttatttatttgaaatttttgaaaatctcaattatatattaataaaaattacagaaattcaaattattaatttttagaatcttttacttacttactgcataaatatacaatttaaaatggaccaaaataaaacggtatttaaaaaattattatataaataataaattattggtttttagctttttgattaagttttagaatcatttattcattgcttattatatcaattaaaatg

SEQ ID NO: 108526 - DNA, 125 bp, Heterodera glycines
  Promoter: Source sequence=SeqID_3558; Location=2141..2265; Strand=+; Gene=SeqID_50861
gacatcgtacggaagtgacggaacgaattcatcccaaaatgaatttaatgggaagaaaaaagtcataaagaaaataagtgaaaaagagcaaaggaaaacaggagaggacgagaaaaggagaaatg

SEQ ID NO: 108527 - DNA, 125 bp, Heterodera glycines
  Promoter: Source sequence=SeqID_22707; Location=1328..1452; Strand=-; Gene=SeqID_53393
agaaattgtaaagatagatggaccattaataataatttactaaatagcaagaaattgtatgggcatataattacatgaatcaaagattaatgcaaaacctttgatttttcagaacccaattaatg

SEQ ID NO: 108528 - DNA, 159 bp, Heterodera glycines
  Promoter: Source sequence=SeqID_39518; Location=1031..1189; Strand=-; Gene=SeqID_68070
agattgcggcaagaattggacaaaattcccggcattttaatggtaattcacgttttataaactgcttgatttgctcagatttcccaagcgaattttgactacgaatctgcgtcagtgaatgcattttgcgatgtttttccaactgtcagaccaaaaatg

SEQ ID NO: 108529 - DNA, 611 bp, Heterodera glycines
  Promoter: Source sequence=SeqID_529; Location=1..611; Strand=+; Gene =SeqID_55517
attttcaaaaaaaagaattttaaaaaaccggaataaaattttttaatttattttttcatttaataataaattttaaaatgctgatttttgtcggccaaatgctgatttggaaattttcagttgggagccccataatgagctcagtctgttcaagacttaagatttataagtctaaatagaattagacgggtctcttgatattttcgggcacaaataagccgggtattcaggtctaagtccaaacagaaaactagtacacgtctaaccttacgtttaaacagctgtaagaattgactaaatagactaaataataagatcatcaggtttcaattcttctatttttttaattttcaagaaaatataaatttttaagcacaaacttgttaaaagttattaaatttaattagtcttatgacttttaatgtcaagctcgccataatggtcttttctcagtttttgggtcattttaaatagtatccaccattggtgtgacgtgataagaatgaagcagcccactaagattttttttgtctttattttaaattaacacactgtatatcgagaaaaaaacattattattctttaaggtacttttttttggaaataaaatg

SEQ ID NO: 108530 - DNA, 134 bp, Heterodera glycines
  Promoter: Source sequence=SeqID_41248; Location=821..954; Strand=-; Gene=SeqID_69421
tgcagggcgaccttttgcaggcattttttggggactcaataaattattttaaataaataaattttaatttaaatagatttaatttaattaatttgaacattaaataggcggctgatgcgatcaccgaaaatatg

SEQ ID NO: 108531 - DNA, 140 bp, Heterodera glycines
  Promoter: Source sequence=SeqID_28433; Location=1525..1664; Strand=-; Gene=SeqID_46100
agatttaggcttttatctattgattggatgaattgttgatttagggagtttacctattaatttttccacattttttgccatggcttcaattgacttgtcacaagaagttagtaaatttcactttaaagtagatataaatg

SEQ ID NO: 108532 - DNA, 123 bp, Heterodera glycines
  Promoter: Source sequence=SeqID_5913; Location=2754..2876; Strand=+; Gene=SeqID_59655
aaagaaatattttgcgctgctatttatttgtctaggcgacaaaaacttagctcaaccacgcgcacccacactgatagcatccaggcgctgttatcaatagtgtggtgaacaaccaaaagaatg

SEQ ID NO: 108533 - DNA, 738 bp, Heterodera glycines
  Promoter: Source sequence=SeqID_29956; Location=467..1204; Strand=-; Gene=SeqID_60426
attggaaattttggcctttttcaaattcctattttgtgtctgtttggattaaaaattaatacattgaatgacggtctaactcagttgggcgcactccaacttttgatgctgctgctgcgcattgtgcagaatgtgctaattaattctatggcttatttggccaattgagcgatgaagcgagcaaaaattcctttgattttttgttggcgattgttttgcgtgaaattgtattttgataaatcctccaatgccactcctttgcctgcttcgcttcccttcccttgtccatatggcttttttcctatgctttatccaatgcttttcctccatttccctgtgcctcccctcggggcttacattccatgccctcccccccccccaccccacccttctcattcatcccgttttcgcttctctttttgcccctcctataattcgattattctccccgtttatttcccaaaagtgccgcgccgtcgtaaaattccttcgtcacttttttcgccaattgcactgcgcattttcgttaattttttcacgccattctttcgagtttttcaggaatttccgtccttagccgcgaaagtgtgtttaattggattgacgattttagcgaagaacgatgtgcttttgttgtgttgcactgaggcggaatcgtacacagcggcggagcgaaagtatttaagcgacaaaggcaacggacagtcaccgaaagagtgccgaaagaacgaagaaatg

SEQ ID NO: 108534 - DNA, 514 bp, Heterodera glycines
  Promoter: Source sequence=SeqID_12297; Location=1..514; Strand=+; Gene=SeqID_75887
atcactatttttaaatataataacagcagttgcaatcaaatgtttttcttttttatttcttcttattgataaaaatctttaattttttaacaatgttttttgcttgaaatttatcattcaacaaatctaaaaaaacttacggcgttaacggataagggaagccacatggtgatcagctgtgatcacaggtatctttcaaatttgtttatttatttattttttatttcatcttgtcacacaattacagctaattgatcaatcgcaaaataaattagttagttataaaaccattttacataatgatattaattaattaatcttatacagcagataattattactaatcgtagcatttaacattagtaattacaaaacgaccgcgaacaggtgatcaagaaatgattgaatagagaatattttgcatataaaagaccctcaaatttgtctgtaatcagtttcaaatcgtattttaattccaaaaatcaacaaattcacctcccatttttacaaaatg

SEQ ID NO: 108535 - DNA, 935 bp, Heterodera glycines
  Promoter: Source sequence=SeqID_2628; Location=6367..7301; Strand=-; Gene=SeqID_80793
ttgtgtcgattttgttttgctcaatttctcttagaccattccaatggaaatggggggcgtagagtgactttgtgttcgttttcttatcatacatgaagggctttcgagattttcagcagattatgtatgagcctatctgacaatctgcggacgtttcaatctctactctcgtctactaaaaatcggcacccaaattcatggtcaggctcaacggcagcccttgtggcatcgatcaattagtcgcactcgatcaatctcaattatgatagcggagggtggacggccaggggatggttggcgtacgggattcggagggatcgctctacgtgatggcgcttcggtgactaatcaggcgggatcccgttccgcaaagaattttgagtccatcagccccttttaatgcatcccgccagcccctaaaaatttatttttcaaaacttcaggtattttttgatttttggatttgaaatttaattaaatttttttcgaattttccaaaatttatgaaccaaagttctgtttattaatttttaatgatattttgacactacaaaagacaaaattcgcattcccataatttctcttttcatttaaatttcgaaaaatgctactgtttgtttaactggtgtgttgaatgttaaggtttgaagctggcaatttttatgaaccaaatgttttaaaattattatgaaatatggcgcaaagcagacaaaaaattcaaacaatctaacaatttgaatgctaaataaatatttggtcaaactctttaaatcaaattttccatataaaaaggtcttttcagaaaaaaaaacataaattattcaacatctcttaatagtgcagtttatctaatattaattaaattaattatggctttgcttgggcctgtttagaataataattttgaataaattttgtcaatttatataaaaatg

SEQ ID NO: 108536 - DNA, 263 bp, Heterodera glycines
  Promoter: Source sequence=SeqID_21986; Location=874..1136; Strand=-; Gene=SeqID_52619
atgaaatgattttttccttgttttacctctaaaccgtctgccaatttatcaacgaatatttaccatgattatatttttgtatattttttctgtaactctcagcagtcggccctaatctgtgatcctttccatgagggaatgagaatgaaaaagggagaaattgttggtccctatcccagccgagccccttcttttcccaggtggtgttgcccaagttcaaattggaggccacgcacggattgaacaaaccgttgaccaacatg

SEQ ID NO: 108537 - DNA, 250 bp, Heterodera glycines
  Promoter: Source sequence=SeqID_1294; Location=699..948; Strand=+; Gene=SeqID_71821
tgtgttgtgctttggggcacctttggtcggactttggctcggttaatctatatgttttgtttatttgcgccttgatttgataaaaaatgaattctaacatgtcttttttgcccatttaccactcaaaaaaggcatttaatccactgacttacaattaactcggtgttatttgtcgacttatttttggttcatttgttctttcacaaaaccatcttctaattattgcttttgactttgtcacccgccaatg

SEQ ID NO: 108538 - DNA, 415 bp, Heterodera glycines
  Promoter: Source sequence=SeqID_26984; Location=1191..1605; Strand=-; Gene=SeqID_46021
aatgtgccattattgactacgctttccttaacaattgattgagccgcaaaagccacccgcccgaaccggcaaacgcatcgctatcaatggcagtgggcctgcggggttggcggtggctgctcaattgaacaaagttggccacgcggtggtggtatacgaacggaagaataggattggtgggctgctccgctacggcattccgcagatgaaacttgacaagttcgtgttggaccgacggttgaagctgatggatgaggagggcatccggttcattccgaacacagagatcggcaaacacgtgccggcagaattgttgctgaaggagaacgacgtggttgtggtgtgcacgggaagtacgacaccaagagacattcgtatcccgggcagggaggcgaaaggcatttgtttcgcaatg

SEQ ID NO: 108539 - DNA, 241 bp, Heterodera glycines
  Promoter: Source sequence=SeqID_8835; Location=384..624; Strand=+; Gene=SeqID_69366
tctaagagttgagtgataactgatcgatttttacggaacccatgctgacattaaggtaaaatcttattggtttcaacaaaatctcttatatttcgagctatattttcttctaaaatttttgacattgtacagagcaaagaaattggacgaaaatcaatgggattagcaggattcggaatttttgggattggacaaacaatcgattttttccatattgtaggaattttgccacacattaatg

SEQ ID NO: 108540 - DNA, 170 bp, Heterodera glycines
  Promoter: Source sequence=SeqID_17420; Location=1697..1866; Strand=-; Gene=SeqID_81901
attttattcgtttaccactactacgcagaataaaattgtcaatcttttcggctttcacttcagtccttttgtctgttttcgttagagtcttcatcttttcatcaaatttggttttgtactccgaatctttatgcttttcacttttcagatgacaaattaatgatgatatg

SEQ ID NO: 108541 - DNA, 216 bp, Heterodera glycines
  Promoter: Source sequence=SeqID_23948; Location=2193..2408; Strand=-; Gene=SeqID_54641
agttgaatatattttttgcctttgaattgactgatcactgatttcttttgtttatatttttgtttgcccaccccaaatggccctctttaggactgtaaccacccaaatggacggaattgacatgcttttttattgagtttttggtcttataaatcggacataaaaattcgatggcacaaaccttggtacctagtaatcgatccgccacttaaaatg

SEQ ID NO: 108542 - DNA, 136 bp, Heterodera glycines
  Promoter: Source sequence=SeqID_7293; Location=1..136; Strand=+; Gene= SeqID_64373
cgttgtcggtgtaaaaaccggtcatctgttgggcccttcttgaaacacggaccaaggagtttagcgtatgcgcaagtcattgggtgttcaaaacccaaaggcgcaattaaagtgaagttttcttacggaactgatg

SEQ ID NO: 108543 - DNA, 425 bp, Heterodera glycines
  Promoter: Source sequence=SeqID_30249; Location=566..990; Strand=-; Gene=SeqID_46199
ggaagtggccggtagggaaatggctggtagggaattggcggtagggaaatggctcgatcccggaaatatggacataaatcgcgaaatatggaaaatatggatatagaaatccttcctagaagcttcaaaccaagctaaaaacatgtttttcgtgcgtttcaggcctcccacagtccaggaaaaaatatggatttccatataattggactccctacttataacttggtcaatactagaccaaataaaaccattttatgctcattttgaagggaaaattctgaagaatatttctaaattagtcaaaaatttaaaaaattgtttattgacaaacaaatgatttcattttcttgagtgtaaaatgccccaaaatttcagccacggaatttattttttactgttcaaaaaaaaattatatttgaaaaatg

SEQ ID NO: 108544 - DNA, 257 bp, Heterodera glycines
  Promoter: Source sequence=SeqID_30676; Location=417..673; Strand=-; Gene=SeqID_61083
ttggcggacggttatgaatgcgacaccagttcgggatacggaaggtttctgggaaattagttcattttttcagaatcccggaaattttaaattttgctaatcggaataaggaagtttgaaaatgtatgggtttcaattcaattagttcacttatgggagtacatcgtggatgcctaatttcccgttcggcacactcattttggttatgtccattcagtcctggtgcgctcggcacgccgttggcgagtccggcgatg

SEQ ID NO: 108545 - DNA, 95 bp, Heterodera glycines
  Promoter: Source sequence=SeqID_5163; Location=2582..2676; Strand=+; Gene=SeqID_57117
ggtaccattttcttgagtgaagatttaaatgtttaattcaataaaaccatttttaccgttttttgcagtttcagtttgttgtttggtttccaatg

SEQ ID NO: 108546 - DNA, 213 bp, Heterodera glycines
  Promoter: Source sequence=SeqID_10481; Location=1742..1954; Strand=+; Gene=SeqID_73693
ttttcttctgctgaaataggaatagacggctaaattttaatattattattataattttgggcaagtatgcaaatgtaaaaagtaataaatttatatttataacaaattcattatttaatatagataagtaatatggattgaaatttcgaaaattattaaaattttaatttaaaaaaaaaaaataatttcagaacaaaaaacttatttcgaatg

SEQ ID NO: 108547 - DNA, 493 bp, Heterodera glycines
  Promoter: Source sequence=SeqID_3869; Location=2779..3271; Strand=-; Gene=SeqID_52231
taatttctttgaaatataacgaatttttaaaatttgcagagagaatttttaggtttaccgaacgataacaaattggttaaattcggacaatatgaaaggagttatactccaaaaaccgggctgtcgcccagtttgccatcgtccagttttacaaaagaaatcgcgtttcacaatttttttttcatttccagaaaatcgtggctcaaaataccgaaggcggctttcggcaaagccgtcttcgaacatatgataggtgcacaaatttaattacttttttaaaatgtaattaaacatcttttctcgatgattttaaggtgcctgccctgccgtcgtgcgtctattcgacccgccctctgacgcgtcgacaattgtgcgtcatcaacgctatttcacggagctggttcagcgtgtggtggacgcatttttgcgaccaacccctgaggcactcaatatttttaaataaattttaaatattttttatttgatagcaatg

SEQ ID NO: 108548 - DNA, 1003 bp, Heterodera glycines
  Promoter: Source sequence=SeqID_6813; Location=300..1302; Strand=+; Gene=SeqID_62968
accatagcaacgcgagatttttgggccaagaccaaacccagctatttctccttcaattgctaaaaagacggaacggtgtccacttaaatttgttttttttttgataaaacaagattgaacccgatttttgatttagactaaatttatggagcgcatatgtccgcagcgcagattcgagtaatctttatcgtaattctcaaattcccgatgcccaaattccatatttcccgatttttctcacaaaagtatgcaaatttttttggcataatgttatttcattttttaattaataatttaattagaaactccaccggagttatttaataatatgctttttatattgtttccaaatttcttgtaaggaaaaagaagaatggcaccgaattgacaccaccagataaaattggaatttttatattaactttttagtaattttggcattgttttctttaatgtttcattaattttaattaggaaacttcaccgtagttacggctttctgttggccatctgttctttttgtgacgcactcaccgaattggccaccccattggctaccggtaaaataattaaataaatatattatttcattatttattttttaaaattatctttagttctcgtttttcttcgtgtgcggattcctttgttgacttgtgtttatgcccaattttttgctttcactggaagtattaattcatttataaatctgttttggataagcgttgatcgatttgtggcattggcattccccgttttgtaattatataaattattattaagaaaattaaatattcaggaaattaatcaaactttctttaagttttcgtaacatctcaaggttttccggaaaatatgtgttaattgccaatgtcttttccttgtcaattgcattttatattatttatttgtcgtttttatttgctctacaaaatcccgaaatgtaattattaataattgattaattgactaattaataataattttaccaattgaaaggatg

SEQ ID NO: 108549 - DNA, 165 bp, Heterodera glycines
  Promoter: Source sequence=SeqID_10921; Location=1..165; Strand=+; Gene=SeqID_74223
tttcttcccaattttgttgtttgcaaataattgcaataaattgagagaacgaccaccgtgacccaactttctttgctccatttttgaatccgctccatccaattattaggccggcccttccgttggccaattttccttctctctgtgcgcaaaatttgtggcatg

SEQ ID NO: 108550 - DNA, 1003 bp, Heterodera glycines
  Promoter: Source sequence=SeqID_236; Location=770..1772; Strand=+; Gene=SeqID_79199
agtaaaaaatatgatgcgttttaattatgagaatgataaaatatatacattcgctcataaattaaatacttccaatataaaaaattaataaaatattaacatgatcaacattttcattgaattgataaataagtatgtttaaaatcaagcattttcaaaaaatatttcaatttacatgttcgttatgtaaataaaggtttaaaaaataaatataaatatatataatataatgtttaaaataataaatataaatataaatagttataaagttgtaaatagataatgtaattaacataagggtctgacaatcaaatttacaagcggtttgaattaattaaatataagtaatagtatcaagcgaaccgaatatgaagaagcctcgcttatttaatacatattagaaaatttaaaaaaattatgtggcaataattaaaaatttttgctgacaatgtagaaaaattagtatcgaaaaaacaataaaaaaacttctcctcattaataaaatttgattttattaaagttcaaaaaaatacaaaaatgttagagaaggaagtaattattgattaggtgtatgaccccacgccacttcgccatcttccccctcccattcccctcattcagttgattattgtgcccaccaatttgacctcccaatttattctctgcatttatttattattttattttcttcggcaaataaacttatttaatttgttatcttcggacataacaaattttggcgcagtcagcaatcaactgcacatcaccggcaacaacaattccgagctttatctcgtgttgatattgctcgagagggaaaattagaaagctcgtgttgatttctaattttcccagatcatcaaaaacttttctctccgtgtgagattaaagtctgccgtgtgcagttctcttcaattggccatggacgcgcaacagctacaacaattgcttaatgcactccaacaaatggtcactaatgccgcaccagcaaatttgagcaatg

SEQ ID NO: 108551 - DNA, 94 bp, Heterodera glycines
  Promoter: Source sequence=SeqID_27127; Location=281..374; Strand=-; Gene=SeqID_57833
agcatttcctgataataaaacctggaccagtcacggtctctacttatatttttaggactcattcttatttcagcgattttgaatttttactatg

SEQ ID NO: 108552 - DNA, 65 bp, Heterodera glycines
  Promoter: Source sequence=SeqID_21413; Location=1024..1088; Strand=-; Gene=SeqID_52022
taatccacaaatatatttaaaaaataaaacaaatttctttatttcataaaaatttgtcaaagatg

SEQ ID NO: 108553 - DNA, 89 bp, Heterodera glycines
  Promoter: Source sequence=SeqID_14299; Location=1..89; Strand=+; Gene= SeqID_78325
cagcaaccaaagcaaatgaacttttcggtacactttttgaattattaaatatttaggcacttttattttgcaattctcagacacgaatg

SEQ ID NO: 108554 - DNA, 173 bp, Heterodera glycines
  Promoter: Source sequence=SeqID_21793; Location=1218..1390; Strand=-; Gene=SeqID_52406
acgtgcaaaaagcgcgccaagtgtaggagaaaattaggcataaattcgataatttacaaaaatttagcgtttttgcaaaaaatggacgtgggaatgaggacttttccttatttggaataattaatgggcagcgtgttgatgtggtaatgtgccaaaaaatttagcgcaaaatg

SEQ ID NO: 108555 - DNA, 659 bp, Heterodera glycines
  Promoter: Source sequence=SeqID_696; Location=2101..2759; Strand=+; Gene=SeqID_59215
ccaaaaggcaaaggcttcgtaaaaggcgcatttccatcttgagaaaggcttaatgtgaatgttgttacatattattatactttcctttaacttttgctctgcttaatttatttcattgtttttgtttaagggtctttcgttaataaaattttattttttttcttcaattgtttaaataaattttttcaaattcaaaaattacctaagattttttgccttttatgtgaaaataaaatttgctaagaatgtcacggcataagaagacgcacaaacgcaacagcaggaagggctcgaagaagttcagttgtttaatttctgcactttattttaacttttttcaaaagcgtaaaaatttccatttttccgtttattttccccccaataaagcgctaatcttaaccaaattttgcatcaaggaaaaggggccgagggagcgcttcttccaatgggtcaaccgattcggacggtgccgttggcacttcgtccacccgccgggcaaagagttcgaatagggcaaatggacggcattctccgccgtcctcctacgactcgaccctttccgaatgttccacctcctcaacggcgcattgtcagcattttccggaccgggcaaagaatggaaacaattttggtcaaattcgcattcgaaaaacacgatg

SEQ ID NO: 108556 - DNA, 1003 bp, Heterodera glycines
  Promoter: Source sequence=SeqID_8481; Location=740..1742; Strand=+; Gene=SeqID_68222
aaaatttcaacgcagaaatgcgttttttgagctcctttcttcaaaacaatcgagcaaaaaaaaagttaaatcactaaaagttgcatccctagtgatcagaaaataaaaaacaaaaaggatactttggttttgaaaaatgtaaatttatagtttgtaactctcaccaacaatggatcattttccaaacaaccggaagatttcccttttaatgttccaaacaatgtttacttaggaaaatgtcaattagcaataaaaattgaatactctccgaaaagttttggaatcgggttttccaaaaaaaatatattcaaaaatttcattaattttcaccaattttacgaatttgaggagggagagaattacattaattatcaataagtttcaaaaaagttatgatcaaaaatgtatgtctgaaaaatggttccttgggtacttttggccatactttgcttaaacttgacggacgaaatcttttcaaatttttgaggctaatagagaacccttagggttatcgaatgatatcaagaattaaaatttagttgctcttaaacaaagttatggctaattttttgttataattttcatttgatggtttttatataaacgactcagcacagcaaaaaatcataattttaaatttttttaatgtatagtaatgaccttgggggtttttgggtccctgatcactaatctttcgattatttgaccaattcgattttctaatctaaatttgaacaaaaaatcaaatcgaaaaattccatttttcaatttttgtagaaattggtcaaaatatgtcagattcgtgatcagcgacagcgccgattttttgaatatacgaagtttgcttccgtttctaccagctttgcttaacagagggaggataagtggggatattgtccatgtaatttccaactttaatcgtgtccagcaggactcaaacgaactttttgcttacagttggtacatgtaaaaagttggccatttgtgccccaaggcagacatg

SEQ ID NO: 108557 - DNA, 79 bp, Heterodera glycines
  Promoter: Source sequence=SeqID_35969; Location=284..362; Strand=-; Gene=SeqID_65415
atttttatgattaaaaatttcttatttaaaaaaattaattatttaatagtgaataatgggaccacactaatggcaaatg

SEQ ID NO: 108558 - DNA, 1003 bp, Heterodera glycines
  Promoter: Source sequence=SeqID_11255; Location=1685..2687; Strand=-; Gene=SeqID_74620
aataaaatgacacgacaaaattcaacgcttcactttttgattaaattctatgactcaaaatttctccaatcgcctgtaaatttcaaaaagtttttcagttgttagcaaaaaataggacataatatttttggcgcttgtgaaaaagtggcagtttttgaaaaattttttcaatttttttcatgcaatttaattattataaatactttcaaaacttattttaaattttccgattgaattctataagggcgataaaacgcaaaatttcgaacaaaaatatcttttttgtgcatttctcgtcgagttaaagccgcagaaaaaataagtaaaaaccccgttaatagcgagcaaaaactacacatcatccaattatgaaaattgataatttgattttttgttgtaggcgcatttaaaaattgttatttaaacaatcaaatatatgaaatttaaaagaacacttattaacccaaaataaatcaatttttatttcttttcattctaaaattaaatttgatgcatttattatctcaaattcaaaaataataattatttcttacaaagtgaaaacaaaatttaaaattataatccaaaattatagtgtttaaatgttgccatttacacgaagagcaaaccgatgtagacttcgcttgaaaattattatgaaggctataattaaaaaaaataatacatttcaaaatggagtaaattttaataaatatttaagaaaagcaaagcagttggtcaacgttctgcactcaacttcttgctgctgcacttcttttttaaacaacttgtttatattaaaacccgataaaaataacaaggaataaaaaatttattaatgctgtttaactatatataaacccatagcaaaaataaaaaaaaattccaataagttcattaaatgcaatgcaaatagatgcaggtatatgcaatataaaatttaaaagaaaaaaaatcagagcaaataaaaaatattgtatttaatttaaagcaattaataatg

SEQ ID NO: 108559 - DNA, 122 bp, Heterodera glycines
  Promoter: Source sequence=SeqID_20060; Location=1053..1174; Strand=-; Gene=SeqID_84844
tgagtactgtttttcggtgggcctgagcggtaagtgataagaagattaaattataaacattatgccataaaatatttagttgctttaaaatttgaaaattccgtaggtttcttatagcaatg

SEQ ID NO: 108560 - DNA, 401 bp, Heterodera glycines
  Promoter: Source sequence=SeqID_3690; Location=1913..2313; Strand=-; Gene=SeqID_51467
tttactgatttgagctctccttaatcagggatcgcgtcccagcaaatcctcgccctccccgaatcggaaaggattgtgatcggaggaggatgtgggaggaagatgggggaaaatgctgatcgaggcacgcatttgtttgtggaggggatggtggggggagattggagatccacaaattgtgtgtcggaggactgacgggatctgtctgctgtctgttcatcaccagcccacacaaatgaccgataatgcccgcgatcggacctcattgtgatcgcgatcgcggtggggtaaaacagtgttttatttgttgccccctcccccgcttggcttggccccaagaatagaagagttccaggcggtggtgctggtggtgcgcaaactttgcggacacatggatcatg

SEQ ID NO: 108561 - DNA, 209 bp, Heterodera glycines
  Promoter: Source sequence=SeqID_20737; Location=1339..1547; Strand=-; Gene=SeqID_51305
cataatttatcagaatgggcaaataaatggcaaatcagaatctaaattaaaaaaacttttgtacttcatttggggaataaaaaccccaaagaaatatataaaattgtatggaaatataataaatgttgtggatacaattagggatttaggcataaatattgataataaattgcaattttccaatcatgtcacacaaataataaagaatg

SEQ ID NO: 108562 - DNA, 1003 bp, Heterodera glycines
  Promoter: Source sequence=SeqID_13175; Location=3488..4490; Strand=-; Gene=SeqID_76999
ccccccctttcccatttttccccattttctcctttgaattgtgttgatactgccctccctctgtttatgcagaatttgcaattggatgatgggcgttattcgttggccattgaacactcgtcagagtgcaaagaaacaaatcttttcatttgttgacattaatatttttttttcattttgttttcatctctaagaacaatttagcgaaggacaaatttatttacaaatttatttttgagtttcgaatcacttctccgagttcgaaaaggtattaatacttaattaatgatttaaataagtttatgtttgacgttaagttaaaatttatatagctattttttctcctcaaaaatcgccgaaatcgaccattaaatttgtctcttttctctatttttttaattgtttttgttcgttgtgcgctatttttatataaaagtttattttgccattttcctatgagatttaacaaatttataagcgctttgctggtggcgtagaagcattttcggcaactgtgaactttgcggtgctaaaccaaggccacctgccacctaacactaacaaatatgtgaaccccccaacaaacagccaaggggcggccgagacagggttcagtggtcgttactgtggacatgccaccattagaaatgaattacatataagtaaaataggttaaatggcaaaaataaatcaaaaaaagaaataaaagcaattagacagacaacgaataaaataattataaaaatgaagaaaaacacagattttttttggtcgttttcgagagtgagaaatagggcgtcggaaatttttttgttttcgtttttgtgtttgttttcgtatttggtttttttttctctcttcactatcggcagtaattatatggatgcaagtttttcgtaagtttggcattcgacaaaaaaaaacgaagggtcaaaatcgattcatttctaattgattcccattcccatctcagtgccgttgaccaacaaaaacagaggaaatg

SEQ ID NO: 108563 - DNA, 112 bp, Heterodera glycines
  Promoter: Source sequence=SeqID_13976; Location=1060..1171; Strand=-; Gene=SeqID_77934
gctggaaaagagaaaagtaaaaaaagcaaaagtcagtgatttaccggtggtgccacccaaattgaccggcaaagaacgcaaagtgtccaaagcgggacgaggaagtgacatg

SEQ ID NO: 108564 - DNA, 1003 bp, Heterodera glycines
  Promoter: Source sequence=SeqID_6466; Location=1202..2204; Strand=+; Gene=SeqID_61692
attacaacaataaatatgggcatatttgaatgcaaaaattttaattgaaaataaacgcgattaaatattgttacaaagtaattatttttaaattatgctgaaaaacgcttaattgattaaaaaattaattaactcaaatttgtttgcgagccgtgtaaaaacggaacggataagataacattttaaaatttaaattggaatcaaatgggtgcctcgaatgctgaatgacaagtatcattgacgcacaaaggaggagcattgattgctgattacgtggagcccatgttcggaaaattgtggtattagtgactctttgaccctttatttgattgtttgaatttgtttggcataatgtttatttgaattcgacccaaatattttggttttcttcaagagtagttagtggatttttttggttatcgtcggtgataatttttagccgttttgttggtcgtcgatttatttgtgtttttattaatttgttgttgattgaattttatttattttggattgtcttttaattatttgttgcataaatttattttgtttggtattggatttttaaagcaggttttggccaattcatagactatttgtgcaaaatttagaagcgtggcaaagaaacccccgacaaattgattcttcttttccaacatggcgctcctggtaacaaaggttagctaggtggcggacggcttggtttttcttcagtgatatttcttatattttttttaaaagcaactaatttggaaaaaccctcgtgttgggttcatcgactgctcgtcaaatttttaataccctcgtgttgggtttatcgactgttcttcaaatttttaataccctcgtgttgggtttgtttttcttcatccgccttatttggtccacttttacaacttatcgtcgaaagcactcgtgttgtgctacaccaattaaattttgtaaaagctcgtgttgctttaaattggatttttgttttatctcgtgttgataaaacaaaattatg

SEQ ID NO: 108565 - DNA, 349 bp, Heterodera glycines
  Promoter: Source sequence=SeqID_7482; Location=1036..1384; Strand=+; Gene=SeqID_64960
atgcttggtgataatttacgcaaaaaaatgaatccatttaaatcaatgaatatttctaatttttttaaaaattgggttttttctgcttttattggagtatttgtgttttgatttaaagcactaagattaatttttgtttaaggacatcaaaaccaagtcattatgttaaggcatagaaatttttcatcattttcaagaaaattaaacggttttagcggttctataaaatacggttgtttttaaacaccgtaatgcttgaataggttaatgttttttgttagctaattgttcatatatttatcaaatacagttctataattagtgccggattttgacagaccaatccatg

SEQ ID NO: 108566 - DNA, 624 bp, Heterodera glycines
  Promoter: Source sequence=SeqID_11993; Location=829..1452; Strand=+; Gene=SeqID_75516
tgtttccggaacccgcttgtgcaacggctaatggaaccacctaaaattaagattgtaataaattaggtataagcgaaaaattttatggcacaaagcttgagaatttctttggcattatgccttcggggacaaaatctcgccgcagaaatttcaaaaaaaagaaaaatttaaacttagaaatttttcaagaaaaaaaattcttagaaaatttttcataagagaattaaaaggagaaaaaatgtttgaacattttattataaattactggtttttttgaaaaattttcaaagaaaaacttaacaaataatttttttttgaaattgtaaagtggatttccgatcacttccccgtttggtctctggtctcttctccgctaaatccttttccgagatttcccgagcattttatcatttcatttcatcatttctccatcctttcccatttcgatcagttccatccttccccatttcgatccgtcatttgtattttccattcatttcacatttcacaagcaaaggtttaattacccaagtttgagatggaacaataaaggatttctggataatatttggactacagcgatcctgggaagggccccccacgtttcactggtagcaccggatg

SEQ ID NO: 108567 - DNA, 132 bp, Heterodera glycines
  Promoter: Source sequence=SeqID_21238; Location=1534..1665; Strand=-; Gene=SeqID_51832
taaaataatttaaaattattaaaataggaattgatgacgcctttttgacaattcattcctggcaattgaccatcaaacgcaagagaaaaaatggtgaattgaaaattccaacaaattcaaaatcgttggatg

SEQ ID NO: 108568 - DNA, 194 bp, Heterodera glycines
  Promoter: Source sequence=SeqID_17789; Location=1..194; Strand=+; Gene=SeqID_82326
gctcttccatcatcgtggcagcagacgcgtccaaaatcgtaattggcgcaacgattggccacatttttccggataagtccgagaaagtgatcgaacacgcatcttgtgttttgtcagattcccagcagaattacagccagatcgaaaaagaagcattggctcttgtgttcgcagtgcagaaattccaccgaatg

SEQ ID NO: 108569 - DNA, 571 bp, Heterodera glycines
  Promoter: Source sequence=SeqID_4219; Location=3806..4376; Strand=-; Gene=SeqID_53646
ttagtcctagtaggaggaacagtgaaaataattaatggagtcggctttggattatctttcgtttttttttgttgccatgcaatttgccacaaaatatttaaattttaaatagtcaaaataagtttatcaaatgatagaaaaatctccatggtgaaatgacatgaagaaaaattaaccaaataatattttaataaataaggctgtggtcatttttatgaaggtattattggttgaaattcttcgcttggcttggaaatgatggggagagaacggcgcagtgggagtggagagtacatagagagaaagagaggagagatagagaacgtgagagacagggagagaacaacgaaacagctgctgagagagagagagagatatagcgagagagaaggggagagaacaataaataactgggacggatatcctgttggattaatgcaaatgtgggattgaagtctgtgaccccgcgcgggatcttatgctacccacccagggtcctattttacactaaattctttaaaatacgcaattatttttataaaatattttaggcggaaattaatttttaatg

SEQ ID NO: 108570 - DNA, 475 bp, Heterodera glycines
  misc_feature (55)..(56): n is a, c, g, or t
  Promoter: Source sequence=SeqID_8036; Location=1..475; Strand=+; Gene= SeqID_66775
tcatgacaatttgtgagccaaaaatagtcagaaatgcaatttacagagaaaccannccaataatttatgagaattttttttaaactaatattggaaatttttatcaaaaatttccaatttctctccttcggccccatcgcattaaaaatagatttaaatgatttttttaaatagataagtcactaaaattgccggccctaattattaagctcaatgaatttatgtaaataacattttttgtgacagtagtccaatattaaccaattaattccttgagaacaagaaattcatgataacaattatcaaataattagaatttataatcttttccttttttaatttagaaaatgcataattatcatttaatctttttgcttgtcgcactaataggaggtattaactccttaattgacaataataaaaaaaagtaaatatattttatttaatcaaaggttttggtctgatagcaccaatg

SEQ ID NO: 108571 - DNA, 159 bp, Heterodera glycines
  Promoter: Source sequence=SeqID_19832; Location=529..687; Strand=-; Gene=SeqID_84580
tttttgaccttttcaagtgtccacgaatacggcggcgcttctctgtgcgtgcaatggcacagtgccaatggcgggagtcctttggtgtgccattccggcggcatttggctgttgtccgcccccggcgcggttcccaagccgatcattcaaagcgaaatg

SEQ ID NO: 108572 - DNA, 289 bp, Heterodera glycines
  Promoter: Source sequence=SeqID_3227; Location=3787..4075; Strand=-; Gene=SeqID_83782
atttggaatttttaaattttccaattttcgatagaaattgcggaagaaaccaataaaaataatttggattttgtcaaatatttttcccctgtaagggaaagaatcgttttttggcaattcatttttaccccgattcgtttttgacccaattcgtttttattaccccaattcgtttttattaccccgatcgtttttttaccccgattcgttttttgaggtagaaattcaaaaattcgaggttgaatcgatgaaattttaaatatttaagaaaaattgcagcttaggaatg

SEQ ID NO: 108573 - DNA, 1003 bp, Heterodera glycines
  Promoter: Source sequence=SeqID_20269; Location=782..1784; Strand=-; Gene=SeqID_47639
tttttaaaaaatttagtgaaagggggaataaaggtcctgaggtgccgtctggcagtgccggaaaaatttttttggaaattttaatgaaggcaattaaaattcaaaaaaattttttgatatcctttttataaatttagataaaaattattcaaaattttgttttaaattaggtaacgatgaaagaaagcaagtgcgcttcgcgttgaaacaaattcaaagcaattcgtgcattaaattcaaagaatatgcagcaaaacccacccacacaacacatcttcattatctgaaggagacaagtttgggagcgtaagtgaaatacacagaaaaatagggcaacgggtactgtattgtattttaaattggatgcaatacggtagcagtaagaatagtttataattttggtattctataatcgagtatgatgaaatttgggtggttttcccattatagttcattaaataattattatgattcattttacaaatttttagtccttgctttgcactaaatgttctaaatgttctctattagcctataaaaatttgaaaaaattttgtttaagttttcaaaaatttatgaccaaaaatgtgcttaaaaactcggtttttttgagttcctctggccataacttttttgaatgtaacaaaaattgttgaaattttgaaggctaatagagaacattttgggctagcgaatattatcaagaactaaaaattttgttcttggcaaaattatgaaaattttgattgtttgttaaagattttccattttatggtgttgtttttgagtaacgacccggcacctttattttaactaaaaacttaaaaattaaattgatatcttttttgtcagaattaaatgaaaaaaatcaacaaaaaaaaattaaatttaaaataaatttttgcaattttttagttgtggcttcagcgaaattggcatggttaagccattcaatcgcataatgttgagctttcgatgtcccagccaaattgggataattatg

SEQ ID NO: 108574 - DNA, 88 bp, Heterodera glycines
  Promoter: Source sequence=SeqID_15553; Location=242..329; Strand=-; Gene=SeqID_79835
tttttccatttcccactgtttttgttttctcatttcattctttgccaatcggtcggtccatcgtatttagctaataattctgcaaatg

SEQ ID NO: 108575 - DNA, 285 bp, Heterodera glycines
  Promoter: Source sequence=SeqID_1625; Location=9593..9877; Strand=-; Gene=SeqID_74921
caacaatttgaattttttaaatatgtcattatttttccgtttgccctgaggatatgaattaaatatgattttttttattattgtaaattaatgtaaaatatttcttatttttgatgaatcattcattcattggataattgtcctgatttttttgtgtttgtactgttttttgtaatcgatttaaaagcaataaattctcattttcttcatttaataaataattcattaagctaaaaatttcctatacattgataattaggtaatacttattgccaattaaaaatg

SEQ ID NO: 108576 - DNA, 819 bp, Heterodera glycines
  misc_feature (9)..(9): n is a, c, g, or t
  Promoter: Source sequence=SeqID_6768; Location=1..819; Strand=+; Gene= SeqID_62834
taggatcanctgaaagaacctgctcataaccgagctatgctatcagcattaaactaacaaacgcttattatttgcttttgatttttaaagaacctgctcatactggaggttgtgtgttctttattacattactaaccaacgcttattgtatttttgctttatagtcttataaagaacctgctcctatcggagatagtgttttctttgtttatttgtaaccagtgctttatatgtgctttgtgctttttcaagaacctgctcataatggagattgtgtgttctttattacattactaaccaacgcttattgtatttttgctttataatcttataaagaacctgctcctaccggagatagtgttttctttgtttatttttaacccatgctttatatgtgcttgtgttttttaaagaatctactcatattggagattgtggattctttattatactactaaccaacgctattatttgcttttttattatgaataactctcataatggaaatggtttgtctgtggccaatacagcctgcctaccctcatgggattttgggcactcagactggcctctttaagtattggtcaatctttacactttccatatctgcactcaatgtcctttttggcaaaataggataggtgagccctgactgatagatttcggcaacggctacacttatggtaattgagaacccacatcatttttcacgtttttaggtcatttgtataaatatttgatatttgcacattcattggtttaattccttcatatttttgtcgcaaccactttttcacgttgattttttgatttaagatg

SEQ ID NO: 108577 - DNA, 157 bp, Heterodera glycines; identical to SEQ ID NO: 100221
  Promoter: Source sequence=SeqID_18032; Location=1071..1227; Strand=-; Gene=SeqID_82610

SEQ ID NO: 108578 - DNA, 524 bp, Heterodera glycines
  Promoter: Source sequence=SeqID_25258; Location=2047..2570; Strand=-; Gene=SeqID_56007
tctagagtcaaattgggtggggaaatagaaaataattatcattaattctcctcccagggcttggattaagatggagaattatttttggaaccataaacgacagagaaaaagccgaaaaagagacggaagtgaccaaaatagccgaacattggcaagaagtgaattttagcaaagatcagaaaaatgaaagaatgggaaaaagcgaattggtaaattgggaaaggaaaattgtgaaggaaattaaattcaggtgaaaaaaggcttaatttcaacggaatctgatcaaaatttgcaaaatgtattgagccaaatagaggagctgatcaccaaatgggtgccatttccaaatttccatttgccatttcccctttcccatttcagtccccctttgcccaatttgtcgtctcccaatcttttggcggtcgcttcgattcgttttgtctctttcccagtgtgtttagcatcgaaaatattatcggaaagcatttttgcaatttaaatggaagggaaaatcgagaaaaatg

SEQ ID NO: 108579 - DNA, 202 bp, Heterodera glycines
  Promoter: Source sequence=SeqID_33717; Location=1..202; Strand=+; Gene=SeqID_63687
aggtaatctaaaattagagcatgtgaatgagaaaaagaattttatttttaaatttttaggtttcttttgaatttcaaaataggtatttaaaattttattctctttttcttttttgcttttacgttttcggcttcacaatttttaaatttaaattgttccttcttttcaagattttaattctttcttcaataataatttaatg

SEQ ID NO: 108580 - DNA, 717 bp, Heterodera glycines
  Promoter: Source sequence=SeqID_12931; Location=1516..2232; Strand=+; Gene=SeqID_76680
ttttgttgaggtaaattattaagacagaatttcggcacttttgcaatcagttggcaacgattttgtaagcttcaaaaatttatataaaaataaatatttgcgtatacctaagtcatgaaagaatgatgattacatagtatggccgcaacttttagttaaaatctcaaaatatttaacgaaattagtgaggaaaatgccaaaatagtgacgaatggtgacataattttcagcggtgtaaataagaagggtttttggtgtccccaatcacgaatctttcaattattttgatcaattccgatttcctaatctaaatttgaacaaaaaatcataatttgaaaaattaaaaatttcgatttttattcgagttcgggttaaggattagaaattagtcaaaatacatttcagattcgtgattagcgacctttaaaaccccggataacaaattagcatggttttttatattaaaaaaattttgcaaaacaaaaggtcctccccccttttgtttcaaaatcggtaacttttacagtagcgcccaagtttttctatttttcgttgttaaccaaatccaatatcttggtatcatttgaaagcttattatgtttagaaattttcttagcctattgtttcgcgattagaaaattaccaaaaaagttatacatgaaaaattattcattccccattatttcgtctctctcttcgactttctctctgacaatg

SEQ ID NO: 108581 - DNA, 1003 bp, Heterodera glycines
  Promoter: Source sequence=SeqID_949; Location=210..1212; Strand=-; Gene=SeqID_64818
tggcatccaaatccatcaatcttggtatcattcgaaagctcttaaaatgctctattagccttagcaaaaagcaaaaagtttttcaagcctgaaaaaatttttaatgaaaaaaacttgaaaatttcgactttttcgcaatattcatgtacagtcatggtcataagtgttgtcccatcatgctttgaaaaaaataattgcgtataaaattgtcattttccaatttcaacagataagtagcataccattggatagcattttttatgggctttccaatgataccatatttgcatttgtgacataaacatttatttgatttattttaccatattcacaatttgatcaaaatataggtggtcaaaagtgttgtcccatttcatttttaaaatattgcttctctggatcagcattaaaaaaatctaaaaaaattcaggtaagcataactttggatgctgatcaaaaaaggtagcaacaccaagttgatcagatcactccttcatggtgatctgatcagcccattttggctgggaacgaggggtaaatttcaaaaaaaatttctagggggttgggaaaatttttctggaaattttgagtaggcccattttatagagcacaaaatttgctaccgaattgcctttggaatagtgggtctacgatttaggcccgctgagatagatcgacttttatttcggtgcctataaaaagcactgtataagataagaaaatagtgctgcattttacactacgcaaaattcggaagtgcacatacctatttttgaaatgaaatatgtaggaattatcgacctctcaaagtggcaaatgcgatttccgatcagtgactgttgaacaaatggctgaccgtgaaatgactaatgaaaatggtcgacagtatacgcacgtatacttggccccaccattaatactaatatgcgaattgattttccaattaattatgcatcatttgaataaattagggatcgcgtaatccctacttggaccgcatatg

SEQ ID NO: 108582 - DNA, 180 bp, Heterodera glycines
  Promoter: Source sequence=SeqID_2622; Location=1..180; Strand=+; Gene= SeqID_80754
cgttttgcgcccgcttttacggcgttgcgagcgcggactgaatagtacggacaattgccatttgggcgagtcatacgaagaggttttagtgaattggcacttgcgaatgcatttaattttacattctctacttttcagatatgcaattttttgcgctcatccaatcggcaaccagtgatg

SEQ ID NO: 108583 - DNA, 121 bp, Heterodera glycines
  Promoter: Source sequence=SeqID_19350; Location=1..121; Strand=+; Gene=SeqID_84085
agggtcccccctttttgaaaaaattttcaaaaactgtcctcctaagatagtgccattcttgtcattcattaattttttcctttcttatatttcagcttttctcgacaaaaaattgcaaatg

SEQ ID NO: 108584 - DNA, 183 bp, Heterodera glycines
  Promoter: Source sequence=SeqID_30271; Location=825..1007; Strand=-; Gene=SeqID_60689
tgccacaagtgccaaaaacaaggccacattgctaatgtttgccgaaagggagcattcacgacaaagaagcaacgccgttcatttcacacggtccaagtcaaagcaacatgcctacaaattggcacgactcaaggacggtggtggacaattttggtctaaattaacggcacaaaaatcgaaatg

SEQ ID NO: 108585 - DNA, 224 bp, Heterodera glycines
  Promoter: Source sequence=SeqID_29405; Location=1021..1244; Strand=-; Gene=SeqID_59908
tgtccgccagcgtttgggccaaccgataattgaacagcacatgggaattggtgaaaccgggcacaatttgcagaattcgaagtgaacggacggagaatgtgagaacggacaaaaagaggaggggggaaaggcggacaaacggacaataacgaagatggcacatatcagagtcagaaagtttcgaagcctcaattttggggaatcggaatccaactcttaaaatg

SEQ ID NO: 108586 - DNA, 258 bp, Heterodera glycines
  Promoter: Source sequence=SeqID_13598; Location=768..1025; Strand=-; Gene=SeqID_77499
ccccccccccccccccccctcgccgactccttctgttgcgtagaattttttttttaaacgaaccgcaaaaaaagggacgaaatgctagaaaaagtcactactgcttattccttttgtttgtgtttttaattttttaaagtatccttgaattcgcaaattttccctcttatatcattttaaattgagctaaccgatggttactctgttttatgcataattatataatagaaccttaacatacacaaaaaaaaaccaatg

SEQ ID NO: 108587 - DNA, 166 bp, Heterodera glycines
  Promoter: Source sequence=SeqID_28581; Location=462..627; Strand=-; Gene=SeqID_59180
tctaaaaaagtaaatgtgtcaaaatttagcaatcataacaattttcaatgacattttagcagataaaaaaaagtttatttcaaaaagacagattttgaaaaatattgttcacaagaaataaaaatgaacaatctttaatattttatatagataattttgatgaatg

SEQ ID NO: 108588 - DNA, 1003 bp, Heterodera glycines
  Promoter: Source sequence=SeqID_169; Location=1726..2728; Strand=-; Gene=SeqID_75829
gtcgcaattccattcgtttaagggtttggacggttcagtcccaaagccattttgtcatttcagtcccgggtctgtaactcttcagcgattggttaccgccaaaaaattctttcggattctttcattagagaccgagcggagtcgattggtatataatttatatacattttccatcccgtcagtatccttcacttttaccttttatagtcatgaaaagggagggattgatgaagtttgttgtatctttttgttcatgtgttataaatagggctatgtttttaggtttttacatatttgtttcctgagctccccatggcctgaaacgcacgaaaaacatattttttttggctgttgttaagctacttttcgagttattagggcctattttctaggtttttattttgaaggaatagaccccaaaaaccggtcggggtcgttttcgcgtggccattttcgcgtgagtacctgtttaggactgaaattggtcggatttgtgcaaaacatccatgtttcgaatcccgaacccgaattcggacaaatttcttaacttttttatttcttgcggctagtatcttctacaataatttgtcagtttggtcggatgtgcgtcaaacggaaaaaataattaaaattggttctagtcggttttacgcgtcccatgacactacgcgtcccatgacactttacgcgtcccatgacattttacgcgtcccataacattttacgcgtcccatgacactttacgcgtcccatgacattttacgcgtcccataacattttacgcgtccgatgacattttacgcgttccataacattttacgcgtcccataacattttacgcgtcccatgacattttacgcgtcccaacaacactttacgcgtcccatgacattttacgcgtcccatgacattttacgcgtcccataacattttacgcgtcccatgacattttacgcgtcccaacaacattttacgcgtcccatgacattttacgcgtcccatg

SEQ ID NO: 108589 - DNA, 79 bp, Heterodera glycines
  Promoter: Source sequence=SeqID_4909; Location=3182..3260; Strand=-; Gene=SeqID_56166
ttctgtatttattaaatacaattataaatttgcttatttattttaacacctcccctcatgtcaggttggctcatttatg

SEQ ID NO: 108590 - DNA, 239 bp, Heterodera glycines
  Promoter: Source sequence=SeqID_15227; Location=57..295; Strand=+; Gene=SeqID_79434
cagtcacagattaatgcatttttaattttaaatcccggattaacacgacaatctatttttgttttttctaatttaagcgcaattataaagatctgatttgtgtacaaaatctgactaaattcaaaatgcctgttaactaagaacaaaagtcagattcgtaatcagcgacataaatagcatcgaaaaaattaaaattattattttttttattattaaacccacattttcgttttgctatg

SEQ ID NO: 108591 - DNA, 1003 bp, Heterodera glycines
  Promoter: Source sequence=SeqID_11533; Location=1261..2263; Strand=-; Gene=SeqID_74961
agggtgtgaagtttttcatacgcaatttatagttccaataacagtacagtgcttgtcattaaaatcaggacacaccccattttcagaatttaaccgcttcccgtgaactggtcgaattgattattaattcaatgagttatttgtagacacgactaaaaaggcaccaaaaaatcgcgaaaaaaggactatttacatataataggcatcaaaaattgaaaaaaggcacgaaaatggaccgatgggttagacaatgtgccaatgggagacgaaaaattattgccaaaaatggaagggatggaaacattttgacacaactttgtttttaaaataagaaaattttaaataaaaatctgaaaatgaatcatgatattactagggctggtaattaaatgcacataaaatcttaaactatgcgcataaaagtgaaaaatatgcacataaatttttccaaattgggggcaaaattttcacaaattcttcaaatttgttaaattgaagcataaaaatctcgaaaataactaaatgtagtatgaataatcattagggttataaattatatgcttttgcatattttttctgcgcatatgctatgaagaaaggggctcaaaaatagcatttctacgttaaaattttttgatttgaagaaagtttttagtccatataaatccatattttgggggttttcgggaataaatccatatttcgcgatttttgcattttcagtccatattttggccgtttttagcaaaacaatttgcgtctaacaatttctgctggccaagcattgtccaaatggttgcactctccgagaaaagatggccaacccaagcgattgcgttgttggcaagggaactttgaatggatcaacaatttcaaggaggtgtggccataatctcgaaaaatcactgatttttgttttcaaattgtttagcattttctccgtgccaatgccatttcttccgtcagttaccaaattcatttttctgttcatgtgccatcaatg

SEQ ID NO: 108592 - DNA, 1003 bp, Heterodera glycines
  Promoter: Source sequence=SeqID_23334; Location=1144..2146; Strand=-; Gene=SeqID_54045
ggcagaaaaagacgaagaaaatattaaagaaaaaagaaagaaagaacagagaaaaagaaaaataattattgaaaaacttaataagataaaataaaaagttaagcaagaaagaagaaaagattcaaaaaaatatgatttggtgaattgattaaatttcattttaaatacctattaattattaacgataataacgataatatgtttaaaataatttaaatatttccattatttaacaattcccggtcccggtcccggtttttggaaaaacaggaatcccagtcccggttttgccagtcccggtcccggcgggactaaatggcatcatggatttaggtagcattttaaaaaatgaaaattaaaaatatatctatttaattttatatgattttttatatttctatcacatattgtttgcattattttttgcgtaaaatgaaaaataattttttgcaattttgtgacggccaaaattaaatgtaaagacagcaaaaaccagtgcttttgcgcaaatttgggacggggaaaaaatgaaatgagtgaacaggtctaaaccagtgcttttgcgcacaatttgatggcaaaaataaatcgtttcctgtgaagaaaaatgtaataattttaacgatggtcgaagctaaaaccaaaatgaacaaattgtcaacaaaatgattacaacaatcatattcttttgtgtaacaactcctatttggtttcatctggcctttgttgtgcctatttaaagcggtggaaattaggttttgtcacattccactggcaaccgatcacttatattattcattaaacctaaccaagattttgccgtatctaaccatttctgacctttgcaaaatatttaggccgagtttttttaaaataaactggcggaattttttccagtccgaaattttatgtttgagctaataataagttttgtcaaaaaataactgattccaactttgtaattaattataggttaaatcaataaatctattttggcacaatg

SEQ ID NO: 108593 - DNA, 61 bp, Heterodera glycines
  Promoter: Source sequence=SeqID_44912; Location=1192..1252; Strand=-; Gene=SeqID_72316
ggtatgatgataaatgatttttttttaattttgcataaattttcaggaggctgtcaccatg

SEQ ID NO: 108594 - DNA, 368 bp, Heterodera glycines
  misc_feature (203)..(203): n is a, c, g, or t
  Promoter: Source sequence=SeqID_7420; Location=868..1235; Strand=+; Gene=SeqID_64765
aaattttggctttaattaatcgcgatcgcttaattggaatattgattttttaggaaaacaaagcttgaattgacaacaaaattaataatcaaaacttaagttttttacacctataaaattctatttgaacaattcacgaagagttgatcactcaatttatatatttgatcactcaatttattgatttgatcaccaatttatgnataaggcatttcggaccgattctgttcacttttccctttgtcagacgaaactatcgaatgcccactaattatgatcattttaaaatgctatctcgcaaatacagctgctgatcagcctctataataaaatttaatcccatttttggcgtccaacttggcgatatg

SEQ ID NO: 108595 - DNA, 390 bp, Heterodera glycines
  Promoter: Source sequence=SeqID_8371; Location=1..390; Strand=+; Gene= SeqID_67831
ggtaaaaaaaggaaaaaaaagagatagccatttttggtcaagaatttttttgtttgggttcaaaatatcgtaagattgtttgataaggccagacaagagaaggcagctgttggtacctagtttgcagtaaaaaaatgacaaaaaagagatagccattttttggtcaagaattttttttgtttgcgtttcaaatatcgtaagattgtttgatagggccagacaagagaaggcaactgttggtaccaagtttgcggtaaaaaaatgagaaaaaagagataaccatttttggtcaagaattttttttgtttgcgtttcaaatatcgtaagattgttcgatagggccagacaagagaaggcaactgttggtaccaattttgccgtaaaaaaatg

SEQ ID NO: 108596 - DNA, 544 bp, Heterodera glycines
  Promoter: Source sequence=SeqID_18295; Location=1746..2289; Strand=-; Gene=SeqID_82883
acaaaaaagaaccgtacaaagcttcaaaacaatgaccattcatacttttttacaagccgaagtaaaaatttttaaaaatattttcagttaaaataatttaaatttaatgaaaaaaaaaattaaattttgttgtccgttattaataaatattaaaaaaacgaaattttaccagctttatccggtccccggattcttaaattggatcgagaattttttttcccgaatttacaattggtttcaaatcgctttgtagggcttccaggggcccgaaaattaggaagtaagacccggatttaactattcaaatttaaccccagcaggtactgtaagaatccgaagtccctaaagcttcgggattttgagcccggttttgggttccccggaagttgcggtattgggtttaaacctatttttggctcggttcaaaattcgaaaaattcagagatttgacacttctaactttttttaaaacaatcgaatcctgataaatttggtatcatccgaaagctattggcgagctaagtctagaaatcagcgaaaaatg

SEQ ID NO: 108597 - DNA, 208 bp, Heterodera glycines
  Promoter: Source sequence=SeqID_5310; Location=1..208; Strand=+; Gene= SeqID_57633
ctgagccgaagaaagggtaatggggcgccgagagatgctgtgcagccgaggaagacggacaagttcagaaaggaggtgttagtgccaaagaaatgcatcgtgcacgtaatcggaaatggtggtgagaacatccgccatttgcaggtgccgagaggcccaattcgtacagcgaaaagcattcattcaggagaaattcggggtcaaaatg

SEQ ID NO: 108598 - DNA, 169 bp, Heterodera glycines
  Promoter: Source sequence=SeqID_23522; Location=1..169; Strand=+; Gene=SeqID_54214
caacacccccgaaaacccaccgaatagtaattttaggaccaatatataaaagttaaattaggcaccacaattctgcaccatttgctagcaaaaatggccgcgccaaaaaagctcgcgccaaaaaaacctcgcgccaaaatacccgcgccaaagtggctgcgccaaaatg

SEQ ID NO: 108599 - DNA, 1003 bp, Heterodera glycines
  Promoter: Source sequence=SeqID_15488; Location=853..1855; Strand=-; Gene=SeqID_79760
gcaacgaccaaaaggataatttttattttctattaaaacaaaaatcccaataaaaagtacatattaggtaattttttccaaaattgtaatttgcaatcagtattattgcatatcccggctgcacctatcggcaccagggctgggcgaagctcggctaaaaaaaggaaggtccccaggtgtccgtttgatttccgaataaaatttggtgggtggatagagcacccacaggttcttaagaaaagtgattttattttttgcggaatgaactcgagtgccgagttatgacgtgccaaagttttttagtgaataaataaattaaaatttatttgcgccttcatcaggtctctaatggcgcagcggtagtgagctagtcctcgttttttaagcccacaggttcggatccctgacatgcaaactcattttttaattttatttttgcctttttatgcaaaagtaaataatcaaatatgttttttatgaactaaatttttttaccattttaacatataagatattcaataaaaatattagataaaattatatctttaacagaaaggtgtgtatcttttaaattaaattattgcgtctttatctttaatgattttttgggtgttaatgaaataaaattaaaataattgaaaattttatttcaattaaattccttacttttgatgagttctatttcctggcacattttttacaacaattttgttgagtagagagtacgacggtgccgatagacgccgccggggaaaattaagaaaatttagttgtgggtttttaacagattttgtccattaaatgatcaaattttcaaaatttatgattttgggtccggcagttttcggaattcttgtcacaatttattaaacgattttcacaaaaaattgaattttttggctatgtttaaaaaatgaaagaaatatttaaattgtttttttatttttcggtggttagaaaatttttgtaattaaatttttaaaataattttacagctaaaatg

SEQ ID NO: 108600 - DNA, 753 bp, Heterodera glycines
  Promoter: Source sequence=SeqID_29720; Location=1006..1758; Strand=-; Gene=SeqID_60187
agtgtgggcgatccacaaaaaactcagtgtgggcgatccacaaaaaaactcagtgtgggcgatccacaaaaaatatcagtgttggtgatccacaaaaaaactcagtgtgggcgatccacaaaaaatctcagtgtgggtgatccacaaaaaaactcagtgtgggcgatccacaaaaaatctcagtgtgggcgatccacaaaaaaactcagtgtgggcgatccgcaaaaaaactcagtgtgggcgatccacaaaaaatctcagtgaataattaaataattaattttaattatatagaacgtgtcactgaattaattataattaaatttattttataccattatatttcaagataaatttaaaaagaacaaataaaaatttgtcatttttgttttaattttttgcataaatatcttttgtcatttatggcaaaaaatgcaaaaaaagggtaaacaaaaggaatggcatgaaatttcatactaaaattgaaaaaataataaaataaaatggaatggctgaaattctaggagcaaaaatggcttaatctatgggctaaaaattcaaaaaaaaaggtaaacaaaaggaatggcatgaaatttcatactaaaattgaaaaaatagtaaaataaaatggaatggcttgaaatcctaggagcaaaaattgcattcgatgagaatgaaatgttgaataaaacaaaaaatgggtatatatatataagtaacaatatggtctttccatcatgagtctcaaaaatg

SEQ ID NO: 108601 - DNA, 388 bp, Heterodera glycines
  Promoter: Source sequence=SeqID_13661; Location=472..859; Strand=+; Gene=SeqID_77569
aattcatttgaatgttttggcattgtctcaacattcacttaattgaatattctcgtcgcatgcaaaaacggcacaattggccaaacattggccataattattattatcattcaaatgcaaatgggaaaaaaagctgcagcagacaataaattgatgccatttttgacacatttggtcaaaaatcattgtcattatattattgttttttggttctggcaaattatggcaccgaaaatgccaaacccgtggctttattctcacatggcaaaaattggtggctataaatacataaatggacagagacagtaaagcaaattcttccatcagtcagtcacacaattttaaaaaattccaccgattttctctccaaaaaattaatccaaaaatg

SEQ ID NO: 108602 - DNA, 609 bp, Heterodera glycines
  Promoter: Source sequence=SeqID_17649; Location=1..609; Strand=+; Gene=SeqID_82177
atgacgaaaatgccgatgaagcaaaatggaaatgttttggtctgagaaaatacagagaaactaaaaatagtgactgttttatcatgggaaataagccaaggaaaaagggcggctaatgagggaaatgaacggtaaaagattaaattaagggagaaaaataattaaatttgaaaatgatttgatattggactcgttattaattaatttatgaaactaataaaaatattttttattcttttagcaaaaattttcgatcggacgaaatttgatacataaaataaacggacgatggtaatgagaaaggatttttgtttatttgaatacacagtgatatcgttcaataatgaatttcgaatcggaatttgttacttttttaatttccaaaatattattatatttcgtcatttttaatttgtcccttttttatttttaattattttttttgtctgatgggtgttagtcccgcctcggctgtgtccaccgcgctgaatttgttcacaattctgtccctgccaatgggccaaaaggaattggacacggacatggccaaaattaatacgtaacttaagcaattataagccaaaatcttctgctggtttcagacacatg

SEQ ID NO: 108603 - DNA, 234 bp, Heterodera glycines
  Promoter: Source sequence=SeqID_22606; Location=1..234; Strand=+; Gene=SeqID_53273
taagggcttttgaatcagaccaagaatggtgtatttcggttaacaaagaaaaatgctatgatactcaaaacttggctgggacagagttggcgtgagggatttggcccgtcctcgcaccagggatggcacggaattcgattttcaatttccaaaattttttaggccctcggaatgccatccatccctgtcccgcaccatacacagaattttttttttaaagatgtgtacaaaatg

SEQ ID NO: 108604 - DNA, 318 bp, Heterodera glycines
  Promoter: Source sequence=SeqID_103; Location=2554..2871; Strand=-; Gene=SeqID_69065
aaaataacgaaaaaaaaaatataaaaaaaaaaggtttggaactatgacgagtgggacgacgacttgttcagcaaatatgtcaatacattcgttggtctcaaagtccaagcgactgggtggccggaagggtgtgagacagatgaacaacgtaaagaattcgtggataatttcatgcgcacggaaggcatccaattagactcaacgaaaatgacacccaacccagggctccgcctcattgccaaaacattggcaaattctctgtggtatacgtttttaaacttctatttgaacaaaaaaaaaatgtttaggggaaaaatg

SEQ ID NO: 108605 - DNA, 127 bp, Heterodera glycines
  Promoter: Source sequence=SeqID_1659; Location=5650..5776; Strand=-; Gene=SeqID_75136
ggtatgtaattgggttttttcaaaaaatccaaaattctctaaccccccccccccgcaaaggtattcggaggcgtgcagctcaacgctggccaccgcctattcaagcggttcgtcgggcgaacggatg

SEQ ID NO: 108606 - DNA, 215 bp, Heterodera glycines
  Promoter: Source sequence=SeqID_45055; Location=1..215; Strand=+; Gene=SeqID_72448
atttaatgtctacttctagatttttatgtctaaaatttccatccctactaatagcatattagtttaatgatattaaaacataaggttctatccgtttttgcgtggcaagaaagccgacggcatacaatctaacaaaaagattggatggaacaatttgtactgatgggatcaataaaacccaatttgtttttcccaattcgatcaaatttgaaatg

SEQ ID NO: 108607 - DNA, 1003 bp, Heterodera glycines
  Promoter: Source sequence=SeqID_13313; Location=1218..2220; Strand=-; Gene=SeqID_77163
agttattagcacctattttatcgtttttattttctttgaaccctaagaagtttaacaaaacctatgttgaccttttttgtgttttgctcaaaatttatgaataaaaatgtaacaaaaacaaaaattaaacccctaagaaccgatccttaaaattttcaaaaatacatcactaggaaataaaaaattttctaaaattcatcaccaaaaattattttttttttttttgttaaaaatttttgagtttaaatattatgtgtctcaatactgatttggcttaatgttgatttttggaaaaaatttacgcttttacacacctaaatgtgaaacttaattactttttactgccgaaaaatctactgtcgaaaagtcccctcctaaattttatgatatttctgtcgaaatgtcctttgctgtcgaaatgtcctttgctgtcgaaaagtcccctcctaaagtttatgatatttctgtcgaaatcaaaaaatttcctagcagtgaattggtaaagcatcgatttttttagaatattcctactgatgattataatgtatattataaaaaataaagaaactaatcatcatataatatttatagttaaacatcgatttagaaataatgttaaggaataaaaaagcactttttccgtggggcattaataaaatgaacataattaaatcttttaatgctttaataaagtgaaaaattgattattaaagaaagtggaaatttttgaataaaaggagaaaccaaatgaaagaataaacaatttttttttggccgaagaatgtgataacgaataacaaagttacggtatgaagatttcgacccatattctgtaccaaaaattctataatcaatccttttttgctgtaattagtccacaaaaacctttgggataagcatgaaaaattacaattgaacttattaatacaaatattgatgagtcattttacagaaattttggaactcttaattcataaatttatttctcaggttcctttaaatg

SEQ ID NO: 108608 - DNA, 318 bp, Heterodera glycines
  Promoter: Source sequence=SeqID_30687; Location=1240..1557; Strand=-; Gene=SeqID_61092
cgaaattggtcaaaatgaatgtcagattcgtgatcagcgaccctaaaacccctattaacatgttttaacacttttagaacaaaaatttatattccaaaaaggggggaccatcggcagtattaccatatcttttgcatcacaaaaacaatagatgggtcagatttgatttgttttccctctggaatttaatatccgctgaatttttctgttgattggtgccaaacttgaggtttcttctcgacatttggcatttatttcccattttcaggaacaattttcgcctacggacagacgggcaccggcaaaacgtacacaatg

SEQ ID NO: 108609 - DNA, 124 bp, Heterodera glycines
  misc_feature (31)..(31): n is a, c, g, or t
  misc_feature (35)..(36): n is a, c, g, or t
  misc_feature (44)..(45): n is a, c, g, or t
  misc_feature (56)..(56): n is a, c, g, or t
  misc_feature (61)..(61): n is a, c, g, or t
  misc_feature (64)..(64): n is a, c, g, or t
  misc_feature (70)..(70): n is a, c, g, or t
  Promoter: Source sequence=SeqID_8588; Location=1479..1602; Strand=-; Gene=SeqID_68621
aaaaaaaaatttttttttttttttgctgctntcgnncagtcaannaattgtacggnaattngcngaaacntaagcgaaattttttttttcattatatacctatgcactaatttcagcgttcatg

SEQ ID NO: 108610 - DNA, 452 bp, Heterodera glycines
  Promoter: Source sequence=SeqID_21329; Location=313..764; Strand=-; Gene=SeqID_51924
ttcggcgccctccccagttcgttggctaagttctcaagtcgagtgaagtcgtcattatcagaacgatgtcgtaaaaaagcccaacaatttcccatataatatggctaaaaagcctagggttagacattggtccatcggaaaattattcaaatttgtttggagttgaaaagtcaacaaaaaaattcgtaaaaaacctctaaagtcacatttcagtaattcgccaccagatttttattattattatttttcagtctgccatttcagtcccgatggtataggaaatttcggtgccactctttaagattgacttacctatttttctggattttctctaacatcaattgattcctttccctaaattcgtgatcactgatcagtgagcccgaaaaatcccggggaacaattttttttttttgagagtcacatttaaacatttatttttaagtgtaatg

SEQ ID NO: 108611 - DNA, 353 bp, Heterodera glycines
  Promoter: Source sequence=SeqID_23673; Location=767..1119; Strand=-; Gene=SeqID_54368
tctgaaaagttaattcgtaaagatcattttcaataactcagcgttgaacaaaagtaatttgtaccaaccttgagtcgaatatttttaaaaatatttaaaatgtggtaacaaatgaatgaaaatttttaaacatttattaaagaccaaattttatttagacaatcataaacacagcggcccaattttgggctccaagtacaaatatgctggatttttcgtcttagtggtctgtgagttagtcaacaaaaagggggtctcaagttcaattcctccttgtgtttgtgtataaatttcaattttttaaagcaaataaataaaataataataaatacagaacgccaaaagaacaaatg

SEQ ID NO: 108612 - DNA, 255 bp, Heterodera glycines
  Promoter: Source sequence=SeqID_15713; Location=742..996; Strand=-; Gene=SeqID_80026
ttcactccctttatataccccttctataaatagcaacccaatataaaattaaattgaaaaatgaactgcccacataaaattaagtgttgtcattactgtccctgtcattacgagatttgtagcaggtgtaaaaagcacagtcttttgcatttcggtacatcattatttgataatttctggctatgccccaaatgcgcgaaacatgttccctatgaaaatataaataggtcaaataaataagaggaattaaaaatg

SEQ ID NO: 108613 - DNA, 1003 bp, Heterodera glycines
  Promoter: Source sequence=SeqID_27715; Location=307..1309; Strand=-; Gene=SeqID_58381
ttaaattttaaattttttaattgattaaaattcatttgaaaatggtcaacattatgccacaaaatttaaaaaacaaaacgtcaattttttaatagattcgaattcgaaatgtgaaattctcaaattcgtcggttttttttttgtttttcccctctatcgcttctgaactttaatcctccattttttctgttgtgattttcgtactttgtctgtgcattttttttgtgttcgcgcccacacatacattttaaattcgaaaagaattttgtttatttaagcgatttatttgttttcccaagcaacaaaaaactccaaccgaacttttacttttgctcacacggcgggacactcaaaattcctttgccgatcgaccgacagacaaacggcggcgacgacgaagcaaaaaagaaaagtgcgcgcattaatttttgaggagcatcgctttgatggagaagagaggtgaacagagcgccaacaatcggtttttaccgccgccatttgcgaaaagcgaagcgcctttccctccaccgtttgccaccaatttctgcctttgattgttgggagcaaaggtttccgatttttttaattgcattctttgtgcctttgaacggtcgaatttttctaacaaaaaaggaaacgacttgtcactgttaaaagtgcattttaaaatttgcttttccatttattttttctttggcttttcgtttatcattttcatattttagtaaaaggtcaattgtttgattttttaccaatttctgaaattcgtcttgttgataattgctggctgacccattccaaaattttaaattaacttgaaaacgacaacaaaagatttaggattaaaaaaaattgtacggcctgccataaaaccataaataaaaattttggtgtttcctatattttctatgttttgtttggcttttcaatttcaattttttcgtttagccttccgtccgttccctcctcctcttcccttctcgtcattccccccatttgaatg

SEQ ID NO: 108614 - DNA, 106 bp, Heterodera glycines
  Promoter: Source sequence=SeqID_6595; Location=2149..2254; Strand=-; Gene=SeqID_62127
ttcctcatttataaaattaatttccatttcctcaagtctcctattttcagaactattttctgtacgtatctcaatctctttttcagtttcatattcagtctcaatg

SEQ ID NO: 108615 - DNA, 1003 bp, Heterodera glycines
  Promoter: Source sequence=SeqID_3490; Location=4324..5326; Strand=-; Gene=SeqID_84885
gggcatggtttcacagaatctttttttttgttaaaataccgtaccactggcgaaatttcataaaactacttctcttatgattagagaccgacttttgaggcatatgcctttttttctgcgcactagtttcgatatattaagcataaataacacattttccacttggtttgaggcttctacgtcgacttttattatgcctttttttgcctttttcgggattttcgtgccttaaatgccttttttggcatttttttcagaaaaattccataaaaatgcaataaatcgggaaaatacacccctaagaaatgaaaaatttctcaaaaattcatctccaaaatttgatatttttttcttgatagaaaattttagttttataaatttcataatacgaaaaaaattataaaatatttaattatcatttaaatgaccaaaattaattttttggttaacttttacgtgtttttgctccctaaaagtccttaataaaaagatttaaatgccttttttcatgcctttttcgggattttcgtgcctttttttcaatttttgggtgcctttttcgcggtttttggtgcctttttagtcggtctctacttatgatatatatttttataattaattcttttacaaataaagagcatttgagaagaaccgagtgttcttcagagtacaagtgtatggattttttgacgaatatttgaattatttcaatgaatttttacgtaaattatccgaaaaaagcggtggcacaacgcgattttggaagtttttgagcagcgaaattttgccggacattagggacggcgattggatggccaaagaattgtggaaaacgcagcaaacggaggccaatgaatgttcgaaaattatcaccaattaattattattgacaatagcatttagtaaatggcttagcattttgtaaaaaagaaaaataatatataaaaaagagaaaaattaattgcccaattaaaagaaattaaaacaattataaaataaaatg

SEQ ID NO: 108616 - DNA, 111 bp, Heterodera glycines
  Promoter: Source sequence=SeqID_582; Location=4391..4501; Strand=-; Gene=SeqID_56669
tttcaacagcatttcttttcggaagaaaattttgcggcgcatccaaatgttgttgccgaacacctcgaacagcgagggcaaattcatttcgcaccggcgcgtcggccaatg

SEQ ID NO: 108617 - DNA, 132 bp, Heterodera glycines
  misc_feature (34)..(34): n is a, c, g, or t
  Promoter: Source sequence=SeqID_41259; Location=860..991; Strand=-; Gene=SeqID_69430
ggagagacgtagaaagacatttaatcagatcacnaatatctcgattccatccaaacccaactaaacacactacgagaaacaaatcctcacattttagaagagcctgatataaaaatttggtttgacaaaatg

SEQ ID NO: 108618 - DNA, 972 bp, Heterodera glycines
  Promoter: Source sequence=SeqID_10440; Location=1587..2558; Strand=-; Gene=SeqID_73638
ttttctgcaggccagggggtggctctataaaaaaaataaaaaataccagcatgtagaggacactttggcggggtgccctcgcagcgggcattttttgattcgagttttagaaaaaaagttatgggccttcaaacgcaagcaaaagtgagaaattagccgccgggactcagttggccaccggagaggaaaacctatagttttcccagatgcgcctcaaaaagttgtaagacccttccactactttcagggcgctccctctgctagaactggagattttgttttagaaacgaaaccccctttttctgtagagtaatataaactagcgggtgcgtgaaccgtcggctatttagctgggaaaaagcgcttcgcgctttgggagcttcgctacctaggctgtgaagtgatttaaattgatcgaatttgttggagaggtttttttgaatttttaaaaaattattaggggtttttagtccacatcgaggctcaagacgggcgcttcgcgcccgttttttaaatttgttgaactcatacgggcgcttcgcgcccattttttagcttgtatggccgcttcgcggcctcaggacgggcgcttcgcgcccgttttttagcttgttaggccacttcgcggcctcagtcgggcgcttcgcgccggtttttcaatttttgttggccttggacgggcggttcgcgcccgttttttaaattcattgaactcatacgggcgcttcgcgcccgttttttagcttgttaagccgcttcgcggcctcagtcgggcgcttcgcccggtttctaaatgtgggtgttctcggccgcttcgctgccttagacgggcgcttcgtgcccgtttttaaattgtgttgggctctggcgggcgcttcgcgcccgtttgatcataagaggtacaacagtgattagaagaggtacaacagcaattaaaagaggtcaaaagtgattagaagagttataaaaatg

SEQ ID NO: 108619 - DNA, 1003 bp, Heterodera glycines
  Promoter: Source sequence=SeqID_38; Location=20222..21224; Strand=+; Gene=SeqID_53325
gcataaagttttggataaggatttaccgatttaatgggacataaaagcattttttattaggctgtataaagaaaaatgccgatagctaataaaatcaccaaccaactctctggccaatcactgacgagtgcaggccgctatctctctgagtgttttctgcgccgtagaaatggatgttgtagttggagtttacaattaaacgaaagcttaatgaatgctaactgccttctgtgagcatcttttatactcattcatagcataaaaagttggtctttggccatgtctagacaaataacctgttaaagtaaaacatgatcaaaaatgcttctgtgtgtataatttttttgggtaggccatatgctcattaaatcagattattttaactaatgtttgcctagggaattaaatttggtcctccaagtgtctggcgtttgacatttatctcagtgattaattgccggctgacggcgaataaagaagcttagcgctaaacattttttatctccggtgaccatcttgcgcttcatcggctggtcatgtgcagttcacccgttccattccactccgacgactatttcaccggttggtcatgtgcaatgcagccgttcggttccgctccggcgaccatcttgcgcttcatcggctcgcgcatgtgcaaccgttccgttgaacgttaatcctccgaaaaaagcagacaagcagacactttgataggctatttaaatgagatttcttctgatgatcataagcatttgtaatgaatcggagagggcgttcagtgccaccaaagggcgtaaatagcgaaagtaattgtgcaaactgcccattggaccatgcgttccgtttctttcaacgtttgcacgatgcccgcggcggaaaacgtttagtgtcaacccctccggcatttatttttcaagaccgaagactcccgcctttatgtatgccaatttagaaatttccacacgccccatttaattaagtgccaaaaatatattccgaaatg

SEQ ID NO: 108620 - DNA, 250 bp, Heterodera glycines
  Promoter: Source sequence=SeqID_11225; Location=1059..1308; Strand=+; Gene=SeqID_74584
cgatttccggtccgtgcattttttgtttctaaaatgtgccattttgaacttttttgaatggtttccttttatgtttattcaaaagaggcgaaagatagtggctaaaaatagtagaagatcggctttactaatccgccacaaaaatggaaagcactgaatttggaaagtcacgtcaatccaaagtgttggtatgtataaatatgctattcgttctcttccgaagttgctttctcattattcctaacaaatg

SEQ ID NO: 108621 - DNA, 295 bp, Heterodera glycines
  misc_feature (9)..(9): n is a, c, g, or t
  Promoter: Source sequence=SeqID_18380; Location=1..295; Strand=+; Gene=SeqID_82985
tgataaganatttttgatttaaaatcttatttaggatcctttattggtctggcttaattttcttgctttttgaataaaaattgtcattttacagccctaaatttgaggcttttagtgcctgtttttttttggtttttttaagaacctaaagcctaccttttggccgatttttagagcctataaatattagccctactctagaaaaaccaaaaaattttttaaattcattcctgtgagactccaattctccagtattaccactaaatcattggaattttcatgtgaatttcagatg

SEQ ID NO: 108622 - DNA, 71 bp, Heterodera glycines
  Promoter: Source sequence=SeqID_5840; Location=1..71; Strand=+; Gene =SeqID_59412
attaggcattagaggaggcaatccaacgctatccgccaaatccgtggtcagtgcacgcggccccccctatg

SEQ ID NO: 108623 - DNA, 497 bp, Heterodera glycines
  Promoter: Source sequence=SeqID_32589; Location=1..497; Strand=+; Gene=SeqID_62891
taatttaattttgggctacggcaaatagacaaaattattcttatttcatgtttctaatatttttcttaataccaagttttgctggcttgataccaagaatgtaggcactgaacaaataaaaaaactgatggccatgcctaagaaactgagaatggcattgattggagcataaaactggaatagagccaaaaaaaaaaattttttttttgaatgggtttggtcattttttgcctactaattttggtacaaaacgaagattggggattttcttagtcagatgtgattatgatttttgagtcaatcagtgatgtatcgggagtctcgatgccagggttttttcaaaactgtcaagatcaggaatatacatatcgaatgaatctctctagtcacaataaaaaaaaaatcgttatttagacaagtccatttccaatttttttttttttaaattcttgattcatttctgacccctttccattctttacatatttaaacaaatg

SEQ ID NO: 108624 - DNA, 628 bp, Heterodera glycines
  Promoter: Source sequence=SeqID_2028; Location=1488..2115; Strand=+; Gene=SeqID_77392
ttcttacattaataaccaaaaagcctaaattaattttttttgtttttttaacaggactccgggtgctgttgagcgaagcaggacaaaactcggtaatactatggcacccccacaaagtgtccaagccacgaaatgtccaaaagagtaaaaacccacgaaatgtccaaaatttttcaaaatttataaaaacaaaatgagtctaatttaggatttttaaggttttcggggtcgctgaatacgaatataccctttatattaccccttgcctaaccttaggcccatctgaataataaaaaactcaaattcgagacttggacatttcgtgggctggacattttgtgggtcagcgaatactataagatgggatcgacccatttccatactgccgtttccataccgccatttacataccgccgtttccgtaccagccatttccataccggccgttccatgccaccgtttccataccgccatttccatactaaggtatttaggccatttccataccaaaaatttttcgaaaattttcaggtaaaattcaataaatagataggtttcaactgtttgatgcttaatatgaattataaattcaatggattctcttttcaacgttatagattggaaaatg

SEQ ID NO: 108625 - DNA, 155 bp, Heterodera glycines
  Promoter: Source sequence=SeqID_1763; Location=7623..7777; Strand=+; Gene=SeqID_75786
ggtagcataattaacaaatcatgaaagtatttggagtgtcttgggggaaacggaaaacaattgcatgtaaatcaattgtgtacggcattgcttttaaaattgtaattccgaaaaggggtaaaaaaagcatttccggcatttcgttattaaaaatg

SEQ ID NO: 108626 - DNA, 57 bp, Heterodera glycines
  Promoter: Source sequence=SeqID_37352; Location=284..340; Strand=+; Gene=SeqID_46509
ggtgtcgtcgatgataaaattgcaattcattcactcattcattttaattttcagatg

SEQ ID NO: 108627 - DNA, 222 bp, Heterodera glycines
  Promoter: Source sequence=SeqID_9776; Location=2093..2314; Strand=-; Gene=SeqID_72654
tcattcattcaataaaacatggctaataagtttttacttgtcccacaagaaatttacaggggtttgacctcaatgtcggacacgggtgacattaatttggatgctgtacgacacgatttgaaccgaaccaggggcgaacgaacaaatccctctgctaaaaatgtcaactacaaccaacaacttaggcggtatttgaaaatgaggagggaactaacaaacatg

SEQ ID NO: 108628 - DNA, 1003 bp, Heterodera glycines
  Promoter: Source sequence=SeqID_17199; Location=1358..2360; Strand=-; Gene=SeqID_81662
aaaccagcttttttgaaattttgcaggcttatagaggacacttagtgctatcatgttagcacgtcataactagggaaaagaaatatattgatataaataaaatcgtgaaatatggacataaaattaggacaaaaaatcgcgaaatatggatataaaaggcaaaaatatggacataaatctttggggtcaaaaaggccaatttagttgttgggggccgttctaatagaggtttttggaaaaatgccaaaatatggacataaaatatgataactcgacactcgtgctcatttggcagaattttttttaagaacccatggatgctctacccacctaccaagtttcattcggaaatcccacggacacttggtcacctccccttatcagactaaaacggcccgtatgtgctaatatagtgacttaaaatatgtttggcgttttgttgttttattttgtgttatttttaattgtgattttgtgtgataattagtagttagttgatgcagtcgtcatttttccctattgatttgtgttcgccttattttaattggaattaaacgaaaattttcttcgacattgtaatgagtggaaaagcagagcgagcatttgacgtcgccaaaaaacatcgcccgaaaaatttcaacgaaatttgccgcggaatagaagaaattttagcgagtgggacgcacagaaatgcaggcattcaatgaagggccggtgtgaagcgacgaccgaatgagtctgtcgatgaattcgcggaacggctctactgcattgttgaatgtgcttacccaggtttgccgccaaattttgtcaacgattttggaatcaaacacctaattcatgctttggaaaacccggaaatttcggtgggattggaattggctcgtcgaccaggcatgagcttcgacagtttcgtcgctcttgcagtgcgatcagagtacaaaaagcaacgaaatcggctgaaactggaaaagagcactagccaaattttcagccgaaaatg

SEQ ID NO: 108629 - DNA, 1003 bp, Heterodera glycines
  Promoter: Source sequence=SeqID_3720; Location=156..1158; Strand=+; Gene=SeqID_51606
actagagccattaatattttgaaaatatctttataggtagctcacaacattctctattagcatgcaaaattacaaaaaaattttgtggtgtttataaaaaaaaagttatgaccaaaaacctcaaaaattgactttttcatggctttttcgtcgcggttgacataacttcttttaccttgtgcatgatttatttctttttcacatattagagctttcaaatgatgccagatttgctaactttaactgacaaagaaaaaagtcagaataatacaaagttggcggcgccaaaacagttccacgccgccgaactaatcccgaccttacttaagtggaagaatgatgaatagggcgaggattcttaggtttttacttattttttctgcggctttaactcgacgagaaatgcacgaaaaacaccttttttgttcggaaaaccttcgttttaacgcccctatccgaccctagaaatccctattttggatgttcgcccctaaaaatccctattttgagtgttcgcccctaaaataagtttttacccctattttggcgttttctccaaaatttattaacaaaaatgcaataaaaacgaaaaatacaccccaaagaatcgaccaaaaaattttcagaaaaatataccccaaagaatcgatccaaaaaatttcgaaaaatataccctaagaatcaatccaaaaaatttcgaaaaaatatacccctaagaatcgacactaaaatgaaaaaactttctaaaatatatcttatttgtaactgcaatcagtgaataaaattgtttgccttaattttaacttatttacatagagaaaacagcaatttaaaaaattgcacccctaaatttgaaactttttcgcccctatttttgcccctatttcgcgaattttttgcccctatttaggtccctaaattggaatttttcgcccctaaaaatcctcgccctaatgatgaagaagagcaaaattggcataattttcagggcgcccggaaaatg

SEQ ID NO: 108630 - DNA, 389 bp, Heterodera glycines
  Promoter: Source sequence=SeqID_7879; Location=1..389; Strand=+; Gene= SeqID_46491
tctgtttctctgcttttcatcgttttctcctctttttcactgttattgatttattccctttccgccattccctccaacgcttttgcctttgtattttaaaagtgcgttcatttcatacacaacagacacatgtgtataaaccacacaaataggacagcaaaaggaagcatgcttttcaatttattgagggcattacgaaaacaatgagatggacgattaggacatcctccaccaaacgcccaaattaaaattcaatgcttttgctctattttaatggaatgtttagccatttaaaaattctcttagcttgcgcaattaatacaattttaagcaatttctttttcctgtgttttaaacttccttttcgaaacaactgatatttcgcaatg

SEQ ID NO: 108631 - DNA, 400 bp, Heterodera glycines
  Promoter: Source sequence=SeqID_10161; Location=1732..2131; Strand=+; Gene=SeqID_73266
tgaattcagtattactgggaagagtggatttttcattttgtttttattaatggtaaagcaggccttttctcggttcttttaaattgacctaagtggttttttgaaggattttttgatttttgcgatcaaacctttgctctcgcaagcccttgtttgacttttaaaaattcaaaaaaaaattctacctttcattatattaccccattctcctgtggcgatctctaccaccagccctcacaaaattcttatggcaacgagaaacctctgatttaattttggttcaaaaataagattcgaaaaagatcaaattaatgcaataaagattcagcccattaggttatacatatctagacggctctatccccttgatctttagtggaaggagcaagcatgaaggatg

SEQ ID NO: 108632 - DNA, 129 bp, Heterodera glycines
  misc_feature (32)..(32): n is a, c, g, or t
  Promoter: Source sequence=SeqID_33556; Location=917..1045; Strand=-; Gene=SeqID_63584
aaaaattcttcttaaaatttttttgacccaanttcaaaaaaagaaaaaaaatttgcagtcaaaaaaatattcgaattttctcccaattttgtttccataatttcccgaaagttattcggtatcataatg

SEQ ID NO: 108633 - DNA, 248 bp, Heterodera glycines
  Promoter: Source sequence=SeqID_13432; Location=2688..2935; Strand=-; Gene=SeqID_77322
ggagcacctccttgggagctccgaaacatcatctctggtggaaagggtcagcttggctcacacagtagagccatctttggcccaacgtactctgtttccaagtaacagagtctgaccaacaaatctcggagaatgttggcccgagtggtgcgtttctcgcatacactcacttaaagcagccaaatgagcaggtcttaattgacccctcacgcttcagctcatggaaacgccttatgcgaacaacaatg

SEQ ID NO: 108634 - DNA, 92 bp, Heterodera glycines
  Promoter: Source sequence=SeqID_21647; Location=1412..1503; Strand=-; Gene=SeqID_52246
tcgcatatcgccgtctcctctcaacgaccaagcgtctgcaatgctctcttgagcttctcgaccgttactccgccgaactgacacggcaaatg

SEQ ID NO: 108635 - DNA, 512 bp, Heterodera glycines
  Promoter: Source sequence=SeqID_26159; Location=1..512; Strand=+; Gene=SeqID_56909
tttatctgaaaaactaacaggtattatcatttattatttaaatattaatcgtaataaaaattacaattatttagggacactttctccgtggcggtattatctctccgttctccgctggaaaattcgtctttttaattctcaccaccaattttattacgtcgggaataaggtattaaaagggtcaaattaagcatttgtaatattattttgttatggggaaatggacaattttgaacacccggaagacccggcgggacaattcgccttttggagtaccaatgaaaagaagcgaaacgcaacaatggcaccgttcatattttggcacacattccaatcggcggtaatgcggggagggggggggggggttcaaagaggaagttgaattaaaaaaagatacggaatttgtgggaattaaattcaaacagaaaataaaggggctcattgatttaaagtgtcaaatgtaatttaatcatttatttaaatgaattttaatttatttagcctacgaaatg

SEQ ID NO: 108636 - DNA, 630 bp, Heterodera glycines
  Promoter: Source sequence=SeqID_7321; Location=1..630; Strand=+; Gene= SeqID_64461
acgagaaacttgccatgccaaaatggatttaaaaagtacaattttgaccagtgactttccccccctccacttttgggccccattagagcgcattataattagtaattgccttttcctcgaactttttgcgcttcatttatttgtttgaatttggcgcgtgccattttcgcttcatttgtttggcacaatgtgcccagcgaccgacgacgccaaccccccgtgaaaaggtcaccttttcatgaccaaattttcatgaatattctctcatcgccccgcgattgggaacatactgagcaggtggcaccagcctaattaggggaattaatcacacatatccatcattaaatatatattcgaggggacgtacggctgactgactcatcatcattagcagcagatcattatcgtcatattaaacatcataatgagttttttggtgccaaagtttcgcgcactctctgtgcccgaccccagcgcgccgttgtgtttggcattttgtgtgacgacggaatgaaatgccaaaaagcgcaattaattaattgggtgaaaggtaataatgagaaaagtaaaaaaaaaaattatttttgcgctactccgaaaagggtataaagcacaacaaaacacagaatg

SEQ ID NO: 108637 - DNA, 333 bp, Heterodera glycines
  Promoter: Source sequence=SeqID_2227; Location=3264..3596; Strand=-; Gene=SeqID_78611
cctgataacccgagcaaatttctttagctttttcatgcatatttagtcattttgagttttaaagaaatatacataatactaattttgtaatatttaatttttaataaatattgcattttgtatttttattagtgttaattgttaattaatatgatacataacacacatttgtttcatttaacatcttttgtttgttaattgaaatcaaaaaatgattgattttatggtagcaataaaggttaatagatttttttgtcgtaaattaccaaagttggcatttttatgaaactggcacaagtaaattgaccgcttttaaacttttacagtaaaatg

SEQ ID NO: 108638 - DNA, 475 bp, Heterodera glycines
  Promoter: Source sequence=SeqID_10945; Location=402..876; Strand=+; Gene=SeqID_74252
ggtgtgttcaagaaaaaaaatgaaaaaaaaaaagttttttcaccgccgaggtctgaacctgggccaggattaaagtgcgaacaaggaaaagcaccactgcgccattaattttaagtcagctaattcttgctaaagaaccaaatcgaaaatgcaaattaaaaaacaacagtatttgctgagaatgttcggtttggtgccccctccgtgacctcctccctcacgcaaattttccaaaaaaaaaaattactaaatttttcttaaaagccacaaaattaacaatttcttggtgcgaatttctttaaaaaatggaaataaaaattgcaattttccggcggcgcctgtcggcctctctggacctctcctgttgcagaaatgttttttttaaaccgcgtcacaaaaaatggcttgaaaaaggccttctctcataaaaccctgagcctgctggaaacaaaagctttcaaaaccaacagatatg

SEQ ID NO: 108639 - DNA, 1003 bp, Heterodera glycines
  Promoter: Source sequence=SeqID_18784; Location=167..1169; Strand=+; Gene=SeqID_83460
ggcatattttgaaaaaacgacccaaatcacgagcccggcaaaacaggattttcaatccttaaatccggtccgggtccttctctgggaaattttgatcatgatctgatccggataagaatgaccaggatcaacgggatttttttcttatttctaccaaaaaacaaaattttttttttaattaatttgtcataattagagctcgcaaaaaaggtgtaggaatttggtggatggcggaggtgtaaaaggtcagcctgcggtgggattcgaacccacgtcccttcctttccgtggaatgctctaaccactgagctacacagggcaccctttacacccttctattgcactttttcatcagtgcaatgagaaactctctgcctcccaggcactttgagagagcccgcactacaaaggcacgaaaatcccgaaaaaggcatgaaaaaaggcatttaaaattttttattaaggatttttagggagtaaaacacgtaaaacttaaccaaaaaccttaattttggtcatttaaatgattattaaatattttataatgttttcgaaaaagtaaaatttttaaaactaaattttttatcaagaaaaaaattaaattattttttgagaaaatttttaaattcttagaggtgtattttctgaaaatattttctggtcatttcttggggtgtattttcccaattttattgcattttaatggaatttttcggtaaaaaacgccaaaaaaggcaccaaacggcaaaatgccaaaaaaggcatttaaggcacgaaaatcccgaaaaaggcaaaaaaaaagaataagctcaattaaaacttttttttgtttttaaaaaaggctcaccccgaaattcgtctaatgtatttatattttatcgaaaatggcacaaagtgggcattttttgatgcaaatttttaagaaacacttagggccaacattttcaatccccccccgggcggcgtctatcggcaccgtcgaacccttccctttacaaaaatg

SEQ ID NO: 108640 - DNA, 137 bp, Heterodera glycines
  Promoter: Source sequence=SeqID_8695; Location=3314..3450; Strand=-; Gene=SeqID_68877
aactgctcccgttggagcgcatgcgtcagttggtgctcaacttcttcggccggtgagcacgagggggtgggtgggataacaatggaatgtgtgtgtgtgtgtgtgtgtgtgtgtgtatgctacccccgatcaggatg

SEQ ID NO: 108641 - DNA, 413 bp, Heterodera glycines
  Promoter: Source sequence=SeqID_27138; Location=1..413; Strand=+; Gene=SeqID_57844
ttttttcgggtaatatttgtagaggaaatattaatttggaattagctattaagggacggagggccaattaaaaggagcaaaattctgacaaagcatggactggcaaccattgtttttatatcccatttaaaaatgcaaaaaactggacttacttgagtgtctctgattatatttaattgccagttggcctctggcaagccattaataaatttaaaatattaattaatcaaaaaatttatttgcttttttttgtttgtttgtgtgcgctttttaagttagtgtgtctacggttgggccgaaacacccgtaattagttgctttttaaccggaagagaccgtactgacgaggcccactcttccaaaaaattttcttaaaaaataatttttttttattcagaaaccgtccgcaaatg

SEQ ID NO: 108642 - DNA, 233 bp, Heterodera glycines
  Promoter: Source sequence=SeqID_20848; Location=3209..3441; Strand=-; Gene=SeqID_45606
cagaaaaatttgggtatttttttttaagtttcactaatttaatgttttttgatagttattcaaaatcaaaatttttatattataacttttgtggcaaataattgccaattatgtaattactcgaaactttttattattcatttttaaagtatctatttttagatttatatttacaaacccaaaatttttctgatcccgaatttggtcattacagtatgataagaacaaagatg

SEQ ID NO: 108643 - DNA, 354 bp, Heterodera glycines
  Promoter: Source sequence=SeqID_3672; Location=1..354; Strand=+; Gene= SeqID_51385
gcatacaagaaaggtttgcattcatttttaaatattttaaacttttaaaaaaaagtaataataaatttaataaattcaaattttataataatttaaccctttattatggttttttcttcatttttatttcttattgttttttgcatatttttcaggtgtttgtcaatgtgcgggtcgcctgaagttgagacaaaacgttatgtgccgaggcctttcatgaatcagaattgtagcggtgaaatttccaaagtgataattaccaattaactaatgacttaattatttaataaaaatcatttaaaaacataaatatttattttttggattattttttaggttttgtcctgcgcaatg

SEQ ID NO: 108644 - DNA, 508 bp, Heterodera glycines
  Promoter: Source sequence=SeqID_2886; Location=914..1421; Strand=+; Gene=SeqID_82189
tgtatggcaaaaaaaaaattattttggcactttccgctcgaaatgcccttgattgcccccggcgggcatttggcatttttttcgctttgttccttcccttcccccttcccgtcgccgtgggggtgaggacgtggaaaggtacaaacgtttaaatggtcccatggccacccccaaccttcattataaggaatatgtaggccaaaggcggcgaccctgccgctgccagtcctcctcccctatgtggagtccaattccattccattccgtctcctcagtcgctccgctccgtccctatcccccgttgcgcccccccccccctccctccaccggggggggggggggactcaaccaatctcgagactctcgaaacgccgccgcagtcacggcggcggcggtgatgatagatgatgatacagcgcagagcagtagagagaatataaacaaacaccgcctccgcctccaccgccgtcttcccctcccttttgcgcgcctccggggtccggggatg

SEQ ID NO: 108645 - DNA, 184 bp, Heterodera glycines
  Promoter: Source sequence=SeqID_11692; Location=3899..4082; Strand=-; Gene=SeqID_75174
aaaggatgtgggctcgagcctgaaaatctgatcagccgtcggcggaaaaggcaatttcgtccgttttttggaccacaattgggcaaatgggattcgtttccgatcgtgatcagttttttggaagataaacgtaagttgcctttaaaattgaaagccatttatacaataaattgttttcaaaatg

SEQ ID NO: 108646 - DNA, 283 bp, Heterodera glycines
  Promoter: Source sequence=SeqID_14319; Location=1314..1596; Strand=-; Gene=SeqID_78348
ttttatgccactgggaaagcaaaatccaattcattaaattgtaaaaaaaatgacgtcatcatggaaagtaaaaaatactccgccccttttcttgttggtcacgcccatttgtttttgttttgctttgctaagaatacgactccgctttttggctttttagtttcttttttccgcctccatttttttttgctatttaaccacaatttttctaaataaaaatcattcgtgttccattttttaaaaaattacatcctccttcgttttttccgatcttcctgcaatg

SEQ ID NO: 108647 - DNA, 325 bp, Heterodera glycines
  Promoter: Source sequence=SeqID_3284; Location=5355..5679; Strand=-; Gene=SeqID_84054
accgtcgtcgcggccggccgcatcgtccgatgtgtgaagagcggcgcgtgtgcgcccgctgtcgtcaggtggtgtggacccgtcacggcgcgcacgcgtgcgcccacaacaacaacaacaacatcaacgaccgccagcaagcagcacaacagcagtgcgcgcgttgtttcggcattcacgacgcgcagtggaccccccacttcatccagccgaagcgggcgcagtgtcagctgatcgccaacgacgcggagcgcccagccgccccggcgggaaggcctcgaggacgacaacgacgacgacgacgacgacgacgatgataacgatg

SEQ ID NO: 108648 - DNA, 1003 bp, Heterodera glycines
  misc_feature (334)..(334): n is a, c, g, or t
  Promoter: Source sequence=SeqID_24105; Location=942..1944; Strand=+; Gene=SeqID_54809
tttcgttgttgacaaaacttaacaaaatggtatcattcgaaaaaattggtaaaatgcggcgttgaaacgccccgcaaaattagccgttgacccccccagactttatgaaaatactcaaaatgttttaaaacctattgacataagaaactaatttttaaaaattaggaattgatcacaaaactattaatatatctaaacatggaatccatctccgaccatgagcctctacaagggaaaaaaattggtcaacaagaaatatagaaatcaatataattcataaaaacaagaaatacactgataaatttatggaaatacacccctaagaattgctcanatattgatcgccaaaatttagtttaattctttcttgaaaaattttttgatttaaaattatccttattcgaaaaaacattattaaaatcagaaaagaaactgagacaattgtttaaaataccgaaatatggagaatgaaagatcaataaaaaggaaaaaaataaaatttttaaattaaaattaaaaatgatagaaatgaataatttaaaaatgaatgatgatgaaaagttaaaacgaaaatttaaattatccgaagcaatttatctttttattgttaatgcacgaatgcattttaattaattattattttttataaaatctaatatttaacagccaataaaattcgctcagtaacaaataatgaattaatagctaaagtatgaaaaaatacctaaatatttagcgaaataattattttaaaaaaattactcataaaccatctttttaaatttaaaattaatcaacaaaactaaagtattcctaacccacttctaatatacagatgttataagagagtataagaaacaaaatattgaacaaaacctacccatatgatttattaacaagtaaataaaataatttattaattattaataaaaaaggattaataatgacaagagaaatttaaagaaaaagtaaaaagcaaaaaaaaagataacaaaaaaacatg

SEQ ID NO: 108649 - DNA, 53 bp, Heterodera glycines
  Promoter: Source sequence=SeqID_7667; Location=275..327; Strand=-; Gene=SeqID_65562
gctaaaagtcaaataggtttgtccaactttctgaaaacggtaaattaagcatg

SEQ ID NO: 108650 - DNA, 177 bp, Heterodera glycines
  Promoter: Source sequence=SeqID_4817; Location=5673..5849; Strand=+; Gene=SeqID_55829
ggacattagataaaacataattagtgtaatattacctcattaaattatatattacacaaacccattggctcccaacaatttcctgtgtccaatgcattcgatatttcacatacaattcttgcgggaagttgaaatatgtaaaacacatctttctgaacattattttcagatcccatg

SEQ ID NO: 108651 - DNA, 272 bp, Heterodera glycines
  Promoter: Source sequence=SeqID_494; Location=3484..3755; Strand=+; Gene=SeqID_54340
tttctgaatgtactgtcccgaaaaacgaaaaagcagcggaaagtacagtaacgctttttgttcctattcgagacccaaaaaaaattctcagtttataaatgttaccaaaaacttacaaaaatttgcactggcagcctcttattcttttggaaagacataaaaagctaagacacaattgttaaaggagtgaattttgaaaaatgttatgattttaaaagaaaaattgaactgaacagacaaaaaatacggtaattaccccaaaaacaaaaatg

SEQ ID NO: 108652 - DNA, 274 bp, Heterodera glycines
  Promoter: Source sequence=SeqID_972; Location=11076..11349; Strand=-; Gene=SeqID_65205
ttccaatttctgcttttgatttgaagggatgaaagtgtggatagactctaacaacaagctttaattactgaactttaattgacatatgtatgatgataaggataagtgattctttttcattgtcatttgctaattactttcttttaaaaaaactttttttaaatgttcttctaatgttagtgattctgatttcaaattgtgtcaattctttattgtttcgatttattagttgcagttttgccttccttctcctttagttcagaattgaaaaatg

SEQ ID NO: 108653 - DNA, 771 bp, Heterodera glycines
  Promoter: Source sequence=SeqID_12319; Location=853..1623; Strand=-; Gene=SeqID_75915
atgcagaaccaatccctctgctacgacacattcaaagaagtgttgcggtatgcccaaaccggagagtatgagccaataaatgtgatgtacctcaactttttgaaacccgacattaggagtggcggacacgtcacttcaggccccctccaaaaatgttatcgcccatatgtaggtaaagggatagtgggccctaattatgatgttctcaattttggacacactttgtaattgtttttcatttcgttcatcattcattgtatctcacacacacacacacacacgcaccctcatacaccgccatacccacgcatgtacccctttgtttttctctattttatacctaaaattgtgttattttgtcgttttattcacgtttttaataaaaaatacatgcataattaagcaaaggaagacacaatttgtaaattattaagcatttgggaacgtcatttttaggtagaaaagtgcataattaaggagtgaaaatacatgcataattaagcaatggaagacacaatttgtaaattattaagcatttgggaacgtcatttttaggtagaaaaatgcataattaagagcaagaagacacaatttgcaaataattaaggaatggaagatacaatttttaaaaagttaaaaacgaacttgtcgtttttaggtagaaaaatgcataattagtgtttaccaataaacgtaagacggttgactacatacaagactttctcattaattttcgtatttaagtcgcaagggcagacacttcaaaagatg

SEQ ID NO: 108654 - DNA, 262 bp, Heterodera glycines
  Promoter: Source sequence=SeqID_3463; Location=95..356; Strand=-; Gene=SeqID_84770
tccctttttatagagaatttttacacggaattgacgggtaggaaaatgtttgtataaaagggacgatttaagcgcagaaacaatcattcttcatttgtcctttactgacataataagcgtctgtctccttcttcactttgttccccttttgactgcacttcagcaacaatgctcatcagagaatagtgagttgcttttttcatcatcattcttctgacaccttaattaattacgctttccttttttcagtcgcatcgtcatg

SEQ ID NO: 108655 - DNA, 500 bp, Heterodera glycines
  Promoter: Source sequence=SeqID_15885; Location=1101..1600; Strand=-; Gene=SeqID_80227
tttcttcgctcccattcaaatcaaacatttatctttcttctgaaatgcattttttgccacagcgaggcctatttttgaaaaaaaaagttttgccaggcaaaaaaattcgggtcgccctccccttgaaaatttttctgaccacaggccctttagctttagagacaaataaaaacaattgcacatcgtctgctccttcctgctgtactcgtcgatgttcaacagttccactttttgaggtgccgccgacgctggggaagacgacgtgtccgaccttttttttgaatttgcacccctaattttcaagtttttttgtgcatatttggtgcatattttgcgatttttgtgcatatttcacgactttatttgcatatttatgcgcatattttggccacttttcgtgcatatttttggcagccctaataatgctatataaaaaaaagtaaataaccttttttaatggaatatttttaaacattttttcgatataaattttcaaaatg

SEQ ID NO: 108656 - DNA, 290 bp, Heterodera glycines
  Promoter: Source sequence=SeqID_17806; Location=1180..1469; Strand=-; Gene=SeqID_82338
ctattaattggtaatggaccaatttgtcggcaacacttgctgaattggcccatttcagcaaatttgtttggattttgctccgttgaaaagcacaatttgtagtgaaattctcgaagtgggaagccgagcagacaatgagcgcaaaagttcaaatttttgctcaattttaatttcttcaaaaattgctttccagtttttttggtcctcggaaagaattcacttgctaaattaccaggaatttgaataattaaattgggttttgctttaatgaatatccttttttaccgatg

SEQ ID NO: 108657 - DNA, 119 bp, Heterodera glycines
  Promoter: Source sequence=SeqID_25095; Location=252..370; Strand=+; Gene=SeqID_55831
cgttggtttatgaagaaggcaggggtgcaggggcgttcggtatataagcaaccatttgttttgtacattttttagtcatttcatctgttaagtgtgccgccgttaagcctgctgaaatg

SEQ ID NO: 108658 - DNA, 311 bp, Heterodera glycines
  Promoter: Source sequence=SeqID_6979; Location=5411..5721; Strand=-; Gene=SeqID_63473
ttaaaattattaaatttattggttttttattatttaaatttttggtatttctaaaccactcgtgaaaatatttcttttttcattattattttctaaatttctttttaattccaatcatttttctcactaattaaaacatttttttaaactaattattttttattagtaattaattaactaattgcctgattaattgtcccatttttaaggaacgcaccgaagagaagcgcaaaatttttgaattggcgggcggagcaaatcgaaacaaaacgaaagcgtcgacaaaagcggaggatcagcggaagaaaatg

SEQ ID NO: 108659 - DNA, 161 bp, Heterodera glycines
  Promoter: Source sequence=SeqID_866; Location=3444..3604; Strand=-; Gene=SeqID_62920
tacggactcaacaggacgaactgctcggggcagtgaggctcagactggcctccctcaccatggtctgcgtgccaaagacggaaagctggctccgatcatactctatctcgacgacggcggtaaagcgatgcccatcggcggggtcatgccgcggcaacatg

SEQ ID NO: 108660 - DNA, 205 bp, Heterodera glycines
  Promoter: Source sequence=SeqID_4008; Location=2015..2219; Strand=+; Gene=SeqID_52790
atttcattaaaattcttctatgaaacaaatccgtaccaactgcgttaattaaagcgattagtgtttaattcacttttggcgattttatttttcctccgattaaatgcaattacaatttttcctcattcagcagtcattttgccccctcccctgtttagatgatctgtcattttcgatcattgatcaataccagcgtgtgctgatg

SEQ ID NO: 108661 - DNA, 447 bp, Heterodera glycines
  Promoter: Source sequence=SeqID_2445; Location=1..447; Strand=+; Gene= SeqID_79774
ctttttcctctcttcgtttgctttttttaatatttgttttgccttttccgatcggtttcatttttcgctttttctctcattttaatttttttcgctaatttaatttcacttggcccaccatttccatttaagtgcataaaaagtttaagtctctgatgagaaagggcaaacattctctcgtcccccccccctccctcaaattgcattatttcgcttattacgcctacggcatggaaatccaaatgaaatcccagaataaaatatagagccattaggggaagaaaattagcggccatctcaaattgcgtgcaaataaataaataaacgcttttacgatatctccacgccccaaaataaattgaaatttctgataattatctcaaaatggacacttttcagaatgttcccatttggctctttctaatttgttttctcttttcaaagatg

SEQ ID NO: 108662 - DNA, 318 bp, Heterodera glycines
  Promoter: Source sequence=SeqID_13066; Location=320..637; Strand=-; Gene=SeqID_76852
gttgagctaaggttatttgggcacacaacagcataaaaggaccagcctacctgtttagactggtttcaaaaaaaacttataattaaattaaaatatattttaaataaatagtaaatttatgaatttagttggttaggaaaaaattaagataaaagggcgggaagagattctgaaattattccgtgtgattcttgattctcaagtcgggaaataagtcatggataaataaggcaaaaatttatattcacaaaaattttgctaacattcttgacattattaacataaaacaattaaatagcattaatttagaaaattatg

SEQ ID NO: 108663 - DNA, 433 bp, Heterodera glycines
  Promoter: Source sequence=SeqID_12637; Location=2681..3113; Strand=+; Gene=SeqID_76312
atgaaagtgccaacaaaatcaacagattctgtgattcgaatacaaatgcatatcattgttgttattgttttgtttaattatgattgtgattatacaataaaatgttggaatttaacttccttttttattctatgggcttttccgttgcgcatttttatgccaaaattggagcgtcacaaaggcagtgccaaaagatgaaaagcattgacttttgggtcagcaaaagtgccgcagaattggtgaagtgaacggagttgccaaatgaatgccaactgagcacaatttgcataaactttaagtagacgaccttctccatgatgccgtcgcgtgtgactacttcttccgtttgctatgaaagaggaagaaacagaacgatgctttgacgcaatgggcaaatagaaaacaatgatgaaaatacagatgaacgcaaatg

SEQ ID NO: 108664 - DNA, 188 bp, Heterodera glycines
  misc_feature (113)..(113): n is a, c, g, or t
  Promoter: Source sequence=SeqID_8288; Location=780..967; Strand=+; Gene=SeqID_67580
aacgggggaaaatgcattggcacccatcacggcactgcctactgtaactgccccgacggatacggtggagaaaattgtcaggtaatcagaatgacaataattaattaattcanatttaaactgagcatagattgagcagaatatatgtactaagtggacagaaggcgacgagggaatatgcgggaatg

SEQ ID NO: 108665 - DNA, 482 bp, Heterodera glycines
  Promoter: Source sequence=SeqID_15569; Location=515..996; Strand=+; Gene=SeqID_79853
ggtcggtgggcgaggggacgggacgccaaaccgcttatttttcaacaaatttatttatatttactgcgtgctttttttgttgctctcttttatcttacgaatttgttggtttactactataattctggatccatcatccgcacatttcacagtgtcacttatttatctctgactctttttggttgcattctttcccggctttaaccattttttataattatatataatttagtaaaattggttttattcgagtttggtttcgggggtttgaattggcgaaatgaatgtcagatttttgattggcggtcccaaaaaccccgagaagcattttaaagttgcaggcgcccacccatggaattgtccccgtacccgtttaatccaaattctggtgccctcccccttccttttctgtaaatattctattctgctcttcaatttacctttagtggtggccatttgccgagacatttatgatgataatg

SEQ ID NO: 108666 - DNA, 260 bp, Heterodera glycines
  misc_feature (55)..(56): n is a, c, g, or t
  misc_feature (90)..(90): n is a, c, g, or t
  misc_feature (105)..(105): n is a, c, g, or t
  Promoter: Source sequence=SeqID_14024; Location=1..260; Strand=+; Gene=SeqID_78001
taaagtaattaactgttattattcccatgtactaataataattagtcaaaaaatnntaattgtttaaaccacttttgaattagtggaatnaaaaatataataatntagttttaaaattaatccgatgaaattaaatttgttttactttatcagcgcaaaagaaagaattattttaacacaacaaaaccactaacaattttgtgctgcttcttctcgcccttttctcagtgcccaacttaaacttcttccatccgcaaatg

SEQ ID NO: 108667 - DNA, 480 bp, Heterodera glycines
  Promoter: Source sequence=SeqID_44504; Location=1..480; Strand=+; Gene=SeqID_71984
ttttattttgtcaaccaaatccaaaactattaggtatcattcaatagccctaagtgtcctctattagcctgcaaaattctgaaaaacctcgttaaggttcaaaaaagttatggttagaagaattcaaaaaacagattttccaagttttttggcttgaactttttttaaacttaatgaatttttttggaatttcgcaggctaatagagcatctgaagggctctcgaacgatacaaagatatttggatttggtttgcaaagaaaaaagttatagtccaaaaacatgtgctcgtacgaaaacgacctggtccgtctcgagacaccccttgtatatgtatgtctcagggtgtttgctatttgtttaccgtagcttttggcttcctataggcgtctatactactagaagtggttttgtccctccgtaccgtaaccttagtgcgccctatttcattactatgatttaagtaatccccgtaataatg

SEQ ID NO: 108668 - DNA, 712 bp, Heterodera glycines
  misc_feature (4)..(4): n is a, c, g, or t
  misc_feature (22)..(22): n is a, c, g, or t
  misc_feature (38)..(38): n is a, c, g, or t
  misc_feature (42)..(42): n is a, c, g, or t
  misc_feature (45)..(46): n is a, c, g, or t
  misc_feature (63)..(63): n is a, c, g, or t
  misc_feature (78)..(78): n is a, c, g, or t
  misc_feature (80)..(81): n is a, c, g, or t
  misc_feature (83)..(83): n is a, c, g, or t
  misc_feature (85)..(85): n is a, c, g, or t
  misc_feature (91)..(91): n is a, c, g, or t
  misc_feature (102)..(103): n is a, c, g, or t
  misc_feature (120)..(120): n is a, c, g, or t
  misc_feature (127)..(127): n is a, c, g, or t
  misc_feature (136)..(136): n is a, c, g, or t
  misc_feature (152)..(152): n is a, c, g, or t
  misc_feature (157)..(159): n is a, c, g, or t
  misc_feature (161)..(162): n is a, c, g, or t
  misc_feature (169)..(169): n is a, c, g, or t
  misc_feature (172)..(175): n is a, c, g, or t
  Promoter: Source sequence=SeqID_6793; Location=1..712; Strand=+; Gene= SeqID_62930
tttntaatttcacttcaccatncttttaattcccaccntaanacnnaacatttccaaaatttntaccacattttactncnnanantccaantaccttaattnnacaattacttatcaacnaacacantctcctttnccctcttatataacanaaaannntnnatatcanatnnnntgcgtcccttcctaaaaatttctcttttcgtctaaccatcccacctttttgtgctctatttcattttcaaaattgggaacatttttttgtatgtttttttgaaactaaaatgtaaaaaatttaataattatttttgatttaaataatgcttctgtttcgaatcttttggctttaagtaattaaattgtaaaaattcaaaactaaaaattctccactgaagtttttaacttggctttaccctgcttttaagtcccaccgtgaggcgggacagttccaaaatttgtaccacattttactgtggaaagtccaagtaccttaaggactacagaagagccaatgacgcagtcacctttggacagttattaaaaagaaataaggaaatattcgatggggtgcgatcctttcaagtctaccctccctcgctttttgtgcactgtttcgtttctaaaattggttccgaattttttggcattttgaaattaattgcaaaaattcgaaacaaaatactctgaagatttgtaatttcacttcaccatg

SEQ ID NO: 108669 - DNA, 316 bp, Heterodera glycines
  Promoter: Source sequence=SeqID_11493; Location=3107..3422; Strand=-; Gene=SeqID_74910
cctgaaaaagggattgtaaaagggatttcttaattggatttttggccttttccgggacaaattccttcccgcattttccttcactttcccatctctttatctccgttcaatcagtcattttcttatccatttcatttccatccttcgccatccgcgttatatccatcattcacttcattttcacatttcgttttattcaccaatacgtgtggtttaattacccaagtttgagatgggagaataaagtaattctggataatatttggtcgccaatgatcctgggagggcccgcccgtttcactggtagcaccggatg

SEQ ID NO: 108670 - DNA, 680 bp, Heterodera glycines
  Promoter: Source sequence=SeqID_11551; Location=934..1613; Strand=-; Gene=SeqID_74987
ttgttgaccaaccataacatccatgatatcattcgaaagctctggatgttttgaagatatttgtaagctattaataataaatacacagagctatcgaacaacaccaacaatgcttaatttgattgacaatgaacaaagttatggttcaaaaagtcttccgacgatgtttcggccgacgacgttttgtcctgcttcgtcttacccgcccccccattgaaatattttaaaatttttacgattattttatgtaacaacttttttaaaattatttgaattttctcggaaaaaactgtaaaaattggcaattttacgaaatgcccatagtgcggaacattgcggcgaaagagccaaaaaaaaaatttttttttttttgaaaaagattgtcaaccacacattttagaaaattttcgaacttttcaaaaaattagcgaaattcaagaatttgctttttttttaattttaaaacagaaaatttgggatatattttattcatttcttctcatgggttttttcaattcaggacaactatgaaaaaccaggacacctgtgtgcatttttttacatgttaatatgtttgaacattcgtggcaaaatcaaataaaattaaaaataattatatttaggcatttttgcaattttatttctttatttttaacattataagaaattatagaaaaatg

SEQ ID NO: 108671 - DNA, 292 bp, Heterodera glycines
  Promoter: Source sequence=SeqID_9452; Location=1564..1855; Strand=-; Gene=SeqID_71470
cggaattccgatttccgacatttttggggccggaattccgatttctgaaaaaattttgatgtcagaattccgatttccgaaatttttgataaaaagtcggacattttcggaaattttttttgaatcttttttctaaaaaaaaccaattttttgttcaatatataccaaaaaacattatttaatcacctttttcttggttaagaattagcctatttaaatatttaggatattttttatatttttctaaaaagccaaaattctttcctctttttagaaacatcgattgataatg

SEQ ID NO: 108672 - DNA, 973 bp, Heterodera glycines
  Promoter: Source sequence=SeqID_3278; Location=2003..2975; Strand=-; Gene=SeqID_84033
tgaggaatggcattgcaaatgccaaatcggggagtgccaattcgaatgcaaattgccaatggaattgcatgccatttcaaatgccaaattgggaaacgccattgcaaatcccagatttaggaatgctttccctttcgcttttgcgttcgaactaatcattagaattctttttatttcccaaatcgttcagccactctccgcagctggccaatgccccctccctttcgttcggtcgacctctccaacaaatcgcttctccgtcttcaaaagtgcccaaaatgccgatttcctttcgcgacacttctggcgacggagtgctcgtcgtggcgcacgtgccccaacggccgctcaccttcagagagttccgccattatttgtccatttcttcaaaggatcgtcgccagtgcgttttttccgcttgcttccccgcttttcacataccatttcagattcttcttcaaaagttcttgcgaagatgggtctgccccttaccaactgttgctgatcagcgacgacgccgcacttttgcccctttttgagggaaaagtgtcggcggagtgtcgggcgcccctttccgattccgattgaccacattattaatttattcacacgttttatctattctgcataaatgcctttaaaagaattcttttggtggccctcttttttattcgctttgtcccttcttcgtcatgcgctcgtctccatctccaccacccgcactcttcgcgtttcgtccttccgctgctttctctcgccattctctcccgtcggatgcgttttgtatccttttttaattgccactcttttggcgattgcgaagtttcttgcgcggagcattatgaaattgaacaaagtgagcagacaaatcgaagcgaatgaaacagctgcgcccaaaacggtgatcagacggacgactttaaggagggaatgggagagggggaggggagggggactgaccggacagcgaatg

SEQ ID NO: 108673 - DNA, 83 bp, Heterodera glycines
  Promoter: Source sequence=SeqID_20932; Location=1544..1626; Strand=-; Gene=SeqID_51515
tgtgagtgaaatgaattgaccttttaaagttaatgagtgaattataaactaattatcattttttagttgctctccacacaatg

SEQ ID NO: 108674 - DNA, 275 bp, Heterodera glycines
  Promoter: Source sequence=SeqID_10243; Location=505..779; Strand=-; Gene=SeqID_73392
tctacaaattatttagaaaaaaaatatataaaaaattttgaataaaataaaaagcatgtttttttacggcggattttcttgtgaattaataaacattttataattaaattttaaaataacaataaaattttatttaatcattaatttagcaattggtaaaataatgatttattcagttttttaatcagaaaaaatatcatttaaatgcctcaaaaaatgaattgccatttaattgaagaaaaataaaataaaatcatttcgagacgacaaaaatg

SEQ ID NO: 108675 - DNA, 586 bp, Heterodera glycines
  Promoter: Source sequence=SeqID_4606; Location=798..1383; Strand=+; Gene=SeqID_55059
acgcgcttccgcccgcggtgcaatgtcgaaaattttttgccgaccttcgcccgttggaccgaattttggcacgggttgtgcgtccgggtgttgccgtccttcacgtggagttggtgtgcatgttgagccgctttcggcgcactttgctcacctttatgaagggccgattggtgcgtcctttttaaagggaaatgagttgacagaaaggagagagagagacgtcaaattaaataagagtccattttgcctaaagaaggagggagggacatgagagaaggaggaaaaggaagaagcaaaagggtgaatgaaccaataagggggaagaggcggaacggaggggttgacaaaggtggaggaagggggggagaaatgagagacgcgtggagagggagagaaagtgaggatgaagttgtccaaaaaacggaagggaaagagagggggggggataatctctgactgctgattgtgagtgattgttccaaaatgaacgaatttgcgaatctagagctcattattttgaaaattagagttgatcactttgggattgttttgtgttttcttatgaaacatacaaatttagaagatg

SEQ ID NO: 108676 - DNA, 635 bp, Heterodera glycines
  Promoter: Source sequence=SeqID_24431; Location=825..1459; Strand=-; Gene=SeqID_55164
ttggaatttaggctacaaatcaattttaaattaaaatcattcagcctcttttctttattgtatgtgctctatattagagaaaaacagaatttatggaacaggagttcattttcgcaatggttcatatgtgtttataaaaaaaggcagaagaaacatgctgatatttattaacatttacaggttttttagagactggtgagttgaaaaaaatttttctttaccgaaaaaagttgaaaatttaaattaaaatcataatgccaaaaatagagcaaaccaagccgattaccgaacagaaacggaaattctcaaaaaatgcaagacggaaactttgtgcaggagtcccgcgtttttcgtgcgaacaaattgttccggtaaaaagtgggggatcggaaattgcttcttgttctttcccgtccgactctccgacactctatgcttaatcttaaatgaagatgggatgcaattttcgtcttaaattttaagtgcaaagttaaggctttgttaacaacattatccttaccacatattaatcatcatatcgcctaattagtattcagatagtttactactttctccattttttgttaaatcttgttgcactcccaattagccatacacaaatagtgtgtaatatg

SEQ ID NO: 108677 - DNA, 413 bp, Heterodera glycines
  Promoter: Source sequence=SeqID_39773; Location=268..680; Strand=-; Gene=SeqID_68269
taattcgttttagtatcaattcatttttttacttcgaaaagttgaactttatgtgatggccaactttttggattccattaatttccccttttaaagcaaaaaatgagtcgaagcaaaacagaaattgtttgcgactttgtgccaatttttaaagaaaaataagggttttgggggtccagcggcgcagataggcgccctggaggaaaaaattggaaattttgaacacagacctattgccgaaactcccatcgattcgacaatgatgtgtttttgacaagaaacacaataaaaaagcagtttcttaccgacttagtttgaaaattaaaaaacaaaaaaagttaatgattattcatgaaataattccaaaaattttaaacttttttccgtaaaattgacatttttcagttcatatg

SEQ ID NO: 108678 - DNA, 708 bp, Heterodera glycines
  Promoter: Source sequence=SeqID_2383; Location=6018..6725; Strand=-; Gene=SeqID_79459
attaattaattcggaaaagaaaaaagaggaaaaaagttggacgcagaaatttggactctgaaatttgaatttgaatttcaattaaaatttataatttggcctttgaaattgattttcaaattgatggctttatagaaaaaaaaacggggcagttttttgtcgtaaggaaaatgagaataaattcaaaatcaaaaagctcgaatggtaaacggtaaagctccatctgctgaataaactaatccgctctggccaaaaaagctcgtaaaaattcaaaaacaaaattttatctccttggcaaattgtttgtttaaatggcctctgaattttgtctacccaccttttggttggttgttcttttttataatgttaaaaacattttcgtaatcagttaaattgctaataaatattatcataaaaaagattgaggcaaaaaaaaggggcaaaattcgtaaacttcttaggtagaggaggaaaaaggcagtagaacggaaaagaaaattatcaaaaaactttcaaaaaattttttatatggatttttcctgggcctggatttttccctggttttcttggacctgaatttcccctgctttttcctgggctgagtttttctgggtttttcttaggcctggattgccatggatttttatttggccggaatttctctgtggctttgctgggccctatttcccttagttttccctggccatg

SEQ ID NO: 108679 - DNA, 635 bp, Heterodera glycines
  Promoter: Source sequence=SeqID_12130; Location=1072..1706; Strand=-; Gene=SeqID_75706
aagaattttggcaccgatcttcgtcaatttccttaaatattttgcactttttcatctccccatttcattttcctaaaattacttttttcttatttgattttggactaaaccaaaaaatattacggaaacatttacgattctgcaaatttttattagaaaattactcccaaaatcgtgttgtcctaatcttcatttccttccctgtgtaaaactcgctgtaaaatggaagtttttcaggggtttgtaacatccaatttttgaaattgtcacaaaattgtttggttattgcatttaaaattagattttaactgctttttgccatttatttttgttcggatgtttacattcccgtggttgtgacgatttgttcacttctcactcaacaaaattgtataagaaaacccaaataataattgtgcgtttctctctttgtgtgtttagctttgcttcatttgttcgtcgaagaaaagcaccgaaaatttcaaatgttaagcaaaaaaaggggcaaaaagtgttttagtcactgcgaaaagaaatacataaattactaaatgattttcatgtgatttgaatgtaaagtttaggctcacatttacgtattaatttcgtttgttttgtatccaatcgaagaaatg
